United States Patent 10,662,479 (IMMUNOGLOBULIN EXPRESSION LEVELS AS BIOMARKER FOR PROTEASOME INHIBITOR RESPONSE) - sequence listing, part 5

SEQ ID NO: 476 - DNA, 288389 bp, Homo sapiens
aaaatgagtgttttcagtctctccgggttgcatgtactgtatgtggagcagtgtacagtgaagcggaggcagagcggctccgcgagcttctctccactttcccatagagaaaccctgactggccgctgagggctagctacacacacgccctcacgcccggcgagcccgcgaggtaggcgccccccatccccagccctccctgggcgcactcccctcactttctgttttcctactcacttgcgagccgccgggctgcagccccaaggactccgcggcaggagcagcggcggcggcggcggcggcggcggcggcagccggtagggtggacttgaggaagacggagggaaccccgcgcgtccggagccgccgccagccggcccgctccctgggcactttccccctccgccaaaactttgggtcgggagaggtcgggggcgagggtcgcggcggccgcgccggctggggccggggggcggggggcgctgaggcagtgccctgcgagcgggaggctgggggccgggctggggagtagtaggccagccggtgccaggctgcgtttgcaaccagcacctctcggcacacaggcagcgccgcctgagaggggcacgggcgccggggcgcgggctggagcggccccaggaaaacaacaacagagccctcacgccggcgggcggctcgtggccgcccggggagccccaaacttcatctcggcgaaagtacgtggagccctgcctggtctcggctgccggggaggtggggcctggggagcaggggcagtggaggaaggtacgaggagccagccttcggtggatttattgaacgtttcgtctgcgttggtgaccgggaacagcagcccagttgctcgttcatctggagagttgggatttgggtgttccggccccgcagatcagtgccctctcaccccccacccctacccaaatgcgcggcgagtagagaaagtgctgttttagtgccagagtagcctggaggaagaatagggggagagggggaagagggcgagggagaaggggagagagaagagggagggaaggggggggagagagggagacagagagagagggagagagagaacgggagggaagagaggagggggaagaggaggagggaggctgtgtcaggattttgcttgaatgtgggattatgttgtgtcaataagtttaaggtggagagagcgaggctgagggtggtggtggaggggaggaggaaggccttggccgtttaaagtcttatttctgaaggtaagttacggctttgcctggtcgcgatgacagaaaacttgcagatcctttatccggggatggggtcgatgcctctagaaagagctccctagccctcttaagccacactcgtgttacactgttatttgctgcgatccgggtcgctagtaaattacagaaatcagactcgaggtttcttttcctcctccacctcgtctcgctcactcaccctctgaaatttattatcatattttatttattttttggtattgtatgaaacttaacataactgagaccgaacccgagtcctgtaatttacaaggaccctgaatcccagaatctggaacacgtttatgtgtgaaatagccgcgatcatttctgctaaatgaggaaggtaaaacgaaacgatgcaaaaagctaagacacaacatgtacgacagagggggggggggggagagggagagacagagagagaagctattttttgctttcctttctgtaggaaggaaaataaagcgtgcattccccttccttcccagtgtgtagggtctagtcaatattttaactgtctgtggacaaattagtccaggtggatcttgttgaaaagtttcgcgaggtggggtggaggtgggggggggggcgaaggggaaggtgggtggaggttgtgggggatggggacggagcgagctctgcctctgctaatggtcattggcctggggctttgaaaccattgcctgtcctgctaatgacacgtccagttctcttctcccggccgcggacgccgggctgccgttcccggggtggctgactgggactggggtactttccccgcgcggggaggggcgttcttcgccatctcctggggttgcccactggcggcgtgggggcccccacgcggccccccgcccctgcgcgccgccgccacctctgctcgcgcgacttttgtaggcagccagcggcccaggggcgccgggggtccccggcgccgacgtccccgcgcggccaccccgggtccggccccacgcgctctgcgccgcgcggtccaagcccggaatggcagcgccgggccgggcgccggcggtgcctccctggggggcagcggaggcagaggcagtggcggcgggatcttcgccggggcccgcgggaggaggaggaggagagggagaaggaggaggggaagaaggaggaagaggaggagagggaggcgttttctgcccagaccgccgccagttcgagcaggcacgggcacggggacaccccactcgttgctcctccgttatggaaaggtgtttagcagacttttacgcccggagtgtggtatttgcacttcattttttcttcccccctctttcccaaagcaagatggactctattccctttctctttctcccactgcctctgcctctgtcttgtcagcctttaagatcgacattttgtactaagatgcaaacttgatggtgaccagcaacaaagccggggtgggatccctcgctctcttcctccctccttgtttcctagctccccccaccccgacctcgcagacctggtggccctgcacttgccgctgtgggctttggcgaatgtgttttccctggtcggttcctatctccaatctggggattgtgacccgggctgggtgtttgggagacggcagtggccgcccaggtctgaaaggctgagggcttcgatacctggacccgctgccgccgcggtggcacctcccgccgtctcctgggcaaggcgaggctcgggctgcctatcgatccctatgatttggttactggtgtgtttgtcctgggggcggtgatcacttgtgcaagttgatgaatgatcgcggtgtggtttttgcgtttgcagaatggatcaactttctgctttgtacatgtggggagtaggaagcgagggtacgggagataccctagaatgccagttgggttgccccccagcctctgccctttcaatacggggagcttctttgccttctgttcccacagttctccagtgtcggggggtggtagagaaaggggaggggttagtgggagctggactcctgggttttggtaccttctcttcatagatgttacaggacttgggactgtactattgtaaagccctactatactgatgatgtacctttatttgatactttataggtcactatcatatgacaaaggctttgccgcagttcatcttcctccctgtgtactttccatttgccttcctgggtaagtatgcaaactgttcgtacagggaagcaggatgacaattagtaatgacataagggtctttattgttcacagaggaagatgctttattggggttacagcaccccagaaaccttgtctcactgagtttcccacagcataagtcagtttatgattcttagtgtttagaattcagctgtgggttattattaagatagtaaatattcattttgtgtttatctacaagtaattgtcgtttcaaaacttattctcaaatagacattttaatttataatgaaattttacatggcattgaaggtctagtaaatttaatgctagacaatactataggaagagtgcagtgtatgagtggagagaattattaaaaacccaaggaagcattgtgcagaagtcctctaattatagtgactgacatttgcttactctctctcaagttctctttcttgagtaacctgtggtgtttgtaacagttacttttggggtggggaaaggtgggattggcagtgtggtaaatctagcgtttagtgcactaatttgattcaaaattgatcataatttcttttaaaacttacatgtttggagaaattaggaacaattcggtagcctgtaaatttaataaacaaagactttgagatctgttgttaagtgcctttttcagatatatgactcccaagtggaaaaatctgcaaaatatgtgtgggacagtaagtgtgtggaaaatttgtgagaggtaacagtgtgggtaagaactgagggtttacagagcatttgaaagcagcacagtgagcctaatctgcagaaaaccaccttgtaagtttgcccctccattgtaaaggaacaccccaggtactcttgagttgttgatgtttggaaactagtactaaattgtgtaaatcagctgtagtgctttgtaatattaccatagtgaatttagagattgtattttgtgaatgaaaatgaacttgaacttacttttctgtgaaagaaaatttagagacctcatctgtggtgtttcctggattgctgacataatgtgtacattaacaaaattattgtctttgtattaagaatataaaactgttgtcttagtattgagttagaggactagacctttctggtagtgtccatttggtaacaaaatatactttcatgttattgaagactttagataatctatgtaagttttgcattgaacatttagaaaatctagagaactttagataatctgtatatgttttgcatcgaacattttctatggaatataaatattgcattactgctgataattaggtggtttgttcactaagagctcagaatacatcacatacatagcaggccaatcggagtgtcaaaatgagaaggttctataagttgaatttagtgcacactaaaatacatggatttcattgtctttgagtttttttaaagcttgtttgaaaagtttcattttgggcaagagtattcaaaatgcattcttgattactaaagaacaccacatttatactgttaggcacattattttgttcattgcaacaaactgttaatattccttccccatggaaatgtgtttgaccaattcagaaattaatatgataggttagtaatgttgagaataaaagtctgataagtgcttgtatttctttgagatatcaagtgactgcttcattaaaacaatattttcaagaacagtcttggactttgaagtcagtgaagtagttctgatagtgtaaatcttgtaatagtgatctaaaaaaagtcattttgacaatgaattgccagttattggcatctaaaatgtatctattagatttgaggcttacttatcaaaataagaatttaaagacgtttttgcttctccatttccaagtgtttccaaacttcccattttattattctgcatgtctctgttaggttctgaaactgaagccctagtttgcatttcacatttaatgctagctattgaaaaggtggctcatctatattgtttcctagtgttacctctttggaggtactgtggcagttttaggaaaaatctttctctagagacatagatgttttttaaaatttgcaatttttgaaacattaagaaaatgtatcttgatcttcgtatccatttttttgttcaaggtatatgagtttttgagatagctgtgcttttaacatactttgaaaatggtatatatagcacttttgaccttatagatctgatttttatacttaatccattaaaacagattcatgtagacattgaatttagaacatatctttgaatgaaaatgaggttgcacatatgattacgattggcctgtgccgtaagtaactacgtagttgataagttttctgtatgttgtaaaaataaataggtctgaagatgttgtgcaactcatgaaaatctaactcagtagctaaaatatttataaagccacacttttcagtaaaatcacaggcaatttttaattactagtcaatagtcagcctactaacagtatatgttttcttacatttcataaagaacatgggtaaaagcaaggggtatatttttaagtagatcttgtcatgaatttcaattacttttatattagaaatctttaatagaaatggtaaaggcttcacagctctatactactaaaaaaagaactttttgaaaacagttccattacagatgtgcctttttgctgtactacaggaagtccctgaagttattattagtgtcttaaaaaagtatataaaatgttgacaattgttacatcaaatgctccaaattactaaatataggcattaattttaacatattacattaccaccaacgtggcatacctgtgctttaagatttaaccttaagcaggtgcttaacttaagaggaagatgcttttcttgaacttgtaccttgaagtccatctcattgtttaacatttcaccactgagggtaccttttgaaatgggcctgagtggtatctctcctgtattttttgtcagattccttcttgtcactatgaaatgaaaacaaactcaactttactaaggacattgtaatcttactgctttgtttttatcgtgtgtcccagggaaatcagatgcaggcagtcctcagtacactgagcaacactgctatgaagggaataggtaaagagaaagactgagactgaatggaggctcttccagcttgaagattctgtgactgtcattcagtcactgggtgttgtactacctcaagggtagtcatcacatactgtgtctaattgtcagtatttctgtattttaagtcatacctgtggaaagcactttttgattacaacttcgctcaatgttcatatgtgatattatcctttagaaggcagttatatttccttgaaatgccagtacatcattttaaaactgtacagatatacccagaaaatcctcatgtattaatggggattgtcttcatttttttttttttgctttcaaggaaacaggtaagaattgaaataagtgccagttatgtgagagaatacaaaagaagcaagccagtaaagaatttcatctaaaagtatatataaatagaagatgagagaatgaaagacttaaaagattaaatgtagaccatgaagcattgatattaccaaatgtaccaaaatgtaaacttaataagttaaaatatgtaagttcgagaatctagatagtgaaatgacttcagataatgagaaggtttgtataaaatgcaaagtgacaggctaggtttggtggctcacacctgtaatcccagcacttcgggaggcggaagcaagtggatcacctgaggtcagaagtttgagaccagcctggccaacatggtgaaaccttgtctttactaaaaatacaaaaattagtcaggtgtattggtgggcacctgtaatcccagctacttgggaggctgaggcaggagaatcccttgaacctggaggtttcaatgagctgagattgtgccacagcactccagcctgggcgacagagcaagactctgtctccaaaacaaaacaaaacaaaacaaaacaaaacaaaacagaaaaacacaaagtaacaatgagaatgaattggattttatgaaatcttaaaaaattaaaaatattttaaaatgttgattaaataattaagccaatggttaaacatggtcctcggatgaaaagttcagggaataaaacaaactcctggaacagaataactgaactcttaaaaggaacatacaaggttgcattttttgtaataggaataattaaataaaaggccaataacctactttagaggagaaataagaatggggtaaaaattattcaaaacagctgtatttctcaaatacttttgactgaggtatattataaaaaatacctttaacatcccaatccacataaaagaactgaaacaagtttcctgaaacaggacaaagtgcagtgccctctgatattttctattcctaactaatctttataaatccaatctgtttcaagccattttattaaacaaaaaatactaggtattatctatcaaattgatttcatgacttatagtttgaaaaacactggcctagagtgcctgcttgccttcttagaaatggaggtctctaggcctcatcctttgatattctcattcagtgtttctggggtggggccatggaatttagattttagcacatgtagcaggtgattctaaagcaagtaggaggtcctccaattgactttgagaaacctcagtacaaaggacagatggcctaagattggatgttctgaatgtggggctgaagttcattgactttatgaggtgtcttgcatcttcaccattctttggctgtatttcagtcagtatgtttgcaatactgaggaaggtcctcatcaccctctgtaggtgctcctgtagtagaaggtgtagtacaaggaacagaggccgtaccaccaaagagctctaggttccactcctgctgcctctattgcttattagttgcgggactctgagcatgttacctcacatcccttaaacttttattctcatatgtgcacaatgggtatggtaatgtttaccatgcaataatatggggattacacaagacagtaatgaatgtaggacccttattcacagttagcgctcaatatatagtctctgtttttgtaattacatctcatctcaccctaccctccactgtttgaaatttctgaaagccttttagttttttttttttctctaaagtgattctcacctctagttatcatgaaacatgggtatgtttttaactagacatgaggtgctggacaagtaatttgttagggaaggaaataataagagtaaccagaaggagaaaagccaagcacagctgaggcacgccacagtaaagtacagtcctccttcaggtttggggaatgattttcccacctctttaaaaaagtagagtatgggatgagagaacagctcttttcatatttcacggtagttctcccttgtcagcacagggcattctctctggtgacttatagatattagaatgtcttagagtatcagttctcaaactttcttccgtcaagacacatgtgtaatcccagccctttgggaggctgaggaaggaggattgcttgagcttaggagtttaagactagcccgggcaacatagtgagaccttgcctgtactaaaaataaaaacaaattagctgggggtggtggtgtgtgcctgtaggcccagctactcggaggctgaggtgggaggatcacttgagcccgcacggttgaggctgcggtgagccatgatcgtgtcaccgcactccagcctgggtgaaagagcaaggtcctgtctcaaaaaaaaaaccaaaacaaaaacatgtgaccaatgtttacatatgggacattatgatttcccctggttaacagacagataaattatgctgtgagttttataggtagttcacagtgtgataaagccactccttttttaaaaaaagtcaagaaaggcatatcaaattgcaagtgagaatggtgctataatgaaaacttcgaatatacttaataaacacatggaaaattgtaaattatggtactttaattgttctaattggggtgttcctcataaacaaaacccatccttgtgtcaaggcatggagattgagaagtgttacatatgtagtgcttaacaaattacattgcacaaaataggcacttgaaaagaggggcaagctaaggagaagataaatggggaatacattaaatccctgaaatctcaaaacaatgtgaaaaccaaaagctggggaaatgtacagaaaatacagaagactacaggtatcagggttttcaaatggtactgtcgtactcaaatacacattgacacaaaaatttaagtagtctcaacaatcattaaatttatgtgaataaatcaaaattaagtgactttggcatttcctaatttttaaggttatatttgccaggaacgtcttcccactttgctaaattttaatttgccatacgtttttgatctccggtaaattaataagctctctatattttgaaaacgcctcagtactttgatgtagtagtattggaaatagattcacaatcttttatctaaaaagctctgaaaaactaaaagttttttttttccttcagaagtgtggtatcaaaactcatttggtagcaaaacctaacccatactgtcatgggattgtttaaagtagttttcaagcctgcttagaatattcacatattttgctggaaataataatattgattaattgtgaggtattatcctagatatagctaggaatgttatgtaatatgtgctataggtaccattttgcctttttaaaccccacaaaaatctgaatcctgaagcatatcaggacctaagggttttaaataagggattgtgatcctattgcattaacttccttggttggtagagtgaaattctctgatatgcctaaccacttaacccaatgaaaaattattttgctaactttgatcactgatcattgaacaatttaagttccttgccagctaacaaatgatgaaagattttttaacattatatattacctcaatcagactgtctgctgaaaccctgtggctccaaatgtacaggtgtaaggcataaggatataaagtcaggtaagcaaaatggtagtcattgacatcatttgtaccatctaagttgagccaagttaaaggcttctgggtaaggaaagcttaaactcaggcagaacctggttagttcacatttcactgaacctcttatattccattttgacgtgatgattcctttgttgttgtttttagttttattaaacacacactaaaatctgcataacatttgaaacctgtaccatgttgaaaaatgtttcttatgtttcttatgtaattatgaaaggctactttcattaatggtttattgttattagaggttatatttcctttattatactgctacctgcacatttttttttccatctatcaggaaaataaaaatagacagtgttttctgtaatttagtctgttctcagatgagaatgttttcaggttatattgttttgtagaggttctagatacctttattttcaataattaattatgaaatgttcagatcttgccttttaatttcctataaaactactttagaaaaatgaaaaatatgtcatggggaagagtctatatggcaatctaggaataaagtaatagctttatctgatttgttatggtaagacttaagtcagtcttcatttgatatagactggaactgttaatgctaaggaattgtttattgatagggctttcattatttatttacatgactacattccttggtgtaggaaagccacagattaagtaattcagagggactcttattagcaatgctgattcttttaatattaaaaatgctggcttgtttttcagcttttggtgcacctctcaaaactcacccaagtgtagagttctcatggactgcagagggaatgtggtggagcatggaacaaaatgagaaaataattctttacatccagctgtcagactttgattatcttttgagttattgaaattatcattttctttcttccctcctagggtttccctcccttcttttccctccctccttctcttcttcttcctctctctcatctctttttttctctcccagtctattatgtttggtaatgtgcatctgtgatactgcataaaaatattttagaatgggaatagggagttgagctttccttttttaaaacacctttgtttgagtttaaagatcgatttgtagtttttgagtccttttggtatttatcactgcctatataaaaaattgttgataaatgagcttgagacttatacacatccctacatatgaaagtgtcagttaggaagggattataaggaacctttatcagggctctgtgaaattaaggcacctgttgtttttatgaaataatggaaataaactccttatccaaacattttcagttttaggttgatagaatgactacacagtttcatttaaacttcaggaaagttgaatgcagtttttagaagtttcccaaagagtattttacactaggaggaagggagaaagataatctggactaagggctgccttatgaggcccagttttgtttttattactttatttttcacaacaactttctgatgataaatactcgattttaatgacaaggaaactaaatctcaggttgaataacttgtctgaagtcgcacagctggtaagtgatcatgccaggtttagactgcctgtctgcagtgccacaatctcctgaggctttttctctatttacctgccattagggccacattccaagaagttaaaaatgaaaggtttgggacaacttttagctaagaattctccccaattttttttttctcctagaagagaggtcttcattttcaagtaataaggttgaaactctgtactttatcacttgtaaggaaagttacgtgaaaaagtctctgacctggggcttgtaaattttcatctgtaagatcattgtcaaagactaagcctttgtttataaacttagtatataattgatgtttagtcagctttctttctagttggtatatctagtatagaaatgtctatggcagctgttatttttaatatttattaattcctctggtatatcagtagaaattatttattctttcatgagaagttgagttttcctagctgaatattctatatcgtttgtgctctgttcctttttttttttttttttgaggcagagtctcactctgtcgcctaggctggagtgcagtggcacaatctctgctcactgcaacctctgccttctgggttcaagcgattcttgtgcctcagcatcccaagtagctgggattacaggtgcgggtcaccacgcccgtctactttttgtattaatgtttttaggagagacaaggttttgccatgttggccaggcaggtcttcaactcctggcctcaagtgatccacctgcctcagtctcccaaagtgctgggattataggcgtgagccaccacacccagcctgtactttgtacttttaaatacttaatcagtgaatatattttactaaaggaattaacagtataacatgcataatgttataaaacgtttacttctgacattagctttgaaaggcagttccatattagtggaaaaattaataagcggattcatggccttcacttcagagtgcctgatcaaacatgaatcagatatagggtcagtcagcagttctaattcatcagtttaggaagtgatttaagtgtgcttttaattttacctgaggaacttatttctgctgtgctaagtggaagagatttcataaattacacttttgtatgcgagtagccaaacatttcgaaaatacagcataacatgttgctttttggtactaagagccctattcatctgaaattaaaatcttttatctttgcaaattcagcaaagtcagagcctaattcagatatggaagattaaaagtttgtcttttttttaaaactggcttttcttttaccctgatccatgaaacatggaaatagggtatctgtctattttagcaaagtagcttttgtggatatgatcttactaagagtgtgctcttcttgccttgttttagccgaacaatggttttccgaaggcgctcgtcttttgtttgttgtgtttcattccccacctccaaaaaacaccattcacattggttggtaaacggaaataagtttaaactttatgtcatttgacacctttctttctgcttgttttcttgggtaatattcgaagaactttttccaaattaaataattaggtcaagtgttggtgaggctagggtagcagaaactataccaattttttcaacattcattgattgagtgcctacagaatgttggtgcttgacctagactttggagatatgaagatgaatatggaacaacccttgtcctcaaagcaaacatgttctactggctggaaaaggctagtcaatgtaaatatctatcatataaattaatctgtgctaattgttttaatagatatggtatgaaatagtgctgagtaaatatctgaaaaactggccagttccagcataggcgctagaccttgaaatatgggacgagtttcttactgtggccctgtgtttgcccgttaagtctgtagaactaatttggcctaagcattatagcgaatttttaaaaatcagacttctaacaataatttcatttttatttaaatagtagttcatccttttggcttctggtattttaaaaggccactgacattttttggataaagatttaaacatattaaaattatatttcagtcaggtgttttggacttccattttatttattgctattaacgtcaccatatgtaaagacaacatgactgattgaaccaaagagaattgttcagctatgtaacatatctgaaagagcattctacatataccaaataatgttaaaagcgcacttaatagatagtaagtttgagctagatgtacaggggtccaaacatatgccaataaaaatactacaaaccactgtagctgatacttttagttaaataaattatactaactgggagtatattaataagagttctagcccaatatgggattccgaaaaggggaaaatgtgttttcctatcttgaggactaatagattacaaattatgctcaaagcttccatcaggcagtttttaggttttccaggatgtcttcaatctgtgcttacagttgtgttttctcttgtggtttagtaagccatggcctggagaacacccgtgagcttggtcagtcttctcttttatgcatagtgatctaggtctggtctttcattcatgacttttgtgtttgttatacctcagaatgtatgtgttttcactcagttttatttgtggcccttatttgactggtcacttctggacatcagcccagtttagattaaaactttgtttctgaaatattgtgctcagtgttccagatgccagtgtactttaataacaaatacattcatatgtgaaatcataaagaagaagctgacctgggaagaatttgttcaaagctcacatcagtaataaccccaatgtttacattaaagcagcaaagagaaacagacacatggaatagtaactgtgagtctttcttccattctttgtcttggggctgtttgacatcatggaagcataaccacttggatcttgttatgtaccagtcttcatggtaataagaacttctttttaggtttcgtatgtggacatgcattcttatctcattgggtgcaatacatacttagacccagagaacatgttcagattgtcataagactagggttttttttatgttaataattttctacagataatctctgcatgagcgatgcaaattcatacaagttatttgtagttttctgaaaagtcttgaggaatgggatcacacatgagcacagaattatacgtttgaggacctggtctcacgtatatggtgatgtatttactgcataaggaactgtgatcatgaatcagttgttgtttctttttctttaatttttaaaaaatatgaccttatatggtcatttctgatctatatatttcaaaaacagctagatggcttttaagtctagtatatccttaagaattaggatgatcgatacttttcttcattaaatagatatttttccgaaaagttttgacttagtttttcaaatagaactatatatatattttttgatatactataatttcagaatgcctcatatttatttttaattgatcttcaattagcagtggctgttggttttacagatggaagctttaatattcccaggtctctatattaactaatcaatggtctataaagtatacataagggagctttgaaaaggatcagaggaacacagtactaatcattgtgtgaagaggaatcatctttttttttttaggcaaggtcttactctgttgccccagctagggtgcagtggtgtaatcatagcccagtgtagcctcaaactcctgagctcaagtgatcctctcgccttagcttccaagctgggaccacaggaacatgccaccacacccagccaatttttattatttattattttttagtagagatggggtctcaccatgttgctcaggctggtcttcaactcctgggctcaagtgatcctccttcctcggcctctcaaagtgctgagattacaggtgtgaggcactgcacctgtccagaacaatgtttagtaaagcaataatgttgctttatcataataatgtcctttatcataactatttggtaattctgggttcaatgtattgaattatctttattttttgcaacatataattattgaggacccataatgtataaagctgggttaggaattctggagcttgcagaataaaaaggcagcagctctggtctcaggatatttctagtatagtagtgacatacatataccaaatgtgaaatagaaggtaaacatgccataatatccatgtgttgcagggatggtgagtacagggtgatgggtgattagggagggaaaattgggatggaattgaacttcaagctttggttgtatagctggatgtctaggaatccttgcaaaatgcttacttaatctatcagagagaaagtggacccagtggagggcccaggctaaccccacctgggccaaacaactcaccccaaatgtgtgattatccaagtcaatgaccttccagacttttaaaatgctattcccctcagtataagaatttgagcatgtgttccttgatatgtatacatttctttataaattatatatactaggctattaatatggtatgtgtatatcgaaatataaatagcttagaaattgaaaaagataagataaattgaatataaataaaaatttaatattttcctgtcactcactccaagtggactatcctgttcatgtttttggtgtttgagaatctcactttggagaccactggtcattattgagcagtgtcacacaaagtttaggtaagtttcatgagacctgggactttgttttgttcactgctttatctctagcacctaggacatggtaaaagctcaacagatactattaaatgagtatgtagaattaggctggttgatagggatgagaacagtctagctcagcatggggatctggtaagaattgggacaatttttgttcactgttttatctcctatgcctataaaagtacctgccaaatagtagggattcaggatatattagttggacagtgtttatgtagttcagcacgagggatctggcagaggccatagatttatagacatgaaaagttaagttctagaagctcccctgaagcagtacagcatatagagataggccaactatgggtaggcagaaagatgcagcccatgggggtcaaagtgttagcaagaacatttctgaggaatggctttggtaacctcatatcttaaagcaaaaattgtgaccatcttaagcagtaagatctggatcttatctttgtttcccgagtcctaggatgcagtatggtaggtgtctaataaattttttgttgaatcgaattactccgttttatattaatactatgtactgggtgtaggaggccctgagcctgctggagtggatcagcatcaagatcagaggcctgtaaatgaatcctgcttcgaatgaagcaaagccagtgattctggaattatgtcatatgtagataatgattttaagccctggcagtgttgcctgtatagaggtactctagtgaccaaaactgccaaatcacattatgtgtatatttatttaaaggttgctattaacatacttttattaacatattacccatcaagaatgtggagtttatgattgaattatttcatatatgctgctatcctgttccttcttccctcatcactaaagttgggatatgtcctggatcaccccaacctatactattacaattagtactgaatttatttataaatacataaaacaaggtagtttatgtattcactcctctttttggaatttttttttactgagacttcctttttaaaatgatggttaaaaattcttattttatggtcataaaataaatctgtcatgcatatacttgagcatcatcagagttggggagaacaaacatttcctccctgagaagcatctttctcctttagtggctggccacatgaaagcatgcctcgttggctctcttatacttgttattgcaacttagactttacattgtgatttcactgacgttgctttgtttgctctgtataaccatgctcttaggtaggtgtccttattcccattttacagatgaaggaacaggctcaaagttgttaagtgtcttgacctaggatattgagtttgcagtggctcccctgcgaccagcactcatatattctggccatttgtctagagagcagtgcaaaatttatctttttgagctaaaatttttttttcttgtacttaatttcaacctgataagttattataaatatttggagtagcagtggtgaagaaaatccggtgctaattttgttcatgccctgtgagctacaaaatatcagttaaggcccatgtagggccttaaattttgggtgtacttaaatttatttgtgcatttaaataagtgtactaaaattatgtagaaagactgtccatttgacttaacttttttcacaacttgtgatggcaaattaaatgtatagtgaccacatactgacaaacaatgaacttttaggtgtatgttgggatttgtaagtgagatttggattatatttagattatgttaatcccccccccatgagacatatttctgaagttacaatgaaaattaattagagaatatgatttgatattcagatacctgagctactcctatttctgtaacatgttcatattgtaacttgatattaactgatgtttttaaagaagtataagcaaattctataattttttttttttttaagagatggagtctggctctgttacccaggctagagtgcatcggtgtgattatagctcaccacagcctcaaactcctgggctcaagtgatccttctgcctcagcctcccaagcagttgggctacaggtgtttgtcaccacgactggatagtttttctttttaaacttaaaatgctttttagtttggcactccgtagtaaaggaggttccagaagccagtaagagaacctctgccaactatgaaagagaagatatttctatctacaagttatttcaggatcaattattcaattaatattttatataatagaaaggttttatttgttaggactttatctttaagttccccaagagtaaaaaggtctagtcattattatactgtgggagaatgatagaagattgattacattagaactccagaacttctatttatttaaaagatttaagatttgacacaaaagcggtttattttagaatgtttatttctatagattgtcattacttcaactcagttttcataatttgtatttgagtatactaactttggaacatagtgtaatattaatggctacagaagaggtttgttgaagaattgtaatttgaaagaacagcatatgtttattgaagagagcatatagagatggaagtggttagaaactatgaactttctttagtttggcttttcatgtaaagtggaatatgaaaacaaaagtcctaaagacagttcagcagagttcctcttcaccctgtttttaagcagtgatgtaaaccatgaatttagtgtttccaccctcttttataccatgcaacaacctgtgaagtaggaactattatctccactttgaatgaggtactgagtttcagaggctcagcaacttgcccaaggtcattcttctggtaaatggtgttgctggcattccatcccagttcattctgtctactggaggccatatttataatcactcactcccctatcgtgcctcctaggcttcccacgtggcattcataccactccacaatgcatggaccagtctaggctcccactgaatttcttatgcctatggcaataaggcatggctttccagcccagggtaaaagagctttttctctatttgtgtttctgcattgttaagcctgttgtcatacacacagttgctcctcagtagcttatttcttgactcattctaaacatatggtaaacttctaaagttaaaaaaagttagtgttatattgagatgaaatatctgtgattaaaaaaatgaacatcatgtcacaatataaaaaagaaaataggtttggattcagataacttaaatccaaagagaattatattttagctttaaaagggattctacagatgatcttggagcattataatctatcattataaatttgaagaaaggaaggcctagattaagaaactaggacccaggccatttgagtggcagaggtggaactgagatataagacttctggtttggtgttttgctgtagaaatctgtttagctccaaaatgatgtaaaacacatttttagccaattcacgacaccatctttacagcaggaataggtgaacaatttgtttttattgtttataaatggttaaaaaattaaaccaaaatgttatgtattgttagaatgaaactataggtaatacattatgcatgtcaactttgaagttatgttactagttctactttatttagtggcacaacatgattttagtagttaacggataataaactgtacgtggcttcagtttagttccctgtgtcctgtgaaaacagagcaagaatttgcaaaacaataacacattgttaaatggcataccagtttatcaaatgccctaagtttattacagtctgattttaggaaaaaccattccagcttcacaacagctcatcctaatcttaagcaaaagagtctttaaaagccatttcaaagctgttagattttgttctgtccatgaaagcataaattgctcatagctgttgatgaggagaaaagaagtttgtaaagccataacagatttagttgtgaaagggtcatttaactgatttgtgtactgcgacgcctcatggtggctgtattaagaaactactgtagtgaaatattgcgaccacataccttgtcactcggactgaatccatttacatgtatgcaggctaaacattagtaagttaaaattccaaataatatttttaaggttagtatatttgtaagttttatttgggagaaaatatcttttgtcctgcagttcagggaggaaacttcatatgccttatcagagttctgctcctgggagttcacctgggaaatgaccatcattcagccctgaacttccagaaaatactagccaggtaatctgggcagctgcgactctattctgctcctttgtgtaaatgagaaaaaagttacctctttttgtgatactttatttctaagtgttggaaaattgtcataatagattgattttgttagaacacaacactttactgcattttgaaatgtcgtcacagagatacagatctgtgcttgctgatgtgaatggcatctcttagggttctagaacatagcatgacttccacagatgtatacagagaccctgcaggcagttatatcctaggaaatcatgtctttagacatgagatgttaaaacatcacatctggaaacctgtacatattatatatttattgaatgtaaaatgctagttatttgtaaaatcgttactttaaaagttataaatataatagaagcctggcacagtggctcacacctataatcccagcactttgggaaggccaaggcgggcagatcacttgaggccaggagttcaagaccagcctggccaacatagcgaaaccccatctctataagaaataaaaaatttgactgggcatggtggctcacgtctgtagtcccagcactttgggcggccaaggcgggcggatcacgaggtcaggagatggagaccatcctggctaacacagtgaaaccctgtctctactaaaaaaaaaaaaaaaaaagaaaaaaagtagccggacatggtggcgggcacctgtagtcccagctactcaggaggctgaggcaggagaatggcatgaacccgggaggtggagcttgcaatgagccgagatccgccattgtactcgagcctgggcaacagagcgagactccgtctcaaaaaaaaaaaaattttttaaaaagtaatagaaattaagagaatacattatagagacgtttctttacctctgcggtttattgacaaaagtctttacattctgttacatatctcttggcccaaccaatttaatgtattttccaagttagtgtgtcttttagagtttgattaaagaagaaaattttctgacctttattaaaaagcttttctttattagatgggtacagtaatagaatgcaaaatgactttaagcatctatcccctttatccatcattaaaagctaattgtcacataatataagtgcaacttgatgggatttttaacgtaccaaaaattggcaatctgtgatgaggaaagtgggctctgtgaggactcaagttaagagaatgaaagaaaaaatgaagcttttataaatcttaagtggtagctaaatggaaataaaagcttttaatttttgtaggagagtagtgatagcagatcagtaccttatgttttgctggaaaccgaagttttcagaatgtgcttgtatgactgctagggtggtggtttgggccactgaagactgtacagggttaattccttatgtttggaaaaatggtaatgccttctttatctttgtgctatccatggagttattttcttaacaagagcaataatgacctttcttgctcctctttagggaatggcaattggtgggatattcagtaggaaatccattaccctgtctgtgtcttgggtagtttgtggtgctcccctggtccagtttgggtcttgctcagtaggtagtgatgatgcattaagtggataaaaccacagtcatgctggggctttcatttggctcagtgacatggttgtaaaacacagggtttcaaacaaagatttttgaaatggtgctctcttactaatcctcctcacagtttggtagaaagggcactaaaatgttgctggtttgtaaaaagtagagtgcttgtttatcgtagctcaaaggtgctaattgtttctagcaggagtattacacatgaaacctcaaggtcatgcttaacccactggctactgaacagtttgactgcactgtaatacacaacctgtcccaagctttcatgcagcttcctagctcggactcattagataacgttagtttgtttgaatcagcacactcttctgtgccttctgaagatctaagacctgggagctactgaccatccatattttcattccttaactcctaagactgtgccaagatgttacgtcttctctagtcattcctgcctataaattatttgcaattttgttttacctttactactgtcataaatctaggaaattttagtttgggcaacttaaggaccatagtttttatagcccattgtcagaacactagttatttacttactttttgtgacataaaacccagattttttagattccatgatacacagaaccatatgattaaatcagttgttattatgtgcttttagtgacaaatctttttagggctacatcatcttatcttacatgagacagataatttctgtaagaaacttgtatcagaaacatgtagcctgtcgtgaatttttattactttctttgttgtttattgaaagggttgggacttctgagttaaataatttaaaaagttacattttactgttataaaaatccatgttaatccaagaagaaaatttctgttaaatgcctttttgatttaaagtgtgtgaattagatatttgatcatgatttgggacctgaaaaactatcttatttctttataaatgtaatatagttactgtatctgaaagtaatatatggttcctttatcctctctactactgctgtattttcagaaggagaagcaattatattgatttgctgagtaacttcttactcaaccagtttctgttatagtatattaacataactgttctgttagtttatttattctgacttgtgggcatgaatattttaggtaaactttataatgttcaagatagtttgaaagattaatcaatgcttatttccttgctttacaaatgtataagagctattcaagtaacagttatctaaacaagttgttttataatgaggtagtataagagaagtatttccctagacaacatgaaataaagctcaaacatcctcaattttttttgtttgtgaatatttatagctttgaatctcagctgtagtcgggatgatggcataaattgtaattatactgcagaactgaaagaaaaatttgaaagaactgataatggctctaaaacagtatctttaataagctaatggtattggtgaccattcagtaagtatctgctcagtcaatgaaatcattgaacttcatcttatttgtgtaagtgatgattgtgccctccatgacttcacagtacctagttcaatacctactaagtaaatgagcattcatgaatgaatgaaatgtaaggctgaattttgaattttgcaagcttttttgacatacgactttaagatctgatcagatctctcacagattcccatgaaacctatcccagttggttttcttttcgttttatatttgttctacccttcaataaatgaataaaatatgatattaaatataatatgtacttactgcctgtggtgtacccggcactcttctgtgtactttcagatatctcactttgaagatcataacaaatattactggtagatgtaatttatccaacccccaatttcttgtttcctccactcccccacctcactctgctctccttccttcccctccccttcttctttcccttctattgatcttattcttcatttctctgttatttgacaaattttgagactgagactttgagaggttgagtaacttaggtggaatcacacaggagggccaaagccaactccttttctactttcatcacatatctagggactctgacacctagattctaattgctgattcctggaatggttgcttgtctttgtcatttttatggcttctttctcatgatataaaatgcaattctgggctcagccacactctcagagcctaattaagttggtgttttaaatacttacctgggaggcatcgaggtttggacgtatgattgtgtgtcagacaactcctgtttgaatgtcatttgtaccacttcttaactgtgtcagtatgaacaaggcacttaacctcttggattctagtttcctcatccataaacgaggaaaataatagttaccttttgaagtcattttgaaaattaaaaagatactacctatataaagctacttactagtcataaatttatactcttgctaaaaacacttttgcctttttcgttagacgtgtttagcgtatctgtgtttatgtgtgtgttccatttgtctatttataagcatactatgtggtctgataatttatgaatgagaaaaacagatgcagaaaacatctgggagagatgtttttgggagatgttttgggagatgtttgggagatgttttgggagagatcttaataatggttagtagtatacatttaaagacaaagcagaatattatttaaatagttccactgtggaaagcagttaggagatttctcaaagaacttaaaataggactaccatttgacccagcagtctactactgggtatacacacaaagaaaagtaatttgttttgtcaaaaagacacatgggctgttatgttcattccagtgctgtttaccatagcaaagacgtggaatcaacctaggtgcccatcaacagtggattggatacagcaaatgtagtacatattcactgtggaatactatgcagccataaaaaaggaacaaaatcatgtcctttgcagcaacattgatgcaactggagaccatcatcctaagcaaattaacgtaagaacagaaaaccaaataccacattctctcagttataagtgggagctaaacattgaatacaccatagacataaagatgggaacaacaaaccctggggactattagatggggaagggaaggaggggagcatgggctgaaaaactaaccattgggtatgctcaccacctgggtgacaggaccatccgtatctcaaacctcagcatcatgcaatatacccatgtaacaaccctacacttgtattccctgaatcaaaaagttttaaaaatagaatatgaaaaataaatagtaaaataattgtatttattcaacaaacatttatcaagcttttactcaataaatggggtaggctccattctagttcctgggactatagtaataagaccattaaaaatactgcctttatgaagtatactttctagtgggggaaaacagaaaataaataaaataagtaagctgtatggtgcatattagatggctatatgttataggaaaaataaagcaagggaaggagagagaggggaggttgctctagagtgtggtttgtgatgagatagggatcatactctcaggaattatgcaagtccaggataggtgtgtgcaaagatagcgaacagtgtgctgaccttagggatgtccgtcctcttccaagacatgcacgtctttttctgcaccatttttagagtagctctggcagacttggagacattcctgttcagcatgaaaagttgtacagaagtttgtacctggtggcagacttttgggaatctactattatgcttggaagaggatgcctggtactctggatggctttctccatagttggcagaattaggggcaagccatgtgcattccttgcagctgaagtgctgattgatacttctcttaagacttttccttgaaattcctaatagcagtcaggtgagctattaagtgggtgttttggactgagaaaaagtgtcttaagtaagcgtgcttgttcttaccttttttttttttttttttaatactgaatggaaggaaaggtgcatttaaattttaaaataactctcaaggagccaggacaagggagaagagctaatattaatttttcaaaaattcttatgggaataaatactttcttttcctccttattcattcatttatacattcatttatagatattaattttttcagcatgtatttattgagcatctcctgtattctaggcactgtgaatgttacaaagtagataaggataggtaagatacatgctcacaaggagtgtatacaacaggaagagagaggaagaagtacagaaacaactttcctatgagaccttaatgagataacacaaggggaataatctagcacatacctgggcatagtagatgctcaataccaagagtcaactgttgactcttggataaagtgattagtcactctggagaggtacagacaatatggtcagatgagggatcggtaacttttgacgctattgttggggaagtcctcatggaaacttgaaatgggccttggagttgaatgggatttgggcacatccccctgagcgtggggagatcaccttatttggctttgtatttttagcaggtggtacagcataggttggaaataatttttttagatgaataaatgaggggaaaggacagttttggtgaggggtaaaccgcaagcaatggcatgccagagattgggaagtacaacagagtttaggggctccagcagtgattcagttcagctgaagaaagagtaactacaagggaaatgtatcttctaagtaagatcagggtcagatcctggggaggtcatagttgccaggccaaccatgtaggatctaaagcaggcttggtagccaacactggtgacattggagcagggtatgggtggcaggagcctcagatgaggagactattacagcatcagagctggaagtaattactcatctagggtggccatagggactatagagacctggatagaggtaagtgatattttagaggcggaattgacagcacactaaagtaagtacttcaactgtagctcagtggaatgattttgaatgcctccttttgctataggaactctttttgagaaaatgaaaacctcaaatcaaatttcctggaacaacttttttggagagtttagcgctatctaagtcattctcctaggagctcttataaaacattatgaaggcaaaaaaaatgttaaataaagttattatatcaacaggtaatttacagcacagttcaatatttatacactgtaaatatatttttatagttcttttggaccctttgtatattctgtgttatacatactcacatacaaacacacacataccaggaaaggagagaggaaatacagaagtagccacgtgttagttaattatttgatgctgcatcttcgattactaatgagcccagtgacaacactttgttgatttttatgtgaaaattctttatgatcatcagtgttatgaagtggtttccacgaaagcatttcacccatctttttcttcttttaaagaaacatttacaatagtgatgctgtttaagttttgttaatacaatgcatttttgttgggggaagcattcttcggaaaaaccgtatcagcttttgctttcacatctagcataaatgtataagactgtaagaagaggcaatataaaaatgtaatatgcatgatcctttctttctggcatcaccgacctcattaatagatttgtgtgtaagggaatatagtcctgaaaattgttaaaccagatctcaaccctggtttttacactgatgtgagtatcctgtgccagacactttatttcaacaggccttagttttctcatttataaataagagcctgccctggaatgatcaggaacatccttctgggagtaattccctgtgactctgtgccctgttagggccacatggggaagagctgctcataaacattgacaaattgaaatattttaaaattcagattatttgtattcttcacaagttccagactattatcctttttcatgtaagaggctgaagaaagccctatgtttactttagttgcagaacattgagcttttctgaacagggtacatggcacatggaagattccccaataaataattgctgggtttgtttcagctgtgagagtttagtacagcgttaaaggattgctcctggggctgggcgcactggttcacccctgtattcccagcactttgggaggctgcggcaggcggatctcttgagcccaggagttcaagaccaacctggacaacatgtcaaaaccttgtctatactaaaaaatacaaaaagttagccaggcatggtggcccacacctgtactcccagctacctgggaggctgaggtaggagaatcacttgagcccaggaggtcaaggctgcagtgagccatgatcatgccacactgcactccagcctgggcaacagaagaaaccctgtttcattaaaaaaaaaaaaaaaaaaaaaaaaaagggattgctcttggacttggtctgatcctctgctcatgttagagaagcaactgaaacaattcttaatgtattcaaaggtaaactcttaaatggataaccacagaaacctaggcatggtattaaggcctgggaatatgaagtaaataaaaataggtacccccacgagctttcgctatggtagggaaaatagacattagggacttgggacatataggatttattccattgttacagatagaaaagtgtgaaatcaagtgacttctctaaatcattgttgaaagtaaaattgtattttaaaaatcagtaaaagtgcttaaaaattaatcacaattggattcatccccatttttcctgccccaactaaaggttatttcttttgaagtaacatgacaaattctaatatggtttcttcataatttcctttttcaggtctgaagcacagatatatttcagctagtctcaacatccatgttgagaggcaaggagatacgcaatctctaaggacattgcatttccaaatatatagggatttatagatcaaagccatttttagtcatttttgctgaggtagtgaagacctaattttacccaccctttaaatgctatacgtcttttgacttcataaagaaaaatgttgatttcaaaaattttattttggtgttaacagtgatctcagggtgctaaggatctgctaaatttgctgagtttgaatggtttggtcagtagtgaaaaatttggcttatttggtatttaggcatcccattaaaatgagtgttgaacattctcattgcattatactgttttcataaaatcctctgtattcacaataataattactactgattatggaacattatgtatcagacaatgtgatagatattttaaaccatcttatttaatctttacaaataagactaagagatagacattattgtttaccattttatctatgaagaacctaagactccaggtggttaaatatctatccatgtagctatttctatgcttcaggatttgagttctggtcattctaactctagaggctaagtcagttaccatattgctactttctcccgtgctcccaagtaattattgctaaaatctaagtcctggctttttaacgtatgggctaaaggacagattggatgtatgagaactgtgtctatgagggcagtttgtgggaggagggacctggggcctaataggagaggtagattttagaaactgagttaaggacaagaaaaccgtagctggcaggagaatccaagtcaacaactgaaagatactgtatcattcactaaagaggaagggtagatgaagaagtcactgagaacttgaggtctagctgtgatttctgattactatctcacttgttttttgaaacagtattaattttacacaaaaggtatggttacttacccagttcaacttatgcatattttattaattctttaatttattctatctagtgttattagatctttaattcctgagtacttattttctagatttctaacaatggtggactatgttctttcaggaagatggtagtattttaggtttgttatgtgtttttttttcttctggattctccagataagcagttaattaccctatttgtctattcctgaacaaataagaaactgagagtgggatccaagaatgtatgtttttcacaattcctgaagttgattatgatatgcatcaaatgttgataggaaattgaatacgcgtgtagagaaggtaaagggatttgggatctaaacccaggagtgccgggtatggggaaggctgttcctttactggagaacagaagctgaacatgaaggaataaaacagacagtggtgagggattattgattacggatttagagaattagtcattcttaatttaaaaaccccttttggctgttacttgtggaaaataaattggtcttttttcactcacattttctatgtgtagaatggtctgtttttagtgacctggtatccaagaaattgtaaatagactgatgtcatttcacttacttttgaaacacaatatagaacagttggaatacttttcttgtgttgattccttggtttaagattttatatgtatctagctcacaaaggaatttgtggatttccaagggcattttggcaaagagaaggtaatatacaaattttaatatacaaagtaaccaaaaggtatggttacttgcggagtttaacttatgcattttttattctttaatttattctgtctagtttctgtagctctttgattcgtgagtacttattttctagatttctagaaagatcatgcaattgcactccagcctgggcaacagggtgagaccctgtctcaaaagaaaaggagaattcttaattgtgtcctgagtccaatgacattttaaaagattgataaagtagctgggcgtggtggctcatgcctgtaatcccagcactatgggaggctgaggcgggcagatcacttgaggtcgggagttcaagaccagcctgaccaacatggagaaaccccatctctactaaaaatacaaaattagccgggcatggtgacgcatgcctgtaattccagctactcgggaggctgaggcaggagaatcgcttgaacctgggaggcggaggttgcaatgagccgagatcgtggcattgcactccagcctgggcaacaagagcgaaactccgtctcaaaacaacaacaacaacaacaacaacaacaacaaaatacatatgtttctactttattttcatagtattgatatttgtttctgctaaaccaaagctcctatttgaggtgtagttgctcagtttcccacctcctatcttctctctatttgcatgtacttttgagtagatggggtgagaacaggattatttggctaaacaatatagaacagttggaatacgtttcttgtgttggttccttgatttaagattttctatatacctagctcacaaaggaatttatagatttccaagggcattttagcaaagggaaggtaatatgcaaagggctaagtaattcaccaattgggtcattaagacccagaaaaagcttggagagtgcttgttaacttttcaagaagacattgactgctgtgatcacatcactgttatgatcatgaagatcaaacaaaaaagttactcatcaaaaagcagaaccggaaccaaaactactatcccactcatgtttaagaatgtggtgttcatgttctgaaaatacaattatgtatccctcggttagaaagatgtgagttaaagaagccccaaggaaaggcatctgtaacactgctgggatggaaagctgccactgaagaagattctcttcttgaatgctgaaagcgtctctggtttcatcctgtgaaatcatggatgaagcatcaaaggattaatcactcaaattctggtgaatctgaacaagtagtaatttcttagagtcctaaaaatttctgtatgaatagtcctccccttgggattcatggctgtcttaaacattagggcagaactgttataaactgttgtcctcagaaaagataatagaaaatacatatttctgcaaaaatataatttaaataaatttgtttgtgatagaaacataatggggcattatggcaagtaggaggctttgaagtttatccctgatcttgtgaggttgatgtcagggttgagaaagccatgttcttccacaccaagtccttctgtccactgtcagatcaagtactggccgtggctcagggatctgctcaactcttttggttcacgggctctgatattatatcactctttgctgctgtcctgtcaggttcttccaagacactaggactttgcctttcattttagaaaattactggttaatagactccactgcctatttaacactgtgattcaatagatgtttattgaacaggtttatctatttattagtatatataaaaatggttcatattagattcataattttggtatgtgtgtattttgtttatttaattttttttgaattagatgctgtttagatgctggccttgagtcagaaccattttgccaagcaaactttcagagcccttctccctgcagggaagtattacatgtaaatgctgggtgttatacagctttataagtacctggtacctttctgcagttattcctttgattaacagaaccaatgaggctggggtcactgtggttgtgccgattttctggtatttattttttatgaagagattgctttaggaaatgcgtgttaaggcacagactaccttaagtagtaatcctagcaggttacccattataaatttccagaaaaggctcaatttacataaaattaccaaagaagatgttgggaaactttcaggaaccgagcatttttggatagattctggagctacctcttaaattaacccggaagctagaatcagagggatctttgggtttcttagtattctacttcatgcatttttctactaaagtacctgagtggcagagggaagtaaactattatattcttatgaagtcaggggtcatagcccaaattttgttgccagagctcaggtttgttgaagtttctagaatgctttatcttaaaagtccatgtgaatattatattgtattccataaggtataccttcttttgatttttgattttttaaaaaattgaggtaaaattgacatacagtgaaatgcataggtcttaagttctgtatacagtttgagtattaacaaaagcgtacactggtgtaattcacatacctattgagaatatactacatgttttaacatagaagtagcatttgaaattattttccatcaagaaaatggatgtcttaggaatattttctctttttcattttgtggcttctacttgatataccactctgtattcttcagggatgatggcagtggacaatggcatgattattccattttgagaagtgtggccttcatcaccaagatagctgtgcaaaatgattagacatcataatggactttcgttagctaaagcctaacattagttagagaaattggctaatgaccattattcactgaaacaccaaaaattcctgtttctctaattgcaaacagtttatcaaatcaaaccctagatctatgatcaggaaattaaagagtcagtcacattcattgtttttgctggtaatctattttatagtaaggtcttactcatatacatgtgaacatttgatactttccagtacttaccctccaggaactccactgatgacctattcccggctttcattcctatttcttgaattatttcttgaacattgcctgcagcagctcttagtgtttgtaccttcttttcctccagaatctttcagggagtagatattaaagctctatttcagtagggaccaagttttagttattgtatgtagtacagtgcataccttaagctcagtagattgatttcagttgttagtgttaggtaataaaggagacacaaagttggctaagggatagatagactcctatggtcaaggaatgtttagtaatattagcaaggggggaaagcaggatgaggagggcagtggcccctggactagctgggtcagcatcacctggtagaaatacctatacccaggtctccagaatcctgaatcagaaactcagcggggcttggcagcagtctgtggtttaataagtcttccaggtgcttctaatggtgctaaaatttgagatctactgggttagaggaagaagccaggcaaagatgtgggttctgctaaaatcgagcttcagcaggatacttcagggagctttggagtgtgaatggcaccttagagttgtcactaagaaagggggctatcttggccgggcgcagtggctcatgcctgtaatccccactttgggaggccaaggcaggcggatcacctgaggtcaggagttcgagaccaacctggccaatgtggagaaaccccgtttctactaagaaatacaataattagccggttgtggtggcttgcatctgtaatctcagctacatgggaggttgaggcaggagaatcgcttgtgcctgggaggtggaggttgcagtgagccaagatcacaccaccatacttcagcctgggggacagagcgagactctgtctcaaaaacaacaaaaaacagggggctatcttcatactccatattaatcaggtatgggctgtcaggggctgtcctagttgacagacagtgagagaggagcataatttcccagattctttgggcaagttggctctcaagcagctgtgagctgatagcatccaacaatcacagcatctgggcagtgggtatgccaattaggtaaagggggtctagatgggacattacactgagttacaggaagttatttaactagcttaaagttccacagctagtagtgggatttgaattcaagcagcctagcaccggagtccatctttctaaccattagctataccatgtgcagtagtcagaacaacagtagcaataatagcaggggcataactgaacaagggatgattcagagaaaggagttgcttctgaccggggggaaaacaaagaaattatcatggaagagatgtcatttgattttgctttgaagtagtagttcatgtaaaaatttatgtgagaggctttttaggcagaaggaatagcctgagaaaaggcatagtggcatgcaaatgtggtttgtgtgtaagaaagttggttattctgtttggcttcgatttggcttatcaaagagagttctgggagaaaagttgttcaacattggtttgaggccaaataatggatatccctagatgccagacaagtgaagatttttaaactgggaaatgacgtaatcagagtatactttagaaatattaatgtgacaacagatgaataggggaaattttaggaaaagaaactggatcagataagtaggagggagacaagtctggaagcaatcaatgtgtaggataaactgggacctgctctcagctgaggcaattaaactggaaaagaaatagattgaaaagatactacagaagaagcagtacagaagttgggggactgaaggagagggagccactgcaggtgctagctgcttaaggggataccagtccttttacagatataatagatacagcttctgaggtggagggtgataggagtgtgtagagaaattgcagttcagaactggagcatgcagttaggcaagaggcatcccatgtgaagatgtcaagcaagtactggaaaatgctgaactaaaactcagggatggatatgtagatttagagaacttcattgtagaggcagtcattgaaagctaaaagggctgataataaaattgccaaggatggaaatagtaagagggagtcagtgttattaggattagaattctgttttgttttttctttaaacagattctcgctctgtcaccctggctggagtgaagtggtatgatctcagctcactgcagcctcgacctcccaggctcaagttatcctcccaactctcagcctcccaagtagctgggaccacagccatacaacacatgcctgccttatgtttgtattttttgtagagacgaggttttgccatgtttcccaggctggtctcgaacttctgggctcaagcaatccacccaccttggtctcccaaaatgctggcattataggtgtgagttaccacactgggccaggattagaattcttggtctcttaacctctcgttcagttttttcctcgtcgactcacatgccctccaaatgaataccgaagttagattttgcatattaaattgaaagaaagttaaaagccttactactttctaattcagtgtagggaaaataatgggaaacatgaaaaaaaaaaaataacaaacctctgggatgggtgaaagcaaacatgtgtcttctcagttcctcctaggtggtatcttgaccttttatcccgtcttgtttttttccaaaaaaaaagtaattaaatgatttcactttaaaagtctttcttgctcttactatactgtggcttagatttataaataaaagaaacagtgaaaatgtcagctgagatactaagtaaagtcagctaggaagtgagaataagatttctttctgataagctgtgatagtcagatttagttgtatttccagttgtttcagtttagataattcacagttcagaaagagatattgtaaatattctgattaatggggttatagaatggtattagttgttgtagcattctccttattctgaatccagctgtttgtggtgttagaaaacacttccattagagatcactgcttattatctaaggaaattctaaagatttcctaggccaaaagtttctggaattcatatttggccaaggattgtaagtaaatttgtgtttccagcttaagctagtacaaacaggtggatagtctattcttcaaaatttaacattggggaaagtgagttttgggttatcgggaatagctaggagggaggtattctgagcaatgaggaagtctaaaagtgtaacaatctaattaagaaggaagaccaaattaaaagaagggagagactggatcttcctattgcaagtgtactattgatattttagtttggagagtcctttgttgtggaaggctgtcctgtgcattgtagaatgtttagcagcatccctggccttttaactactaggtgctagtaccactctcatagtcgtgacaatcaaaaatatctctagacattgataaatgtctcctgggggcagaaatcactggttgagaaccagcatgctagcaaacccaagtggatcaagcaagaatgtgaaagtctgcatggtccatatgttaggtgttatataagatgtagaataaatgaatatttgccatttgagaaactgattttttaaacactgtgcttaggacagattgtcctggttatgtagaatccattccaagtgaggacacattggtcaatcactgaggggagcaatttgccaatatctagcaaaagttgaaaaatatatagcaattctatatcgatctatatgcccttgtgaaactctaaaacatctgcataaggacttatgtataagaatattcatagtaaaatgtttttgtaatagggaaaactggaaatagcatcattgaccacaagtagggaaagagatacattatggtgtattcacatgatggagtaaatatgcagcagataaaatgaatgaattattatggattaatcacaacagtggtcatagaaaatacgcatattgcagaataatttttactttatatcatccgtatatattttagaaacaccctcaaaatgctatatattatttactcaaaaatatgacaatatctgcttctggggagaaatggatgaagaagaatcagactagagagagaaaaatggagggtctcaatttcatttaaatttaaagaaatttttaaaagtctgaagtatatgctacaaaatcttaaatttgggtggtaagttcatgcatatttgttatttatcactatttgcactttcattatttctttttcagtttaattctttgtgctttcattaattctttttcaaaaatgtaaaggaaaagacttgatagcacaaactgatgttctttattgcatttggggatacattgagttgtaccttttttgaaataccttttagccatggatttcatttaatccgtgatgtgtttgaagaaagtaattgtgctctatgccatttcctattcacatttccatgcactaagccatggtttcatgattcattcttgcacaaacatgtagatctggattctcacacgttgaaataaacgcagctgtgtttatttcaatgcgattacattcaaataaacacacatgggatcccttatgagcgtgaacccataaaacacttgttgatttggttctgaaattgtgtgttcaaataaacacacttgttttaagggaagtttcgctttactcaaatgttcatgccttgaacatgtgttttatagagggcagatgtagagtgtcttaaaagaataatagttctttagaggctgagtcattgctttagacaaatgcagaatttatttaatgtgcttttttttaatatattggtaattgtctatataagtaataaaaatcttggaatatctcattttatgtagtaattcatttagttttgacaggttaactgaatggaatagaattttaaacaaattaatatgtaaaatatatttgtgagtatatttttaagaaacattaatgataaaataacaagtgaaggagacttttttaattttggaaactgcttcttccttaagcaggcttacaaaactgttttttttacacttcatattttagaatgaaaataaagctctaaaccaggaaggatactattcacatttatatttctgctgaagtggaaatggatgaagaagaatcaggttacatgtgtaacctgaaaagaaatgaattaacgtgcttcagacttgtacaaaatattttaatcaaacagaaaataactttcaaagtactgatatttgagatgatctatttttaccaaatgaactgcagagtataagccagtggtcttctttttcccctccaaaatatgggggaaatttttatgtgtggtgttatgcaaatacttaggaaatatccaaactgacatctccttttgacctggaagcctgagaatttttattttattgttaggttctttggttcagaagttgtgttaggctcacagctttgcctcccatgtgggaggagtgctcagggtcagcgatttatgtgtgtggagggagggaaggggtggaggttgttaatggagggatctcttccaaacatctcctttgcccagtcagggcctgattgtttgtggcctcagaggccctcctcttccctgccttcttctcaggatccatggatcttgttcacatacccctgtgaagctccttgcagattttaggtccatctcacagagccagactgaaggcagtacccgctacttcctaccacaaggagtgtacaaatatctctatacaaagcctgcatttctttttattaaactcatattttctggtcagtcattgctgggtttggccttttaggaatttttatccgggcatcacagaaggttaaatattattatgtgcataaattccccaaatataaaacttctatagagaaaataaaattgtataaagttttaaaaattgatgtttctacttcacaagtaatacatgaatacatttttttgtgtcaaaaaccaatacatttcagaataaaattggcctgtttcatttttgtactaatttctgaaattattttaaagtaaaataggaaacatttttattgtttgctgttttacatgtttatagcctgcctctctagaaaggatgcttcatgaaaacagggaccttcattttacttgccctttatatccagtgcttattacagggcctgacatgtattaaacactcagcaaatgtttgtgtttggatactgagtgaataaaagagcacattttctcgactttcattctcaatcttaatgttttgccagcccatatccaccaactccccaagctacctaccttgtcacttaggtgtgtattcttcaaaatcctttcagtgcatttgcgtacttacctgtggtttcacagagaaagcagagcatagttgctattttcctatacctttgaaaaacttagtattatcagactttttttttttccagtctgatttgcagaaaatagtatcttgttttaatttgaattttccatgataactggggtgatttcatctgtttattggccagtgtttttccccctgaaatgacctgcttatatgtcttgcccatttcactattgggctctcctttcttttctaccttttcttgatactatttttgaatgagctttacatatatagtctgtatattatttgactatatgtatgtatgtgttagacatatatttatatggcaaatattttttacagtttatttttttaactttgtagtgtcatgtctcatggggatgttgacagtttgcaggtagtcaactttatcaatttttccctttttatgtctttttgaactataagaaactctttcgtataccagtgtcattgatataggttgattcacacatttaagccctttaaaaaatctatctgcaatttattgttaatgttgtgagatgtagatgaatctttttgtccctcccatcatctcaatcctccacacagggggtggacagttgttccagccccgtctgtagtctagtgggcgttttctcttaatttgaatgcttttatcacgtacaaatgtttttgagatgtttttttgaatttacatgttatattctatcaatttattattgtatttctttggaaataagtgattgacttatagctttataatcctcttgctatcagatagagcaaattctcttatttcttttcacaattttttggctattcttgaatattcattcttccaaatgaatttagaatcgcctcttgattctgaatgttgcatttggatttttatctgaattgcatgcaactaatagattcatgtggggaaagttatcataaaatactgattatccatctgggaacattcactccatttattcaagctttttcttccatctttcaggaaatgttagtttttttcctacaaatctcacacatttttttcttgggtttattctcagatactttatagtttttgttgccatgataaaggggatttgttttcagcagttgattgttgctggtgtatggaaactatttgatttttttaaaaaattgatcatatatgtggccaccttgtaaaaccttttattagttttactagtttgtcagttgatttttttgttttttgtcttacgcaaaatcaaatcgtaaaagttgtgtcagcctgttcaatcgtttagttttcttctctttattttttttttggctagtacattggctagcacttctaatatgttgattgtttttagtgatagcatacatccttatttgtacatattttttacatattttaattagtctaatatttatttcactactattaacaatagttttattttatttatttatttatttatttatttatttatttatgtatgtttgagacggagtctcactctgttgcccaggctggagggcagtggcgcaatctcggctcactgcaacctctgcctcccaggttcacacagttctttgcctcagccttccgagtagctgggattacagatgcccaccaccatgcccggataatttttgtatttttagtagagatggggtttcaccatcttggtcagactggtcttgaactcctgccctcgtgatccactgggatcatgctcggattacaggcatgagccaccgtgcccaacctagttttttttttattttttatttttttgaatgtgtatgtgtgtttcttctagacctctttatcaggttaaggaagttcttttcttttcttagctaagaaattttattatgaatgggtgttaagatagtttgttgggctgggcgccgtggctcacacctataatcctagcactttgagaggctgagacaggcggatcacctgaggtgaggagctcaagaccagcctggccaacatggtgaaaccccatctctactaaaaatacaaaaaattagccaggcatggtggtggatgcctgtaatcccagccacttgggagattgtggcaggagaatcgcttgaactcgggaggcggaggttgcagtgagccgagatcgcgccattgcactccagtctgggcaacaagagcgaaactctgtctcaaaaaaaaaaaaaaaaaaaaaaaaaaagatagtttgttgacctaatcatgtcattttcttctcttaagtggttaatgtagtgaattccattgataaattttctgatgttaaacatccttacatttctgagattaaactcaacctgatcttactcttttcaaacactattctattttttattttactaagaaattttacatctactttgaagtgtgagtggataataactttgctgttcttacagcttctagcacagggttaaagtgaacctcagctaaaataattttctataacctctctgtgctgtggaataagtcacttagagtgagaattatttatttgaacttctatgaaactgcctcaggactggtaccttttttgtttttttttttttttgagaatgtagatctttggcaactgctttagtatttttcctatggtggttttgttgttgggttttctgtttgttctttggtcagtttttataatttatattttgttagcaaactgtccacttcatgtaggctttgaagtttttggtataaagttgttcttactgttcttttctaatgcttaatcttttttgtgtctctagtttttgtttttcatgtatttattacattcttttatcctaatcaattctactatttttgttctttttactttgttcatttttctagtgcttgttttgaaataattcatttatttttaaactcttttcttctctgaaatgccatttgatgtactgtttcctatgagtaccattttggtagtatctcacagttttctcaggtagtgtagtgattgtcattcaatttgattttaaaatttaaccattcatttattctcaaaccaatacattattttaaaatgtggtttaaaatttcccattaattttttttgtctgttatttcattatttcttatgttactgtatttaggttagtgagtatgatctgcaggttagcagtatttagaaatttgttaatactttctttgttggctgctgtgcagccattctctgtgaagtgagttctttttatgtggggtcctgagtacatatattcgtatcaggttaatattatgtctcttaggttgattagaatttgttattcctagccttcatagtattacttatttttcttttgatttgtctcttattttcagagagaggtgttctaatctgattgtgattgtcaagttgtgttatgggttttgtctttttttctttatatatttcaaagctatattgttaagtatatagataattggtgattgttatccacttgtggaaggttattctttttggtggtaaaaatatttctttttcccttctaaagatttgcttcttgattacttttttgtctattgtgatactgctatacctactttttaaatttcatttgcctgctgtatggtttcacatccctgaattttaaacctttacgtgtcattttgttttaggtgtatcttttacggatatggacatagctgggttttactttttggttagtctgaacgtaactctgaatagcctgtttatgtttattttgacttaaacctcctgtattttctgttatcctttctcttcatttccactttccagacttttcttggaatgattaagttgtctttgttttactctttatttgctctattggtttgaatagcatacattcctttctattttgtggttgcctttatattattaacatgcgtatttaaacatgtttttctcacaacatctacagttataggtatttgtagcttctccctaagcaagagaacttgagtattctcttattctcctccattctctttcttggacctctcaggttgattaaaaaaaaaaaaggaaaacatctcctggattattgttaaaaggaagtttggtgcttcttgtgtgtataatcttttgttcttttcctgagagtttttaaggttttctgtttatccttgctactcagaatttttcattgatatgttttaggtgtttttgtttttaatttatcccaattggcagcctcctttcaatgtggaggctgttggagtcatgttcttcagttatgtcagattctctattttctgctatttttttttttttttttgagatggagtcttgctctgtcgcccaggctggagtgcagtggcggaatctcggctcactgcaacctccacctcccagattcacgccattctcctgcctcaccctcctgagtagctgggactacaggtgcccgccaccacgcttggctaattttttgtatttttagcagagacggggtttcaccgtgttagccaggatggttttgatctcctgaccttgtgatcccctcggcctcccaaagtgctgggattacaggcatgagccactgcgcccgaccattttctgctcttttcttatgttgcctcttctccaatttctctattctcacctcttggaattgccaacagatggaaggtagatctgtcctctatgtctcctaacttttctttttttaaccatttatttctttatttctttcttttgcattctggggaaatccttggcccaggttccactcataattctttcttcaacgatattctttcagtggtgtcctaacagtctgatcagtcttatagttcaataaataaatttttaatttccagcttcccaaagtttcatttccaggactcaaggttcattttagatacatccaaatgttttgaagtctatgtaaaatatgtgtgtgatacaagtatagattccaacaatcacacagagctctgttcagatcttgtttctctgccattaactgtgttgtggctggttacctgattcctctgagcttcaattttctagcaaaattgtggtaaaaatgttatactgcctatattgttgtagggatgaaatcccataattgtaataatattacctaacttagctaactacgtgccaggaactgtactaggttattttattcacgtgttatttcatttaattgagcaattccttcataacaatcttaagaatatatccttgatagtttcttgatatcctacttccttgaaagtaactgaacttgttgaaattaattacaagagtgagtctttgatcactagttctcatattgatatctcaaacttaccacgttaacagtattttatggaggtgtgtttggcatattcttgactgtctttcttatttagagtaattccttttttattttttatttttttaatttttttttatttttatgacaacaaggctgtttatttcacctgggtgcaggcgggctgagtccgaaaagagccagtaaagggagataggggtggggccgttttataggatttgggtaggtagtggaaaattactggggaaaagggcggcaatgagatgtggctatagcctaggaatagtcagggaagcagataatgtagttaaaatgtctcgacctaataagggagctgggcaggtggggataactaaaaaggactgtataaaagaatgttgtccaagttggcatcagagttggggagttttaagaggtttagaagcctggctgtcaatgcctacaacagttatggaggcaagggaaacaggcccttgaaaagaaggtaatgtggagtgggtagcctccatattgattaagaaggggacggacttaccctccactttatgagttacccaaagtgtctgtgatggtccagaaggcttccaaggtgattgggcagcgtcagtcttcagctattaagctgagaagatctgggaaggagtcagtcagagagccttgggccagagttccaggggctctgggagtggctgccaggcaagttggacagtctgatttccagtggggtcccgtacagatagaacatggcttaggaggaatcccgggctgcaggcattccttggcccagtggccagatttccagcacttgaagcaagatcctggggcgggcagtcctggaggaacccctggctgctgcggttcaggcgttatgaagttcttgtgtgctggagatgtggctgaggtttctctcacagtggaggcaaggaattgcaactcagaaatacgttgctacttggctgcctctgttctattattgtacaccttgaaggtgaggttaattaagtcctgttgtggggtttgagggccggaatctaatttttggagctttttctaatgtcgggggcgggttgggtaataaaatgcatattgagaataagacggccttctgaccttttagggtctagggctataaagcatctcagggttgctaccaaacaagccatgaactgggttgagtttttacatttgatgaaaaagagcctaaatgctgtctgatttgggagaggtcggataaagaaaaaggaacattaaccctggctatgccttcagctccagccacctctttaagaggaaactgttgggcaggttggggagggctagttgaggaaagaaactgtaagccagatagggtgtgaggaggggaggtgataaaaggattatagggtgggggagcggaggctgaggaagaattgggacctggcttggcctagtgaggagcagcttggggaggaggggagaggtcagatgggtctgcagaaaaggaggattcaaaggactcaagagtttggggtggagactgaaggaacagacaggagagaaagaagaaggatttgggacaagttcgcactgggagtagagactagggagggactgatgtgtagtaaagaatgcctggacgtcaggcacctcagacccatttgcccattttttcgacaaaaatcatccagataaaatggagaaatcaaaagtgttgttttctggctatttagaacaattattgagtttgtattggggccaagcggtgttgcagaagaaaataagacgcttaggttttaggtcaggcaagagttaaagaggttttaagtttttgagaacacaggctaagggagaagaagggggaatggagggtggaaggttgcccatagtgaaggaggtaagtttaaagagaaaggtagtgacacggagaagggggtggtgagcagccctgggacgcaatgtgggtgagcagccaaagcaggtgtccccgcaattgacttgtcaccaagggtacgtgggtgaatgaccaaggcaggcatccccacggtgatcagacaccaatgaaacatgggtgaataatcaggcaggcatccccgcagtggttaaacaccaagggaagactgtcttcctgagtccgtgactggcgccggagttttgggtttccggataaaatgtgtctctgtctctactagaggggagaaagaactggagttggaaggacagggagattgaagggtagtgagagagggagattgaagggtagcgagagaggctggagaagagagtgaaaagaccacttacctgatttgaaattggtgagatattccttgggctgattggtctgaggacccgaggtcataggtggatctccccacagagtgagggcgaggacaggggactggtctcccgaaggagtcctcctgtcccaggtcttcggcaccaaatgtcacgcgagtctatgtgaagagaccaccaaacaggctttgtgtgagcaacaaggctgtttatttcacctgggtgcaggcgggctgagtccgaaaagagagtcagcctcctgttttattcctttaaaaatctgctcagtgtttggttcctgtgcatgtgtatatgtgtgtatgtgtggtacgtatgtgcatgcacatgtggttcactttaatccacctgttgggattccttagctgagtgaggtaccattggtgcaagttctgcttgccattgactgtgcagggcatttactttttctgaaaggataatgtacctattttatgaagaaatcatttaacaacataatatgaaagggtaaataaaggttatgggaaattatatcatgttagactaagaggctgaaaatactacccagaaagtacgttaccttctttaaggtgcttaggatggtacatttatttctgagcagaaccactgtgtgctggtgaccacatcggacactcattgtctcttgaacttttcccgtctgctatattcacgtaatcctttcgttagttctcagaattcccagcgaaagactttgtgacaatcatttatttttttttaaatgtgagcaattaactcttttttcttctatttaatatattatcttgagacaactggtatgtgttaaatggctattttactgggattgttattcttcagagatgccaaaaatgcctgaagctgattggagattctcatgtattaaaagtaattgcatattagtctttatatctgaatgctttataattacaggtaaactctcagtgtgtttcctttcttcgtaacattctgatcgttagtatgtttacagattcttttagaaaaaggttagaattaacatcaatatggtataatcatttcagtatttaatataaaaatgtataaacaggctgattttaaaagtaacatataaattatcaaccctcaaataaaaattatatatcttaaaagtatgactaggaaagctaatttttaaaaatatactgatttacctctattgttgtattaaaaggctcattttaaagaatgcaaaacatccaggaaaattccatgaagagatattgttaagtgagccaccctctttgttaattttgtcttcaaaagaagtctgtgcatttaatttgctaccggtgtacccaatatatgtgtttcttggcttatttaaaaattttaagtaaatttccaactaatataatattttaaatgttatcccagtttagtaataaattaaccaagtgaaaacaatgaaaatattatattcaatcttacatcctcattattggaatgagatcgtatttacaataattaacctacatcaatgcaactatttttcagtgtttcaaagttatgattctttaatgtgtacgtagaataaatctaaacaacaattaaaaagaatcaaacaagctatgtctaatggagattaagaagcattctccgtgaagatttagtatatcatctggtatctctttgtataaactcaaaattttttaggtacaaataataaataaaatgtttgttggctgggtgcggtggctcacgtctgtaatcccagcactttgggaggccgatgcgggtggatcacaaggtcaggagtttgagaccagcctggccaatacggtgaaacaccgtctctactaaaaatacaaaaattagccgggcttggcgggcatctgtagtcccagctgctcgggaggctgaggcagcagaatcgcttgaacccaggaggcccggaggttgcagtgagctgatgagatcacgccattgcattccagcctgggtggcagagtgagactccgtctcaaaacaaacaaacaaacaaacaaacagtgtttgttaacatgttatgtgggctttaaaaatgaaactaaatatagattaaacatagttacagttttgttaaatattttcagtacattttaaaggaaataaacagctttggtttcctgtgacagtcctaatttaaaatctctctctctttttttttgaggtaaggtttcgctcttgttgcccaggctggagtgcaatggcacgatctcagctcaccgcaacctctgcctgctgggttcaaacaattctcctgcctcagcctcccgagtagctgggattacaggcatgtgacaccacacctggctaattttgtattagccgggagaccgggtttctccatgttggtcaggctgctctcaaactcctgatctcgggtgatccacccgcctcagcctcccaaagtgctgggattacaggcgtgagccaccactcccagcaaatctttttctttataagtattcttatgtttgttcagaccatgtatctctatttttggtttgaaaaatataaatagatagtaaaaatagtttaacagctatcatttcttgaatactcactctgaagcaggcaatatggttaagacctttggaagattatatcatttattcttctgaaaaaaaagttaagatttgtaaacatctccattttataaacgagaaatttgagacctggaaaggttaggtaggtaatccaatatcacacacctaatagggggctccaaacttaaacctggcatcgtcttactgcaagattaacattgtgttatatttgggtacaggttatttcactctttgcaatttagcgactttaggttgatcttttgagaaatgtaatttcagggaaatatatatcttagataagtatctattaaagtttaggctgatctttgaatgttatgaagaagagggatcatgttatttatattttggtactctcaacatgtagctcagtgtcacatatgataataaacactcaattcgttgaaatgaagtaaaggaaattcttcattgggagcttaaggaataaaatgggtgaaaaggtatggagcaatattgtaaaatccaccttttacatcaccattattaaagatattactaattttaattacaaattataacttttaaaaaatgtaattatgaatgagatgcaactgaatgctgaagaatatctcttgacctcttctgtgttgtccttccacattataaaaattgatttatttttgagaaggaatgactcaaggctgtagagggcagtataagccaactcaagtggactttcctgggttagtgaagtggtacaactgttgttactgtccaagtgtccagttaggtttgataccccaagtatctgaccactggccattagaattgtttcagacttaaaaataaaggaagataaaatggaaagtgttttagaaccaaagaatcacataaacccacaaaaaggtggcaattatgcaacagctgtttccacccttagaaattcttgtggcaaaaccaaagccattacctggataatcccagcctaaaaacaattcgtctcagtgaactttatgataaagtttcttgtaaagaatttactttctttacttgtctagttgtataatttcaattaaaaatagtaaaatcctccaccgtcctccccttttcctctctctaccttcaccaacttataaagacatggactgtttagttgtttaccaaatgatgagctattactaaatttagaaaataattaatatcagttcagatttttttgacattctcttattttgttgccagtgtttatggacagtttgattattcaatgtttgcttgattatatcacttttctagttaataagatgtttttggactatattttcattgagttttttaggttttcatttagggaaaaaaatcctggcaatattgtcacctttgttgcctacactgatcatctgatggggatggatatctaaaaagaagtaaagtgcagggtaatgctaattatatattttagttagatagcattttatctgctcatttattttggcatttagctttagagaagtatagtttccatggctgaattttttttttaattatatctaacaatatctgatgatgtaataccagacattctactcatttcctcgggtaattatgtctaatttaaataatttcaataggcagtagtatctcaaaagttttagtaaatagcaagttttctaaatgtagataaatgaagcatgtgtgccagaaatgatagttgtgctgtcttcaggtctttcttgtatgtttgacaatgtaaaatgtgttgaggccaggcgtggtggctcatgcctgtaatcccagcattttatgaggctgaggcaggagaatcagttgaacccggcaggtcgaggctgcagtgagcagtgactgtgccattgccttccagcttgggtgacacagcaagactttgtctcaaagtaaagtgatgagaaaaagaaatgtgataagaaccaaggaatataaaattagttcagaaaaataaaaataaaaatgtgaagacaccaaatgttcccatcatattctcatttaatttttaccacgaccagtggttgccattattatctttgcagatgtggggaaactggggctcagtcaataccagtgatatgctgaagttgaagtggttcataaattataatactataactggcatccagtcttgccttaatatttgcttagaattaaatagctattttatgattgtattggcacaaatgtgattttttcaatatctttttcaaaacactacttatattttgttgaatgaataactggcttttttttcttttagctggagaagatgttgtctgaaaattatcatcggtttattgacctccctaattccctgactttgggcagtttctcattttcagttttgccttagaaggtttttctgtgtgatctaaggtatagttaagcttgaatgtatattacatgtgtgtgaaagccaaaatttaaaagaatctatagaactaagagcagtgagacattaatcagatgaaattataaattcaataaatttgtgatgcaaatttactttttgacactcaatattttttagatacaagtcaagattccaaatattgattgatctatctatctagttatttttactttgtgatttttgttttaacattaggggcttatatctttggttacaagggattgaccaaaacgcactatttttctttcctcccgaagctctttataagcattaaattgcaagaagatatttatttatttatttatttattttttgagatggagtctcactctgtctccaggctgtagtgcattggggcgatcttggctcactgcaacctctgcctcctgggttcgagcaattcttctgcctcagcctcctgagtagctgggactacaggcgtgtgccaccatgcccagctaatttttgtatttttagtagagatggggtttcaccgtcttggccaggatggtcttgatctcctgacctcatgatccacccacctcagcctcccaaagtgctgggattacaggtgtaagcgctaccgtgcctggctgaagatatttattttttgtggtatctctgtaaagcacataaaatttgttgccatgaatctcattattaaaacactgaaatggatcgctgatatgcctgctcttctctaaagaggagggggtggactcagtatatggtactgttggtgtgagtgtggatcacaatatgattcacccagctaagaagtaaacccatatttggttttaaatttgtcgaaagaacatttccaaagggaaaacatggcgggaatggaaggaaagattggaaagtaaagatattctgctactatcttactaggagaagaatttgaggcctactttaagggtatatgacttgggcaagttatttaaactttctaaatctcagtatcctcatctataaaatgggaaagtaatagtacctgcctcactgattattaggcataaggaataatagaattatgaatagtgaggtaagacatataaatggcttctgtagtacttgacacatggtattctctaagcaattgataataaatagtaaaaggtagttcttattgctgcagtaatcgtaaatgaaaattaatgcctgaagttcagtggtagcaaagggactggaaagaaaatatcaaatgaacaaagggtagataagtagaccccataagtgcttagtgactgatgtggtgtgggtattgcagtaaggaggctcaccaagatgacgagcctggccaagcatagagggctatattagaagtactgtcttatctcaagaaagtaaggttttcaaatatcaataaggcaaagaagtagggggaaaaaaacccttgagaacaacttctgtttttgtttgacacacttgttttaatgaatttgtatctaacattgaccatgtttaagtggttttagataaagtgcatttttgctgttgttcttgtggttctcctacctaagcaattcaagttttcagaactaatttgtttgactagtcaatgttctctcttaaacagcttagtggcaaaattcctgccattgctctgttgtaaagaatcagctcttctttaagataaacagtatctagaagcatggccaggtgcattcactgcactgtaagagggagacatggggggagtagtcaggaagcatgtaggtgggaagggtttcctgtttccaggcaacagcaaggagctacagacggaaagcaacttgaatataaattcattcaagaaaggacattttaccaccttgccttctaagcagtgaggacgcagacttgactgaaagatagagtgaggttgaagcttcatttgtcagtgggtaaagttattagaaacctatttctcattaggttttgtatgtatgaaaaatatcacatactagtggccaggttagcatttttaaatatttgaaaaatagtagcatctacgcttgccttccttccaattttccagaaacatgggtttttttatggcttcattttcctgtctttctgcctaaagagcagaggggctcgtggccctgaaacaggctccttccctgcctgactccatctgcaggaaggagaagcacagcacactcagctcaaagggaggtgcctcctcccttgaagaagcccatccagaggttcacagggagcagatgagagaagagttcttcctgctccctgggccaaggggaatgtggacctgtcccctgcttgtgacattttccccaacctgtcaaatgcaagagtagcaaatttggaagagtagaagaaggcagttgcaggcggcagctacctgattggggtgagttattcttgaggcatttgagatattgagttgatgatttaaatattggcccactaaagattttataagtaatgtagtcattccttgggccctgagggaccctcttgttctatattccagctctttcgtaatgagagggattacccatactcagaagagatgcatgtctcaaacgcctgcattattttttctcactttcacattgtgtttcctctagttgttgaggtgagctccttttaagataggctttattgttttattatactgcttatatttaggagtttttcttcaaaatctatgtcagaagataggtctcgtaaagggcgagtaagcacttgggcgaatcatgcactggaatttatcttttgattaagtttgagagtgtgcctggaacagttgggtctttcatctctcagtctggagcctcctttagtaacttgtcctgagactataggcaacccactagctagttatagggccaccaaaagagctgcccagacacttaagcaaacacacagggtccaagcttcatactggatcccttcttgccatgtattcggggatgaatcactgcttgaagggtctaatctgtctccttattgtcctgtctggaagggtcacattatttgagtgtaactcctgagagcctggcgggtcttttcacacagatgttgatggatgctttgcagtccctcccatcccagcagatttctttgtgcctctttttacataggcacttaacctatgttgagggagcctcttttattaccagaaagaagacgttaaaggagtttaatcctcactgttggtaatagtttgttcttccccagtttgcatactcgggttttagttggatatcgagctgcctcttttttaccatatcggtcttcattctattatttgtgttcttaaatgtcttgtgggaacattagaaaggtacctatgatggttgaatatctttagttttactatcattttctatagaattttaaaatctagttttaagaacacaagttggcaagctctggagtattttttgttaattatataaattatatatttatggcggtggattttttttccctacgtaactttggattgtacttgagaagctcattgcaaatcagcacagcagattttaaaaagccaataatcttttatgtaaaatttgacttacttatggcattatatatgcagttaattgggtctagttcattttaatcacttgacatcagttatagagtccaatttcagacataggaaattatgaaacattaatgtaatacaaaataggctctttatcatgcttttttcatgaaaaaatagtttcacttactaggagtttatgttggctatttgatttttaatcttgtttctcttgtgtgagcttttggacagaatatgaattttaaatccacaggttttttttgttgtgatttttaaaaattattttcactatcctccaacattgttattcagtattattatacaagcacattcatgtgataatatatactaacaatttgttttattttactgaagattccaaaacaaaatttctattagtaaagaacattgtcttttgatgtaattatagtaaattttagtttaatcttaatatttaaatatttaccaaaatatatgactcatatgtaggtaagttatcaggggaaaacatcctatgattttaaaactgttaagcactcaatttttttttttaattgagacagagttttgctcttttttgcccaagctggagtgcagtggcacgatcttggctcactgcaacctccgcctcctgggttcaagtgattctcttgccttagcctccccagtagctgggattacaggcatgcaccaccatgcctggctaattttgtatttttagtagagatgaggtttcaccatgttggccaggctggtctcaaactcctgacctcaggtgatccgcccgcctcggcctcctaaagtgctggcattgtaggcgtgagccgtcacacccagcacagtcaatatttttaataagagataataaacttcatgattttagtcagtcttctgtaactatgcaaacaaatgttaaaatatggaagacctaaaatctacctaatatctggtctgagtgtaatctttaaattgttattcataaatgaattcttgaatgagttttgcttaaagacaatcttgtatttaactaggagcaaatttaaaccaagcttttaatttttcatatccaagctgatgattttgccttaaaatgtctttgatcatatttttacttactaaacatctgtaaaatagttacattcattattatacacttatatatatattattattacacacttgttggcagtgtagggtggataaaagagaaatttaagacgttttccctgtgtcctaggaaggaaatggccttttcccatctcctttgaatctcttttggttatgcaggccagtctcttttatgattcttaaacttggaaattccccttctgtgatctttcatttgtgtcatgttcctaccaggtttgaagtgaagagactatattttcttctaggggcttagcagtactttgcatatactagatagctaaaaattgtggaattaagcatagatttttaaaaactagctttgataatataagtatatgccaaattataattagtggtttggtaactggtcttctgtgctgtgggcatcagctgatttattcagtttttatacactgcttcatactccgtcgttagtgtccttgaattggctgtttcttttactttgcaaccaggaacttaagaatttgagttacacatgaagaatttatttatcaacagcagggcagaatttatagaatttgttaaatctcattctttatcatgtactatgtcctctagggaatagttggctgatatttttagaaaagaattatgttattatcattaccattagaatgctttttttaaaattagaatctagattacctttatcaatttgtacacagtattattacatctgtagtggcatatttgtaaaatatttactttagtatataatgtgtatatatatgagccaaggtattttttagaaagattctttaacgttttatttttaatgttttcccccaaaactttaggcagaagcagttatttcttcttagcttgctagggcatccaattttcatcaaattttcgccaaaccttctttttaaaaaaaaatcacatttacctagtagaggtattgttaaagtactttctataggtagcaaatattaagcaaaataatattatattttttgaaaatatttggaaaaatttctgcagtttttaccttaaacatttttagcacgcatatggcatatgtggaagctttttttttttaaacacatttttgttttaagtctcattggagttttatctcagtatccatacaatatttacaaaactaatattttttaataactgattttttgacaaaaagatggaagttatatctttatggttgaaggatcgtcctagtctgtcagttgtcatctttgaaaaccaatagccacccaaagccaaactattgatactaattttaagacagttcccagggacaaatttcaacaaaggagggtacgttctccctgtttttatagtttgcttgttcgtttttaatcataagtggagaacagttctttccttattgtcatactaatattatcctaccttaaatctgttggcatataagaaaagtagtacttcctgtgttaatgttgtattgatgggaatataatgtagtggtaagttagtatgcttatgagtttaagttccagaacatttagttttaaaattttttaatgtaacggttagatttaaacttttcaataatgatctgtttttctgctttgctaaatagaatttaacaaacataattttactttttttgataactcaaaatcatctttgttgttgttaggactaatagaaaggtgtaggtatgtgctgtgcagtgtattgtgctctttgctttgctataaaagttctacaatgctgttccttggagaatgacctgtgttttaatacttttttatattctctttttcatgtcattagacgcaaggctgttagcctcattacataatttgctactagataataaagcaactatgaagtattgcaactataatcaaaataaaaatcaacatatgaagtttaaagaactgctttaagtatatgggacttgtcggatatcagtaaaaacaagttttggctatacagaggaccttcagtgtttttttaaggcttatactgttttgtattttgagtagttaagagtcttatagtgagctttctgattaaactctttaactttcaaaaggattggaaaggaacttgcagatcagctgctcaactgcttatattataagtgaggaaacagaacatgaatgatttgcctgtttattaccagtggcacaagataaaagattttggagtaatcgataccttatttatcattttaggaacaaactgagtgactgagtagttttttttgcatctcattttttattgatatatcatagttgtacatactttggagttgtatgtgatattttgatacatgtatatagtatgtaatgatcaaatcgggataattggaatatttatcaccttgaacatttatcttttcttctcctctaaccattttgaagtatacaataaattattaactataatttctctgatgtattatccagtattagaaagtattcctctacctatttttgtactcattaaccaacttcaggcttaagaaatgtttattccactgtgtttatggctttcttcattatagcctggtttctgatgagcctgagcagattaatgattctgcaaaatagtcctcagttttaatttctggaactattttttataggattattttgttattttaatcttcaagataaattatactttatatatattatatataaagtataaagtataaattatactttatatataatatatatattatatatattattatattatatatattatatatattattatattattatatattattatattattatatatattatacatattattatatatattaattatatatattatatatattatatatatcatatattatatatattatatatatcatatattatatatattatatattatatataatatatatattattatatatattatatataatatatgatatatatattattatatatattatatataatatatgatatatatattattatatatattatatataatatgtataaagtataaagtataaattatactttatatataatatctctaatttattagttcttctgaacttagttcaactaactttgcagttggtttgtttttaacacctgaatcaaattgaaacaatactattttttctttagttttgcacacattttagaattaaaaatagtagttgtcaatttagtttgtgaaatttgtccattcaaatcttcatgtctggaaaactatatggtgggcaccggggatgatagcccctaacgttacactgtaatgatggtaattattaccaaataattaataatgtcattattttaattcagattgtcataaatgcttaacacagaacaatggaatatcaagaggattggatgatgggtgcagaattgatcaaaactttatggggtggggaaggcttctttaaaaagtgatttttccgttgaaatcttttttttttttttttttttttttttttttttttttgaggtggagtctcactcttgttgcccaggctggagtgcagtggcacgatctcagctcattgcaacctccgccttccgggttcaagcagttctcctgcttcagcctctggagtagctgggattacaggcatgcgcaaccacacccagtggttttaatagagacagggtttcactatgttggctgggctggtctcgaactcctgacctcagatgatctgcccacctcgtcctcccaaagtgattacaggtgtgagccaccacccccggcctcagttgaaatcttaataattactggcctttgagagacaaaaatgcaggtgagtatataagaacaaagcttggagatccagttcagtggcatgaaccatactggggctgagaactggccatggaagcaggaggggaaaccaggagaatgtccagtcagtaatccacgtggaggaaacaataaggtgaggaggtaacccaccactgcatttagcaatgtgtaggccattgcgatgatgtggagaggtgttctggaggaatggagaagggtcagagccatctaacagtgggttgaggagagagaaggaagaaaaaggtgatagttaccattgacacatatttttaaagttttacctggaaacggagaagagagagaggatggtgggggtgaaattgacagtagtctggttatttatgctaaaataaatgagacgtatcttcatacccaagtagaaaaaaataactttggaagctaatgaaggcttagcttcttgaatggtctgtactatatatgaaagcaagaacaattaaaaagtctttaaattgttcaattttctataattccaatgctcctaagaagctcccctccccgctgccattatggggctcttacctaactcaatataccaaaaatactatcctatttctttatctgtggttctttgtttatcttttttggaaaatgttttatcaaaatttataatttctaatgatgctgtattggcataaccacttgaaaaaataagagaaatagtcctagaataggaaacttgtgatatatatgactctctggagaactaaagtaaaaattaaactaaaaagtgaacttattttaattatgttattaaaaacacagtaggcggatgtaagaaaacaagctatttggttatatttatttcagaaaaaaggtcagtgacccattaactaagaggtttcacaaacttcagttttcacttggctattactcttggttagggtcacattataatttttggatatttttgtgaaagaacgatacaaaattgagttttaaatatgttttctgatgttctttcatataactgtattgttaaatattttcatttaatgtttagtattctcattttaagaaaacccaatgcaaaatctgaagttaataaaaaaaatagacggtgattatttggctaagataattcacccacatcattctcttaacagtaatctgatattctaaagaggttatttatatattattaactaacttgtataccagagaactgtggctgagtgcagagaaatttaaaattaagaaatttaagacttttgaatattaatcaagaatgaacttgtatgcagtttgttgtacatacgtattctggtactacaactatatattcatttcttgagagatattcgtaattgttttttttagatctggatttctgaaacttgagtcaagtaatggacatatcaggggtcacctagtttttaatgtgaattaaacaattttaatgtttcatttagatgataaatataaaagaaataatgtcttcttggttgcctaatttgattataactgagcattcctattggattctcatcataaagtttgcatttgtgtttatgaggccatgaaatatacctaaaatgaatgcttaactgttaagactgttttccttaggctggttcacagagttgtctgtggatttattttcgttaccaaggctaagcaagtttgagaaatagtgtccttgataatggtctgtaattattgtgatgttgtaaggaagtgattccacactttttttttttttgagatggagtttcgctctttttgcccaggctagagtgcaatggtgcgatctcagctcactgcaacctccgcctccgaggttcaagcgattctcctgcctcagcctctggagtagctgggactacagacgcatgccaccatgtccagctaatttttgtatttttagtagaaatggggtttcactgtgctggccagcctgatctcgaactcctgacctcaggtgatccatctctctcggccttccaaagtgctgggattacaggcatgagccactcactgcgcctggccgattccacacttttgagagttttgccatcttattttgcttcatttaaaaatatattctaccatttcttatgaatgttttttaaaaattaagctaatattttaaaagaacatctctactaaacatacaaaaaaattagctgttgtggtggttcatgccagcaatcccagctactttgcagctactttggtagctgaggcagaagaatcacttgaacctgggaggcagaggttgcagtgagcccagatcataccacagcactctagcctggttgactgagagaccctgtctccaaaaaaaaaaaaaaaaaaggagtgaaattacttttggtaagcttttgagaatttagttacatattggaatgatttggatcttcttgtaattttaaataatctaccctagaaattgctgttctcacaattcctaaagaattagttgggaatatgttacaaagtttttccatttgctggctactgttagttattaaattttgggtttctgtcctaaagcagatcctgtctgggggagatgcttagaggagccaggcaggaagcatgaatatgtgagtggggccttgagtaataccacagcaaatagtcgggatcgtgacttaacaggagatgcgggccccaactgaaatcattcgaattcattttcaccttcactgggtacgctagaccaacacagatttgcaggctcgaggctcttttaggagttaacagtctggttgagggaggtaaaacatacagatgaaatggtttatctacaatccacccatttattcattcatccatccatcctctcatttatacatgcattcatttactcatcactgaagtacctattatgtgccaagctttagacataacatggaatccctacctttagtaattcacagttttacagcaagttggcagaaagccagccaaaaactagtacaagagtcacgatttttaacaatacgtatcactgaccagaattatctttgtatttttttacctgtttgttttctgttcttcttattagggtagaagtcttttttgttttattattctcttttctatcctggtgactagagcagtatctgatacatagtatgtgttaaaagagtaattattaaatgatttgaatgactgaaggttctgcttggtcagctaaggctttatggaggggaggtgtatgagccaggtcttagatgatggttaggccttgaggaggtagagaaaggaagaagtgactgacagacactttgagggctgtgtgaacaacatgatcacaaagtaagggggggcctggagcagggggtgaggaataatggagtgatgtgtgtaggaggatcagtaaggaagccagcctggattgagtaaccatttcatgctggagacaagccaggagctaacgtgttggaatgagatgcaggtggaaggatgagaggggtgtggcacacattgcactcacagaagcaatttggttgctagcatgaattctggaatcacatatgttaagattcagatcccagtttgccacctataaactgggtgactttgtttaagctgcttaactcctgtgtgcctgaatttcccatttccagtttaaaaatatacactttggccattaagattctgttcattgatgtttttagtaacatggggaaatgcttatgctatttttcctaaaactgaaataagtgaataaaaaagaatggggtaaaaattgaacatataacatgttttaaaggcagtatgcctctttatttgccagggttataaaggaaaaagactgggaataaaaaatatcaatagtgatgtgattacaggcaatatttatttattttaattttaaaattacgtatttagtctactaatcaacacccatgaatataagaaattaaatctcccaagttaggtaagaaataccataaatgatgtctccaaagaccatctgtgttgtcaaaattaagggggatatgttacacctacttagatttctgtcatttaacctgccccatgaaccttccatttgaccttttttacacaccacattagaatctttgggtatcattttatgctgttctcccatattttaacgtgaacttgactttagtggaggaaaaattaaggaactatttcattgtattacttgagcttgttatttacacttagtgagtaagtatcttttgaacatctactatttgaccatcatcttgagttcttaggaaggtcaataaataagtgtatttggttctttacctccgaaagtttataaaagaactgagaaaacaaagctagtagaagaaaatgattggtagacagttgaagtcaaagcagtttaatcctaattctgaactctttttctgttttctgccttctagtccagtagtcttccccttgcttccagattaccctattgatcaagttatttggtcctccagatggttacttgaaaataaaaatacagcagagaaatgaccactgctttcaacttagcagcaccggtttaagtgatcacatgattgtagttggcactgtttgaagaagttccaccaaaggaagcatgaaagcccaagtcttgacttggtttttgagcagtgccacagagttctttttcagtttcagaagtggaatcagactcttcattgtctctgggaagataccaaagaaggcagttaaacctgactattactcaagcacagaaataagtcagaatttctccatgcctgttttgagtattttggccttcttaatcacagaaaagtcacacagatgtatttagagaaagagcaagatctagcaaaacaaaatttgttttaaagtgtgattttcacagttggctagaggtttcatgctctatgaattctgattagttctttatgcttttattttattgctttctatcattttggggtctaatatggtactttcattttttttataggtcttaagtctttcatttttttttaccccaagaatatgtgacatcacatgtgtaacatacttttacagtttcaaatatgaactatttcccttaaagtgaacttttataaacatctctgaaaatatttttataaataatcatttcgtgggacctttgtcagtagggttgtaccagcttttagtataaagattttataaaataattacctgtgtgcatttattaacatggttaagcagaaatttatatgtatttatgtatataggcatctatttttttattgatatgtagtgactgtacatatatgggatatttgtgatattttgatacatccatacagtgtgtaatgatcagatcagcgtagttgggatatcacctcaaacatgtatcatttttgtgtgtaaagaacattgcaaatctatgtattttgaaatacacagtaaactgttgataagtatagtcaccctattgtgctttcgaaccctagaaattattccttctaaaatgtatttttgtacccgttaatcaacctgccgatccttctcagtctctggtatctactgttctactctctacctccataagatccttgtttagctcccatgtatgagtgagaactatacacatctatcttacattcgttttctgagtctccacttctcttattttacccatccctctcttatttctttaaattactttaaagtttgagtaccatcagagcacctcctacctacattgatggggcccttttatttcagtgagttgggctgcttgttcctctctcttacatcttggagcttatttacttgatatttactccattttcaacagctatagcagtgggctgtgcccagcacttgggttggggacagatagtaggaattaagctggtttggagtatggagttggggttccactcaacagtggcagcacaagttgcatgtggtcccagtggaagtcagtttgcctgctgcagtattgccggaaacttagttactgacctttcatgaccttgcttccctaacacaacttgaaatacctccagcttccaggcattacccacccttgtgatttggccaattttctaaaggttaatgccattctggatagatttttttccccccagtcttaagtatagtataatagattaagcagagaaacacatcattccttttcaaggttcatatctcttattggtgctttcagttctaaagaagacctttttaaggattttttttttaactgtaatgcccatctgaagaaaaaagcaaacttagataagttttccaataagctccttaacattcttcatttttcataggacagtgaagaaagttacaaaacttacctaagagtaaaatgggtcaaaagcatggttggagaattcaggggaggagtgtaagtccattaaaagaagcttataaagacttggtttaagatctataaacagtcagtaaactgctaaaaggggttagaaaggaaagggggagatattttatgttgtgttattttatttttttgagacacttctcactctgtgacccacactggagtgcggtaacgctatcagggctcactgcagcctcaacctgcctgcctcaactgatcctcctgcctcatactcccgagtagctgggaccacaggcatgcgccagtacgcctggctaatttttgtattttttgtacagatgaagtcttgctttgttgcctaggcgggtcttgaactcctgggcttaagcagtcctcccaccttggcctcccaagtgctggtattacaggacatgagctgcccggccagtaaatgttacatctactaaacacttttaaaagaaaggtccaaaccccacactgaaatattttattgaggcagagtattataggtgattgaaatgttcttagtacaatttcatggaagtaaagggaagatatttgaaagtatgtggtgaggagattctgaaactttccagtgtctttatgctggttagcatttgtaatcattaaggtgcaaaaaatgttatttttgaatatttttggcattgtatatgtaatttgtagttagctatgactgtggcttcatattagagattaaccccatcaagaagttaacagtctcccagtttagtatgactttcatatttgagaaaacttgtaagcttgtctgtttacaaaatgtaatctacttactgttcctatatttttcttaatgttttgggttaaaaatggtgtattaaacagctgggtttagtggtgcgcacgtgtggttccagctactcaggcgggaggattgacacttgagcctggggtgtgaaggttgcagtgagccgagattgcaccagtgcactccagtctaggtgatagagcgagaccctgtctcaaaaaaaaaaaaaaaaaaaaaaaggtgtattaagatgactgtatgttctttgtgagattactgattttaaaaaaatcttataaaactgatttttaatataatagcagccttagtattgaacagaatgctcaatcttaaacgtctattggagtccagtaatacaaggaaattttagggaaatgtgaaacatttaaaaatagatctttgcatagaacctaaagtttaaatttaaaatgtgtttatttattgatattgctgtgtttaccagtatgtatgagctcatgttttattgataaaaggggcatgtgcaatttttaggaatgccgaggtaactttttcaaatttttcaaataagtatgtttagattcatcaaatagtaattgaatttggggagtttcaggaatattataataggtgatccttgatcctgagcctcccacctccacacatgtcttaagggccaacaatttctgttaagttgtacagcttatcttatggaagagtggtttttttaagatcaaggtcaaatgctcgtttagcactttgtttttcaaagatctacttgatctttctatacagaagtaaagaattatgattttttaaggttttcaaaattgtctctaagtatatataattttaactttgtacttctaaaaagctaattatctgatcttaaagtcttactggtgttctgctagatctgttaacaccctcgttgggagttcaaggattgtctgcatttggcctgtggcagttctaataacaggagtcaattaatcaaccaatataaaagtgtttatctgacactgaccttgtgctaggcactttgctagatattatgggataaacaaagccctttgaggtagttaataaattttaagtgatcatgaccctaaggcgtatcttctgtttgaaaactgaacactggctgtttgttcaccaaaatagatactgaaagatcaacccaagggaggcttcctttttattttcccaaccaagtgccatgccagagtaatcactaatccactaaatcctaatcaattttggtgatctgagattattactgcctaaggagataggcttctagagtaagttcagtgtcaatggaaaccttgaaggattcagaaaacagacttgaaaactttcaaatagtttttcttccaacatttattgagtgcaacacagcatactaggtgctggggttgtaaagatgaacaagacatgggtcttctatgggatcgtagagggtaatggggaaaccagatctatagtcacagatgggagtcatctgctctctaagtggcatatgcagagtatttgggaatacataggatgcaacctaattccgcccaagggaaatgggcaaactgtgatttctctcagtccctgtaagtggaaaaacaaaacaaaacgaaacaaacaaacaaaaaaagtccccccaaaaaccaaacaggctttagttttatacggaagctgtagaggaaaataatgtggattaaaagcccaaaacacagttattcaaaggaacccagaaataacattgcatgcacatatgatttaagatttgccaaagaaatagaattgcagttcagtagttgagagggaggttttgctgggctctgatattttcagaggcaaatgcttttctttgtgcttgtatcaggtcatcaatgaagggagattaaaatgatcacatttttctcttagtgtcagatagcagttatttagtagacaaggattagactccaagttgtatcacagaccaggtatttgctatttttctttttagtattcttttaggcatctgataaatttttttatatgtaagtttgtctttcttgggctgtttccctttcctccccctgtctagtagctgatattttttcacgttcacagttgcaggcctccatttagttcatccattccgctgcacattattctcttccggggaccagcttccttggtgacttcttcccttgaagcccttattcctgtcagtcttacttagtcaagtttttgtctctttgtctcatcaccactggggtgcttcatagacctagccgcccctctagcctaactgtagacaaggttggtgacggcagcggagatgacaatgatggtgttggtggtgggaataaatgcagtgctataattatatcatttccagagagatcgcatttctgactatgagccctagagtcaggctgcttagcttcaatgccagctctttcatttcttatttctgtgaccccaggcaaattgccttacctctcctagacaaggtctttcctcatcaatgaaacaggaatgaaaataatagtatttaccacatcataggattgttaggagatttaaatgaattaacacatgtcatataataatagcttaaaaacgttattttttatttttaaatttttgcactgccccttgcctgaagaaaaaaaaaatttgataaactcaagttgataactggcatgtgctaaggatactgtcttttttgatccctcaaagatgctgttattacctttaaaagatgaggcaattgaggcttagtaaagttaaataatttgctcacagttattatgttgtctggattcaaactcacatctgtgtgactccagaatgtctgctctttaaaacacgatgtcccacaggaatcatagaacagagcaagaatgctgctgccattccttgcggcagagtctgtgtttatcctaacagagctgtttcagtggggcaagcatgtttactagggaactaggctggaccatccatctggaggcttgagttctagttttgactttcatctgctgcctttgtgaccttgagcaagtcacttaaatacatacgaggttcagattcaaatcagtaacctgggaataatagcagagttgcacagaggatcaagtgagaatataataatagtaactttataatagtttgtggaagagaataaggggcctagcttaccatatgtgcattttgaaaaacagaatacctcccctctgatgttatttgaattttatttgctacttcttgaaagtgaaaggtttatttcatgcttctgggaatgaacctgaggtttcagacagggtgaaccaagaacttggaaactgaagcttcggactatcaaacacattaataagcaaaaacatttagtgcagaaataactaatgaaagtataataatacggacttgtgtgagtggttgggaaggagatggatttgacaccgaaatgaatgatgatcagagattaaaattgtattaggcccctcctttctgtgactcttgttatgtcagagcagactgaagttttgtatggaacacgtatagttaaattgttctataccttactcagcagtcactatcagtgatccagaatgcatatgatctctaaaaataaatttcacaaacttgatgtaaagcttactcttgaacaacacggggtttaacatgctgacccctgcacagttaaaagtctgtgtgtaacttttgactccgccaaaacttaaatagcctactattgactggaagccttaccagcaacataaatagttggctaacatataattagactagtatctacatatattttaggcactcatgacatacctaattttgtcttaatttttttgatatttctgggctttgcagttcatctgtgagttttcacaaattgtcgcaaatctccaaatagttttccaatatatttttttgaaaagaatctgtgtgtaagtggaatcacatagtttaaacctatattgtttaagggtcaactgtattttatagacagcacactcatctcttacttaacctatttttattagaattaaatacatctaattaattttttggctgatttccatgcctactgcagttagaatgcaggggttgggggcaggaatgggggtagggacttcatgcagtcattcagtgttgagaagtgataggaggagcctgaccaaaaaggggaaaaatccagaacatagtaagttttcttgatatggcatctttaaataaaaagtgtattcacatctgtgcactcatgtcagttttgtgagatagtttaagaaggtaatggtattaacaattttttatggggaagaaagttgggacccagagagtttcagtgcctctctcaggggctggcagcttatgtgagataggctaagctaggaattgaacccagctcatgagattccacaccttgcaatttcctggcagagatgcagagaagcagaccagagcagcctcctggatcttgggggcattatgtttgagtgctcagtgggattaatgttactggtgattgcctgggaaacactaataaaggttaaatcatgttgatgtggtccatttaagaagatgggaaagagttccccattttggcaacattttcatctagaataatttaaaattagaaaacaaaactgtttggtactcaacgagtataaccacaaatatctggaacacttcgttgatcaaagtggctcatttcctgagggtctaaattgctgttttctttggtttgtttgttagttttttcactctgtaatggcacttgaaaggtgttttgtgtgtagaatagacgaaaagtaaaccagtacagtggcctttaaacttttttactcctgtaaaagaattttgaaaactatggattactttattgacatttgaaatttttcatcgtaagtctaaatcatttgctaatggtgtaattgccattttattgtaaattttggcatttcttagtaaaattgttatattcttaaatatatttgtcttaagcaaagcctataactttataatactttatgttgtccacttatgaactactgtttgtgtgaaatttttgtgttaatttgcctccttaaaactttttccacattttatctttatatattgttatgtttaaaaatctattgattaccctatcatatttctggtaaaaaagttaattttctgtgaccatacggctcccagtgattgtttttaaaaagtatcattagagtgatgattagaacacagtaggtcagaatacacatgtaaattgcaaagctttgaaaaatattagagataaaaatacagttttactagaaatttatctctttatgcatcattggtgtttttcttctaattaattcataattagtatatgaatattattggggaaagagttcagcatatttttcattctttttaaatatatacactctggaattttgtttacataagttgaaagaatgagagtacttatatagcagtgttgctcatttctttcaatgatttatcatgtaaaattatttttgatgatttaatgatttatcagctgacaactcaattaggtccttctccaattttattctaaacaaagaattggcaaagccacctgagtggcaaaagaagagtgattgattagggccattcactttttcaccaacagtatttccaattgtccccttgtgtcctgcccagaggttttgttttgttttgttttgttttgtttttggtcccctaccccaagcaatgccccagagtgagaaactgatgatgggtgagctgtgtgcctgattttgtaaaatgggagaatgaggggtttgggaaagggaaggtaagatagggtaatctactcccctggagcactctcagacaggtcagttttaggagagggtacttggaaaagttgacatggaaattgatttactacctgtgtgcctgcatatcctttggaaaaccatgtgcttccagaagtttgcttatcccagtttgaagactattgtgatagtcattggcgtattttggcatcttaattttttaataagaatttctagggggtgtgtgtgtatgtgtcccttaaacttagaacactgctgaccaaggtaaattgtttatgctgtctagggtaatgtcttaggtctttggtcttgattgcatctatgcatctgtttataaattgtcttttcctgcgcatgagtctttgcaatcctaattctctgtaagttttccagatcaggagtgacacttgaactacctgtagcttatccccctttatatcttgtgctagtcttactcacattgactagtactttggcaaagcagatctaaaatagcttaatatagggaactacttgcaattttgagtaaacaacaaacaattggccacagtaagattactttctgcttcccggcttatttattttgggtgtcagtttataaaattacaatagtacaaaagactgcagatataatttatattaattctttagttttacagaaaatgaaactagagaggttatgccaattgcctgaagtcacataggtggtaggaaaaaagtagaacctatgtcccttaactcccagtattataacctttgctacatcacaccttctgctgccttttggcagattgcattcctcacctcaatcctatttaatactatttctcttgaggactgattagcttttagtgatgcagcattattttttaaatggaaaggcatttactctctcattgaagactttctcaaaacaaaaatgcttcttacccgctggcagacactttctgccccacaataggacccagctaggcaagcctggggccctctggccccaggcagtgaccctgggggaggaaggggatattaacaggtcagagtagaggtggattggcagagcgggggctggtgggaggtgggaagcttacatcatttccctgcaactgggctctggcggggctgtaaggccttactttcccctgtgtaatagtttaccagattgacagagattcatacaaggaaggaaaggtatggcaggatggatgttcacgctgtttataaatccttgctattagatgaaactgtcaataagtaactagaagcagccagtactgtctgtgcttcgctctctcccccagctgagttcctttctgctccgccccatccctgctctctgctgctcagatcagcttcctgcttctcatgaaagctgttcccctataaagctggtctgctttcactgaaagaattatattcataagtctgaggctggttttgtggaagtattgttggtttggtttcctttgggggatgaaggaggaggaaacaattttttttaaaaaaaaagtgggggcaggctgaaagagcaaaatcatcttgaattttgttgtcacatcgtgccggtgttataaccagctctgtagactgccgcactgaaaacatttctgtgagaggtatgtgcttgaaaaatggaaaggtgttggctgtggaacaaactgcccgtccagcagctgcttagatggctgtaaggtcgtaattctatctagtgttttgatatggaaagggtaatccttacttgaaacgtagtacagttaaccagcttaatggtaaaaaaggttaaatatgtgcttcgtccccacatcaggactcctgaaatgctggttcaggctgaaaacgtctagtcaaatccacagtgttattccaggctcttttggtggcggttgtctgtaaacaagatgatgatttttaatacgtctctcattatttatgaaccacatgacaaagattaatgagagactccaagtagcctagaagcttcagattcatgaggagctttttgcactgacagatggcaaaagtaaaaggaaatgggtgatgatttattgtaaactaaagtgaaagttttaaagtttttagagggtgtgttacatttaagtggaaaaatctggaggagccactaaaatttagaagcatagcctaaaaccattgatgcctgacctatattaaggccagaagccttttgaacacacatgcatgtatattttcaaaggaaattaagaaatctttatacatgtttttattcagtagtcagagaaaagtattaagaacaagactataaccaatacctaaggaagcatggagaactgtatattggttactaagaagccacattgttctgttatagaaagttttagaaatgtttgaagtaggaaaatatataacattttatcatgtgcgttagatgagctactagtggtagagaccattcaagctacaaagtagtttctgcttgatttgaattattttatcatggaagatactggagaacatttgaatgttagtatgttttaaatttattttacaaaacttgggaaattaaattgtttaagttaatttacatacaaaggtgctggcactgttcttttccacaaagacagtagtgcttaaatctttgaaaccttttattcatgaatagaatacactggctgttataacccaagctattacaaattcttgagagtgcgccatttaaatttcgtttcttctcaaatatttgtaaacaggagttaatcttcatgatcatagaggataatgttgggcctaacaagttaaaaatattaaaagttctagagaagacggaatctgggaagtaaacctaatacaggcctctgaggaggactcacctctacaccacagagagacaggtggccatcctgactgtccatgtgtaccttgctttactgtgcttcactttattgcacatcacagatactgtattttttacaaattgaagatctgtggcaactctgcctcaagcaagtctatcagcaccactttgccagcagtatgccctcacttcctgtttctgtgttacaatttggtcattcttgtaacatttcaaatattttcattattatcatatctgctatggtgatctgtgaggagtgctctttgttgttactattgtaattgttttggggcaccacgaactgcacccatacacaactgcaaacttaattggtaaaagttgtgtgttctgattgctccacccactggccgttcccatctttctccctcaggcctcccgattgtctccaacacaacaatattgaaattaggccaattaattaccctgtagtggcttttaagtgttgaagtgaaagggtctcatgtttcccactttaaatgaaaagctagaaatgattaagcttattgaggaaggcatgtcaaaaggtgagagaggtgaaatggtaggcctcttacactagcagctaaccaagttgtgaatgcaaaggaaaagttcttgaagaaaattaaaagtactacttcagtgaacacacaatgataagaaagcaaaacaactttgttgttgatacggagaaagtttggtctggatagatcaaaccagccacaacactcccttaagccaaagactaatccagagcaaggccctaactctcttcaatcctctgaaggctgagagagatgaaaaagctgcagaagaaaagtttgaagctaacagaggttggttcatgaggtttaaggaaagaagctgtctctataacataaaagtgcaagaggaagcagcaagtgctgatggagaagctacagcaagttatccagaagatctagataagactattgatgaaggcagctacactaaacaacatattttcaatgtggacaaaatagccttcagttggaggaaggtgctatctaggattttcacagctagagagaagtcaatgcctagcttcaaagagcttcaaaggacaggctgactctttttaggtgctaatgcagctggtgattttataagataaagccattgctcatttaccattccaaaaatatcaggactcttaaggattctgctaaatctgttctgactgtgctctatcaatgcaacaaccaagcatggatgacagtacatttgtttacagcagggtttattgaatatttcaagcccactgttgagacctgctgctcggaaaaaatgtttcctttcaaaatgtttctgctcattgactatgtacctagtcacacaagagctctgatggaggtgtacaaggagattaatgttgttttcatgctgctaacacagcattcattctgtagcccatggatctggagtaattttgacttcaaagtcttattatttaagaaatacatttcctaaggctacagctgctataaatagtgattatagtgattgctctgatggatctgggcatagtcattgaaaaccttctggaaagattcaccattctagatgccattaagaatattggtgatttggccagacatggtggctcacacctataatctcagcacttgggaggccaaggcaggaggatcacttgagcccaggagtttgagatcatcagcctgggcaacatagtgagaccttgtctcaaaaaatatatattggtgattcattgggaggaggtgaaaatatcaacattaacaggagtttggaagaagttgcttctacccctcatggatgacattgagggattcaagccatcagtggaaaggataactgtagaagtggtagaaatagcaggaaaactgaaattagaagtggagactgaagatatgactgaattgctgtagtcttacaatggatacttgaaccgatgaggaggagttgcttcttgtggatgagcaaagaaactggtttttcaaatggaatctacttctaataaagatgctgtgaacattgttgaaatgacaacaaaagatttagaccattatataaacttagttgacaaagcagtggtggggtttaagaggattgattccagtgtttttttgttttgttttgttttgttttgttttgttttgagacggagtctcgttctgtcattcaggctggagtgcagtggcacaatctcagctcactgcaagctccacctcccaggttcacgccattctcctgcctcagcctcccaagtagctgggactataggctcccgccaccatgcctggctaatttttttttgtttttagtagagacggggtttcaccctgttggccaggatggtctcgatctcttgacattgtgatccacctgcctcggcctcccaaagtgctgggattacaggcgtgagccactgtgcccagcctgattccagttttgaaaaaagtgtgtaaaatgctatcaaaccacatctcctggtacagatccatcttttgtgaaaggaagagtcaatgcattaaactttcttgtcatcttattttttatttatttatttttttgagacggagtctcgctctgtcgcccaggctggagtgcagtggtgggatctcagctcactgcaacctctgcatcccaggttcaagtgattctcctgcctcagcctcctgagtagctgggattacaggtgcatgccaccatgcctggctagtttttgtatttttagtagagatgggggtttcaccatgttgaccaggatggtctcgatctcctgaccatgtgatccaccagcctcggccttccaaggtgctgggatcacagatgtgagccaccgtacccggcctccttgtcatcttattttaagaaattgctacagccatcctgacattcagcaaccaccaccttgatctgtcggcagccatcaacatggaggcaagacccctcagcagcaaagggtatgactcactgatgatcactagcgtttttaaaatataagatattttaaaatttagtgtgtacttttttttttagaaataatgttatttgcttgcttaatatagtacagtatcgtgtaaacctaatttttgtatgcactgggaaaccaaaaagttggtgagacttgccttcttgtgatactggctttattgtggtggtctggaactgaacccatagtatctccaaggattgcctgtctttaccgtggtcattctcaagtgtagctgcgtattggaacccccagggaagtttttaattcctcccattgcccgggcctttcccgagagattttaatttaattgcttggggatggggcctgggcattgatagttttaaaactattcccaggtgtttctgatgtgtagtcagacttgacagttgcattgcctgaacattcctagtgctatagcagcctgttccgttttgggtactgtttgtatctgctttggtatgtgtcctcttaggtcggaactcttctgtcacagagcagctcatgacatatttaatatcatttctcctccaagacttagcttttccagcctaaatagtcctagttcctgcagtcttcaggacttattttctaggttcttcggtattctggtcactccccttcctggaattgctcttgtttgtcactattactcttaaatagggtacttttgggactgagcctatcattctagatgtctggggcccagcagaggatgcagagaatacagtaaagctgtaactccatggttctgtacatgacacttctgttattggtggccaagattacattagtttttttggcagtcatgtcacactgttgactcatgtggagctcaaagtcagctcaagcccttagttctttttcaagtacataaactacttaaatcaggcctctccttccccatgcttacatggctttcccacccccgccccaactttattgccagaatttacatttttccttttgaaacataagaggaaaacccagtggataagttattccacacagggagataatacatccaaactgaatgccagaaatttattacatgtatacagcagcaattttaaagaatgatctaggcccttcgtttggagccacagttaaatatattcttatttcagttcatctttacagtgtgccttttgattcattactcaaaactcactgttcagagttaagaatttacttgactgcgtagcttattttaatgtttgtattcagtactcggtgagatgccttttcacaatcaaaatacatgataaccattgcattctcctgacctattggcataacacctttattttaaaaggaaatgtgttgtatctatcataacattcttgattaacaacagaaggaaatattttgcaaatgagcaggtgatttgtgtacagttcactactgtcaagcctagaaccccaatctaactctgctggtccccacttcattactctttgtatcaaaccacagtagctgatgcaatttgtcatttaggataagacttcaaagaaaactaaaaggaaacaaaagcttccatggattcttcactttctatttttttttttgggggggggatttaatattaaaccccacagcattttaacatatagcccagtcatggatttgttattcactcagtgttctgcccaaagcaataaaaagaggagtaaaataactaaagtcaacattcctaaggttactgcagagaatagttttcttaggaatttgggcatccaaatttttactttccttggagagttagatatcccttccttctcctaccaccctctcaccacccaaacacacacacagttgatggtagagtaatatcgttttgttcttaataaatcacagtatgagaacttttgcatataaagggacaggcatgtatgtcccatctcctcattttgcagatgaagaaatggaagcacaggaagtgaaggcttgctgtagacatagtgcttagccagggtacttagtacataagacatactagtatgtaagacatgcttaataattacctggatgctgagcagctttcttcagtactattttcttgtccccaagctttttggattttacctttcttgtccccaagctttgctgttggatactcattgccttaactgttgaaaatggaacagatttttcaagaatacctattactttcgaaaagctccaatgatatagtaaaagttcagataaccaggtttatttttcctgctcttgacttttaggaaaataagctctttttctcccctttaaaaattgattttaaatagttgtagttaaaaaaagaggagtttccaaagaatgaatagcctagggtcagtttgtatatgtatctaacccaaatgttcacatctttgtttgggtccagtgagaaataatgttcacaacaatgcttatcctaatatatggtaagacccacggtcagcagtgggagatttaattatgttcactatattgtagttactaaagcaaggaagtatactctaatatattttaaaatggtttgcaatagcagatgtttgaaacaaaaaggcttcagaagtacatttagtcaatcagactgggctattccttcagccgtttggttaatacaggttgattgtgttccttcatagtttggaagcccctggttttattaacctgaggctggcatcatatcataataataccatgtgatgcgacacttttgaaacatccttggtttctctaccccagtatttccaaatgtctgtttcctattttgtagaatattttatattactcaattaatattggttatatttttacatggctatttctctctttttaaaaagtttttattttgaatttttgtgggtaccttgtagatatatatatttatggagtatgtgggatattttgatacaggcacacaatgtataataatcacatcagggtaaatggggtatccatcacctcaagtctttatcctttgtgttacaaacaatccgattatactcttttagttatttttaaatgtatgattaaattattgactatagtcaccattctgtgctatcaactactagatcttattccttataacgacttttttatacccattaaccatccccacttccccccactctctggtaaccatcattctactctctatctccaatggttcagttgtcttaatttttagcttcccaagattagtgaaaacatatgatgtttgtctttctctgcctggcttattaacttaatgacctccagtttcatccattttgttgcaaataacaagatcttattcttttttttttgagatggagtctcactctgtcacgcaggctggagtgcaacagcactgtgtcggctcactgcaacctccatctcctgggttcaggcaattctcctgcctcagcctcccgagtagctgggattacaggtgcccacctccatgcctagctaatatttatatttttggtagagacagggtttcaccgtgttggctcctgacctcaggtgatccacccgcctcggcctcccaaagtgctgggattacaggtgtgagccactgtgcctggtcaagatcttattcttttttaagactgaatagtattccattgtgtgtgtgtaccacattttctttgttcattcatctgttgatggacacttaggttgcttccaaatcttggctattgtgagtagtgctgcagtaaacatgggagtgcatgtgtctatttgacatattgatttgctttcttttaggtagtatatatctagcagtgggattgctagattatgtggtagctctatttttagttttctgaggaacctcccaaccgttctccatagtggttgtactgatttacattcccacctgcagcgtgcaagggtttccttttctccgtatccttgccagcatttgctgttgcctgtcttggataaaagccattttaactggggtgagataatacctcactgtaattttatttccatttctctgataatgagtgatattgtgtacctttttatatacctgttgctgtttgtatgtcttcttttgagagatgtctagtcagatcttttggccattttaaaattagattatttgattattttttccttaagagttgtttgagctccttatatattctgtttataaatcccttgtcagatggatagtttgcaaatattttctctcattctgtgggttgtctcttcactttgctgattgtttcctttgttttgcaagaaactttttgacttgatatgatcccatctgtccgttttctctttggttgcctgcgcttgtggggtattactcaggaaatctttgcccactccaaagtcctggcaagtttctccaatttttttcttttagtagtttcatagtttgaggtcttcgatttaagtctttaatccatttatccattttgattttatttttgtatatggtgagatataggagtctagtctcattcttctgcatatggatatcggtttcccaggatcatttattgaagagactgtcctttccccagtgtatgttcttggtacctttgtcaaaaatgagttcaccatagatgtatggatttgtttctgggttctctattctgttctatgtctatgtgtttgttatgccagctccatgctgtttggttgctatagcccagtagtatactttgaagtcagttaaggtgattcctccagttttgttcttttttgcttaggatgagtttggctagtctgggtcttttgtggttgtgtataaattttaggaattttttttctatttctgtgaagaatgtcattgctattttgagagggattatattcaatccgtagattgcttgggtagtatggacattttaataataccgattcttacaatctttgaacatggagtatcttttcattttcttgtgtcctttttgatttcttttaccaatgttaaatagttttcattgtagagatctttcacttctttggttaaattaattcctgtgtgtttaattttattcatagctattataaattggattacttttttgacttctttttcagattgttcgcatatagaaatgctactgattttagtacactgatcttgtatcctgcaaatttactgaatctgtttataagttctaatagtttttgggggaatctttaggtttttcaaaatatatgatcatatcatctgcaaacaaggatgacttgacttcttcctttccaatttggatgccctttattgcctaagaaacttgtctgattgctctagctaggacttccagtactcttaacggtggtgaaagtaggtgtccttgtcttgttccagatcttagaggaaaggcttttagttttttcatcctgttgctatgatgtatcacactgattgatttgcatatgttgagccatccttgcatccctggggtaaatcacacttgattatgatgaatgattttcttaatgtgttattgaattaagtttgttagtattttgttgaggagttttgcatctgggttccttagggatactggcctatacttttctttttttgatgtgtctttatttggttttggtatcagggtaatactggccttgaagaatgagtttagaagtattccccatctcctctattttctggaatagtctgagtaggattagtattagtatatttggtagaattcagcagtgaaaccatcaggtcccaggcttttctttgctagaagactttattatggctttgatctcattacttgttattggtctcttcaggtttggaatttctttatcattcaatattggtaagttgtatgtgtctgtgtgtctaggaaattatccattttttctacttttccaatttattgttttgtagttggtcacagttgcctctagtgattctttgaatttctgcggtgttggttgtaatgtccttttcatctcttattttatttatttgattattctctttttttcttagcctggctaaggtttgtcaatttatttatcttttcaaaaaaaccagcttttcatttgttgatattttgtattgttttctttatttcaatttcatttatttctactctgatctttatttctttccttctactttaggtttggtttgcccttacttttctgatcctttaagatgcatcaacatatagtttatttgaagttgttcttcttttgattgtaggcacttatagctataaaattccctcttagtactgcttttgcttgcatcccataggttttggtatgtttgtttgtatatgtttccattatcatttgtttcaagaaatttttcaatttccttcttaatttcttccttgacccacttgtcattcaagaagatattgtttaatttccatgtgtttaagtttcttttattattgatttctagttttattctattttgtggtcagagaaaatgcttactattattttgaaagttttaagatttgttttttggcctaagatatggtttattttttagaatgatccatgtgctaaggagaagaatgtgtattttgcagctattggatgaagtgttctgtgtatatccattaggttcatttgatctgtagcatagattaaatccaatgtttctttgttaattttctgtccagtgctgaaagtggggtgttgaagtctgcagctcttattggggtctctctctctttctctttagctctaataatattttatttatgtatctgggtgttccagtgttgggtgcatatgtatttacaattattagattctcctgttgaattaactcttttatcattatatagtgatcttctttgtctcttcttctagttttggtcttgaatactattttgtctgatataggtatagccactcctgctccttttctttggtttctacttgcatggattgtctttccccacccccctggctttattttcacccttcatgtgtctttatatgtgaagtatatttcttataggcaacagatcattgggtgttttttttttttaagcatttaatcactatgtcttttgatgggagagtttagtccatttacatcacatgttattattgataagttaggacttactcctgccattttgttatttgttttctggttttgtggtcctcttttcttttttcccttacttttcgtcttccttttagtgaaggtgattttcactggtggtatgtttgaatttattgttttttattttttgttcatctgttgtatgtttttagatttgaggttaccatgagttagaacctattattttaaactgataacttaacactgcttgcctaaacaaataagcaaaatgagaactattaaaaactgtatgctttaatttcatatccccactttttaacattttgctttttgtatttatatcttattgtacgatgcatgtcttgaaaagttgttgtatttttcatcactttatcgttttgtctttctacttaagatcagtgtctttatgcaccacaattacggtattataatagtctgtgtttttctgtgtactatcaaccatgagttttattccttcaaatgatttcttcttgctcataatgtctttttctttcagattgaagaacttcctgtagctttccttgtaggacagatctggtgttgaaattcctcagcttttgtttgtctggggaagtctttatttctcctttatgattgaaggattattttcaccagatatactattctagtgtaaaagttttttgtcttaagccctttaaatatgtcatgccactctctcctggcttgtgaggtttccactgaaaagactgctcccagacatattggagctccattgcaggttatttgtttctttcctcttgatgtttttaggatcctttctttacccttgacctttgagagtttgaatattaaatgccttgaggtagtcttttttggttaaatctgcttggtgttatgtaactttcttgtacttggattttgatatctttctctaggttaggaagttctctgttataaatccctggaataaactttctacccctctctttctacctcctctttaagtgcagtaactcctagattttcccctttgaggttttccagatcttgccagcatgctttattctttttttctttttgtctcctctgattgtgtattttcagagagcttgtcttcattctcactaattcttctgcttgatcagttctactatttagagactctgatgcattctttagttggtgagttgcatttttcaattccagatttttgtttgattctttttaattatttcaatctctttattaaatttatctgataggattctgaatttcttctctgttattttgaatttctttgagtttcctcaaaacagatattttgaattctgtctgaaaggtcacatagctctgtggtcacatggttctgtctctccgtgcttggcccctggtgccttagtttgtttgatgatgtcatgttttcctggatggtcttgatgtttgtggatgttcattggtgtttgggcattgaaaagttgggtatttactgttgtctttgcagtccaggtttgtttgtacctgtcctcattaagaaggctttccaggtattagaagggtcatgggtgttgtgatccatttttttgtcactgtagttgtatctgtattagggggcacctcaagcttagcaatgctgtggttcttgcagatttgtagaggtactaccttggtgatctcggataagatccgaaagaattctctgggttagcaggcagagactgttgttctctttccttactttcccccaaacaagtggaatctctttgtctatgctgagctgtctagagctgggggatggctgacacaagcacccctgtggccaacaccaccggaactgttctaggtcagacctgaagccagcacagcactgggtcttgccgaggcctgctgtaaccactacttgtctactgcctatgtttgctcaaggccctagggctccacagtcagcagatagtcaaggcaggcagtcttgtgtccttctgttcagggtggcaaattcccccaggccctgggtgggtccagagatgctgtctgggaaccagagcctggagtcagaaacctgagaggtatacatggtgctctattttactgcagctaagctggcactgaaaccacaagacaaagtccttctcactcttccctcccctttccccaggcagaggagtctctcagtgtccacaaccaccaccacagacccatggagagtactgccagggtactgctgatgttcacttaaagcctcaagcgctctttagtcagcttgtggtgaatgttgccaagcctgggtcttagtctgtagggcactgggctcccctctggcccagggtaggtcagaaatggaaggctattttttttttttttttgagatggagtctcgctctgtcgcccaggctggagtgcagtggcgcatctcggctcactacaagctctgcctcccgggttcacgccattctcctgcctcagcctcctgagtagctgggactacaggcgcccgccaccacgaccggttaattttggctatttcttttatctcgtatcctaaaatacattcctgttatccttttattattttgatttctcataatgatgcttttaatcagatgtttttaataggaaataaaatttgaatatatacacaaccatgatgaaccatgtatgtatgtgtgaactatacagaattgtacagttgaaaactgtaacgtatgacaaatagataaagtataattactagtagaattagttaattcttgagtggtacttacaaagtattcatattaatttgaaaacagagataggatatcaggggaaaaaacccatccatcacattggggaatagattcaatacatatgctttttgttgtagaattttaaaatgtaaagatttaaaaccctaacctctcaaaattattattcagagattgcttatagacctatcttctaaagcttccaacaaattattttgtacacggcacattgcaacagtcattttcctattttttcccttgttgtttttattattactgttaagagactgagtggagctcaataaactttagaaagaatgctgtatagctgaaattcagggtcaacataccatggtttttttttttttttttttttttttttttgagatggagtctctctctgtcaccaggctggagtgcagtggcgcaatctcggctcactggaacctccgcctcctgggttcaagcgattctcttgcctcagcttcctgactagctgggactacaggcacacaccaccacgaccagctaatttttgtatttttagttgagacggggtttcccccttttggccaggatggtcttgatctcttgacatcatggtccgcctgcctcggcctcccaaagtgctgggattataggcgtgagccaccgtgccctgcccatgtgttaatttttaaacagtgaacttaaaaacctctaaaaattttgtatatatatgaatactttagcaaccagtattcataagaagtaacagttatagtttaactgtgaatgacaaaggctgttactagaattattattattgtacttcatatttagaaagcttcacccccacccccccaaaaaaaatggatgtcaagtgactatccagttaggcccaagttaacctaaatatacatgtgacttatgtatataaatagaatatagttcttccttcttctctgtgaagattctaggacccctgtggataggaaaatctgaagatcctcaggcccctgatattaaatggtgtagtattttcatataacatactcatgtcctcctatattcttgaaatcattctagattacttctgatacttaatacaatgtaaatgccatgtaaatcattgttatactgtattttttattgttatcttttatttttaatatattcaggctatggttggttaaatctgtggatgtgaaacccccagatctggcagactgactgtatattaggtagattggtctgggagtggtaggaggaaagtgcaaaggccctgcagggagaatatcagaataccttggagaaactagaaaaatcttattatggctggagtttagaaatgaatgtgaagagtggcatgatgtgggtggaaaccggactttgtgggattttgtgtgctttgataaggatttctataagcacagtagtagcagtgaaaagttttaagctaaggagtgaggtgtttggatttgcattttgtaaagatcagtctgtttgccaggaggaatgcttttgaggaggggacaagtagagctacagaaatcagctaggagactggtatattggtgtttcaacaagctggctgtgttgaggatgggaagaagtggactcattgaccatgtatttaagaacttgagttaatggtgttttataatttactagtatatatgagaataagaatgagtaaaccagacaccagcttgagcatctgggtgcattggatggtaatactgacgtcctaagtccgttcaggctgttagaacaaaataccatacactgggtagcttataaacaacagaaattaatttctcatacttctggaggctcagaagtccaggatccgggcatataaggtgtctggttcatagatgggattttttttgatgagtccttacattgtagaaagagcaaggctgctctctggggcctcttttataagggcacttaatcccattcatgagtactctaccatcacgatctaatcactacctcaaaggttcaactccaaaaaccataaccttggggcctaggttttcaacctggcaattttgaaggaacacattcagaccatagcaagtgacaactactgaaacagggaaagatccaagggaagcagatttgggagctgtaggggaaaatactatgtttcaatgatcgagcttgaaatgcctctcagatacctagattgagatattcatttaaaagtaaaatatgcctggacttcagaagagtggtacgggcttaaaatacaaatttggcaatcattggcatatattaactgaagcctttcagaatgaataagaccagattaggaggaatgtagagctagtaaaagctctatttggtaaccttggcctgaggcccttcaaaggaggcagtccccacccatggaatgagaacctaggagaagcacacgctactcacctgctttttttttttttttttttttttttttttttttttttgctgttgttgttgttgtttaaaattttttttaactaaactttttattttgagataattttggattcacatgtcgttatcagaaatacaggttgagcatcccagatctgaaaatttgaagtacaaaatgctctgagattcaaaatttttttagtgccaacatgattctcaaaggaaatgctcactggagcgtttcagattctggatttttgaattcggtatgctcaaatggtataatgcaaatatttcaaaatgaaaaaattcaaaatctgaaacacttctgatctaaagcattttggacattttggaaaagggttactcagcctgtaatacagagagatcccacgtgccctttacccagattcttataataggtgcatattcagtttttgtttttgtttttgttttaaagaaacttccaaatggttttccagaatggctgtgttttcattcccaccagcagtatatgaatgatccagtttctctgtatcctcaacagcatttttggtgctatcgttttttgtgtgtgtgtgtttttttaaacaacttaagctgtttcagtaggtatatggcaatctcattgtggtttgaatttgcatttttgtgatgcctaataatattgaacatcttttcatgcatttatttgccatctatatctcttttggtaaattgttcatgtattttctcccttttctaactggagtttttcttactgttgaattttgagtgttctttatatatcatcgataactagcaccttgttatatatgtggtttgcatgtattttcttcatctgtagcttgtcttttcatcatcttcttagggtatttagaaaagcaaatgtttcaaatttcaaagtccagattactaattttaccttttatggatcatgcttctggtgtcaagtccaataactcaaatttaactagctctagattctaagattttatcttatttatttttcttaaaattttatagttttgcattttacatttaagtccatgacccatttcaagttaatttttgtatgagttgatctcaggtcaaagttcctttttttgcctgtgtaagtctactcgctgtagcacagtttgtgtgaaaaggctatccttcctccattgaattgcttttggacctgggttaaaaagaaggcaggcatatttggtgggtttctttatgggttctctatgctgttccgttagtctgtgtgtctgatcgtccactgatactacacattcttgattaccatagctatgtaagtattgaaagcaggtagactgactcctcacactttattcatttttttttcaaattgttttagctattctagttcctttgcatttccatgtagaatttagaatcttgtctgtgttgctgtgtctacaagattataggatgtgtcaaatctgtatatcaatttggagagaattgccatcttcgctatgtttagttttctaattcatgaacactgtatgtctcttcagttactgagatctcccttgattttttttccatcagcattttacagttttcagcatatgtatcctggacatgttttgttggattcatgtttaactattttttatttcagctattgtaatcttcattttagtgtctacatgttaaaatattttaattttgatgtccacatgttcattgctcatatgttaaagtacaattgattaaatataatatttaactggtgtcttttgactttgctaaagtcattcattttagaagatgtttttgtagattccttgggattttctgtatagattatcatgtcatctgtaaatagggatcgttttgtttcttctttcaggtctgtatgcctttttttttccttgacttattgcactggcttgcacttccagcactatgtgaataagagtaatgagactggcccttcttgttcctgattttaggaaaaatatattcagtatttttctcttgtagtgttagctgtaggttatttttagatgctcttttaccaagttaaagtttcctttgattcctaacttcatttaagttttctttttatcatgaatgggtgttgaattatatctaatatttctatacatcaatatgattatatcatttttcttctttatcctgttaatatggtggagtacattccttgatttttgaatatggactcatccttgtattcctgaaataaatccctatttacgttgtataatttcttttagatatttctgaattccttttgcttatgttttgttagggatttttgtatctgtattcatgaggaatattagtgtgtgtcttcttttttggcatcatctttgtctggtgttagttcgaaagtaataccaaaattgtttttctgttttcaattttactgatttctgctgtttcttcttttcttaatttctgcttatgttaggtttattttgacttttcttcaggtacctgaggtgagaatttaaattattgatgtgcatgatgtcctgtttcaaaaaaagtatttagtgctacaggttcccgtttgagcattgcgtttcctgttctactcatgttgatatgctatattttcatgttcacttgtttcaatgttattttctcccccttgaaacttttgacccatggattatctataagtacgttgtttagtttccatgtgttggggtattttcctgttttctttctgttactattaataatttctaattttatgcccttgtgactaggggagccactctgtatgacttcagttcttttaaaatttgttgaagaatgtgttttatagcataacatgtagtctgttttggtttgtgttccctgggcacctgaaaaagaatgtgtattctgctgttgggtcagatgttgtgtaaatgttaattagatcctgtaggttgatgatgttgagttcttatatatcctttctgattttctaattgttctgtcaattgctgagagaaaggtgtcagtgtttcttactatattgtggatttgtctgtttctcctttcggttctataagtttttactctatatattttgtagctccatctatgcatacacatttaggattggtatattttcttggcgatatggcacttttatcatgatacagtgtttctgtctgtgatcattgttttttgctctgaagtctactttttcctattaatatagcactcctactttattttgattaatatttgcatgatataccgtttttcttcttttactttcagcctacctatgtcattatatttgaagtaagtttcttgtagatagcatatagttagatcatttttttaaccactgccagtctgacttttaattggtgcataaccccataacccctttatgtctctttacttcctccattggtaatataatcgtcttaaaagctttctttaacacatttagatccacagcagatagtattctaatttgtttcagtcatcaaacataactgtaaaattcaagagaaggaaaacttattatatttacccatatttttgtttaccattttttttttgtcctttctgatgaatatcaggttttttctttcactttttcttctccgtttattgaatgtttttagctgctcttttagggtagtcttttggggaaaaatatccatgtttttcttcattggagagtgtctttattccctttccattgctgaagggtattttcactgggtataggatcctggatcgacagtccttttcttttagcactgcagaatgtgtcattccttctgacctctgtggtttctaatgaggaatctgtcatttgaatgttattcccatataagtaaggtgtcttttttctcttattgttttcaagatttgagagggaggggagatgattaatttccagaagtttgactatgttgtgtcttggtatatatgtttctttgccacagttgggaagttttcagccattatttgagtactttttcagccctgctctctttcttctctcctttctggattacagtgacatggattttagttcttttgttactgtttcataggtccctgaggctctgtttatttttttcaatatattttctttctttggctcagattgggtaatttcttttgttttattttctcctttactgatctttttgcctctgtcccctccattctactgttgagcccatttgttaaattttttattttggttattgaggcttttagttccaaaatttccatttggttctactaatatatcttctgtttctttggggagacattttatgttttcatttgtttcaggcacggttgcttattaaaacatttttatgatggctgctataaaatctttgtcagataatctaacaacactttcatctttgttttgttgtctgttgattgtatttcctcattcaagttgagatgttcttggctttggtatgagaagtgactttccattgaaacctagatattttgggtattatgttgtgagactgtggattttacttaaacctcttgttttagtggtgccttctgagactgctttagcagcatgaagaggatggcgctgtcttattattgcaagatgagaagtctaggttctcacctgtcctccattgacacctgagtggaaaaaggagtttttcattcctgctgggcaggggcacagtctacctttcaccagtaggcttctgctgatatcactctaactggaagggataggaatgactcattactgttttatacatggcctttactgatactatggatgtagaggtgggaaagggggaggtggcctctttactactgggcagtggtcaaaatcctgctacttcactaggccccttctgatgccacccaaacagggagaggagagagacattattgctgcatagggggttggaaattctgtgtcgccacatgattgatttctgcggagtgtgtgtgtgggggggtggggggagaaaatcggaggtcactacttttgcttctctaccaccccctcagtattggggttgtggctcatctttataacctggccagggtagaagtctaggtttagtcctcaaccatagccagcattggttggtgaagggccacagttttttttctgtgatgattggcttgtatagagcagttactgtctaaaagttttctgtcttgctatactgctcctttcctgctcctttggctagagaaagctgacttttggggggagctggcttttttgtctgtgccctgttggcatttttggattgccagcttcttcagttcgaagttgcagatatgtgaagtgaaaggaaaatccaggaaacgtaccactgtgttgtttcttgggtccccaaagtcccgagcttctctgccctttttctgcctttcacagtcttcttaatgattgttttatatataatgtccagtatttaaaattctacctcatggatatgcacatgtttcatttttctggaagtggaatttattcacctgctttttaatgtagcagagaaaataaaaatgctgcatagattacattataaagaatatagcttagaactctaggtagaattattaacattggaatgggtctttcaaagacagtttgtcatctcaggtaatttagatatcgttcagcttgaagacctgagttgctgcctggtgacaggcagtgacatagtgttctttgattttctttccatgtgctattttggtcttggttttgtatatacagttaaagcaggaagcatattgggtaggattatacctttgtaagtcattttcagcactgatgcagttcggttgatcctactggccttcagtgccacgggccaaatttatttcaatcaatgaactgatacagctcatcccctttaaatactcttattcatagatacaccagtaatttgtttttctaggtttgctttttttaaacatggggcctaaaaaaactttaatttttcgattaccagcagtaatactggctttttgtgtgtatcattctgtgaagtttaaaacatgtatagatttcgtgtacagttctttgttaaaatttagaaaagtttcatcacctgaaaaaattctcttatgtttttcatttgtagtcatactttcctcccaaccctaacccctggcaacccctgttctcttctttattactgtagttttgtcttttgggggcatgccatataaacggtgtcacgtggtatacaaccttttgagatcgccttctttcactcaacataatgcttgaggttcatccacattgttgctttatatcaacagttcatttcctttctgtgcttatcagtagttcgttatatgtaactatatatatgcagtttatttaccccttgggttgtttctactttatagtaattgtgaataaatacagtgtaaacattcatgtacagatttttatgttagcgtaacttttgatttatccagggttaatacctaggagtgggattgcatacatatcctgtacatgcgtgtttatataagaaatatccagattttttcagagcagctatgccattttgtaccccacctgtaagccctttatctttctatccttttcaacagcatttacctttacttgttagagaatttttataaagcctctttaatgtctttatcaggtagtttcaacatctgtgtcattttagagttgatatctgttgcttgagtgtcttttttctgtgcaaattgagatttttaaatttattcatgtgttgattgattttgaattttattctggacattttaattgttatgagactctgggtctttttttacacatcctgtggaaaacattgagattgtcgttttagtagtcagtcaactcagttaatttcaggattcaagtttgatccagccctctgtgacttgtggttcctatgtcagttcagttttcaaagtcttttcagtgttatttgaatttgtcccacttatttgccacccaatggccagtttgggaatttggcagtgctctgatcagtagttcagcactcagtgtctgcctatgctgtttaggatcagatccatgcttgtgtagcttgggtgagatgaagagttcataaataacttgaaggaatcacttccctgagctcctccctctctgccatcgacgcagtgctttgtttttggttctctggttaggaagctggagtctttaattactgtgatctgctgtacagtttccatgattgtgcccctacctggggacaagcagtgggatgataaagaggataaaaacaacaggggttagccttaccctcctgggatcagtattccgtcagtcagagatgaaggtttcccactttcagaatttttgctctctttctgtggaccctggttttttgtgccttctttctacctccacagaaatatttgaggcccagcatgtgaaagaatagagaaaatggtacttcaaattttgttgttcttcctctattcccttctacttttagctgccacatgcatcttgtccaggttttatagctacttttcatgggacagacaaagtgaagtgtgcttattccttcttactcagaacctgggatccagtggggttgctttagtatggaaatcattaacaggaagagcaggagtagatccaggtttcatggggtctgaaggttgtataatttggagaccctctttaagaaaaggaatagaaagttatgaatatgaaattaagtacactatttagaaggggtcatgaaagtgaagacccctgaaacttaaagtttcattggttttaatataaacctgcctttgggaaaaagataaaacataaatactgattatgggttgggcactgtacagggtgattttaaattcatgttttcacttagtattcataaatataagaatgtaacctattttactccctattttacagactctcgtctgtaaagcagatgtagagtagtaatactgtatagatagaagtgttagaattgacttttaaaactcaaatgtggcagaattccaaagcaccttatcttttgaccacccatcgcactttatgaaagagattacagattataagcatcaatctaggctcatggttgagtctgctcagaagccaggctgccagggttcaatcatgtctctgctatcagtgtaactccgagaaagcttctcaacccttccttacctctgcacctctgtaaaatgggtataatagagcctacctaaggggtggttatgaggactaagtggttaatgtaaagcatttagaatacctctggcatatagtaagtgctttttatccattacataaaacaaggcatttagataaattatatcacactttctttgctgtgctcatcagccttgttttttttgtgtgtgtgtttaaaaatttttatttttttatttttttggaatcctttttgctttggattctataggctaataaacatcatatttacaagcttaaaagcaaaaaatatacagtgtatgaaaagttatttaaaaatgctgaagggcgtaataaaagtattagaacagtttttatcactaaaaatgtataacatattaatagaattatcatgcaatgcgggactgatttcttttagttaaaagtagttggtcgggcacagtggcttatgcctgtaatcccagcactttgggaggctgaggcgggcagatcacctgaggtcaggagtttgagactagcctggtcaacatgatgaaacaccgtctctactaaaaatacaaaaataagctgggcatgatggtgggtgcctgtaatcccagctacttgggaggctgaggcacaagaatcgcttgaacccgggaggcggaggttgcagtgagctgagatcgtgccattgcactccagcctgagcaacagagcaagactccatatcaaaaaaagaaaaaataaaaagtagtttacttaggagaataacattcatagtttgctcctgaatttaggcaaatggtaattaggctggttataaaattcttaggccatgactgataattctattattttattttcttctagcattgatttttggagaaggtactgctaaagctagctgattttaaataatttcaaagagagttgctggacaactttggaatttcttctttctgcctcattagctttttgttctctttctgagacttaagagttagactttactgtatctcctgtatctcttaccctctattctgtaattttatacttttatctctacatgattcattttgattgttttattccagttttgcttctggttcactaattttctcctcagctgtgtataatctaattttattattttttttgggacagagtctcactctgtctcccagtctggagtgcagtggcacaatctcagctcactgcaacctccaccacacacacagtagcgattctcttgcctcagccacctgagtagctggcattacaggcatgcgccactacacccagctaatttttgtatttttattaatagtagagacggagttttgccatgttgtccaggctagtctcgaactcctggcctcaagtgatccacctgccttggcctcccaaagtgctgtgattacagatgggagccaccatgcctggtaatctaattctagattcatccattgagttttttaacatcagttatttttttgtatgtccagaaactctggttttgttttgtagtttctttttctttgttaaaattcttaaatttgttctggccttttggacataaatgcttatagtctgtatataaaaacttcaccatataggtgccttcatctaggtcccctgtagctctagaactgttgtcttttatttctctttgtttttattttatatgtaatttcaacttttattttagattcaaagggtatgtgtgcaggtttgttacatgtaagattatttaaattgacaaataataatcgtattttttcatggggtacatagtgatgttttcatacatataatatatataccttacatcttgagttacaaagacaagttatgaaaaaaggggattttcacttacttacacataagttctggacatattacatgcttggcacacaagctgagacatgatcattggtaaaataggctccaaattatacaatcgataatatattttctgtcaacaattttaaagtttttctaaaagtttaggaacattaatctatttaacaagcaaagctagaagaaacatgttctatatgggtgactggaaaatctgagatattataggttaaatgttttggtgaaatgaccaaataatgacaaaaagagaaaaaacagttcaacaaaaagatattcctgttcctagcatatctgataccttcctgggcttttctgtaaaataaaaatagttgtagtatcaatctgtattagttatctgttgaagtgtaacaaattatgtgaaacttaaaacaatgaacattcattctctcacagtttctatggtcaggaatttaggagtcacttagctgtgtgattctggctcagggtatctcatgaagtacagtcaagatggtggcttaggctctattcatgggaagccttgactaggactgggaggatcacttcaaggtggttcactcacatgcctggcaaggttgtgcctggcttgcaggagagcttatgagtttcctcaccatgtggacctttccataggattttttttttttttttttgagatggagtcttatgctgtcacccaggctgtagtgcagtagcatgttctcagctcactgcaacctctacctcctgggttcaagtgattttcctgcctcagcctcccgagtaactgggattacaggcacccaccaccacggctgactaatttttgtatttttagtagagatggggtttcatcaaatttgccaggctggtctcaaactcctgacctcaagtgatccgcccgtcttggcctctagtgctaagattaaaggtgtgagccaccgcacctggccttccataggacttctaaatgttctcatgacattgcagctggtatttcccagagcaagtagtccaagagagtagaagccacaatgtcttgaatgatctggcctcagaattcttactatcatttcttcagtattttactgcttacacgggtcagccctattcattgtggaaggaagtactactaggaagtgaaaattattggttgggcttactggctaccaccttatcttaccggattactgtagcaattaaatgagattattccagtgaaggcttctagaacctagtaggtgctcattgcaatacctgtttgattagtgtgtttcctattgatggtactgggcagaagaaatcaatttctggctgtttcccaaatgcagaggcttatgtatctctatgaagaagagatgaacactgatctgtggccaaagagattaaatgttgagattgttattgtaattggtagtttgtttagaagcttgattggttgttatttaggttatttaggttgttatttaggtagtagcaattagttttgaggcaagaatattgataagtgctggaagctacaattttgacccacagtgaactctttaatttgattaccacctagcatgtaatcattgaagaagaataatgcatttcaagtgttatacatgcattttttatgattgaatatcatttaaacttttactttctctaagtttaactaggttcaattttttttttcttttctaaattgaccatatctcactattgatagtgatataggtatggtttccttatagaggacactaattatttaaaaataatatgtaacaagaatgtaaaatagttatttttatatgttgtaagaaagaaagcatgaactttcttatttaatgtttttctctaaatgaatttttctttagtatctgaaagagttgcttcttttttcttagaatgcctgttttgattatgttttcaatgagtttttttctcactatagcaatgaataataagggaactataatactggaaaatgtccatcattttataaaatctagagtctgattacatctggttatttgtgaatgaaattaactgaagcaattatcttctttaaacataggaataaaacaagttcataaagaggtggtacccatggcaatcagtagactatcttgatttatcatggtatttataagtatttggccactggagggctccatattttaaaaaattataccaaagatataaatgcttactgtaccaactttaaagatagaaattctatacaattttaaagtatagaaaggtataaaggattccatattttggagtagaattgctaataagtaaagatattgaattaaaaagcagctgattataaatgaaaattgtgtgcatgtgcaaataaagtgtatttatcaagagtttgctttttttattgaaatgaaaaaaaaacatattacccaatttttaaaataaaatatctctcaactcagatgtcaaaatacaaaactaatcatttgaagcctctcagtaaagaaagaagttgaaatagattaaataatttttttctcatatcttttttatatgtaccattttttatatgaggaaacctttttttaaggattcattgagattattatttccatttaatttaagaaaccctccagttatcttagtgacataatattaaaattcacagaacattaggacacgtgaaattgaaccaaacataaaataggtgtgtcatcaaatagttggttatcactgatttttagggttttttaatacttaaaattagtatttctttggtcaagatgtgcaatttacactgtcttgctctgaaaattgtccttcacagcttgtttttctttattaaaataaaatgggaacttataggggtgagagattagaaactccatgtattagtacccgagagaagcatctttttgcctagagaaattctagatagtaaactacatcatgtttatcacaaacagcattttttatttccttgatctttttccacttgaaagaagtgttttgatttctttgtaattgtgaagtgtttactttttaaatgtttgagctgagctctgggaagcttgcaatttctaaggtagttagttaagcttcccctccccacccataaaatttgggtctctttgtactcagcttgcagagctgagaatgtgtgttttgggtgatttgagtagctaagttctcaggttgttcagtagctttttccgttagaacctcctcttcacaaaaggaagatgagatgcaaattaattgctactgaggaggaaacaaaacaaaataatatgaaaagcaaacaacttccttacaatttcacttgaaacctatccagggtccatgaatatataaatcccaacttatttctacatagaagggccaactatttatatagggacaaagataccgatgaattatgagagaaagctgtccctaaattagtacccattatgcacatgatgttgagcaccattgtggaatgatgtttgaagctactgtgaaataactgggcagcctcacagaggatatattccccctcatctcccctgctcattggtatgttaaagatgataaccaatgtcattaacttttggccatgggatatgttttttttttccttctacaaacacatcattcagtgccaaacgtgttccatctatttaatagtaatcatggcatacttctggttggagcttagtggtcacacagaaattttgccctcctcttgcagccacagaatgcattcttaatatagtcagctgagttgcaaaacatgtttatcaaatgtggtggagaacataggaaagggcatgatgaaccaaccacatctcttccttattgctttgtgaacgtaaggacagtttcacattgcgtattttgagactttcctccaacaccattttttttaatacacagatccattcaaatatgtggcataaactggtgagatgcgtgtctgtagaggtacagtcttgctataaaagagaataagcctaactggtctgattcaatattacctgtgaccgttttaaaccctccactttagtcctctgagctcatcagtcacaaatactatcaatttttaacacttagttgttatcacttcagtccttctatatccatagcggttctcaagtctgacggcaccttagaatcccctggggagcttttccagctctggatgcctgagaccaatgttcaggattattctgatttaattggtttaggggagagaatgtgtggttatctgcatattttaaagtgtctcctgtgattgtgttttgtagtctagcttgagagtgattgattcaaaaataattgtggaaactttttgaggttcctacagattgtgagtagttaaatgtctcagagtaaatataaggactctttatatttgaatatgttctccctcctcctccccactcctttgcacgatgcgaggggggaactctggtattatttggttgctgtcattgcctaaactattttggacttacatttctggggtggaagtggggaaaatgacgttcagttttcagatagaatttgccccgacccagtgagtttgccatttctgttgcctgccaaagcaatgagcttatctttcatctttaaaccaattctgacagaaaataggatgtgatctggccaaggaaacataattcagtgcgtaaaacatgttttgagtatagagatcttttgagagatcttctgaaatgtgtgggattataaggaaaagttgtggaggaacagtgtacacagtagacaggcatgtgctgtcgggatggggtacttgaggattagcttgcccagagagcaggtttagaccaactcctagaaatactcaacagtgtcagtcatgggcaagggtgatgatgttcatgtttctttcctaactcttctcacaatgaaaaaggaactgtcaaaagccatgctgtgaaggttccctgagatttcagcccatgggcccctgatttccctattctcttttgaggaggaccctgggtgacatctcttcaccataggtttagtggtgtgcatttagatgactcacagatcttcctgtctgctcaaactttttctgattcattaattataacaccccatgtcaaagtgatcccaaactggatctctgcctgactagaacaaactgtttagcttgctgctcatcctaatcacctggacaggagtcttttccattacaatagagaaattaccaccttgtcactctgcccagccttctaagcctttgggctcatttttaggctcatcctaggcacatctgactatagcctaatcaaacatacctcataaagtgcccgggcaggcacttggataaaaaatagtgaagatgtttagattaaaacaaggaagaagaaaatcactgtagaagatacgtgcggtgggagaaagtgaagtgttaggataaaattcaaagtgtcaagtaagtctcccagtgtaggtcatctagaagactttaaccaaacatttttgtgtttgatacatagtgtaagttttattctggcatgtttgggttaaaaaccattctccttgcttagaattagttaaaaaaaaaaacactaaaaataaaaatctaattaacttcagacaggttttggggttctattttgtttttaaagtcatcatcatttttgtgggatctcttacctagaaatatattaccagtgcatgcattctttttgctgtttgtggattatttatgacaacctgatgacatttcagttccaggtcaattttccttagctacggaagactctttaacttctctgcagttgatacttttctgccttgtgtcgtctaagaaatgtaaaattgattttacttttaaccataagaaatgtaaatagtagttacattaaatgtgttatatttgaaaacttaaattatttttgcatatatttatatcattttaagaaaatgtatttatgggagaagaagatatttcaaagtgatttgaaaatggttttcagaattcttaattcagttgcctttctttagcactggcaatcaagagctggctcacaggtttcaatttcagatcctagtgggaacctctggtggaatcttagaaatgctttttttgttgttgttgttgttgagatggcgtctccctctgccactcaggctggagtgcagtggcatgaccttggctcactgcaacctccgcctcctgggttcaagtgattctcctacctcagcctacccgagtagctgggactacaggcatgcaccaccatgcccagctaattttttttttttgtatttttagtagagacaaggctttaccaggttggccaggctggtctcaaactcttgacctcagataatctgccagccttggcctcccaaagtgctgggattacaggcgtgagctaccacgcctggccttagaaatgcttttacatatttattagtacttttagtttttgaaagtgtctaggtgtgtctacttgtaatctatttgaagttaatttttataaaggaaatatgattttttaatttagggttgttggaattttcttttattgcttttatgtcagatgtttggaataaccttaagagaagggttcacacaataaaaatatgtgattacaaaaagagctcacctgttatcaaagtagttatctgtatagtggaattttaactgaaagggaatgtcccctggcaggagaaaaatggtaaaatcccttagcaagtcaattataaggcatgttaattctacaaagatattaaccttatgatcttcaattctggggtgcattctctaccctgcaaggtcagctaaaaatatgctgaaaagcaaattttataagataatgaaataaaaatgtgaagctaagtctgtaagatacaaattagaagataaaatcccttgttaaatgattctgacaaatccttttgctcttttacaattagtagtctgttctttcgggatgttcataaaatactgattaaaaaacaacgacaaccaaaagtaaaacaaaactgatgtacatagagaagccttgtagttgaatgacttacccatctgataatttgtactgtggagattatttttcatatttgtacagttaatgagtataactgtagctattgttagctctgttcttaatatataacatgggaaaactttattatataagttactataataatttttaatagatttgaatgtttctaagtgctttgaatttcaaaaaacagttatatgaaaatagataataatgctatttattttgaatttcatatgttaacagtttcaatttagtgcaataaaatgagcataagctaaatatataatagttgaattatattattattaaatcttttgattttatgaaaagttctgtactatctttaaattagaaactagcatatgatcaattcttagtttcttaaacagtttgatattaatactgatattaatcatgatttaaaatgcatataacctgaacttttgaaaatttattactgcactagcatatttggcgcagatcaaagggatagagctgtcatctctgggcatcatgcctgcggacatgattgatttcaggcatcatggtttccagctctcatttcttttgttttttgaaagataaagaatcttgaaatgttagaatcttagactctaaggcctcagtgccctgcacaaacatccaagaggaactcacttcatttttagacagatctgatggttagaaagaatttcctcatacggaacccccaaaactgcctgttagaaacatctgcttattgatttcagttttaacctctgaaaccaccatacaaaattatgtctgatgtctcttccttaagaccataaaaggatgtgaaaagagcacttcttcttttccagagtaacattttcatttccttcaactattgtgcccccaacagggtttcttagcccctcttcataacctctccatagtccttatgttcttaccagatgtagacagatagcaccagatagagtgggctttcatctcttcttgctagccagctacttcacagtgttggctcatattacaatatgtcacttcacatgcttttcagttaaggtaggcatcccctctctattctctacttttggacttctattcattccacttgatgctactaagtttagactataggtgatacctttcagttatataaacagataaagatgacaatgcttacttatgtctgtgggtatgcttacatgccacctcgtcttattactctaccattggatttttaacttagacagatgtctgttagtatgcattgagttctcatgctagaacttcaaaagagaaacctagagtttccctcttagtcctctcctctacctctgttatctgttgtaccattctcagctctatgtagaattagtaccatacaaaatattcagtaagtatattaaaatagctttggagagaggactggagtatggagacaaagcgcgacctaattaattaaaattattttctagcaacagtgttgaactgtgttgtagattttactgtaaacaaataatgttaaatttcaagcctatcaagtctatatcatagacaatctcttgaagattccccaaaatttattatatgaaacttgttgctgatgagattcattgaaggctataaaccatgattcagaattggaatccaaagtgtgttactattcctgttactgttcaccctgaaaatagaataattgaagtttgcttttactcttgttatcaaagcaggctctggcatttccagaaacctgtaaaagccttgttgatatagctaacgtttggaaataaatcttaggtctgaatttacatttaatgattcctttctttctatccaccttacctccagagaataaacaaatacttttgttgttgcttttaagttatagcaagtactctctttgtctggaatctgagtaatggtagagctcagtagtttgaagtttatgtttttgattatgtgatgttcatgtgtgaccatatcacatatattaaattcaacttttatgaaagagacctgggtcaagtaagttgatatgagggatctagtctagtgaagaaaataattatcatatatattgtatgatacccaactcttgggttccttgtgactattaccatctataaaaataactcaaacactgtgcctcttcaagctatgaagattttatttgaaaattatatttagaatagtttgggtattgatatagtttactttaactcctcagaaattgattatgtttttctggaggcatgtatggtaactctcactgaagcgaaacactgtattccaaatgagtccatgtttttattttgtttaattttttctgctaaatctaagaaaacatatcaagccataaccttgcatggaaaatgaattgtgtgccactgtccacttaagtatactgccatccataagcaaatttcaagatattggaaataccatagaattagttttagaagtcaaattaacatttgccagtttttagtatttgtgttgaaacctgaaacttatctttataggaaatacaattgaaggagaaactgatatgtgtagtaaaaatttcaaatctaaacatcttgacttactgaatatcatcatgtgccaaaaattttgaataaagtcactgaaattaggatttgaaatagagtaaaataaatcagtattctctttcctttcttttcaggaagtatatatgtggttcagtattttcatctttttttttttttttgggatggattctcaccctgttgcccaggctggggtgcagtggcaccatctcggctcactgcaagctccgcctcctggttcaagcgattctcctgcctcagcctcccgagtagctgggattacaggcgcctgccactacgcctgactaatttttgtatttttagtagagatggcatttcaccatgttggccaggatggtctcagactcctgacctggtgatcctcccgcctcggcctcccaaagtgttgagactacaggcgttagccaccgtgcccggagtacttttatttcaacaaaactgttaattgttctactctctgtctcctctccctttgggcactgggaataatatagcataaacttggtattatttattttgcatgctttgccatgattcaggtttcgtacccattcatcacccagctgcagtgttcacgaagatggaataagctgagtggccaagcctgggtgatatttctatacctgaaactcaggtagaattaggtcagtcccactcaaggagccatggactattttcccaaaatatatatacattcaaggtacatggaatattttcctaaaaatctaagcgcctttaccaaggaatggaggtgggggagactgtacgatgagcaggcaaaagcatacatgtctataatttgctgcttaagaaaagctaatatggaaaatacacttttgtagctgattattctgctatttaaataaagtttctacatgagacttgaaagttgacaatctgattttgataattatataagaagttaacatttcaaaatacttattagcagtattaagaaccatggctattacaggtatctctcaggctgcttcaggataagtcttttgccatttgccttgtagtacttataattggtgcccccggagttgtatagcactgatttctgtgggttgctacactggaattagtgacaaaggataacccttatgtctaccaatggaaatagttggagaatatttcctttgctattttgaattggcttaatctaaactaaatgttttgtattattttaaatattgactgctgtgggagcagtagaactaatgcagagggcatttattgaggattaattattggtagagcatttatatcgtaaagaggttgttactgtagagaatgtgcttagttttaatggaaaacataattttaattggtactaggtgtttctagtgtggtgagcatttaaaggagaattactcttcatatattctcaactggcattggcttgctatttattcttcagtcaatatataattttaatatagttagaatgtaataaactggcattaactttttaaaaaataatagacctttttttagaagttttaagcttacagcaaaattgagtggaaactacagagaattcctctatactgtctacactgacattaactttttattctaaggtatttataggaatatttaagaacacaaagaaatattttacatgctcacttctacagctaacaggctgtagaaggcatctttctttgccttcagactagaaaggagaaaatgttttagagccaagaaacattctctgactgagcattgacagtaaaaacttaggccctggttttaccatacttttccaactgaacgcttctgtagaggaacacaggaagagtagggatgcattgtaatctggtctggagcttcctgctagtctgtggatgacaaactgcagatcaaacggattgatcatattccagaagggcagtgtgatacagggcaagtgtactgaccatggcagtagccctgggttctggcctacctctgcctctgtcttggttgtgtggtcgatgggttgaactgagtggcttcaaactcttatctgcctccaacattctgtaatcctgtgatttcacaggatgtgtgatagggagaaacatcaactcctacaagggcagcagtgtgaagtcatgagaaaagcaatgtgaagacctgggatgttgtcacagctctatcataaaccagctgatggccttttgtgtagtcacttaaactttctgggtcctacttggcgtcagctatggaaatgtgattggacttccctgatggactctaaggaaagtttcttggattccttctttccctcccttctttcctccttccctttactttcttctttcctttcctttatttccttccttttctttcttgagacagggtcttgctctgttacccaagtggaatgcagtggtgcaatcatggctcccggcagccttgaactcccaggctcaagccatcctcccacctcagccttccaagtaactggtactaactacaggcacaaactaccaagcctgactaattaaaaaaaaatctgtacaggcaggtctcactgtattgcctaggctggtctcgaactgctggaatcaagcaatccttccacctcagcctcccaagtagctgagactataggtgtacatcactatgcccagcaaatttttaaatattttgtacaggcagggtcttctcagtatgttgcccaggctgatctcaaactcctgagttcaagtgatcctcctgccttggcctcccaaagtgctagaattataggcgtgagccatggagcccagcctagttttctgatttaaaacaactaattgctatgtgatgttatttgtcccaaggataactgctttgtaataagttacttcaaaaaggagcatattgacagttgccattggtcacttttgagcagactcctgtgtgtcttccttatcaggaatatccttggaattaatatacctggaacaattctttctgcaggtaagcgatttgctggaaacatgttagacacacttgaaacaggtactttttctggacagtacagttttttgtttttttaacaagtaacatatgaccaggcacactggctaatgcctgtaattccacattttgggaggccgaggtgggaggactggttgagctcaggagttcaagatgccagcctgggtaacgtggagaaaccactcctctaccaaaaaaaaaaaaaaaaaagtatacacacacacacacacacacacacacacacacacacacacacacacacacacagacaaattagccaggtctggtggcatgtgcctacagtcccagctactcaggaggccaaggtgggaggatcacctgagcccaggaggcagaggttttagtaagccaagattgcaccactgcactccagcctgggcaacagagtgagaccctgtctcaaaaaagcaaaggaatatgttataatttttgatcataatatgctgttaagtgatatttaatgtattaataagggaaaataagagatcactgtcctttgcttcttggaactgaagattttccatttaaaattatgtaaattgataattaatgacttccctttttatcaaatgactttggactaaatttttttattaagaatgtgattttgtaatatattgcaaattattgccaaattattgctgacgtgaaaggagcccagggaacactcttgcctcaacaggggacaaggtggtcttaaggtttctccagtgggtttcatttgcagaaccccttcctgaaggtgcaggctgatgcctaaacagtgtaggtcagggtttacttcagctaacccaatctctgaggggtatcccatggggctgggattatcttcactgtttattttccagcttagttctcagtggcttgatagagcttatgaatcttcccaaagatcctggggcttccctgtcgttattcctgatgtagctgctggcaaacatgtttttatacccttcctggaagtgaaactctttttgccttaaatgtgcgatatcccatacctgagaaggtctcattgatacaattcataggagtttaaaagaggcatctgactggactaatgcctactccttttacttctccacttatggaaactgtagacattcatggttccaccatggtccctgcagcaaaaatcttatggcaatgtacataatgtacataatgtacaaagatcttatggcaatgtacattaaatcagctaatgtatattgaaattggtagggttaaaagtgagactgtcagaattaaacatatatgaaagccatctaaattaaaataaaatctatggtgaaataacacttgagaagtagcaattcattcagcacccaaatgctgagaatagtcaaggcaaacttaagtgtgttcacaatgtaactttattaaatgcttttctaccccttagtttttatctctaatgagattactgacatttattgagcacttattgtatagcaaatgctttgaatttataatatcttctaataattctgaaggcaacaattagagatgtagggattgttatcccaattttgctgatgaggaatagaggctcagagaggcttaggaattggcccacaattgcagggtagtaaacctaaggccagtatgcttagtataccaccatgctgctaacattactctgctatttaggaaactatggagagaaaaaagagcaaatcacattgctttctcatttgcccacatttcatgtcctactttctcacgtgaaccctgtacttcaaccagatctgctgcatatgcctcctatcccttccagcaagtcatgcttgctttagtattgaacctttgctcatcctatgcctttaacactctcctccatcctgtctgtctgtattcccaactgccattggttcttcaggttccagttttattcgtctcctgtgtagagatcccctggtatattctaactttaaaaaattcctttccttaccattttgacatttattacatattatgctactattatttagctttgtgtgtttgtgtatgtgatcacccaactagatctcatcagctttaagaaagcagtaactattataataactgttttgttgttgttgttgtttcataagatggagtcttgctctgttgcccaggctggtgtgcagtagtacaatcttggttactgcaacctccgtctcccgggttcaagtgattctcctgcctcagcctcccaagtagctgggattacaggcatccaacaccatgcccaactaatttttgtatttttagtagagacaaggtttctccatgttggccaggctggtcttgaactcctgacctcaggtgatccacctgcctcaacctcccaaagtggtgggattaacaggcatgagccagcgcacccggtctgttaatagtttttgcagtgttaatgcataggaggttagtaatttcccaaacagtaaaaggctacatcatttgccttgctattctgttggcatataggtaggtggtaggtaatttcttttctttctttttttttttttttgagactgaatctcactctgtcgcccaggctagagtgcaatggcattacctaagctcactgcaacctccacctcccgggtttaagcaagtctcctgcctcagcctcctgagtagctggaactataggcccacaccatcatacccagctactttttgtatttttagtagagatggagtttcaccatgatgcctgggctggttttgaactattgagctcaagtgatccacctgcctgggccttccaaagtgctgggattataggcgtcagccaccaagccttgccggtcatttttaaaaataactttattcttggttcaatattaagtactgaaggggagaggatttgcaaatctttcatctgctgttataaagggcccatctgaaccaatgaatgctggagttttctgtccctcctacctagtgttttcttatacttttttttggagaatccaaacaaatggacaaatctgtaattacttagtagttactatggtttactgccaaattatctagggaactcttaagacatgtttgcctttattactatatttaatgtttttcaactgaaaggctctgggagtaatgaggaaatgccaaggtaggggtgggaaagtgacaaagaggtaattcagatttgcatttcttttgagagatttccattctcagtatagctgtcattgtaatttcagttaaagattggtgcctggccagaaatgcctgtgaaacagctgtggtttaagcttcaactgtaaaagacagacgggtaattttaacaaaagttttctctttattcatagtttatgttgccactttctttattttatatgtgtgtgtatgtgagtgtatatatgttcctgcagttatctttctctatatgaagatattttatttcagcagatgatttaactagagatcagactgtcagtttatcatttctaggcctttagcctgtagtggacaacagtgacctgaggcatggaattaattggccaaaattgcataacagttggtataacaacatcattttcagtactacaaattgcgtaatgtgtatgaggccactgttgggaataacagaatatatagaatgggaaagggttatgcacacccaggacagggaaggctttaattaaatcaacaagaattttttgactacaaacacaactccattatattacatggaggtaaaagcttggtgattaagttcattttatcaacatgtagtatataaaataatgagtcaagaagaagataagaattgtatccatgtaaagatggagaagtagttttaaagtaggaaaagtctcttaagaaaacttgcattataaaatggaaattggaatacagtacctactgacgaaatggaggaagccagcggaaggttttgtggaagagtgggtattagaactcctagttcgtgacctatacttgcttggggtctcagaaatcatgctggctcttaaattagaaatacagtctctttgaaagcatacatgtagttgaaagcagtcatttaaaaatttgctttttcattccctacctcccccctttttaaggtatgaaagcatgagtattctgttctccagaggatgaggaaaaaatccttatttcctttttctagcagtatggctatttttgttgttgtttttactctataaatggagaggcatgtgtaccatgcatggtatcatgcccagcagtttttttttcagttgaatgtaattgttccttagcaaataattgcagtccagaatgacttttattgagcttgattgaattaggggtatgtatgaaaatgagttagttaaagcttaatctattacccagagaattgatgaaaacatcagaaaagcagtcattcatggggattaaatattcttctgtgtaagtgggcagcatcgttacctcggagtcccttctgcactgactaggtagtagtgacatcagggtgcaaaacacagttttggcatactaggggattttgcaatgacgtgcctttgaatgttatgctggacattaacactaattgggaatctgcctcattgtaggaggtggcacctcaccttttttagtataaaaagctttttaaaacagcacctcaagggggagtgtgagagctgtgtcaaaaagccagttgcttcagcgtgtgtcagtggtggtttaggccacatctgtaagataggtttttcagatgccctgtttgtaagggacaaataatatttaatagatggctgtcccacctgccattatgaagtttcttagagggaatcctaagctgtgccagatcagtgctggctaggactgggaggggggtgtgcagtgtcatgggtgggaagcagaggccttgaaaagggaaagacaagttcctagcgaggcagtggagctaatcaccaggagtcaggaagccaaggctctgtgggggtgattgggggttgaaagtaagccaaagtgggacccagagaacacagacaggtaccaggtggctcagatgaaaatctgcccaggcgttggtctcagggctcattcaagtcaccgttctatagggttgtgctcatacttagggcatttccccctgctggcccacctgcctttctgatacctcacatcaccactcatttccgtcaaatcagtacactctctgaaatactagtgatttaaatgcagaccaggctatgctgcaactgcttttctgaggctactcatgtggccatttgtaatagccagataaaatttggagtgtttctgtttggctgtcagagaactcaaaggcctgtgatagacttatcacaggcaggaccctcagccttgaaactgatgtctgctctgtggctgatttcctggcttcttaagtctaccatgattccttcgttattttaagagatttaaaaaacccatattgggcaaagcatagccaatctcctctctcacccctctgctactttatctatagatagttgcatcatgggtaataaattattgaacagttatcaagacaaagtgcaattatggtcaactttttggagtatattcaattatattaatagaaacaaatctccaagggtacctgaagattaatgagtttatctttgagctcctgaaagaacttacttacgtatatagggatgtatagggtattttatttctcagatagcatatattcacttcttaaagagaaaatccttaaatcaaaataagaatgaaactcacactgtcaaaattaatggtagactttcttatcccaattttggcagtacaaattatatatatttttagattataccagtttatttacttgacgtttatttacagttatttacttcatgatatttactcatctgtttcataatatttaatgcttcttctgtatactttcatagatgtatatgaaaagtatgtgaatgtgatagtattatgagattttctttaaaaatgtttttgatatttatatgttgcctattttataataatagactttgatattatttatttcatcagtgtttggaattggcatgctgctttcctaaactgtagtaaaagcgtagacgtttgacttgaaagtattcatatgtgtcctttatagtttgcttcaaagatctggatttattcttttatctatgcccttgttttaaaaaatatggatgaatgagtagtatcttgcctgaagccacatgagaccaattaatactttattcattctttccagcttttgtttttgttaatagcacggggtggcaactgagtcatctaattctagataggattactcagatgaatcattacatatttttgatatttaatgtgaagagccagttcttccatatcatagtggcttattagaaaaaaaaacttaagctaagccataaaatgactgatattatattgatagagccataagccagaaagtgatatccagtttctacagtgtgtagcttacagatttagaagaaatatattgtcataatctgcctagagcagggaattgcttcttttagttgagtgtggatttagtttcaccactgaagcagcctaaatttgtcttacaaagaaacataaatgataacttttgaattcttagaaatgatatggtttagggatatatatttgcagtgttattaaaataaaatattccatttaatttacatgtacaccatttcactgattttgatcttataattacttcatcctttatccttaaaaaataaaaattattttctatttgtccccctcaccccaggctgctttcttgtttgttcgtttttactatcttgccctattaactttaaaatatttaaaaggcaaatcataagtattaatatctgaatcacagtttatctagttgagtggggccagtcatttaaaataacttgaatttagttagggtgtcgatttaaccccatgtttttccaggggatttgcctgtaattctacacttaattatagccaaaaggccaggaagttattgcccgtgattaattcttagtatgtgtaaccttaatctcagaatttccgttgaataattttagtgactgtctttttgttaaaattgaaaataaacactttagggccactttctctaactagcattggcataaggatatttgcctcatgttgattgtttggctggtaattcattttatttggagattattttgctaaagagaatgagtgtcagctttaatttgaaaggccttcctggctcaccattttaactacttttctatgggtccttcacagaatcctgctgcatcacagaagctggaagttctgatgttccactgaaatcacaatggaaagtcttgacttgactggtaagagctgttgtgaaggtacatcttacttacttacctggaagcagtgaggcagtcaagaattatgtgctgtcagagctggtctcagcatgatcaaggaagtgtgatcattggatatttttttcttgtcaattttattattttttaaagtgtgacttttattgatctccattatcaagtaagttaaattttcttttaaaatcatgaaagtgttaaaactagcggtttcaaaatctctgattcgtttctccacagtagtgcattattggtgaaagtcagttttctaaagtcctagatactaagaggttatatacctaaataggtattaaattgatctgttccccaaaagctgttttttgtactgctgttggctttaattgaaaaatgaatcagtatcgaagcattatggagtttttcttacctgttaaaaataatagaggtgggtgtagctgcatcttgaaatcactttatatatgaaaaccacataatgaaggaaaaagttgagattttaaaatatatacatgtgccaaattatataaaactctgaaactcacagatactataactgtccttttatatgttagttattttcaaagctgtcgttttaggggaaaaatttttttaactttaatgtatggtaataatattttaaaattagttttaataataattacttaaatgcctagagttttcccaatctgggaatcagatgtgggattgctttactggtatctgaatactttatggtgaactgttgatttataagactgaagaaacagttgtgaattaaaatgagcaaatatagtaaatattatttagttatagttttcaggaaaggaacttattctttaactttttaattaagattaatccaaaaccttttctattttaaagtatatttggtagcttattacatctgtctagattatgtgtctaccttccccttttggtaactatatcactgaatattgcttctatgatgtcagtataaatataaggcctctgaacgagtctcctaaaagtcattgtctaggattgtatacatagtaaaatgtatatgatttacttgaatgtgtatttataataggtcatttaaacaacaaaaccttaatgccagtgagaagattggaatttaattattgtttttcttcttcactgtgctatccttcaaggcacacttgttacaaatattaatacaaattctgaacttaagaatgtcagccagaatacagttaattatggttttactgagtcaggagtatagactatggaattttcaaaaattgatactgaaatttcaagtatgttctcatttgctaatctaaaagagagttgagtatggtgaggtttaaagaaaatggaatttgtggcagtattctgaatttgctaaatatgaatacatatacaaaaagcaaagccggacactttatctgacctgttcagaaaaactaagtaatgaaccaagattaccatggcagacttcactaagtagccatctgagcaatgatttctgaatgttaatcagattattgcaatagagtgttttattgactataagcagaaattgacagaaattcacactgctgataaaatttaaaatggaaccttaattgcagatggctaagactgcatactttctagctgacctatatgcttgtcttaaatgcagtattaactgagaaatagaaaagatgccatacaaaaaccaggagtaattgaggaaacaaatcctagaagatgttacttggcaaaaggatgccagggttcaataaatctgggaaacatatcagtcaacttagtcaattacatttcagtatcagaagagcctccaaatcttagtggtttatggcaataaacatttatttctcatttatgttcatgtccctgattagtctcctgccactccgctccgtgtcctcttcattcttggaccaaagctgaaggagcagtctttctggcatgtacatgtcttgcagaggaaagaggaaagagaaaagtgatggaactatgactcttaacaaggctgcttggaagtggcacatgtcattaactctcatatttaattggctagagcatgtcacagggtgaaagctgcatcatctgagagagtggccttgtaagaggggatagggaaagactgatagggagaaacagtacatattttaactattatatctgcaaaatactatctgctgcttttttagagacagaatgcacataatgtattaaagattccaggaagttcttcggtaaattaatctgtttaacatgtcaaattgtttgaccatgaatccttttgttgttatatggaatattgtcagtgacaagttttaaggatacaattcaagagtttcttgatgttttgaaccttacaacttttcctaaaacttaggaaaagtttctaatatgtataatagacttacattattcttttataggtaattttaaagtgaataaaaattactgcaaactggaccctctgtaatttgcatacagaattagagaaaggaaatatgatacttaaaataattcttttacctatgtataataggttacagaactttgacagatattatctaatttgatataggatgagaatgaggaaatgggtacttcgctttttccagtagtaatatattaatcgtactagatataacgggagccaaatacctttgtctacttaagttcaatttcaagaatcattctagtgatgaagaatgcagacaccatagggagcttaacagttgcatccgggagttttctaagatactctacctgaggtcacatttactatacagtgacttttgcattattattatctcttgaatcttctagaaaattgttagcacatagaactcctcagccaatagtggttttattcatctcacaatatgaaaaaacattattatcaaacttgtgtggattaagatgattgatttaaagatccaatagtatataaacaatgctttgtgatagtttatagttccttaagattgggagtaaggaacatgcttagacatctgtattagtctgttcttatgctgctaataaagacatacccaagactgggtaatttataaaggaaagaggtttaatggactcaccgtttcacatggctgggaggcctcacaatcatggcagaaggtgaaggaagaggaaaggcacgtcttacgtggcagcaggcaggagagcacgtgcacggggactcccctttataaaaccatctgatctcttgagacttaatcaccattacaagaatggcatggaagcaaacccacccccatgattcagttacctcccaccaggtccgtctcatgacatggggattagtacgatttaagatgagatttgggttgggacacagagccaaactatatcaacatctgcatatcttaaaaaaaaataaggttagaaggcaagacactatagcaaaacatgggttttggattcagataaatcctagttttggcactttttaattgaaagcatttgggtgattatatttgacctctctgaaatgttgttttctcattgtagtatagggctaatgatctctaccttgtaggattgtgagaattaaatgagataattgggttaattgcctgaaaagagtccctggcacatagaagcactcaagaagtagtagtttgaaaaagaaagatgtgatcaaagttcaagaatcttgataccctgtaccatacctctgatagacatccgacagtgcatatctaaaatgtgtttgtttttaaacacatatgtccacacacctgccaagggtttttaaaaaattgtcctgaatgcataagaacttaggcattcttctttacttctaccggaaattggaagtggctttatccttactgctgagagaaagagtgagtcctgtagaaatattcgttaccgcataatctaataattaacttcttgccactgggaatttgcttcttgccactgggaatttggaagtcccaaggacagagtgatggtcaaaagttcatatactttatggcttttactctgtatattaataaggtcagcattaagttgcaaaaagtatcaaattttatataatctttaggcaaggtacaagaacagaaaatggtgctactgaaatttttttcctcatatagaggaaatactgtttggtttcagaagaaatagacatttctattttaagatttttatggtgctgttcccagtgtgaaggtttaattaatttagactccttaaagcaggggtccccgacttcctgggcctcggactggtactggtccatggcctgttaggaaccaggttgcacagcaggagctgagcaccacctgagctctgcctcctgtcagatcagcagcggcattagattctcataggaacctgaaccctactgtggactgcatatatgagggatctaggttgcatgctccttatgagaatctaatgcctgatgatctgaggtggaacagtttcatgcccaaaccatcccccccacctcccctaccattcgtggaaaaattgtcttccatgaaactggtccctggtgctaaaaaaaaaacatggggaccactgccttaaagaacttctctattgacgttgtccccttgtactttcagaatcaagtacaacatagtaatatcttttatgattcaaagccttatgctttttctaaaatgactactttgtttaattttaaaatagcacatgtatataaaaatggtttttttgggcctggattagtcttcaaattgttccaggctgttctctttataaatggagtatttttgtaactattagttgcttattcacctggattattggtagagtaaaaccacctcaaaaaatataaactctgcatctttagaggttgtattagtttgcttgtgttgctgtaacacataaaaaacaagtgtcagactgggtggtttaaacaacagacatttattttaagttgaaagttctggaggctagaagtcagtgattaagatgccggaaaagtcagtttctagtgaggtctgtcttcctggcttgtaccaccagaaagggctgcctttttgctatgtccttacatggcctttcctctgtgtaggcagcgagctctagtgtctcttcctcttctcataagtacatcagttctttgggattagggccccacccatatgaccttgcttaacttttatttcctctttgtaggccctgtcccatcacattggggactggggcttcaacatatgaatttggagcgggacacaatttcatctataacataggtttttgtttttctttaccaaagaatgaagtaaaagtgttttaaaaaatactttctacgtgatttagtctataaacaagataatctggttcgttaacagtcttctaagattctaaaaatatctttgatacttttgaggagggagacgtttgaaattactgaattcctgtttcttccactttgaagtcaccatccatgaaaataaggttcttacaagtgaaggaattaagtctaagaacttgaaaattcaagtgatttatatgatggaggaattacatcattataaaaattgacttccatgtgtatttattgttatctaggaatactagaaatgtatttgaaaattaagttgaacaagataattactcttttgggttatacctgtttctgtttactttatcaagccaattcacattttgtaaggcaatattcttttactttgtgaatcagttgagaatgcaaacaaggaaatggcatatacttaagatttttggtaaacagaaaaaaaaaagattgtgtatttgaaataatgccaacagaagtcagggagtcctaagtctgatagatctacttaattattgtcctgtctccttacctgccttctttcttttttccccttttttctctgacatcagcttctaaattaggtaatggatgcttgaatttctcaacctgccttattttgttgttgttgttgttattttgttttgttttaggcttttagcagcctgtagccatggtttttagtttctgtctctagtaagcagaaaagagggctgaggaaggggctttactggttcaaccagaaacagaaactaagaacccatgactgaattctctcccttggacacctaagtgcaatgtctgtatagtacttctttctattatatagtcttttataacctgcttagtttaatttgcagttctttttctattaggtaagtcagttgatgggtgcttgggattagtgctgagtaaatagtgcattaacttgtgggatattgatataggctcaaatgaactttgtttcttttttggacgatttttgtctgtgtgtacatatgtgtttctgtgtgttctacatcactagaataattttagtttctagtgatttggcatttgtctaaaaaatgtaatcaaaaaaggaaacaaaccttttagacaaatacttttatgtaaaaataattttaaattcatttgtaaaatttaccagtttttctgtgtacttatagactaaaggatatgctattcagcagtgatataattttaatcagtttgtcagtgtaattgttttgtccacttttgatttcagtcttccctaaaagctatttatgaaatgactcaaactcaaaaaccttgtatataaggaattttacctgtgtatttcttcttaacattaagatcaatctaatgattgtgaaattcactagttgaggacagtatgaatatattcaggcatggcttcctgcatttaatgctactctgaaaggtgttggatcaattaagtatttttatattgaagtctgtattccctctgatctctattatagagaagtgtgttttcctaggaaaataaatggatctaaggcggggaacttgctcataacatttctcctaggatcttcatatattttagtgtaaaatattcatttactggatattctatataaacacataaacatatgtatatatgtatacatgtaattctttcatagaacctcttcaagatgctacaggacttgtttatgctagaaagtttactagaaagtctattttgtgcatgtctgtattcccaaaatttagaaatagcatctggtacatagaagttgctcagtaaacgtgatgaattcgtattacaggaattcacatttcattaacctatattccactgaacttggtgttgataagcatctcctggtctacatggaaatttttcccagacttcgttcagggagaggagtgttcttccaaattacggtctctttgtgccttcaagtttgccattagttttataatcaataaatattagtgggctgagagcttaaaatgcaaccacaaaaaatttctctatacctgttggctcatttgtagcttacattgaatcagcaggtgtttgttaagatttattagtcttctaacaagtgcttttccaacacttcatcagcgaccctgtgagtggagtacatgtgaaggttgtgagatttaaggcaggcactttggttcatgttgggctttaagagatgcaatgtgatacctggcttcagttaatgtgtaccagaaaggttgactgaagtcaacatttaggtgttttgttctgggatgtatttttaggatattgctatattcaaattgatctatgaagctgatagacaagaatattgtgtttgttttgtattatcttgtataacctgcttaatttgcagttgttctgtctctgctgtggctatattactattcttataaaacggatgagttatctaattgtttcagtgttcttaacatttaccgtaaagcaatttattaccaagcgtctccttatgacagaaatgttctgttttagagtatcgaacattaccataggcacttagaatgccctggtttctgagagagccagccagatgtggaggaactggcttccaaaggggcttagcaacctactgtttatgtggtgagcactgtcctaataagttgtgccacaataattatactgaagaattgccaaataagagaaaaattaacacctatcaaatgtgagatgtatccatgtgcagagtagtatataccctcctgtccatgcaggtagcacctggatggacatgaaactccgtccatgccttcaatagagtttttgaataccactatgttttcagcattgttagagttaccaaatcattaaataggtgtattataaaagttaatgaagaaaaatttgaagtcagcagctattgtcaatccccttaaataccaaacctctttttatagcaatcattttgtcaggccatttggaaggacagaagcatacagatcatctttcaattcatttggtgaagtgaacatttaaataaatcataaagttttcaggtttgaaagtttagttcctgttaaaatgctgggtgttgcctgtctttattattcacctagagtttcactttttagagaacaaaagatatatctttctaataaggctattatatcttattgatagtagaagtgtttcaatcatgtctctttttatgagtttttccctaatcagcaaaattatagattttttttttactggctttctgctataatagaatattttatacattggagtttattatgtgcctctgaaaaaatattttagaacttttactttcgaatacttataaagatcttgattcttacctctagattgtcagctccaaaatgctcactattgattcctgatattaatatgggtaggcagaaacttaagcgtttccttataggagacagatctaaatggatcacttaaaaaatatgtttttgttttgttttgtttttgtttgtttgtttgtttttgactgtagggtgatctcttagaaacatgggctgtggagtcagatagactcaagactaaactaactcagctgtttaccgtaactgggatgtggtaaagttacttagctttatgtgaaatggggcaaatacctgccatgtaaagttgttagaggattaaaggtactagagggtataatgtcaacccagcatatggcaggcactattaaggaaatgtgttcttaaaataggcagcaagtaaaaaatgatctataactttttttgcttcttaactggtccttgaaatttaatttcatgtttattgctatctctattcacagcaagagaaatgtccggcttcaaactgtacatttttactatgttgggaaaatctttattgaatacaagatggacttgctttcctgacgatttcattaggaaagaataaattaacatttacttttattgttggatttcttaaaatattttctgtacaattctaagtgatagaagtttgattttattttaattgtacctcccccaattttgcaattttagtaaagcccaaacgtatgaaaatactaggaaataagtcatttgtcattcagtggattatagttatttaagaatattattgctacctgctattagtattaacaagattatcagcccaaactatgtcaattttttaagcataagaacaaatttatatagtctagataattttcttcaaagactataattatttgaacaaaacaaggagatatcgtatgattcttaatgagaattcactaagtatgggaacttaaagtatgataattaatttttttttttttttttttttttaagagataagggctcattctgtttcccaagctggagtgcagtagtttcatcagagctcactacagacttgaactactgggctcaagtgatccttctgccttagcctcccaatagccaggacttcaggcgtgtgccaccacacctggctaagtttctttaaatttattttattttttttttttttgagacggagtcttgctctgtcccccaggctggaatgcagtgacacaatctcagctcactgcaagctccacctcccggattcgcgccattctcctgcctcagcctcccaagtagctgggactacaggcgcccaccaccatgcccggctaattttttgtatttttagtggagatggggtttcaccgtgttagccaggatggtctcgatctcctgacctcgtgatccgcccatcttggccttccaaagtgctgggattacaggcgtgagccaccatgtccagctaagtgctattttttaaaaatattacacactgataactatataaatatttaaaaaatttaaatagctcattcaaccatgatcttattctgttatttaattcataaacttgaaaagagatgcaaaattttccttcatttcaagttagtggtttaacatttcataattggtccaagagaaaaaaatattttttctctatcttcagaaatgttctgtgaaagtatttattttctaataattttcatgcacataagcataaaagccagtacagcttggtctttgtcccgtgtatcaatagctattttgtattaattttgaatatctctcaacaattaatatatctaaacttgttttcaaggtattttagtactatctatgaaatactttggttccttctaaaagctgcttcttatttagtgtgtatgtgttaggtgtttgtggttcttttatagcaattttcccttttccttgttgagtatgtaaacatccaaaccataaccaccatggattttatagactttaattgtatacttttaaaattattaatatatattgagaaatctaaacctttccagactgcttgtgagagtttgtgctctggatcgttatccctctttaatctttctcctgctctgttctgtttctttttagaacctgaacaacgtatagtggtctcactggaaaaatgttttctttaaagataaataatgtattttctattcctctgtatagctaacaaatatttactaattatcatgtgcaaggcagtgcgttacacactgtcaagatcaggatgtggtaatataaggcaatgtctaggcacaaaagagggagatatacaaataaacttcaagttctgaggaagaccttaaaccccacttaaggatatcagggaagacttcacaaagaagaggaaataacagaagtatggaaaggtgaatagactacttgggccagtgggatgggatacatgtaaagttacggtgggaaactttggtgtgaaggcagagatgtaaagagggtcttgaatgttaaggtgagtttacttttttttcccctcaaaaggcatatgggccactgaaaacttctgagcaatggatataaatgagatggaacagaaggaaaaaaaggtagacattggaaagactggtttagggggctttactattatcctaggtaagaaaacattcattcttctgtagtgtgttgacagttgtaaaaggggctattatgagagacattatgaaggttatactctggatcttgaaatattttagattgaagtattccaagttacagaactagtctttcccatttacggggcaaaagttaatggatactcagttttaaggattccttcaatgacaattttctaaaacacttgattcctactactatttagcctctgttttgtgtgtttagttatcgtaaatttagctttcactgtgtttcttgaatatgaagtctaggtatctgtcacctgaatcaatttagaaactattaatctacagaacttgacaatagactgaactcattttggggatgtagagggacagagaggttaggaggcaatggagggtatttaaaagaaagtcaaagataggtttttaatttaagtgtgggtgttcacaagagtgctaatattgccatcagaagtaaggagctactagtattactgatttgtgggagggggaggtgaagtttgggatggattggatttgaacacacaggatatccatggcattatatttaggatgtagttataaatttgagatgaggtttggtagagattcagactgaacataggtttaatagaagagagaggtaagagctgaaactttgaaaattggtgaaagataatatgcctaaagtggaattgttgaaaatacccattctttgttaagggaagtctaaaggaaagaaatccaatcagatctgtggtgggaaaagcagaatagtgctgtgcaagatgggaagactttcaagattgacagtattgaaaatttagggatatctaaatgcctgaaaaaagttccttgagttagtaatccaggggtgaataacctttggagaaagcagttttatagagcagtcaaagaagtagccatgttgtataatctttccaatattccttctttgagtgccaagttcttgattttctttttagctgaaactgtgtgttgagtcactgtcttcgttgagtaatccataatgatttacaaatcctctccctcggagcatagaactcatcttctataaatgtagttgtaatattctttaaatatgttaccttagactattttaaatcaaagctcatccaggtattaatatcatttcctcaaatgcactgaagtgattttctttaaaatgccatcagcaaacaaatactttcaaatgccttactcataagtcttatatttattataattggcattacagaggaatgaataataaatttcctgtcattgtcgactcttctttcacacttagtgaaacttaaaataaggcctactcttttaataaagatcctttagaaagccctttggagtatttgggccaactgcatatgcagttcctagtcttaagaaacagatacatagccactttggttttcatcttcagagaatggtggtaaagataaacaagacttgccctaggtagtaatgatgattatgattaaaaactacagctgttatttgtcttttgtgtgctaatttctttgtttgtgtgtgtgtgtgtgtatttttcttccttgtcttcacagtgagccttaaatgtaggtgtcattattcccatcttatacaagagagaactgagtctcagaacatttaaatagcttgtctgagcttcttgacttgttaaaaacagacctgagattcaaatccagctcattcttgctttcaaagactatattctttgcatagtctgtgcagttttatgatgtatctgaaatttgacctgtaacacctttgatggcaactactgaccccagtttgggaattcagtgccttattactttcctccccttttctaccaacttgaaagaatagatcactactttccatttgtttaaataaatatattgtcaaatgccgttattaagtcaggcattcttctttatatttaatagtattatatatatttaatcttcacatcagtctgatgagaggtaggcatattttcccccaacattttattatgaaactcacatactctccacctagatttggccgttaacattttattatatttattttattacatatctgtcatcttttcatctctctattcctcatcaattcaacttaatttttgatgcatctgaacatatagatatcactacagctccctaaatgcttcagcatttatattatataatatttatattaactagagttcaatatttatgtataattttttgatgtaagtctacattcattggtagcatacatcttaaaagtacattttctgaattttgataaatgcatacacctgtgtaacccaaatacctatcaaaatataacccattacttagtactggtaggtgcttctttttcttctcattttttagatggggaaactgaagaacagagaggtgaaattatctgcccaaggttacgctgctaataagtggcaaagctggaattcaaactcaggctgtctggctgcagggtttgttctcctaaccacaccaccacactgcctgtagattatcctcacatgtttgggtatccttttacattcatgtgcatgaatgcactgtttatttttaacgtaagtgtgtagatacagaagtggtaccctgggtttagtgagactagaaatgctgttctagaaatgcatcagttcctagcaagaggtttatggcaggataaattaagagggacgtataatatgacagattcccttcgttgaagtagtagggtgaatctctatgtaatagctctgtcttaactggcatccttgattaatgtttccacacatagcagtgaagagatagtgagttttctaatgatgacactgaggttcaggaaaatcctcaagtaccacttgagcaattaaccgtaaattatgttcagtatagctttgtattaagcatttttgctcttttataattagtagaaaattgttcatctgtgtgtgatatatatagtatcactcatctagatatctcagactctgaaataatataattgactaatttggaatttataagttaaatttataaggtttttaacaaatatatttgtaatggaattatttgacttttccaaataaattgcataaagatgtaaggattgcaacagtttatattaaaatttttttctggtttgcaatacttgggtggcctgatgaaaagaaattcttcaactttagtctctttcctgcattgtgttcataccactcatattttaaaagttgaccagtactttttgttcacttcttaaatgatgaaaaagaagccatcatgtaatttttttaaatcgtaagtattgtgcaaaaagcattaaaaaaaaaaaaaaaaaaaaaagcatgtagctcacaaaacctatccagtcactagagggcagagcagtactgtactttagaccttatttgaaaatttctggtttaaaaattgctgaacatgatggaaaatatattgatacacagttgaatagaaatttctttgtgttcttattgtcttattttgctgtaaaatccaataacatgcttatacttttatcaaaggagcttttctggcaattccattgaatgttactaaaaaggcatgattatttagaagagtttaagtgcccctcaaaagagaatactcgtgcatacaaagagcaatacattttataatttctaccctatgaagtaccctgaaattggattgcagtgtagactttaggtgagacatttgagagaacaagtagttttgagcaccggttctttactagtgcttagctctaagaattcattgaaatgcagaacatcagtttatctttccagtcagctgaaatgtgttgaatcattaagactgaaattacaaagttgtagaagcaaataaactaattctagccctttttaaaaatttttgtcaagtgactgttcacttaatttcatttctgttcttaatttttttatcattctgatatttttatgcagatttttttatggtatatcttaaaaatatcctagtgagtagtgtgagtaattcagtgtcccataagatagaaaaattttatccttaattatgtttatttgaattttattttacaaaaccagtttggatttctttaatattctactagggacaatataggataccagaaaaagcagtggattttggaatcagaaaatttgggggcctcgattatcattcatttgcttgtgtcttgggcaagtcacattacctctctgaccttcattttctaaactgggaaaaatacttccttatttatagctgggttgtttggaggattgtgtgtgtagatgtatctccaaagatgaaaccctgtgaagatgaattttaataggtaaagttacaagctcagaaaaaccatggcaataacttcaaaatggttgacggtatcacagatttagtaacatgagagcacctattacatgagtaaatagaaccagaaatgtggtttcaaaaccaaaacccaagttcagattgccagcttcctccctgtctgtgatttctctggctgcttaatctctccattaacttctgactcttttgctcctctcaactctttatttctgtcctctgtttatttccatgtttcctctctctgtgtttctcctgactgtctctggtctctgtgtttttcttgtcccaggcaccctcaggaagaccccaagcctctagcagtacctggtatcatctccagcatgttatagatgtggaggattcactgggatattgagaaataccagaggcgaattgttccactgtagtaagtcattcagcatttgttaagtgactactgttcacgcagcatagttggtggtccttttggggaagaagaatttgttaggacacaggacagaagaaataaatttgtaaactcttgtcagtggttcttgcaggctagacaaacatgcaaatgaaaaaaacaatgacaaattaaaaagctgacagataatcatataaacgaattgtgttttatgtgtgctgatggggcctagggttaatggagtagagaaagccaagtggtattaatcagatttcctgcatgagtttaaaattaggttttgaagtacatttggaagagagatgaggaaagagagagtggaagtgagtaatttctgtggggcttggcaagcctttttgcttccctgtgagtgaatccctgacggtggcgggtaatgaaatgaaagtgctaagtttcagtctcccaacagctaactttacttccagtcttagagaaattccagttatgaaaagaagtacagccaagttgagactttccataaacataattggtatccgctgccagtttagaatttttagggtttaagtgtaaattgtgattatatgaagtaataaagaagtactgtgacataaaattgatacagaccattagaacatggttcagggatgcattctgaataacataaactgaaatagtaagctgaaatataacaagtctgggtttttttttttttttttttgcattagaaatttatttttgctgttgtatttttagacggtcctagctagtagatgcatgcttttcacgtttggatatcagagttggatatggtttgaatcccagctgtactagcttttaaacgttgggcaatctacttcacaatgctgaatctcaatttccacatgtgtaaactaacaccggaaatatttacctcaaagagtcctgagtacgtgctaggtacttgctactcgcggatacttaaaaatacctttaaaattgtttgttaaataaatatgttatttctgagagctttttaaaagtaagaatgctatatatacaagaatgtttgtatatacagaaaatgctatagatacaagaatatttattgtgcatggatattaatgaccctttgtaccttctgctaataaaacattagaaaactgtgtttcacagtaataacaggtataatgtcacaatactgaattaaatattagaaatggtgaattagactctctgtatgtccctatggtctgcaagctgaatatgtgcctttaaacaaaaaattttattaacttgagaaataagtttgtggctatagtcagcaccctattatgctaccttctctaccattgtctgtgtttataattctgcagtcatatctttagaatcatgatgaatctaaactatgataattttttttgctaccctacacaaaaatatttatactatgtagataaggtacaaagaataacattaacacgaataactgagaacctaccactagtttaagaatagaacattaccagtttctttgtagcccacagtgtgccccacccagattccattgcctctctttaccccctcatcacaatccttaatgttgagtttattacttctgtgtttttcttggtcgtttttctcatacttatgtaccccctacattaaattttgcctgtttttaaattttatataaataatacatactacatgttttcttctgcaacaactatttttcctgctcaacatcgtatttgactcattcctgcttgtctttgtaattcatttattgtcatatatgtataatcttttattgtatgaaaataccatagtttatttactttcttttaatggctatttagctgtttttctttctttctcttttttttccttttttttttttgagatggagcctcacgctctcgcccaggctggagtgcagtgatgccatctcggctcactgcaagctctgcctcccgggttcacgccatcctcctgcctcagtctcccaagtagttgggactacaggcacctgccactgtgcccagctaattttttgtatttttagtagagacgaggtttcaccgtgttagccaggatggtctcgatctcctgaccttgtgatccaccggcctcggcctcccaaaatgctgggcttacaagtgtgagccactgcgcctggcctctttctttttctttttcttttcttttatttttgtcattggaaataaagcagcagaggaaaagttcttgagtcctgtatatgccctctttatgtacatattacttcttcaggatatatgttcaggagttgaattgttaggtgataggatatgcccaacctgaaattccacaagataatgccacgtggatttccatagaacttgttacattttatgctcccactaacagaatgtaagtattctctctctctggctcctatagttctttaaaattactagatttttgtttaatatgttcaccatatctttaggaatgatactttgcatgaatgtgactatatccgagcagaagtttaaaaatggaaaagattttttagtttgcctgtaaacatcatcttaacaaaaaccctgatgaccctcattttttaaaagttagttttactctttgtggaagctgcttttatttttgtttcccaattgtcactcataccttttctcaaactcatttaaatctagacatcctgaaatagctggatatgtgtgctcactaaatgttttgcctccagaaaaccttatcataagaataaatgttctcttgcaataaatgaaaactgtcagctgtttctgacttctaagaaatacagtttttgcagagaatgtacatttcttttcttttccccctaattcttgttgagatagagaaagagtgacccacagaggactatttgcaagctgcagcgctttgatcaacccatcttttgttctgtattgcaaaagttccaaaagcttgagtaaatgactcaggtccccttttctgtccttcgccctcttttgtttttgttagccaatgattcttttggtatctgatatttgtacacactgttccaattttaatatcaaaagttcctcctaatctcgtaatgggtacttcgtgttttataattttaattgtctgatctcaatattttgcgttttgtcaagcttgctgccactactacatgtatcttctgcagtttcccaggaaatataccaggatctatcctatttcctggtacttattcaatgggtatttattgaatgtagaaaggaaagatgtaaatacagtcagcactgaaatacctttcccctgctgagctacaataatttccctaaaagcactaggccgaaatcatgaataccttaaatagttttgctagtaagtagctttattaaaccatagccagtcatttcttcttgagctttactctactttttttgaaaaattagagtggtagaccagtgaactgtaagattccttttgacgccacaattttgtattctatcttctaattgaaatgaaaaacgctttgtcactgtctgagcaccactaccagagtctgaatctatctaccttactgagctttaggcccataactgtgtcacagcaacctgccagtgattgtctctcataaccaagcaagtgggggcatacattgaacttctcttcctctctttgttctttagggttgatttgttctagtataaaaaatgcctttggcttcccgatttcatttatcaggcaacccaggcattgttctatgctaatgtctgagttctgccttcttgctccttcttctcttccctcaacccgacagccatgcccagggcaactcgtccttacctttgttatttgctatacagcataaccccatgtcttttctcacactctagttaccatctttgagtcagtattgattctttctgttgggcttttccttgaagtcgttgagtctgtctgtatctggtgctgaaggcaagttgtttcttcctttctattgtggttcctctgcttgggacacctcaactccaggtgaatggtgagtgacagcctgacttctttccttgcaccttcatgtagtctttccattaactattgcagggaattgctaaaccactttcaaggagttatttgactccagattctcacgtgactaatatttcctaaatgtgttgctggtcctggattcatcttgtgagtacttttgaactctgcaccagaggcaaaagatgccagagatcaggctacaatgggaaggggaaccaacttccttttaattctctgtagactgtaactaatcactcctgagggtcctggacagagagctatgtatttgttctttaacaaaggtcaggtatagactcttcctcacctttattcagcgatacagaatgtgtacatttctgttgtgcttagccagtggacacattacgctcctcatgatgttaatagatctggtttgtgaacattccatttaagtcttgcaacttttagcataaaatgagaaggcaggagaaaaattttacaactaaaaaacaaggaaaaggggggaaacttctttagtgaaggatttatttttaataacactaactgaattctgaatcaaatttggaagcttaaaaattgtgagtttttaatatgtcaaattattcattattttttttgagacggagtctcgctctattggcagactggagtgcagtggcgcgatctcggctcactgcaacctctgcctcccggtcccggattcaagcaattctcctgcctcagcctcctgagtagctggggctacaggtgcgtgccaccacgcccagctaatttttgtattttcagtagagacggggtttcaccacgttggccgggatggtctcaatctcttgacctcatgatccacccgcctcggcctcccaaagtgctgggattacaggggcgagccactgcacccggcctaaaatataaaattatttattattgaaagcctagctgttaacctcctacccccagcctccatacacataaaacactcaagattcactgggctatacagccatgaggcacaagaagccagactatctgtgagaattcacccctcctaactaactgcttacttgacaaaactgttaaggaaacgtattatgcccaatgttctgttcagagaagcagttaataccaccctatctcaagaagaacagattactttttgttcctcaggaattcaaggagagaaacattcttttatgcttatcagggaaaaaatgggagaaattactgacatgaaaactttactgataggagaatgttcattctgactgttattataatgtgtctttgattaatgtaaaagtcttgacctgttaagtattcacattaatattttaaattatcagtgataaaagtttcttttgtagtattaattcacttaatattttattaatttagacaggcttgaaagtgcttcataaaacctacaacactcatttagtattcttattttaatttaatgtcttctgaaagccatatattctctaatgatttaagttgcaacaaatattaaaaataaactatattattaataaaataagttggaccatccttaagtacagtagaaaaatttataaatatataaatatgtgatacaaaattttctttctgatgatgctaggaaatgcatttatgatagattctgtattggatgggcttaatttggaaaaggttttataaatgctaaattaagaataaattttgaactgcatattttttactcttattatctattatacagtaaagttggtaataaatataaaagtaactcagcattgaggtttatgtaattatccaaggaagtattctaaaaatagatttatctatattattagaaagtattttattaaaatagttttgaatagtttcattcagattcaggtcttgcttgaataacaatattcattttgtctcgtagtttgtatttgaaatttaaaaattgaaatgtttaaatggatctgtaattttgatgaaaaagaagtgagcaatgaatctgttttcttgaatattttctagtatttatcttagctataaaaatttacatttccaaaagcctgactaggttttattaaatttgaaaaataagtcgctgattgtttttgtaaaaacaatggaacagaaagtagagcagctgcactttaatattgatatttattttgaggaattgggacccttctaggaagctcacctacatattatgttgttgaaaattactaaatatggttttcttcttctatgcaagtgccaaactgttttctcccagcaaatcttaactcagaatctgtgtgtttcttttgtgctcagccagtggacactactcctttttcctgtgctagccaagcactgtgtctcatttgaatgatgacattattgcccttaggttaaggtctgttttgaacttagaggattcttggctgcccttttcatccatttatggttatttcctgttaacttaacccctacacagcacgtatagatgtgtgtttcttataatcaggttgatggcagtattatttctatgagcccggagctgctcaataaacattgggcttgcgttttcatcccttagtaaccagctacctgctaagaaccactctggacctaagaaagttcatgctctggaactctgagtcagagaactaatagagctctgtgccaaggcaggagtgggtctgattttcactgaatggagtcatccagtcagctgtttcttcaaaattaaagctcatggagacagcctttcttcttcactcattggagcttaatcaagattgatttgagtacgtttccttttctttcaatctttaaaaaatgtgccggagacttttgttgatttgtttgaaattatttgcatttaaatggcttccaagacagttttcacgcaaaggttctggctcttattttttgtacttactatggttgacaaaatcatgatgggactgcgttctcctttttcttgatttatgctattgtggcaacttcaaagacaaataagggagacacctactttttcccatccccctcccacattcagaggttaaagttaaggatgaaccgtggacaatgttaacttcagagatttaaatctgtggtcttcaatgggaactttaagactccctgcctgtaattaagaggctagcgatgatgatgatgatgatgatgtgaatatttctgaggtagaggtacaataagaggctgagtcacagatttaaaattatcatttgagataataatagaatagtgtcacaaggcagtttatggctcatgctgtagagaattaagaatttagaggaaggagatgttattttgcctaggatcatatttgacttgcatcaagaggaagagagaagggccgttttaaataagggatctctggacaaatgataagaggcaaaaaagcactccattgcagggagctgggccttgaatacatcttctgggatatagtaaaaggcaaaggaagtttgaggccaggttttgaatatgtgggtggggagtgaggtgggaaggggcacaaaaaagatgcggaataccaaactaaggaattaaattctaggagtagaccgtaaagggccactaaagggtttgatttcagggagtgaaaacctcaaagcatgattctaagtaaatctgatacagattagtttgaatggagattatcacttagaaactgctatagttatctcttgggttgaagtggtgccaaagggtttgaagagggaaggaaatatgcatttttaatagtataatagtatgtatacaaggcagtatatatgaggtactctaaaagggatttttcagatttattatctgtttccattgtcaccatcctgtgaagtaggccctagtctacttttacagattaatgaacagaggtccttaggttagtggtcaaaattcatagccaggcctgactgccaagtcgccaagccttttaacacccctgctctgactcatgagcatggaaatggaaaacagataaactttttagtttttattttgaaaatattactttattaggaattatgaaatggatccaaattagggttatattcatacatatttttatatatattctttcatgtatattagtacacctgagtttgaatcagatgttatgtattagacttagctaattagatttaactatttcttattcacagcatttgaggaaatgcactttaaattgagagaaaatgtcagttaacaaaatagatcactaatacattttattaatgtatcaacttaaaacatacagtaagagaatacattttctaccaaatagtaattttaatatattaagaaatgaaactgatgtcttaattttcaagaataaaaatgagatttgttaaaggatataaaatgacagctaaatagcaggaataagttctagtgtaatactgctgttgaatgactgtagttaataataatatatagtttcaaatagctagaaggaagatattgaatgttcccagcagggagaagtgataaatgtttaggacaatggatatgcaataattaccctgatctgattactatacatcgtatgtattgaaatatcaacaccataaatatgtatagctgttatatgtcaattaaaaaataaaataaaaatttcaaaaagaataaaaattatggaataaacaggaatgtttaggaaagaagagtttaggttactttattcattgaaagctagaaaactttttagtttcatatttgtgttacaaatataaaaatgttgaatacacttgactggattaataagaaatagtagagggaagcttattttttaatgagaggatcactttaatgaataataattattttacagatgtttgaagaagtaggtactgacacccaattaattgcccactaccaacaccaacaacatctctacctcggcactccctgcacaagacattctggaaggctggtgtttgtttttaattgatgctagctttttataatttgttgttttttcctaaaaacaattttaaaaaatatatggctagttgaggaatgtctgttagttgtgttctgagatttacgtagatcagattgctgttttatccttaaacatgttaaatggatccttcctgttgagcattttaaaaaaattttttggagtattctgatttttttttttttcattgtacaacctgcgcttccttcagtgaaaatagttttgggttcacaaacaagaagcagctgtcttaaatatgttcattgactcagccgagtgtctgcagttgcccaacaaaagttatttgattttgggtagtgcaaagaaatcaaaattagcattcagattatattttggctgctgtaataagagcttctgtctgtaacttgaagttctgaaatccacatgtagtgtatttttgtcttaaaatttgtagagatttgagcctaaacaccactgagactattaagagaacttaactgatagagctcagtatttcttttgaattatttttctgatcctcagaggaaaacattgagtcttcatttcaagattgacctaacaagggctacatctcaatgttattcacaagctgagaaaaaaaagtcataattttgtgtgtattatttggtgaaattaagtgaatgctttagttcactgaagaaagtcaattcgaagaatgacatggacaaggccagaaacatacagagaaacatatctcaaaaagacttttcagaattgtaaaattgagcgctgcagaataaaacaattcacacattttattagatccgtatagcactgcaaactcattgcctccttgagagaccattgctgtaaatatgtagggagcaaaagagtgttgatgagtctctgacataactaaatattcataatggaatagcatgctacaagaataatgaccacacgaatgcagcctagttttacgattctgttttctcagatcctttttgaaaaatcttacatcttcaaagtctctacttgtgattctttatctcagacaactacagaaagatcaacatggtttagaaaagtcctaaacaccaaattttaatcgttgataaaatgaatttttgaagttttgatatccacatgtagtgtattttatttgaaacttggaggcaaattggaaaaggatatcttctgtttcataactttctaatgaggcataatcttatgtctggactgttaaattgagaattagagcagatgtattagagtcacttgtatgagaccttaagtatctcttcaccttagctccccaagtgtaaaataattatgttaattatataactgttagtgcaggttatttgagaaaaattgttcttatcttcaaatcacaatctacaaagtacgtattgagaggatttgacctattaggagaaaggtcctggctattttataaccctgtgatacaaagtgatattttgagttaaaggggatctaggataacatgactgcagtgttcaagcataagttgagtatgggatttcatgaaaagaacctatgttggaaacattttgtagttcaggtagaaagtgtgtatttttgaagctgtgttgtactatcgccagttcctcaagataacatctcctaagtataagacatgaattatttagaagctgaagtagggaatggtaaaagaaagcaaccagaatagaggaagagtatcaaactagggtatatttttattaagtagaagagtccattggagtacagtgtgctgaaatattaggatcttatgataagtatttagttctcatatattgttttgccttttgtttttaaagggcctggcacagctgtgggtgctcactacattcactttgaatgtggaatgactgttggtcattttaatgaagtaaattttaatgaagtgaaatttttatcctttgtgaagagtgtcacgatttactttttaaaaaattaaataaacttttgttggctttagaattgttagtctttctcagtgataaatgaaaatgaaaaattaaccccatggatgactttgtactagccccagctctttcatcttgaacaggttctaggaccttgagcaaatttcttaattttggcctgaattttcttgtctttcaatatgggagttaaattggataatctctgaagtatgttctgacttctataattttgtgattttgaatgaagtaaagtaggagtccaaaatgaatagaagattattcctaaatcaagttagatgaagttaataagagttattaataagagtttcacgttaacagacttttgataataaagaaaagagaacaagagttagagaaaacgttccttgtagtagaaatggtttcaggagttgcaaaaccttttatggggtgtaatgacaattagatatgtttgattagggcaaagagtttttcttggggtatggtagtaagttttcctattatgttgataaaggctcaacaatttctaataaaatggccatttaaaatctgtttttaataaagctttaatctacatttttttaaacccagcattttggcttctgtacctacctgcccaccccaaaaaaccttcacaggaatcatattgtttcctttttaacagttgtataattccccagaaaaattcagagcataggcaaaaggtaaacattctaagactctcaaagaatgaaaataatactgattaaaagtatgcctccttacaataaagttttctgttttataaattgctgcttattagagacaaccggataattattatagtaagacccacttcaagtttttttttagaaatttctcttattctggataacatttgactactgtaaactcttgaaaattatcataaaatactacatgtagaactatttttaaaataaagaagcccacttgttagaaatacatttcttcatgtataaacacataccttttccacatttggaagtcttgtttcatgtaaaacacgcatagagcagtttgacaaaagaggcactgtcctcgtgacagtcttcaagtattttatttatgttggtggacagatgtgaactgttctttacaagtggtatggccacaaaatgtaaaattaatcactctctttagaaaaaaaatgcattcaaacatatatgatagaatttgacgcaaaccattaataacacttgtgatgatacatttttcaagggaaaagaacgtgtcagtaaatcatctgtagtcccttaaaaattggaaatacatgtcagaggagcctgaaaattaggcattcacatgtaaatatctttggaaattctgactatgtaactaataccaaaaactgccttttgattcttcttgattcttttagtaagtaccgtaacgccttcgagccagaaaggtgtgtctgaaagttctaacacacacattgtaggattcctaagtcattgtctcactacccttctaatttttcacagattattccaggcgtttagtagtaacataaaaagacctcctttgtactgattttaaacttttatatcaccttggaagttttagactagaaacccttgcgctagtaatgactttgggactctggacatttagctggatgactgatcccagtgtattgttgccaagtgaagggaagacattgaggcgtgcgatgcgtagaattgctttgactcacttctttcccctggcagcggttgcagcctggcggcagcagtaccaaatctgtgtacttgcatgtttgaaagctgcttttcttaggctcccacagcagtttgtatagaagaggagccaaagtaagacatctaaagagactttctcaaaagcaattcacatgtgatcttacaaagaactccttttagatttggtcctatcactacactcctcagacttctgttaaagcctttgctaagaggtagtgttagggcaaggcctggtaagttctattgtgttgaatttgttgcagagtgtttttaagaagtaacaggcttagagtaatttagaatgtaggggccagccatctccagacacgaaagagggaacctgagattgacaggttagatgatttagctaaggcatgctcctgcttacagagtccaagttttcagacttccatttatgtgtgcatttattatgtcagaatatggtttatgaattgtaagaaataagttgcagaagaaagaaaggacattttaactataccataaatggtgtcaactgccattaatctgataggaagatccagattaaagtttcagaccctggagactggaaagggttcagagctgaaagaatgtatagtgtatctgtccttactctgtgatatgatgagaggcaaaagatggcagttttgacggaaatcagagcttttcttctcagatactgagggttagtttgtgaacttctgttttttggccatcatgttttgagcacctgcggaggaaatcgtgctccctcagcctcagctagtttaaggactgtgctgatgggaagcagaagcagctccttgtgccctcttagtaaacaacacagattctcacttcaataactgatgagtctgttctgttgtctctcagtccccttgtcaaaaccactgatctggattgctctacagaagctgctttgcccctctcttctcatgatcatggaggagctcagttttaataccgtcgtttgtgtctgatacacttaggcagcagttccctcatggaccttttagatcaaaaatgaaactatagtaccttaagaagcttttaaaggagacattctgttactatttggggaagaataaaaaggcagtatgatatagcggaaagagttctgattttgtggtcaagagacccagagcttaactctgccactaattggtttggtgaacttgagctaacctttaactcctgtgggtctttttattgtcatctgtgaattgggggacaagatgatctccaggggctggatttgcagtccctatcaagtctatattgaagggtttcatttttagaagagtagctctttaaactatcctataaattaaatatgacaccagaaatagcagtgacaaatggagaattttcctagggaagccagttatgataggctacagaaaactttttaaaataaaaactttttattatcacacagtaggaatgccctccaaataaattgataatttctgttttacaatgtgggaatctgaaaatatctagaaaattagaagcttttaaaaaaaattatagaatctgcttccaaagatcaaaagaaaacaaaacaatgagtctataactaaggtaatttagatagatgtggatttcatctgattaagtttaattataaattgtatctgaattatcatagactaatactataaataaacatttggttggatatcagtcttccattttgccttatgtatttatgctacattaattggtttcattaataccatttaattgatcataacttgtgttactgccaccctgatggtaaaaggagcctttacagctgtgtacatgtagggacatggtaccactttcacagctttgctggaaacactatactgatttctaaatatcagacatagcttatttagaacaagtgagtttgttttcataaaatgtagggcagcagtaacagtaattactgtcctgatataatgatgctaatcttttatcatcatcatctgaagtgaatgataaaagcatgttaaattgaatctcctttctaacttgtgttatgcagccattataggtcctggaccacttaggagataactgggctgttccttattctttgtggtagtggcagatattcaacttgagatttaaaatcaatattaccagtcagagttgtgtgtgtttaaaatatgttgtccaccagctcagaccagtaattggtgagaaagcggtgtaagggataggtgttttttcatgcagaatagctttttaaaagatcatttcatcaagatttaaatgtaagcaagcagagaaattttataaaaacatccactagatggcatcttgtaattgtgtttagcattatcctgaagcattcttgactagagggtataattggaacaggtttttatttttttctctgaaggttggttgttcatgaatatatggattcatatatactttaaaataatcttaagtgaaaaattttaaccagtcattttgtcatactgcccactcatcataggaaacgtttctagaacattcctgatatgttctcaaacatagcatgacattggtaacctgtactaataacattgggaaacttgctttcataaccattttacattcttaattttataaaaatatggaaagcatagaaaactggtcccctgctagaatatccattagttagaaaataagctttggtattttgctttggtagggcattgtgcttgtggcagagatacagattatatttctggtgtggttccaaagttcttttaaagttctaagaaccactgaccttgatcctctgaaaaatttcttagtgttgaatttatttttcaaatacagatgctctttgacttaaaatggggctacatcctgatacactcactgtaagttgaaaatatcctgtcaaaaaatgcgtttaatacatctaaccttccaaacatcataacttagcttagcctgcctacatgctcagaacagttatattagcctacaagtgggcaaaatcatctaacagaaagcctattttatgatagtgttgcatatcttatgtaacttatcgaatactaaaagtttttcaagcatgtttaagctaggttaggctatgatattcagtaacttgggtatattaaagacattttccactaattatatttttaagttacttgtaagttgagaaacatctgtattaacaagctaacaatcttattcttaagtgcatacaaatttaccaatgatttggttaatctctttagcctattagtatttttaaaagcttattgtttacggaactataagtataccccaacgtcttcttttttgatttttgaattatttgtattttaagttaaagaaaagctagaaaatagaattaccaaaaagaagaaaacctcatccataattttatcacagagaaataatgtcgtaaacaatttagcattcattctttcaggcttttttggtttatgtgtatataagcacatatttattatgtatttttttaaaggaatcaggctcttatattctatgcaaccttttttcccacttatcttcagtgtctttttatgccaataaatgcattttcatggaattcttagtcactataaattgttacattttaaccaagctcctgctgtttatattttgccccccacccccattttttctctacccacagatttttgacatgcagagatatttctttacctaagggtatttagtgaggagagcactggattaaagcagcataggtcaacctagcacaacatctggttaatagtaggttctcaataatattgaatgaattttttactttttttggttacatgagtttaatggttagaagttattatgggcctagcatggtggctcaagcctataatcccagcactttgggaggcaagccgaagcaggaggattgtttgagcccaggagtttgagataagcctaggcaacacagtgagacctcgcttctgcaaaaatttgaaacattagctgggtgtggtggtgcacgcctgtagtctcagctactctagagactgaggtgggaagatcacttgagcccagaaggtcaagctacagcagtgagctgtatttgcactactgcacttcagcctcggcaagaagggcaagaccgtttctcaagaagaaaaaaaaagttgttaattgtagtttatttcaagttgacttgaatgtttatagtccatgattaattatgatgataatgatagcaaatcttcatttgcacttactgcaaagcactattccaagcagtgtatgtgtatataaaaatggcttaatcctcacaatgaaatagatactgttattatccttccttttacaaatgaggatgccaaggcacagggaggttaggtttcttgcccaagattacacagtttgcagctaataatttatagatgcgggtttacaaattcaggaaaaaagagagttcacagttaacatttgtgtcaaatcgcatgagatatgaagcatagacaaagtgaaattaagcaggatggtctaggatttctttcaaagtcatatttaagggcttcattaaaaaaaaaaaaagccaaagatttgtgtagttcttttgaaatggcgtctgtgccattttcttattgaatataagatcgcaagttgtaaagtttgtagtctagataatagagattacagttatgtttgacaccgtacatatcttactttgacacagatgatacataatttttaatttgtatggaatttacatatcatggtaataatttaatgcatattacccaaaattcaggctcatagagttttctgggcttgagtcgcatattttctcagctttgtccaggtcctgctgtgctgaatatggaagctgtgtggtttcccagcagcagagccattgatctaatgaacatttattaagcacctaatatatgccaggcacaacaatagcactgggcatacaaagataaataaaatatcacctcttcaagaagacatagtgtgtggctagcaacattgaaaagatccatcccagaaacaacaggattctgttaaagtgcttgcttacttgctttaggattgtttctttataaaatggaaaaaataaaacatgaacaaacagaaccagaaagggattagtacagtccaggctttctctttcctctgaacttgtactatgggggctttataaaaaagcccctctcatcttgatgtcgtagtacctaaaattccttcatgaagactcattaaaaattactcttccccaaagccatattttaaaatgagttttaatttattatgttacttaacccttgttgtctcattgggaaagcccagcctatgacaacctggaaggactcagaactggcattttaaaacagaaagtctatcagcaatgaacagcttcagtaagaaagcagggtctgagtccctgggatcagggaaggctgggaggaacaagtgttcagtgtgaatgtaattcaggatttcagatacttcctgctgagcccataagtgttactgtggccagaaggctgtcagactttgacaagtgagccctatttttggatgatggagaagcaagccaaaccttccttactggccacatggggctttttggttcttaggaatgtctggaaaagctcctcacagaccaaagtcgaaggatggcataaatgaacacatctggcttccctgttttacctagagctactcctgagttggacttctttatcaccgcttacgagtacctctttacaaagccaatattccaaaatccaaataggatttcagaagccccatatttctaagaggaggccaaggggtgtaagtggtagtagacatgcagaaagtaagggtgaagtggtttccaagtaaaatgaggttgttgattgacttgaagaggtgacagagccaaatttatgaaagcattagggtttcccatacctgacagtatggcttgttggaaaaaggagcagaaagaggctgagttttctgtcagaaaccactgaaaccactatttatgtaatatttatgggagaccatgtgtgattcaattgaattgctctgtctcgctatagcagtttttaaaagcttcttcgattgttgaccggtccgttaagacatgctgcccatgtagataaggaagacactcaagtttcaacatccacactaagtgatcatgaagttcttatggtttaaaaaagttcagatttacaattccatgtaacctttcattaattaaacagattggatctttgttactcttctgaaagttttagaattgcacttcatgttttagaaatgactcatcagctttgcattgctctgctgactggaaagcctaaacttgcagaagtagtgtttttcactggattttggagtgtgcctctttacgtgtgttgtaccatggtggcccagcatagagggtatagcgattgactcccttcctgtaatgcttttcaaaatgacacctgaatggtggaagccctgatggtagtgctgataaataatgctttagaaacctgttttaacaaaattaagccaatttggatagcttataagtaatcaacacaaatagacacagaaatattaatggaaggtttatgatatcaggattgttagcaaccagaggtcacgtagaaaatatttacgtccaccaaggatgccttaagcatatagtagatgagtcttgtatgttcctggaaatagatggggaaaggtttagttaataatggtgttatgaaacgtcttttttaaggagtcttaaattatttttaaaattcaaatttatatagtgcagtgattttcaactagggatcaatttagagcagtgattttcaactagggatcccacaaccctacaaggagtgtttagaaattcgtgggacattatttggggaaatgccacagtctgggagtgggtgtaggggtcaaagggcagggaagagcctagatatatgttaactcagcaggaagtgaaacagccttgccaagtaaggaactatctcactcaagatgccaaaagcttcctcactgagaaatgctgattttagagtaccggatattactgtaagttaagcctaaccagagaagtaattggaagtgtccgccctttggactctgaagatgcatatcatatactgagagaataaagtagaatttcctgtagaaattctggagatttccacacttactattttattaaggtgaactaccttgtggatagttttactcagttgcttaactgagggtaaattttatttctccctgtcagtaaagctagcaacaggggggctataaatataaatttccagaatcttacacctgctgaccataaaagtcagtctagatcactggggaagctgcaccaaaagcatgttttcagcagctactgataaagctaacatgaaataaaatcacacacattcaacgtgcttcataacagtgcagtgtaatgaaatccagaggccaattgatagtaaaaatcaggtgttgtaaaagtgtacttcacataaaactaatttgattactctttttaatagcagatgtagaataaattcatgaagatgttaggaacatgggtagggtgagtgaggttcgaggaaggaaagacgacttaagttgttgggaacttttcttatggaaagaacatttaatagtttttccagtgttattgaggttatggatgattcactatgatttcttaagctgtctctgacattttccccaagttatttctaagacagttcactcgttcattcatcactaagaatttgttctttgtagtaggtatgcttctattaagtgtggaagacaaacctgcaaacaataaaacccctgtcgaaggtgataatgtcacagtagctgtgtagataaaatactgtgggaccgaagggtctactccagcaaaccaactccagcttctgatcataatggggcaatcacttaagatacctagaaatgagataaaacagtatttctgctctcccactagattccataacattggttaataagctaggatgactctggtataaacaaacaatagaaatttaaagttcattcttaattaagatatgatatgttgagagtctattttattcccatgtatgtagtcaagtaaatgcttcacttctaaatactgaaactataagatgtcccacagtaattgaattacagacaaaaaggctcatttgctgcagttgcagtaattatgtggtgaagcagttaattttgaacaagtgtgaaaagatgtcacgttgtcacagaaaggatcagaaagagaaaatcactttccactgcagcatattgatctgatacctcagaagcctgatactttgtcctccattaaatcatgtttaaaatatttgattttaaaataacttattgactttcttttttgtttgtaaaataagacatgttgaatgagaataacaccaaaatgcatggagacaaaaatatcagtcaatgcatataccactccatatctgttgtgaacattttattgtttgtcatttcagcatgtttactaggcataaacatagttgaacagtttcttttctttttaattagaattatggtacataaatgttactgtaaatgcatttaatggaaaatatttttattgattgattttgccatcaaattcctatgcctgcccttgttagaggtcccccctgcttccgattttagtgttttatttgatttcacaaagatggtgggattcaaggtgtgatgtggtgtaaacttgtactttttagaaatagatacttcctcatatgtttgccatgtatcataaaattactgccctttagtaggatgggaagcatagttttctttttcagggaaaagaaaatagctattttgctagagaaggaaaacttcagggtattataaggatttatttgtgatcacatttgcctgatgctgatagatgcaatggtatacacattgcttgtttagattgtcgttcttttattctgctttcttaactttgctgcagatgctcttagtcactgcatgttcacatactggagtggttaatgctccttttagaagctaagttatcaggctgtcagtcaagaatgtactaactgctgactttatggatgcgtcccaaaagttagatttggcgttagaggtcacattcatacaaaactctgttttatgagagcaacgaatactttatggtccaagtgctgttggcaattttccagtttctatctatgtgtctatcagctctacactttgtagaaagtaggcatgcatgtgcctgcacatgtgttaaccttaaaagcatagttcttttccatgaaagctgctttattttttcttacccagaaagattctattgtggtaatggtaacttctaacccaggattatacatcttccttaggcttcagttaaatcctactgttgctctctactaactgaactttaagttatcaaaaataagagccttcccattattttactatgtcaatatctgttgttacctccctgcattaaaagaccccagatggaaaattgtctttctaaattcccttcagcaatacctattgcaggtaagaaactattttttaacaaatattataatgtggttgctatttatcttctctaactgtttaacatgaaccatggagatgacggatattttattgttttaaaataagcttgtttcattctacatatcatcattagacttttgccttagcagtaagtatgaaaggttaagaaatagattccatttttaaataaaaaacttaaactatgtttcagtttaaggtcttcaaaatttttcccatagttgcgatattttttttctgaggtaataagccctgtccaaggagatgctgaataactctctaataatgtccaacaatgtctgacatcacagagaaggaattgagagggtctcccaggtagtcaaatggatgctgttgctatggtaagttcctacgtcaccatgacaagcagaaatatccaaggaagcagcagtggcggagcaaaggcagccacttctagcctggcaactaaaagctgaaaactcacatgactgaatttcagggaacagttttcccatagttgagagtggggtgcctaactgaatcatcaatgtcagctatgaacagtaagaaaaatgcctttgtaagatcaaagatagatactgtatttggaatttgttcaggaagagtaactttgcaattgcaaatatacttttaactgcagtatttgttatctgtcttcgaaggagagctgcatgttgataggccacttcctgcctttcatcttttttttctgattgtaggcaaagtgggtgcggggaagcagcaccgtagaagtgccagtccttttttaagagctgttttaaaacatggacaactgaattacatattttagaaagtagagttggttctgaagaaatgcaattttgtggtaattttgtggtagggtcactatgaatggcttccaagagacttctgccaaataatagcagaggtcaacagtataatctatagagaaactagagaacagaaaataagaatgtattagttttaggagccagggtgttatatagactgacaggaggctgccaggatcaagaaacaagttttaagagaataggaagcccatctgataggagacagtatccatgagagtagacactgatttgtcagtttgacaggttcttgttcgtggaatcagcataaagttaccttgatccactttaacttgagggtgtttaatcaggtgtttggtataacgaatgttgagggtagtaatttggggccacattaggctatttgcaaagtcacacttgaatagccttaaccaagatgatttttctaaatgaaattgaaggaagcaaaggggaggaaactcatcaaaggttgctgaaaattacatgtagaagatacgctattccctttccttctcagccttcatttttcttcatcagctctcgccagtgatgcatctgtgagaggataatgcaggctatcctgccatgagtaatggaccttgatttccacttttctgattgcttgctatctgctgtaagtaatgccttacaggcattctccctgtgtcctagagcattttaactaatactctatttgggcagaagtcccaataaccacataatttttcattcaacttttctaatttttgtctttattgatttccagtaaaactctcagtgcagatttttgcacgtttgttttgtaaccacaaggttttttgttggtatgtaccttttctttgtgatattctttcctttgagaatagcaaggaaccctgagaattgttagattgttctcaaaatagatcacttcttgtctgctccattcggctgtgacttctctcattaggataatagaataaaattgcccttaagaagcttttcctttattgatccagttcatttcagaggcggaaagtgaagaagaaactaagagtcctttttattatcttattgtaaataaacctggccatttttactcttaaaaacaatactgtactcattttactcatactaatagtacaaattcaagtaatctcagttttataatttaataggaaaatacgtaaatatgtgtgtgtgtttatgtgcaaaatgtttagttttaacttaccctcttgtggattcacttttacagatcattaaattggtgagtttagatcagttctaacattgtacagttttatctgtgattcccaatgtatgcttcataaaatctcagatctagaaataaccataagagaaaccttctggttttcctttgtctgtttgagcagtagtagatttaatataagaagagctgtctgtgttttttgttgttcttgttttttgtttttttttttcttctggtgaatttctaagactataaacctgtggtgatttttaagtaggaaagtttttaaaactgttttggaagatagttgaaatagtgacagtagttgtctggactttgcagtatcaataatttagcacttttaatggtcaaggacagacccctctttccactagtcatgtctaggggcacttgaactccccattgattttttcatcatggaggagcctctcagtgttccaggtagttcttccctgagcacacgaatggttggattgatgtgaggaggcccacaatttaaaggcccaggtttggccatgtttattacttgtctgagctgcagacagttgtggtgttcacattttctagtgtcataggcagttttgctccagattctgaataaatgcaaaagtagggctaaggtggtttagtcctaaccaacccgttaaaggtccagatctcctaatttctgaaagtttaacatctccataataaattatgcactgaattgtgtctaaaataaaaaatttatatttattaagggcctctatggctttgctttgaggacattagaaattgactttttttaaggaaaaaaatgtttttcaatatactttctaaatagatgttgggaattcttattaaaatgttggagaagttattttttccttagtacagaattctaagaaagcacatcagaaatgtttaaaatgtcagaagttaaaaaacaacttagtgacggcttacaaaattcagctttaagccaattttcaaatcatagaatccagcgttaattaataatggagggcagtttgcataaactgggaaaaacagggagtgagacaaatatacaaaacagctgttacagtttttcttaagactcagctacacagttaagtttcttttttttttttttaacgagtataaaggctctgtgaaggcccgcatagctgatatattgtgtctttatttttcttgtagagaatggagaggggggaatggagaacttatagacagagaagcggggaatgcaggacagcctggcccctgctggagataaggaggtaaaatcatagcatacagtggtaataacaggccttcatggtcatctagcccaactttttgatgcttgaagactctccacagtttttcagcttcatcagttgctaattttgtcttgaaccggcctgacattggatctatttttccttttgtgaggtgaaagccaggactagacactggtcatttttactctgtctggtaccattattggtcccatagttcactacccaaaaagtgctctacaagcaacagaaaatgaatatggaaagtacaaaatggtccgggcacggtggctcacacctgtaatcccagcactttgggaggccaaggtgggaggatcacctgaggtcaggagttcgagaccagcttggccaacatggcgaaaccccatctctactaaaaatacaaaaatcagcagggcatggtggcacacatctgtaatcccagctactctggaggctgaggcaggagaatcacttgaacccgggaggcggaggttgcagtgagctgagattgcaccacagcactctagcctgcgtgatgagcgaaactccatctgaaaaaaaaagaagaaaaatacaaaatgttatttacactttattacattttatatctgttcccagattatctttgaccatttctgtatgaatgccacaaaattccagttctgttctctcttcagcattactttcctataaaggcccagccagttcttctaggtcaatcctgaggttccaggaatggccagttacctgacctatttcctgtgatcacatcccttgaaagttgctgaacctacttagtcctaaataatagcacaacaaataactgaacagttcttttcagactcttttcaatgtgttgttgatgcccaaagtaagagaatccaggtcacagttggcaaagtttgcagtggcaggaagctcttggggaacccagggttccttcttgaccgtgtctttggcagtgtggataaatttagccattagttaaggggttaataatgggacaaattgagatcatcagagggagtaaagagaattgtctgaattctccaatggcttttataattgccaagtgtccagtgctgagaatgttatattattatatattatctattccctaatgatttggaccacatttgttgcactctattacctgctgcctagtttccaaatggttttattattatataggttttatctcaccaacaagttctttattgttccaactcatattttataatcactgtcatctctcttaatgctagtccattaataggtcctcaaaaggttgatttgggatcagaaggtctccctagaggagttatatataagagctatgaaagaatttgcccaccttttagtacagatttggcagtcatcaaagcaaatggctgggagagctcagcaagcagaattctcctttgactcctcagtgagcccctacctttcagttcaagggaagctataatgtgatataaaatatgtctgatatttgctgttagattgtgatttttggtacacagcagacaacgacaggttttccttatttttttccccctagaatcagggcgatcaagtatattttattttctccagttggttctttttcaaattttcgcctaaacttttattcttaagccgtatagtagtacatattttaaaatctagcaatacttggacatttgtgaagacctttatttggtacaaaatgtcttttgaatttttgcttgtacttaaaaatatttacaataaacacaggaagttgtatgctactctgagattataggggaggtttgtagagtgcccttcccttacgtgctgtgttgcttatgaaaatgacaagctttcataatatctgttaaactgtaacctgcctattgtgttcagtacagaatgctgaatttagttaaaatgttaagatatgtttgttccacttctgcctcagaaaaattagatggagatgtgtgtgctctccatcaataaagcgtatttgttttgaaagatgcagcactcacgggctgtcagtcataacgacttctgagagtactttaagagctgcagcatcaatatttacaaaatacaaagtgaagaaaagtacattgcgtcacagacatgtgctgtcttgttccgattccctccctcctcagtgtatttagtatagttaagtctatatggaggagtatttgagatacgaatggaagtttgggattcctctaaagtaattactgagaggtatgaatgaaataccaacaaggcttgtaaaatggaattacttttcctcccaaagtaaatgtattgattaaaaactaaaatcagtgatacaatcagatggaagaaagtacctgtgtttaaagtccagagcctttataggctgtgttcctagtttgcttcttaatgacattataaagattatgtaaatctctctgaggcgcctctcaaatgggcataattttacccatttcatgggattttgtaataataaatgtgtgcaataaaggctttgtaagttataaagtggtacatagttggaaagcagcaaataaggtagcctagggttttttaatggcagtactagctttttgtataagaaaatatatttggaacttattaatgaaatgtactcaagttgtatattataaagtgctttatcataaaaaattaaaacgaatgtattagatatgtcagaacaatgactttattattatattataatctatctttgaaaaaaactaaaagcagcatgggctcacttttagcatatagtctctcttatttatcctgtattctgccactaactcttgtggcctggtaaattactaagtgaaagcattctctccctcttgtttccccaacataatgccattgtgtaaatatggaaaggcttggttagacacttatcacaaagtacgttggagattccaattagaaatggactaaattaatgagaaatggttttagcagggttaagaatcttgcttaggggaaaaatgatattgtatttgaaaattcttgggtttaactcaatatgtggatggttacctatccctaaaatcagcaaacacaatgccttaatgatataaagagcttcttcagtgatttcccaggtttatatggtttatgattattttacagagtagcttttttttggtattataaagcattacctttatatttaaataggatgctagaaaataaaaatttggccagcagagggagcagacttatgtaaattgggctgtaaggaagatactctagggtacttcagtaaacgtgtatcttgtgggtagtgatttacaacattcttgtactgtgcattgagaagaaaattaaaggaaggaacttcagtcatattaaaaccagttctttatgttctcactttgatgcccccccccctttttttttttttttttttttttttgagaaagagtctcattctgttacccaggctgaagtgcaatagcatgatcacagctcattgcaccctctacctcctggctccaaggctcaggggattctcccacctcaacctcctaagtagctaggaccaccggtgtgcaccaccatgcctggttaattattaaattttttgtagagacagagtctgattatgttgcctaggctggtctcaaacccctaggctcaaacgattactcctgccttgacctaacatagtgctgggattacagacatgagccatggcacctggccactctcgtactttttaaaagagaaaaaaggcgagcaaataatacacgaataggaactgtgttttgttattgttgttattcttagacatgaagaatcttttgtaaataaatgtcatcaatttagtaaatttactggataaaaataaggttttagtacttggctctggttggagcacattcattctaaacacataaaaggaatataaataacacctgaaagaaatataaaaggaattgttaatgttctaaacagagcactgttatgactgaatcatcaagtaagcacttacattttgtatcatatatattaaatcaggaaaatggaaaatatttaacataaaaatttcacccagcatgacgcaagtataaaacaaacggttttctgctcaacactagttatatagaaattaatcaatgatagcatcctatgcattctaattaatttccttggcaaatgtgcaggctgatataagatgattggattcatgcatttacaagtactatttattaaatacgtatattcaaggcagtattctaagcatttgggaaggtaaaggtaaaccacacctacctttatgtaatttgtaatttagtaaatggtgagtctaattctagtgtaccaaagtgaaagtaggtgggcgttgcagcagctaggataagcaacttcgctaaacactatactacttaaaataagaaatacgtattctttttttgcttttgagaaaaatatttttgttttgcaaccattaagattgagaagttttgctttatgaagtgaagtcgatttgactgttacttaagttattcaccatctttcttacagtaaagaacagtagctaaggaaaaagatttccaatcagtgatacagactattgattcttaactaaatcattgtttctgcattgttttttaaaattataattagatatcaggatgatagaaaacatccagattttttaattattttatttatttatttatttatttatttatttattattattatactttaagttttagggtacatgtgcacaatgtgcaggttagttacatatgtatacatgtgccatgctggtgcgctgcacctactaactcgtcatctagcattacgtatacctctcaatgctatccctcccccctcaccccaccccacaacagtccccggtgtgtgatgttccccttcctgtgtccatgtgttctcattgttcaattcccacctatgagtgagaacatgcggtgtttggtttttgtccttgcaatagtttgctaagaatgatggttttcagtttcatccatgtccctacaaaggacatgaactcatcattttttatggctgcatagtagtattctatggtgtatatgtgccacattttcttaatccagtctatcattgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacgctgacttccacaatggttgaactagtttacagtcccaccaacagtgtaaaagtgttcctatttctccacatcctctccagcacctgttgtttcctgactttttaatgattgccattctaactggtgtgagatggtatctcgttgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgacaattttggcttttgttgccattgctgttggtgttttagacatgaagtccttgtccatgcctatgtcctgaatggtaatgcctaggttttcttctagggtttttatggttttaggtctaacgtttaagtctttagtccatcttgaattgacttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctgtatctctgttttggtaccagtaccatgctgttttggttactgtagccttgtagtatagtttgaagtcaggtagtgtgatgcctccggctttgttcttttggctcaggattgacttggcgatgcgggctcttttttggttccatatgaactttaaagtggttctttccaattctgtgaagaaagtcatggtagcttgatggggatggcactgaatctgtaaattaccttgggtggtatggccattttcacgatattgattcttcctacccatgagcatggaatgttcttccatttgtttgtatcctcttttatttccttgagcagtggtttgtagttctccttgaagaggtccttcacatcccttgtaagttggattgctaggtattttattctctttgaagcagttgtgaatgggagttcactcatgatttggctctctgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatcttttgagataatcatgtggtttttgtctttggttctgtttatatgctggattacatttattgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctattgattggaatagtttcagaaggaatggtaccaattcctccttgtacctctgatataattcagctgtgaatccatctggtcctggactctttttggttggtaagctattgattattgccacaatttcagctcctgttattggtctattcagagattcaacttcttcctggtttagtcttgggagggtgtatgtgtcgaggaatttattcatttcttctatattttctagtttatttgtgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgagtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgaattctagtttgattgcactgtggtctgagagagagtttgttataatttctgttcttttacatttgctgaggagagctttacttccaactatgtgatcaattttggaataggtgtggtgtggtgctgaaaaaaatgtgtattctgttgatttggggtggagagttctgtagatgtctattaggtccgcttggtgcagagctgagttcaattcctgggtatccttgttgactttctgtcttgttgatctgtctaatgttgacagtggggtgttaaagtctcccattattaatgtgtgggagtctaagtctctttgtaggtcactcaggacttgctttatgaaactgggtgctcctgtgttgggtgcatatatatttaggatagttagctcttcttgttgaattgatccgtttaccattaagtaatggccttctttgtctctttttatctttgttggtttaaagtctgttttatcagagactaggattgcaacccctgcctttttttgtcttccattggcttggtagatcttcctccatccttttattttgagcctatgtgtgtctctgcccgtgagatgggtttcctgaatatagcacactgatgggtcttgactctttatccaatttgccagtctgtgtcttttaattggagcatttagtccatttacatttaaagttaatattgttatgtgtgaatttgatcctgtcattgtgatgttagctggttattttgctcgttagttgatcgcagtttcttcctagtctcaatggtctttacattttggcatgattttgcagtggctggtaccggttgttcctttccatgtttagtgcttccttcaggaggtcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatactggcccccactctcttctggcttctagagtttctgccaagagatccgctgttagtctgataggcttccctttgagggtaatccgaactttctctctggctgcccttaacattttttccttcatttcacctttggtgaatctgacagttgtgtatcttggtgttgctcttctcgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacatagatttggtcttttcacatagtcccatatttcttggaggctttggtcgtttctttttattcttttttctctaaacttcccttcttgcttcatttcattcatttcatcttccatcactgataccctttcttccatttgatcgcatcagctcctgagacttctgcattcttcacgtagttctcgagccttggttttcagctccatcagctcctttaagcacttctctgtattggttattctagttatacattcttctaaatttttttcaaagttttcaacttctttgcctttggtgtgaatgtcctcccgtagctcggagtaatttgatcgtctgaagccttcttctctcagctcgtcaaagtcattctccgtccagctttgttctgttgctggtgaggaactgtgttcctttcgaggaggagaggcgctctgctgtttagagtttccagtttttctgctctgttttttccccatctttgtggttttatctacttttggtctttgatgatggtgatgtacagatgggtttttggtgtggatgtcctttctgttggttagttttccttctaacagacaggaccctcagctgcaggtctgttggagtacctggccttgtgaggtgtcagtctgcccctgctgggggtgcctcccagttaggctgctcgggggtcaggggtcagggacccacttgaggaggcagtctgcccgttctcagatctccagccgcgtgctgggagaaccgctgctctcttcaaagctgtcagacagggacatttaagtctgaggaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgctgccaccttgcagtttgatctcagactgctgtgctagcaatcagggagactccgtgggcgtacgaccctccgagccaggtgtgggttataatctgctgctgcgccattttttaagctcgtcagaaaagcgcagtattcgggtgggagtgacccgattttccaggggccgtctgtcaccactttctttgattaggaagggaactccctgaccccttgcgcttcccgagtgaggcaatgcctcgccctgctttggctcgtgcacggtgcgcgcacccactgacctgcgcccactgaatggcactccctagtgagatgaacccggtacctcagatggaaatgcagaaatcacccgtcttctgggtcgctcacactgggagctgtagaccagagctgttcctattcggccatcttggctcctcccgccttttaattattttaaactaaaacaacgactaagtcatatgaaagaaaaattaccttttaaacttttaccattttagatgaaatttaatatatatatatgttttttttaaaaaaaatgtatgattgctcttaaaattcaaagagctaggccagatgcggtggttcacacctgtaatcccagcactttgggaggctgaagcgggcggctcacaaggtcaggagtttgacatcagcctggccaatatggtgaaaccccatctctactaaaaataacaaaaattagtcaggtgtgatggcatactcctgtagtcccagaaacttaggaggctgaggcagaagaattgcttgaacctggcaggtggaggttgcagtgagccgagattgtgccactgcactccagcctgggtgacagagcgagactccatctcaaaaaaaaaaaaaaattccaagggctctgtgtaacctggagcatggaagattaaaaatcagtgttcggtgattgatacaggagaaaagggaatggataattatttctcttctgaggtcaaaattacaaatagagagtcattttttctctcttcagatctgcaatacttagaaactatttctaagtaaataaaatcaccaggtgttttagtttggcagtttgaatatgctatttgagtaattgttaggaatgtctgaaacagagggtcacagagcagggcatggcaaggacggattagaaaagaaggatggtgaacaaggaaaaggactatgggcaggaggaatggacttcagggaacagtcctagaactcattcattcattcatttgcctgcagtgcgcccggctctgtgtcaagccctggagacacaccatggtgaacacgatgcagcccctgttctctgtcacagttgagtgtgatataaagaaggaaacaggtcatttcagtgtagcctattaagtgtagggtgctgtggagacacctctctcagacttgaaaggaccagaagtggcgtgaggtgagatccaagctaagccccgaagcagggataagagttccaccggaaggaaacagcagccaggttccaggaggtgggagtgcatggcaagctccgggtgatggcatgtggctcaatatgggtagaactttgaaagtgagaatgagcaaagaaacatcagctgtaaaggcaagctggactaggtcaggaagagtcttacatgtttatgtgaaggaaggaatttggaatttttcattaatacattgagggactattaaagagactccctttaggagaaggacatgagcagatatttgttgaaaattaaagtcagcaaagctataggtaagaagatcagacagctgaaccaaccttgtggggctggagaggagtagactctttgtaagaggtagaagggacagatttttgagagattagatgtcagggtgaacagctgattgcagtgatttcagtttatgaagagaaacttgcaaagaaagataggctttccagatgcttatgtgaagggaagggatgtctagtttctattcaccaggctctgacataactccacaagggtatggtggaggcagaggcctggcccagacaagatattttctcgagaggatagaaattaaagacatgtgagtcatagtgaggtagagaagccagaggtgatagacatgttggaacaatttgtaagttctttctaggaaactaatcctgaggtttagaagcaagaatattaggaaccaggtcacttagtgaagcacatcgttgggtgtggaggctgtgaacaaatgacactatcaagcagcctggttcttggatcctagctgcattaggcagtaccatagcctaagggctagaggccagtttgtacaaagaaagaggactagctaaaggagagtgagaattcaggcaggtctttagacttgagattgtgtatagactgaaggagtagaataaactattgacagttcatcaaagtaactaaaagactaatggctcaggataactggagggaaacatatagattgggagtgtggtgagggaaggagttgaccttgaatctctacctttgaaagaaaacagaagaagaaaataaactttgaaagtggcagggaagatgagaatttgggagggttcaggaaaattaacaccttcttgctagttaagcaggaggcaaaggtattttctttcatcatcattattattattattattattattattattattattattatactttaagttttagggtacatgtgcacaacgtccaggtttgttacgtatgtatacatgtgccatgttggtgtgctgcacccattaactcgtcatttagcattaggtatatctcctaatgctatcccttccccctccccccaccccacaacagtccccggtgtgtgatgttccccttcctgtgtccatgtgttctcattgttcaattcccacctatgagtgagaacatgcggtgtttggtttttgtccttgcgatagtttgctgagaatgatggtttccagcttcatccacgtccctacaaaggacatgaactcatcattttttatggctgcatagtagtattctatggtgtatatgtgccacattttcttaatccagtcgatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgagggatcgccacactgacttccacaatggttgtactagtttacagtcccaccaacagtgtaaaagtgttcctatttctccacatcctctccagcatctgttgtttcctgactttttaatgatcaccattctaactggtgtgagatggtatctcgttgtggttttgatttgcatttctctgatggccagtgatgatgagcattttttcatgtgttttcttagagtgacaaggattgcaggggaagggcagtatggggacatgattgaaagctcaggctctagggaacggaagaccttgttttcattcctggtcccatcatgtgctggcagagtggccttgggcatgctgcttaaggtttgtcattctcagttgctttatacttaaggtatattcattgtaggatctttcgcctagagttgtattaaggattaaagaaattaattcatgtaaagtgtttagcatgtagcaaatgttcaataaaatttgtgatgatgaagcaatattgtataatggtcaagaaccagactgtgaagccagaccgctgagttcaaatattagcttcaccaatttcatgctagtagtgtgatttataaacataattcatagctcaccaagtgctcagtaaatatgtattcaactgcattgacaataaatatggagactccatgaacttgtcttcctgtgctttgagttcttgccaatgtcatgcttatgttctacccatttgacgaatggatacagtaaaaacctttgttaatttatacactaaaggaagcaaaatatgttatctctgcctcaggtttctcatctgtaaaaaaaaaaaggggataatagtacctaccttttaggcttattgtaagttaagagagttaatagatataatctcttagctctggtacataggaagcattatatatgtctagctagcattgtcacatttatccctgctcaccatcatcagtaggagttgagaaacagaatttataatgggcacggtgggattgactatgtaactgagtaagacaagtaaaaaggataaaagtaaagaacaagtgataaagcacttaggaccaacctgagattgaaaacttttgtagtagggtcagaacacaggagcagccagaaacctggggatagacctgagaagaaaaatggttggagaagtttagagttagggtttattactggaccatttgtgaaactataagagagccagtgagctgaaggtataatagtacgctgttttgagagaataatgaaagtcattgacaaataaccagagaaaggaataaaggaacatgttttagacagctgtttgaaagtgactttgattttattgtatttattacattgccttgtcaatttgcttgtttcttttctctctcctttcccatccaaacaacctttcctggcttcttatttcttcttctctgcatatttcaagccttttgtccattctgccttgtagcaaaacaacataaagaaacgcataataagaaaacagagaagtattgtttctatgttcaattctccacatattcactgaacatctattccctgtctagcacagaaatctttgctctgacagatccaaaaaaagcatctggcatgttcattaccctcaagggtctctgtgggaggaattcacatgaaatcattatacatacattgtacaggaaaatgataattgtcatacaatcaagtgtcaaaaattatggcacagccattaagtgttgcagtgatcaaaaaaggtgctcagaaaggagagagacatgagctgaggcaaacacagccttttagaaatggatgttcagagaggcctttcatagagagggagaatgggggtgtgggggacggtgtgcaggcctgggagagcagagaaaggactgcgcagaagcatgtggcgggtgtggagagcaggtcaggcaccagcccagcaggaggtgagttgaatgggaggtaagactggacacttaacccttccagagcatagctcagcaggtgatcaatacgtatgtgttcagctgcattgagagtaaaggaggaggagacacccatgagctaatcttcttgtgtttcagcttcttgtcaatgtgatcattatgtcctagccatgtaataagtgcatataataaaaacctttgtgaatttgtaaactgaaagaggcaaatactgttttgttaggtccactgaagaatagaaatttggtgactttttgattaagaatgtaaacacctctgtaaaattataggaaaacagaaggttgcatttttggaaggtgtggtggggaacatagtcctagcttgctactgacttctctatgtatatagcttttcctcctcaagccacctctttggatgccttgtctctttcaaggtagctttcgtctctgtttgtagcctagaacagcattccatttgagaaccatgttaagctgtcccaaggctaagtgtcgtggagtgcaggtattagagatcttaaaactacatatttctttatgagttaaaggcagagggaccagaactgccagtacagctaagcccttctttgaatagtgggtgccttattagtattcatgaagagcatatcgataacatcttgacagagttaaagtttcaacttgaagagctactgcttttcaataaggagcatatttaaagacactttttgcatgactagtgagtgaattgcttctaaaatgagagtattactttattgaatgagatatttttcatgtactttgtctacagtttagaattgtcattagaattacaagaaataataatgattagcacttgtagggcttttatcttcaaagagttttagagttaatctaatttaattgtcacttggcatcatcagagatgtgtatttgcttttctaccatgaaaagtggtgttcccttaccagccccttaatgcttccttttggtattttcatggtctatgagctgtttgttctataggaaatagagagttggcagattgaagagctttgtattatagctctttttcccaggtaagcatttgggttctttgagctgggtttcctgggtccagttctggttcctctacttgccatgttatcctgtgcatgttacttaaccctgttgctttaagtggaattcatcacagtaactgcatcagagtgtttttgtgaggattaaatgagaaggtaaatatgtagcagttaaatatttaataaatgttagttgcatatcagaattttaaaaaaaatttaggagcatgtcattctgagaagtcatatgtggttaagtgttagatgaggaaattataagccaataaataccctttccagaaactactgtgcagtaggctccgtgctaggcactgagaccaaaaaggtagtgatggcacctgcactctgaaggtcacaaccttttgtggacgtggagatgtcttaatccattttatgttgctataacaataccacaaactgagtaatttataatgaacaaaagtttatttggctcacagttctggaggctgggaattacaagagcatggggccaatatttggggaaggcttttgtgcatcattattccatggcagaagagcaagagaggatgagagtaagaagaggctaaacttgctttaataacaaacccactctggtgatgactaattcactcctacaatcacaacattaatccagtcacgagggcagatcccccatgactgcattgcctcttgttaggccctacttcccaacactgttactctggggattacctttggaggacacatttcaatcaaagcagggtgcaggggagttgtcaaaacactatgataagtgcttgacctaacagaatcaagtacaatcaaagctcatagcagagtgatggactttgacttagggctttcagataaaagaagagatatttgacccgggtcttggaggatgagaaggactttcagagaaaatgggagacttttaaggtgagaaggagaaaggcttcaaatttggagtatttgctgttttctgtggcagcaggaccccttgaaagactgaaagcaaggtgtgatttgaaagtcccagaactctttagaaagaatgaaagcaggtgggtccaatttgtgtggaagtactagagtttccactatgttacagtgtctttgggctggtttttcctctcctccgtagactctggagaaggccgtgcggttttgtagtcttaattggacccagaagaggccctatttgtggttagaatatgtggttgtctagcagtggtatttaatgggcctcccatactctcctgtttcactgggcgtgaattttaatgaccaggatttgagtggaatttcattggacttttaggaaacagtttaaaataccaccgtgacacagttcagtgtatactaatgttttaatgattaaagtgtaactgattgcctaaattgtaagacaagacaatagatgagaggatcttattcacaaaatttatgacggtgccaaggcactgtttctgactgtgtatcactcagacaaaggaaaggaaactctccatctttctttttcagtttctgaggctgcagattatatcatctgggcagcatatggatcactatcaaatgggagacatctatgctcccttttgaatgacatcttaggatgagtttaagtgagcagatgctgcctgttaatcccatgcttcccagtctaaaaagcttgttgagtaaagggtggatttgccaacagtgaacgagaatcttctagacactgtgctgggtattacatgtgttctcacagtagagctattattatttagttttaacatgaggaaagatcagcacaagtattaactttccaacaggtagtttgtggtagaggcaggattctaaaggaagcctatcaggctccagtgtcctttttttttcttcttcttttaataaatatggcatttgctttgtactctttccttctaaaatctttcttctttaagtttctcatgaagtctgacctcagtaaacgtccttcatgaatgagcttgctactttttttttttttttttttgatacagagtctcactctgtagccagactggagtgcagtggcataatctcggctcactacaacctctgtctcctgggttcaagcgattctcctgccccagcctcgcgagtagctgggactacaagtgcatgccaccaacaaccagttaatttttgtattgttagtagaaacagggtttcaccatgttggccaggatggcacaatctcttaacctcgtgatccacccgccttggcctcccaaaatgctgggagattacagacgtgagccaccacgcccggtttggcttgctacatttgaagaatataattaaatgaaatttttcctaatctgtcaatttacattgaattcagtacaatgaatgtcaatttagggtcacctgtcctgccatacacagaaagggggcaaagggggtacacatgggttggtttttttttcacaaggtaaattttggtagggggctttatatcatcatttgacagtctcagcagcataatttgatgatgtttagtttttcaagtacagagtccattgatagttaaataacctgatttcaattattctaaaattgcaatgcagaatggaagaataacgtcttttgaataaagtccaacatttgcttcatttactgcatagaggttattagcttaatttgctcttgttctaagaccaagaaaccaaactttaaaatgtgtgggctttttagtggcaaaataatgacaagattagtcctctgtcacttcaaaaattaacaattttacctcctcctcattgttgaagtaagatgagtgataacattgtctcaaaattatgctttctttgcccttgtctttcccactttttttcatctttttaaaatgattctctcttgctttctcattacttctgaatcataatcaggaacatcatttcccttcactgttttgccttctttcaataatttgaacatagatccataaggaattaagaaagaattagataactataaattattaaagtgcacagtttatactttgaggtatttcatagttattagatcaattacagtacatttttcttgatttttcatctgaggtataccatttccaattcacttactgttttattcatcttctgtacctgctaaaaatgtacctactttgttccaggccctgtactaggggttgccagccttatttctccccaagcctgtgcatctggtggttctcagacatcacatgccaccttggtctgtgtgtctgagctgtgcacagttttcaattccctttgtttcccacttagaaaagaatatctgaattcaggaaagtgtaagaaattgtagttaatcttgaagctatcctggagaatataaatagtgaatcatcatcacaatttggcacaggagtttgtgtcattgtttgtgacaatcctcacaactaactgatcttaatgatctgatgtgccaggatgtttctgagtatagtcttggaccattaagaaaaaggcctagcaatggaggtatgatgtatctaaataattataattgaagggaaaatgtggtaagtgccattagcaatgtagagtctttctaatgtatttctgggtgagaaagattaatttctggagtatcagaaaagacattttctccaaagtggtatgtgagctacgtgggaagaattagaaatgagggaggactgaatgcgattattttgaacccagaaagaagccacatataaccctcattaatttgattcttgagaccctgtttttctctttgaatattgaaattacatgtatatacacaaaggtgcacacatatccacacatatatatacattcacacatagttaaataataatttaattcaaaattttgggggctaaagatttatttttctcttggcagtggcaatcactttaccctctccaactgatagaagttgccttacttacagtttcccactgatttcttttactgtttaaaatattagacccttaaatgggtttaactaccactcaagcaactcatcctgaagtgattactatgtcacagaaacaaccatttcctcttctttctatacagcattggcatttctggaaattgagttacctgtgccaacttttatttgtagatagaatgggaattgttaaatggactatcaattcacaagaaatcttctcttattaagagcacaccagatacctaattccatttagttttcaataacttcttgtattattgagtcagccacacaagtcatgtaattgcttcagatattccagcatgagcttcttgctaagaatgccacaagaacatgtttttcttttccccctttctttttcttgactggacatagcttttaataaattaatgaaggccgggcgtggtggctcacacctgtaatcccagcactttgggaggctgaggtgggcagatcacaaggtcaggagttcaagaccagactggccaatatggtgaaaccccgtctctactaaaaatgcaaaaattagccggttgtggtggcgggcgcccgtagtcccagctactcaggaggctgaggcagaagaattgcttgaaccggggaggcagaggttgcagtgagctgagatcgcaccactgcactccaacctaggcaacatagcaagactccgtctcaaaaaaaaaaaaaaaaattaatcagaacttttattaaaaatgaagatttttttagaaaatgattttattaaaatgagttattgtagcataataatcttttcatcaatagtagactcagtaaattgtgatacattcatgttttagaatataacacaattattttagaattagaacaatcgacatatatttacctacatagaagagtatgatatatgcagcttaaattttttaatggctgtttattgatatatttgtatatttaaaaagatgtagaatgatatagtccctaaggacattgaaattggtcaaaggataggcaagcagttggagggaggttattaacagaagagaatccagaaataggctcatatacatgtgataatttaatataggatagaaggaataatgaaaagctggattatttaataaatggtattggtatagttggctagctatttttttttaaaaaagaagctagatccttacctcacttattttatcaaaatgaatcccagattaatcaagtatttaaatgtttaagttgaagttgtacaagttctaggagaaaacattggtgaataattttttgaagtaaggaagacctaggcatgacccagaatccagaaataaggaagacagataacctataccatattctctgaacggcttgagaactagatgaatctttatattatgtgttcattaatcccagtttctgttttaacatcgtgttaaaagtttaatggtaccacttctcaagcatttggactaatgcaaacatactgagcaaataggctgctacctggtaattttagcaactgtacttgtgtttgtattgtcagcattcatgaaccatttaaaccaatggcatttaattgtattgtttgagtttttccatgacagtaatttctattttaacattactttgaatgagtgaatgaatgaatgagaagtaacatcagaaaaaaagttgtgagaaaacatacaggaaactaacatgcagttacctctggaccatggtgcaggacatgatggagagggcaaacctcgttttatgctattttcacctgtttaatagaaatatgtattgcttttatcatggagaagaacttttttttacatcaatgaaaagtaattcagaattttaggcttctaaaagatttttgtcacgtttatagcttggccattgcttggccatttcttagcttagccaactgcccaaatctaaaatgttggattcttacaaattactcattttatttagtaatattgtaagcacagatttaacatggtatagaatgcaaaattcatgtaaatcattatagtaaaatagccatcagagaatgcctggggggcaagcccctgtgaactcttcaactctcttgggaggcatccttcatgttcttctgatgggaaattgagaaacgcttccctgagtaaatacacacaggtgaagacaactggtaacatccttaagcttactggggttttaggttcagaagctatggagaggagggaagtagatttcacaaaacgcaaattttattagctccatttagcccactaaaatgaatgtttcattatgtattttggattcattatgtattatgtatttatctaccagtaaatgagctgatagtatagtcattaaaattataatctaattaatcctaaagggagctaaataaactaattgtaatcaaatttactttgatttatctcggtgtctctctttctctccctgtttccctgtttctctctctctcttcctattacaggtcacagtaatgaaaggcagtaatagaaataaggatcattcagcagaaggagaaggggttggaaaacgaccaaaacgaaagtgtcttcagtggcatccattgctagcaaagaaacttcttgatttttcagaagaggaagaagaggaagacgaagaggaggatattgataaggtaagtcctatatttaccatagaagtttcaagtttattagagcaaatcataatctagaaacaatagtgaacatgaatgatattacaaaagtgtttccaaaagcctgtatagcttgaatcctattcaattacttagtttacatttttattccaattcttgattgctcttaaagtatttgtacttcctaatagtgtagactgagacacatccttttaaatacgatttttgtcacctaactaatgatttgtgggtaatgttcaaatacattgagatggggatgttcctaaaacttgatgtgctcatctgacgttctaccctgtggctcttctggcctctctgtcttggcttctggcctcgccctgctaccattggcagtcttagaactgctctctttgtctctatccgtggccttcacagcttctggctgcacttgcccccagtctttgtgatgactcattcctcctagtcctttctctggcatcaggcctcagcagctggctcttcagtcacataaccatgcaggtgacttaagaaatcgtctcaagtgttcgtcccacccaactcattcaaagtcaaaagattttcttcatggcacttattgctatttgccatgtatttagctgtatacttatttatgtctgtcttctctcagaccagaatagaagctcagtataagaacaggggccttgcctgtctcgtcctttcctcttgcctcagaaatgagaatggtgcctggcacatagtaggtattaaatatagatgtatgctgaatgaaagaataaatgagtacatattttgtgtcactacgaattttataaacatgtttttaatatttttcaggcctttgacatccattcagtctctcttggctttcatcaggaattaaaaacaattttactctttttcagacatcatctggataccctctaaggtctctcttactaatgaccttttctcctttttcacagagaaaatagaggccaccagaagttactcttttagcttcctgtacacatctatgtaattgtctcactccttactaatctttccttccacctttcctgtttcagagaaacaggttttattcttcttacttgagggtattatcaagcttgtacttaatttcattttttaaacacatttgcatgtgttgatcacttggtcattgaagcagtctcctgtttccatgagggcacccactcctgtttctcttccttctttcctttggccacccacacctgtttctatttatcctttcttttttttttagaaagggtctcactgtattgcccaggctatagtacagtggcaccatttcagctcactgtagcttccatccacctcccaggctcaagcagtcttcccacttcagctccctgaatagttgggaccacaggcacacaccactaagcccagctaattttgtttatattttgtaaagacagagtctgactatgttgcccaggctggtctggaactcatggcttcaagcaatcctcccttctcaacctttcaaagtgctgggattataggcacaagccaccatgtctggcccctctttctatttctaccttccccactgttccttcctagtttctttcagttaatgtccctgcattatttacccttcaaatgattgtgttctctaggcctccaatcttaatttctacctccatcctggacttttcttctgaactctggactcatatttctatttacttggtatatccattagttatcaactagaaatctcagtttgaatgaattcaaaattaagcttttgcttttcttctcccaaccttctcctgcatcttccctttctcagtaaagggcaactgcaacattcccatttgtccgacctgagaccttgtagttcatactttgctgctttattttgctcaaacttcacatccatccattagcaaatcctctcagactctaccttcaagatatgttcacagttttgttgcccttttaacagttccttcctgtaccaccttgatccaagccaccaccatttctagcagagattattgtatctacctccctctctcccggcctctgctcttgccctcctgcagtccattctcaacaaagcagccagaggaatcccttcaaaatgtaaggccagttgtgcggctcctgtttctgtgagggcagggactctgtgtgctcactgctctctgtgctcactgtgtgctcacagcacctagaagagtggctggctcatagcaggaacccagtaaatatttattgggggagggattaaagtcattgagtcctcttctcttttcactcacactcagtggtctagtccatacttttagtcttagcaccttctgcatattggtatctcatattattatcctgcagacataggtatccacacagcattccccatagccacttcaaattcagcctgcccagcactgatctttctactctccacctggctgatttctctcatttgagaacaattattttttgttgtatatgaagaaactttgccacccaagccagaatcactcttcctttttctgccttcagatccaattagttaccagccactcttgtttctgcctcataaatattgtccctgttctcacttctctgttcccattactgctgcctagatttcagccctatcccttttttgcctggacagctggaatacatttttaactgggttttctagtttgggttgcttctagttttactcttaaaattcatgctgttgttagaagttatctccttaaaatacaatctaatgatgtccctccactgcttaaagtcactcatggctctccattacatcaatccagctgtgggaactagtgttgatttttcttagaaaatattaatgagctcctggggaaagaaaaataagttctaaactctaagagcgtttttatttgtattttgttattcatgtatttatgtatttactttttgattaataaaataattacattaaatagcaattaaaacatttttcgatgttcatagttggcagaatgaaaagttgacaaactgtgtcaaatcaaatgtttttattggtccatacagttccaaactgctggtttacaggatcaaatgcatgcgtttaaatatggcagagcacattcttcatgaagtggcacagatcatcttcttcatccttgtctcctgaagccctgttctcttttacataccagtgttgtcgaactgcaagttaatgttcagataaaccagcaagacttaatccctgttagttccccatgtctctccattgacgacctgacacattctgatttgtttctcctttttttaatttgtaattttttaatttttttaataatttttttcttttttttttttttttttttttttttgagacagagtcttgctctgttgcccaggctggagtgcagtagtgtgatcttggctcactgcagcctcctcctcccaggttcaggtgattctcctgcctcagcctccagaggagctgggattacaggtgtccaccaccactcctggctaacttttgtgtttgtagtagagactgggtttcaccatgttggtcaaactggtcttgaactcctgaccttaggtgatccgcaccccaccttggcctcccaaagtgctgagattagagccaccacacccaacctgatttgtttctcacaatgtagctcaggcaaccttttccagggaggccttcttgcgcttcttcccatccactagtgctttgttatcttgctggtttcttgttgcagtcagcacactgcttttaaatttatgtttatatggtttttccccctcccaaaacatgaggtcctttgtccatctgttacacgttgaattttataatttaataactgaatgaaaagttactcttttctgaaggggaaatataattgcttcttcatcttatatattaatagtacactttttagttttttttagcttcctagtttcagaatgctaaataaaactcgcttgaaaaatgcaaattattgttaccattatatacataatgaggaagataaatatgtaggcttcaccccaataataattcctaacatatttccaaattagatggctatgacctcaagattttttctgtactctttgtgtttgaagataattaatggttaattgattgcatttgaaatacttaacggcaaaagactttttttttttgagacggagtcttgctctgtcaccaggctggagtgtagtggtgtgatcttggcttactgcaacctccgcctcctgggttcaagcaattctcctgcctcagtctcccaagtagctgggactacaggcacgcgccaccatgcccagctaatttttgtatttttagtagagacagggcttcaccatgttcaccaggatcgtctcaatctcttgacctcatgatcctcccaccttggcctcccaaagtgctgggattacaggcatgagccacccgcctggccaagactttttaaaaataccagttggattaagcaggtgattagtcctaaagtatctgcttgtaacaattgcccaataaacattgtaataaaagaacatggttgccttaaagttgtggttctcagagagtgatcctcaaaccagtaatatcagcatcacctgggaacttgttagagatacaaattctcaggacccactccatacctcagaattggaaactctgggaatgggatttagaacctgtgttttaacagaacctccagggattccaatgcatactcaagtttaagaattaaccactctgctgcataatgcagactaatggttacaagttgagtatccctaatccaaaaattcgaaacacttctggtcccaagcattttagataagggatacttaacctgcaatttgtccttcttgattttaattttgaaaccagaaattaaggaaatgggtttagtaaacattgtggacttctgtttatagttacattgtttctaagaaacattatagaatcattttttccttagaaaatattttacaatcataatatgttctgagattctgtaatcagagatgggctttaagaaagttaacctggcagccatgtgcaagaagtattgtaaagaagatgaaaaacgggaagactaggcgtaggccaaagtggtactagggcagtgggaatgagaatcacccagatggaatggacagattcggagctttgtagaagtcctcgaagaccttgaacaatgattgaatgaagtgtaggataaaagaggattcaaaattgattttgaaggtttaagcctagaggagtttattcctatcaccagagcatttcactaaacaagaaagcttgagatttacaagtttgaagatttattgtgtagttcttctttcaaataatcatgttaaatatcgattttgatttttttacacaagactctacttgtgatgcttgcagaaacattgagtagtctatattacctttttatgtcttactttcatgttaaatagtctcatattattagttgtagaaaaaggcacttttcaaagcagagaaagacaaaggtactattcatatattttatgtggatgttgttaatcttgatgcccattaaccatagaatgggtttattcattcattccacaattaattaagtactaatattatatcagacattgagctaggcactatggttgtaaaggtgaataagagcttttgtcctcaaagagctcactgtttagtgagagagaaaaaaatgtaagcaattataacacaatgtaatatatgctgtaatagagacatgcacaggttgctatagaaactaagcagaaggatacatcataagttagttaccaaccatgaacagtggttgttgattttttaaaattatatttttttcaatgtgtaagttgtttaaatggagctaagaaaaaaatacaatttgcaaaccaagactaactgttaaatcaaaattatccaaaatatgttaaagatctggctttgtttttggtggtaataggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggaggtaggttacaatgacaaggtattctgatagctaaaagcaaccagtcctgaaactcccagtcaacaaatatgaagcacctgttgaaggtctagcaatgagaaggtgaatcataaatgagatgttaagtaaaaacataaccgctttctttgtatgacttgttcctgttcctgtgttccaagtccatgtagaaatgctggtggaggtgccaagaacaatatattaacaaaaagttttttctcattgtctataccccactgattgatataagggattgatttattgtgaaggtttattatgaatggtttacagtgaatggtgatttgtttatttatcatggtaatttattgtgaatggtgatttttttcttttttaagtttttctagaaactctacttttattgtcagagaatgcccatggtaaagttgacaatcttaggttactgtagttatatcatgggaaagagccttgatctagttctgctgctaaatagctttgtggccatatccataagtcaacatctgcatctcagcttctttttttttctttcctaatgttattggaatgagaaagttggacaaagatttgtatcttttctagtgctaacattttttgattttgtaataaaattgtcaagaaatatgctttgacttgtttctgttctgtaggtagtgctgcatgaatatttaaaaccaataaatgattgaataccagtggaacaggatgtactgcaaggtgtacatgcctgtaaatactgtgtaggcggtggttagtgggaagcatttccatgtaggaaggctattcagaaaggtgggacattaatcacttccagaatgatagcagttactaaatttcttcaaaagttgtatcatggttcttttactatatttggaattaatgtgagaccattatacacttaaatgtattgtgatggatttagctccaagtaagggataagcaaagcaatattactgtggctaaacttgaaaggaataattctaacattatttcctcagcgttgcaacttgcaaaaagatcttgattcatgaaaacccctgtcacccaaacacttggttaagttttatcaaaaaatgaaccagcaggggacaaaatacagagtttcaagacattttattagacatctcggtatgtgaaaaaataattcttccaggtgctatgcctttattgagttaattagctaaaaacataaacattaaacataaaaatttaaaaaaataccacgtaaaaatttcttaagaaagtttcatggaaatttgaatctaaattattagcatagttgctactaaaaattattaataattatattaccataattattaattatattagtatttataattatattagtataattattaattttattagtgttaatataactattataatagtattaatgattataatatgattgttaattataatagtattaatataattataataattatataattaatcatacaagacttcaaaaattgactgttaaagacaggattttaactatatagggcctgtggaaaatttgaaatcaattacagtaacctacatgattttaaatatttcattagatttccatagcgtaacagtaattaacagtaaaactttcccattaaatagccttacatttttcatagtcatgcttatatagtaaaataaataattatctgaaacctcatagggaaatgcataagcttcctataattaaatacttgagtttgttttagattgctgtttttggataacatgcagcctgtccccagaatattgtttgttttttcttaaaaactcctaatttacaaacccaataggtggccacttttaagaaaaggaagtattagtttcatacaggaaatcccttactaattacttaattaggttcacaatatttgccaatgtggcactaaaatgaaatctgttaaggtagcccagtgcagtctaagtgtggagactataactggatgttccacgttataatttgccttgtttgtagttgctgttaggaaatgttgcctcatttctactgcaaagtgtagaagattcggctactttcaaaattattacacaattgatctctagtcgtaagtgattcctacttgtttcatcttactttctaaatggttttgcagttacgttaaagggcaggtaattgtgctggtgctttttgtgttaatattgcagccttaactggaatgttagttcagtgaacaaatacttaataagtgccttcaatttaaccaggttttgtgatagttgctagtgatacaaggctgttgataaatatggtctgtttttcaaggctcccccaacacacaatcatttttaaaactctttttagatgtgtaacgtttaaattttaaacctcaaattttagacgttgtccattagggtgcaagacagattctttcagcatagtgtgtggatgtggatgtgaatgcttaggtggtatttgccagtatctgtcctgccattatcagttgagtgagaaatgtttcctttttcttgttgtttttaaaagaagtatattttaaaagcaagagtgagtaataatacaattttgaaaggattgtttgtttacctgttcatgaaaatttcctctgacccctttccttcctcctgattatcttattgcatctggtaagacaaagcacctgttctgggatttgtttttagtttcttaaattattgcccagtgctaatttgcattgctggaaaaaaaggctgattgcacattttgtgttctctgatgaaccttactagagcaataattcattagtaaattttaaaagactattctaagaatacaacctgggttgctttcttaaattcagtaatgtacatgatgtgcaatgttgtggatgttcacaggttctaatttttgaatgtgtgactgcccgttaggagatacaaaacaattatatctttccttttaacatcttcatgtatgtgctcttacaggaatacaaatctctgcatttttgcctgcaatactgctggaaccttctatttgtcatttaaactaattatcataatgaattgaggataaattgagaggatcacacatcttgaacttcagctagaacagagtacaaagaggaggggaggatttggaaagcttaaacaatttgaatgacctttatcatacccactgttttagcatcagaggcatgaggcagaatgtgtgcatttattgattgattggtcctttttgtgcttagcatataaagtaagcaccaacctgtaaagtgagttatgattattcccattcttcagagcaggaatctaaggctctgaaggagttagtgtcttgaccaaccatacattcagtatacagtggagctgggttattctttcccatttgactcctgtgtgttcttctaatacgtatagcaacctacccactttagatgcctgaaagagaagtatatttgggtaattatggcaagaatgataacaataaaatgtcatgagtcttacaggaagaatctgcttgtgctggggagggaagtgggtggaagtggatcaggaaagcctttataaagtaggcagaatttggcctgggtttttgtataaggattcagagagaaggaaaagggtaagagtagaagtgggaaactgaaatcaatttcaggaaccagatagtttgtttcacctggagcctaggttatacatagaagagtaacagaaaatgatgatacaaaggtaaataaggcaaaaaccacgagagaccagacttaaaagtttggaggttcagctgtatgccaataaaacagctatggaattaaatgtaataaaatgcaacttgaaggtgaactataatggccctttgaaagtgttggtatctatttttgtcaatactctgggaaaggttttcactgccacaaaactccatgggttttttattgactagttctttcatatttcttcaagacaaaatgaatctatttttgattatttattttcagctgggataatttttgtaaagaccattcattcccttattttgggttcatcagatatggactcttttccaaagaaaatactctctcatttactcttctgttataatctggagaacttttcttaactgttatgcatcatgcttaacaaatagtataatttgtattcttgcaagcatgctatatagcactttgcctactattagagtagcacctcatttatccagcattctgagaaacagctgctatacctaagtgatttccacatagatgaaactttactcttcttttaaaaacttttattttatatatttatcctagaaatttcattaaaattttgtttacatactttctcaaagcattcagaacatcttttgactgttttttgaaacctttaacacactatttccacaggaatcactttatgatctgtgactttgtgagacttttgtgaataatgttttgtctatatagtaattctcaactattttattccttgaatttcctctctgcttttccatagttgttttgttttttgttttgttttgttttttttgcaggggttgggggttccaccctcagctagcacttgccatttctctcctccgtcagccccttttggctacttctaatcaaatggcttacactttttgagtatggtttaattaggggccccaccacatttgtggaatatagatagtaaacctaaagatgtgtggtttgtgtttcacaacattccttgcttctgagaccttttccattcctgtgttccagatattagaactttcttactgtgtttaaagaaatattcagatgtttgcttttggaatgataataactttgtgaatattgctgtatcatgtccaggttcttttataaacatttaaatgtttataaactcattttattaagttaaattattaaattctaactcatttaacctcccttctcatactgttttgaattgccacatctgtaaaatggcaattaagatgcctgccctcacagagtttatgtaagatacaaataaggaaatatatgtacaagcattacataaagtttaaaactctatacaaatgttggttttagggttatttctgataagcagctttatgttggtttctgtttcatacttctctatctaaatgattattatttttattatgaactgttaatacattgaagggctactaaaatgcaaaatcagtctttgaaacacaaaaatgaacaaaactaaaaatatcatttgcccaatttggccaatactgtccagtgttattaatagcctctagcaacatagatgttaattaagtgaactatttgattttgaaatattagtccatttgccaattgttaagtaaacacttgtatttaaatattcaaataaatttataaagactataaaaactccataactagggaataataaattgagaatttaaactgcgtctctcaaaactcattttggtatttggtttcagatgttaatttttagattgacagatcttagtagacagatcactgtccacctttttaaaagtagtaaaattatatttttaaataaattctgaaatttcagcttttaaaattagtgcacactgattaaactgactcttctggtaattactcaaattaaagagtaaaattatacttgtaaaaaaactactattgccataataattttcgcccttatagccaaatgaagtagccagtttccttgctttcaaattttcatttatgacatttccacaacacaacaagcaaataatttcctggtcacatattcaaaccactttttcaagtgtataatttctgttggagtggctttattatgaaagttttgcaggtttaatgtagaacttaaaatattgttcagtcaaaccataaatttaattcaattttctgtcagtgaaatagtctaattttttttctgttaaaaacagctagcaagaataattcagatcagataatgcattgagttatattatcctaacgataatttttaaatttttatgaaggaaaggtcctcaaactaaggaagtaacagattagtaccacttatcagataattccttctcttcttccacccttgtataatgtaatttctgctcgtggatgggaagagaaacagctgtctcagaatttattatgctagatattcacttagccctctattgcatatatgattatacagtaaaacatttgttatatctctttctaaaaaatccaataattttctagtttaatctctttttcacaattttggtagatgatacttcatatatttgcaccagagtcgtctatctttattaattatacagacattctctgggtccctcctgactgaatctcactagggttgccacttctctttcaccctattgaaaagatctagactgtaataataactggaaatactagtggacttttagatagcacctcctcccagttaaaaacaggcaaacggagaacagttggtaagtctatcttttattaaaattaaagtgcttttgttcatcaaatttgcatttttttgtaaatgatctggaaaagtaatgttgagactccatttttattttatttttttaattttttttattatactttaagttctagtgtacatgtgcacaatgtgcaggtttgttacatatgtatacatgtgtcatgttggtgtgctgcacccattaacttgtcatttacattaggtatatctcctaatgctatccctcctgcctctccccaccccacaacaggccccggtgtgtgatgttccccttcctgtttccaagtgttctcattgttcaattctcacctatgagtgagaacatgaggtatttgtttttttgtccttgtgatagtttgctgagaatgatggtttccagcttcatccatgtccctacaaaggacatgaactcatccttttttatggctgcatagtattccatggtgtatatgtgccacattttcttaatccagactatcattgttggacatttgggttggttccaagtctttgctattgtgagtattgccgcaataaacatatgtgtgcatgtgtctttatagcagcacgatttatattcctttgggtatatacccagtaatgggatggctgggtcaaatggtatttccagttctagatccttgaggaatcgccacactgtcttccacaatggatgaactagtttacagtcccaccaacagtgtaaaagtgttcctatttctccatatcctatccagcacctgttgtttcctgactttttaatgattgccattgtaactggtgtgagatggtatctcattgtggttttgatttgcatttctctgatggccagtgatggtgagcattttttcatgtgtctgttggctgcataaatgtcttcttttgagaagtgtctgttcatatcctttgcccactttttgatggggttgtttttttcttgtaaatttgtttgagttcattgtagattctggatatgagccctttgtcagatgagtagattgcaaaaattttctcccattctgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatgctattgcctaggttttcttctagggtttttatggtttcagttctaacatgtaagtctttaatccatcttgaattgatttttgtataaggtgtaaggaagggatccagtttcagctttctacatatggctagccagttttcccagcaccatttgttaaatagggaatcctttccccatttcttgtttttctcaggtttgtcaaagatcagatagttgtagatgtgtggtattatttctgagggctctgttctgttccattggtctatatctctgttttggtaccagtaccatgctgttttggttactgtagccttgtagtatagtttgaagtcaggtagcgtgatgcctccagctttgttctttttgcttaggattgacttggcaatgcgggttcctttttggtgccatatgaactttaaagtagttttttccaattctgtgaagaaaggcattggtagcttgatagggatcgcattgaatctgtaaattaccttgggcagtatggccattttcacgatattgattattcctacccatgagcatggaatgttcttccatttgtttgtatcctcttttatttcactgagcagtgatttgtagttctccttgaagaggtccttcacatcccttgtaagttggattgctaggtattttattctctttgaagcagttgtgaaggggagttcactcatgatttggctctctgtttgtctgttattggtgtataagaatgcttgtaatttttgcacattgattttgtatcctgagactttgctgaagttgcttatcagcttaaggagattttgggctgagacaatggggttttctagatatacaatcatgtcatctgcaaatagggacaatttgacttcctcttttcctaattgaataccctttatttctttctcctgcctgattgccctggccagaacttccaacactatgttgaataggaatggtgagagagggcatccctgtcttgtgccagttttcaaagggaatgcttccagttttttgtaaatgatctggaaaagtaatgttgaggctccatttttaaaagattgacagaatattgtcttttgtcacataaaaatgcccttgtcaaatattaagtagacaaaatactgtgacaaagggtatttgatgccaatgctaaataacagtaaaatcagtagcaggatttctaatgtattattcttgctacggaaacatggtagtggatagggcctgagggaagggatccagcatttaccaagcaccacatgtaagtcaggaactatgtgtctactgcaaagtaggattcccttacctcatctaattggttggaaatttgcagaaataaattggaagccatgaggtgaattttcatttaatgggagaattttgaaaatcagtatttttaacaaaaatgttgttatctgagagagtcttccattgaaatcttaggagcaatagcttttctgatgttttcggaggataagtgagcttctcctcccaccatcagtatgaacagtctggccttggatatctggggcctgtctcttaggccttttcagtcctgtaatgagggattttgcctacatgattgaacggcatgctaataagttcactcagctgttcgcttcagaggagtatacagagtcttcccccatttgtcccttacccagccttctcctaataatctcatcacaacaaatgattaagcctttctactattgtcttttagctaaatcagagcgagtgattgatgaagtgccaacttccgagaacagatagacatcctcataccctgaggctcttcccacctccaccctcccttgatgctcatatactgcttgtgttaacttgtgtttttacatgaattgatggcatctctatctaaactttaaactccttaaggacaaagactgtgtgttattctgttctctatctctcacgttcttaactcttccactcaatttatacttgatggaactaatgaacgtggttttgaacatctacattgagtttaagaatctgcaagaataatattgtgatacagttacagagtgttgaccctcatagtaaattctgttattgttttccataaaaccccacgtattcccggcctttctcttgctctctgttactccactcatataggtagttagcccttttgcagatccattgtgaaagcatttttcctgcccgagccaggggaagccatggtccagctttatggaccatgtgtaaaaagaaataatgtatttatgtagtaaactgtggactgtaagcaatatgaagacagggactctatctaattcatactcttctctctccccaatgtctggcaagtttctgtcatctagtcagtgctcacagaatatttgagatgtggataggtgagtggaatacatgcaagagaaattaggatgtggtgattataactgctctatgtgattttcagcaccagctccccattgtaaattagtttaagctggactctattggtatgattggtgctttaaaattggttgatgctggcaatcattctggtgacacctgtctagcatttttcacaattatgactttcttcttaaaaattttaaactaccccccccaaaaaaaatagataattttatttctcatgacaaatatgttaatcaatttgtttgaaagtcttttgacactttataaagtggtgacctttgttcaagtgactgttcatctgacaaacccggcccgtgtgcttttactgggacacgataatgatgcatgtgtctgctacttccattttcacctcaccctaccatttgtcactttccacttccagacagcaggcaaagctatttgtctgcctcagcttaatatgtaaatccctcatgcacatgaatgcactgtggtagtgtgtctcttgtatcacagttgatacctcctaacacgttctgctttttgatggtgaattctagtttggccttgtgtccaactttaattatttttgtaagaaaaatgggactgtattctacagttttttatgcttaccttccttctacatgtatccatgtatcaataggcatatatatcttacaggtaaaaaaatggattattcagaaactttgagttaagataatgtgaaataattctacaccattgtcaattaacattgcataattatctatattacagttttcatttatatgatttaaagggaaatgatagaaaaaaagtatatccttggtataaggaaagtatatagcaaggataaaggacctttttcaaactattgggtaaaattaaaagctgtttggaagttatagttagttcatgtcacacattaagttaccattttaaaaggcaagcttatgggattgaatgaatattaatttaataaaatgtctagcaataataaaaattgaagaatatgtggaaaatacattcttaacagataacttttggaaatatgtaacgaatagcaataaatgtattttgtttcacgttattgtcatgcaagagataagaggtagcagaattgagagaaacggtaacaggagcaagccacagaaaaatgaaggagaaagatgttgtcagtgaaggttgaaacctccaagtaagacaaaatttgtgatggattattgcaacatcacatatcagtgctcttagagcttatttatccattcagttatgtatgctcattacagacccctggcatggtggcaagtgtggttacactttataagtagaggaattgaggctgagaaaggtttaacaacttgcttaatgtctacagctagctaaagatatgagtgatgtgctatgcaccactgcttccaataaccctaggcactggtggtattattctcagtttatggaatctaaggttgaggcccagagaagctaccttctcttggttactgtagccctaagtggaagtttgagggtttgaacctgcttctgtctccagagccctaggctcattccattataaacaactccctttccccaccgaggtcagaaagctttttggatactattttttaaagttgaggattaaataacacaaagtatacagcttctgaatccttatcccacaaatggattagataactccatgtcctatctctagaaccctatgctgagattgtcattcttctacaaggagagccacagaagtcactgaaattgtttttctcacttggtatctaaataggggaatggggtgacagcctttagaactttttcaatctatttgttaattaaaatctgctgtctgtcgttttatttatagtataaggatgcatttatgaaagcaaatcctggctacaaatggtgtcctaccacaaacaagcctgtgaaatccccaacacccactgtcaatccacgaaagaaactttgggccttcccatctgactcttcaagagacttgccaagccccaagaaagcaaagactgaagaaatgcctcagcttaactttggaatggctggtgagttgagacactatttccacctattctttaaggacagggcaatacatttcggcagcattttaaacaatactgagggcggggggacaaaatttataaccaatattaagcagtggcaaagatatagcatattttcaagcattggatcatgatatatatagaatacaggtaatttaaaaaaggatatatggcctcagtggtagtgtcattataaatatatgtgaattcctgacattgacagtatggaaaagtagacagcaacatggagattgtcagaagcttaggaaattttatgttcacaaaatagcttacacacacacatacacactagtaagccatcccaggatgcaccttagttatcatgctacttaaacagctacagtcatgtagatcatctgggtgttggaaacattgagggcaagaatatgaacaagtacatcacaaatctgagattggacctgatagctgtgtcttagagagaattcccatcctgtctgtctcctctcatgtccattcttgtatgggacagacaaatttaaaattccagatggtgccatttgttatgggacctttagtactctttgggtggtaaggtatgctaaatcatttattaccatgaaataaagtacttatattcaccctacaagtgggctctgtctttcttagctattacagtgcagtaatcaaaagatgagtttgccagatgaaattagcagattgagcaggagaaaggcagtgaagttgcaattgagctacagggttcctattttggtattagaagcaaattttcttccaaagcagagtattgaactatttgcatatggaaaggttgggaaaagaggttgagtgatactgtgataacactttttttttgaataaccaataaatttaacgagactttatgattcagtgtgtgattcataccatgtaaagtatgtggcagtattctatataatctacaaaaaatattattttaatcagtcctgtatggtggcatgtgcctatagtcctggctacttgggaggctgagatgggaggatcacttgagtccaggagttcgaggctgcagtgagctgtgacctcacgactgcactccatcctgggcgacagagcaacaccctgcctctaaaaaatgaagtctaacataatggcagcattctagggcggaaaaaaggattcaggtgattgctatgtgggtgtctgtagtgtaattctaagtaagctcccaaaatgatgcttctacatgtcccagaagaatcagacatagttatttgtccttgctttagctgtcaattttgtacaattttagcttcaaatcatttgttattagatagtcttggtgagttttctggacttcccaggttatatcagttggagtactttctaacatatcttattatcagaacccagaaagagtatatagataactgacttccagctgattttctttggtcatcatgtaacatccattgctttttctcccaattctcagtctagatccagggtatgtagtttgttgttgttgttgttggctttttttttttttgcatacatctgctcttcacaaaccatataacaattgtaggtgaactgcagaaagctatgaaagatatcttttttgaagcaccgtttctgacactttattaatctgccttttacctgcaaattgaaagtcgaacccacacttcaaacaagatctttacagatcggtatttaagatcagtgttctcaaaagaaagtacaggaaagaaggaaaacaccttccttgcatttatctcattatgtaatggcttgggttatatgttgcaaatccatgttcagaactcttgataggcttgcatatagtggataacattgatctgatatttccaggtatgttccttttcaacaagatgaaagcgaactaatttgtctttaattaaatcctggtgcctagacatctgaatctaggagataatagagggcctctaaatgccagattgtttacctcaatatggaatctcttttgttttgcttgcccagtagtccttgtcacatgacattttgcaattttgaataaccccaaattaccaaatgtatgatatccaagaagggaaagctgtgtagattgtaatttagtgcaagccctttcatttaattgcactaaagaaagcatcctatgtatgtcaatatgtttttgatagttctaaataactttatgtaagtatgaattaatataaaggatattggtaatttcttggcctatgttttagtatctatacagcaaacttcttgcaaagtcacattggtatataaattatcacgtaatcatgttcctattttactttgtaatttgaactaacacatttttatctttagaaagctatcatccaatcctcctgatctctaggatgacagctgcaaaagtatttctctttgaaagaaccaaactaaacttttactttctactaaattcatttccctctcttgatttttaagtagatttaagtatctatttcaacagccatagtatttcttaaacttagcatttagttgaagttggagtctcaaaacaataccaaagagctttgtttcatcaaattagctactgtttgtctgtgtattctctgtgtatgtcttcctatgtggctgccttccaatgttgagctattttttgaccccctgatcttttggtaacatagtttttcctctaataacctcttcccccaacccctgccccttttttttactacctcagaactttttttgcaattttttttttaaaactgtcgataacatatagtcaaagttgctttatgagttcctaagacaggttgtatacaaagatgtacttaaggacatatcttcaacccgaaaaagaaaagaaacaactgaatttctttgtgcaacattttgactgatcctcattttcaattgtagattcctgaaattaaatatacgttgaggaccttatatgtactaggagagatgccgagttaggcatttttacatatgttctttcattacacttctgaattttaattcaagatagacttacaggacacaggtgccttttctttgataacttctttgtttttatttattttctatttgttcatttaattttttagagacagggtcccactctgtcatccaggcctggggtgcagtgttgcgatcttagctcactgtagcctcaaactcctgacattaagagatcctcctgccttggcctcccaaagtgctgggattacaggcatgagccactgttcccaattctgctttctttatttagatacaacctgggttatagatctaccactttgctgtttttattttctctgtttatattgattattgaaatagtgaaaacaaagactttgataacataaaaagcattaattttataccttgaaggcattttgggcatgtgtttgacacatgccctaagatttaaaatgtcaaaaacacatcagttaatataaatttatttttaaaactgtaaagaaagattatttgaataaaacctaccagattttacaggcctgatttgaaaacttctctctgttctctagttctctgatagcctattattttaaaactagtcctgatttcacatggcagaattaataatttgagaataacaatctaaaatttctcagaagacaaacagaaacattcttttgtttaaaaaatcttatctaaactccctaagcagtaaggaaagaaacattgcattaggagataaattaatgttacaaacagcaatggtattgaagaaagtgttgttggaatggtgagacaagagtggtattcaagaggctcacaaagtatgagcactaagcacatatatgccaggttactgttgcataaagagtttttaaaagtttttataaaaagttatatgtggttctgttggatttctgattgctagtctttatgagtattctttttgactctgtggattgtatgtactttatgcttataagttggtgatttgtttttgacttatttagatcctactcaaatgggaggcctgagtatgctgctgttagctggagaacatgctcttggcacaccagaggtaagccagtccttttccgtctccactctgctcatactgtgggttgggaacacagttatagtctgtttacgttgttcattctgcattttcactgtttacagctcatgaacaaactttataatctttctctttaagatctttctgtgtgtcttgtgtgttgagtgtaaaaaaaaagtggtgtaaataaggccatgaggatgtaaacacaggtgttgttttctgaacctacaagtaaggttgtagtaatgcaatatatagatcactggtgtttgcatgactctgtcatggttatgtcagttgggtgctgtaattcatttattcgaaacattctctgcttgggtgatgttcacatgctagtgaaaagatgatagctaaaaatttgcagctgtcagtctctctggtacctgaataattccaaacagctgttttgaaaattaggaaacatggcatttcaggattgttttattcttctttcccacccccccttgagacagggtctcactctgttgcccaggctggagtgcagtggcatgatcacaacctcccaggctcaggtgattctctcacctcagccttttgggtggcttggactacaggcatgtgcccccaagcccagctaatttttgtattttgtgtagagacagggttttgccatgttgctcagactggtttcgaacttcagggctcaagcgtcttagcctcccaaagttctgggatcacagatgtgagccactgtgctcagcctgtttgaatctttaaaatggaaaaaggacctaggctttcatgaccttggtttcatgatctagttattggactgctttggctaaacatttttaggtatgattttgacgggcaggtagtggcagttaaccatgcacagtctgcatttgtagaattcccctatttcccagagacatttaacagaggccaattgaattaacctacaggtcatgttattttaccacactcaggtttttgagatggaaatttttcaatccccaaccagaattgttgtttagggccaaatagcaatgactcaattttattttgggtcatattttttactttttgttttttagttgtgattatgtcatacatattatacttgaaggctattcaaatagtggttttgtagacatataattagataataacctatttacattataaaaggtttttattttttatagtttacatttgggatccacaattgttgactatatattcaatttaacagaattattttgattctgttcacttcattgtagcaagaaatgtataaatgtgtaaaaaatgcactggtagttactttgtgctaatcttcagctggaaaaacatacatgttactttgtgcctttgcatattcattattcatcatgtttgtagtttctaacataatagcattgtcaggcatcatttcactttctaacacattgctgctacctcttaacaaatcaaactctcacttaggtgtagagtatcccaagcgtgttccaaaggtgaatgttggactaataatatgcacttgacctttcaacatgtctgactcaatatgattcccaagaatacattgaattgtgaaagccagcatcatctttcttaactatttaaattatcatagtgtttcattcgcaacatctatttagtgttctttttaaccttcaagtacaaatgtaaacaaatcaacgtctgtagaactcatggatgctagtcaaagaaaagcatggtttctttttcccctttttgcttaaagtttgccttttgggctcttttcaatgagaagttctcctactccttcttaagaaggcagagttttgacacatgcaactcaatactgtggtggaccctttatctctgaagtggaaatgttttgagaattctcaagctgaagaatcaaagaaagctaaatgattgaaagaagggaaccataatgggagaagagaatctatgctaaggaagaaggtggtagcagttaggtctttaagaatcacttcaaagaacacaactctttcttcatattcagtatttcccatctcagagatatttgggtcattattgaaaatagtcttgagatatttaaacagtgaaagttgtataaaataatgctgtctctaaatataggtagtttgagaatttacttcacagctatcagtagactgcattagcacctgaatttctatccgaagtcttattccagatatgtagacatgataatgaactttaagagcttatatgcataggcagatgaacatgggacaaatgtaataaatatgtacttatgttttcctaagaagactagcaggataatgagataagagaaatacagaaatttcatatttctgacatttagaacaattactgtgaagtctgttggtactgtgaggtaagaccaaagtgacattttcaaaaattctgccaccagcaaatggtctaatcatactggcttttaaaaatgccatgacagaacccttattctgaaatattattcttaaacagagaaggttttcttttgttcactgacttgagacctaaccatatagaaaaagtcctcaaaagactatttttttaaatatgaaaattttaacatagggaatagatttcttttaaaaaagcatctctagagggtagagaggcttactgtaactgaaataataaagtcccagattaaaagcctatactgcttcctagatctactgaaatgcacttagagtttttagagagaaattataatttcttgagatatcaatcgcaaataataacaaacaaaatgttgtgtattctctttttttctgtcttctgatcaattcttaatctacaataatagattttttgcattattatttcaacattttttatgtgcctctattactaagcctagcgtggttctatagtctcattgtggtaactgggtctgtgatgaaaaaaaatggatgcgttttgatagtttgttttgtttattttatttgcacataatcggccttgtttttttatacccagagtacattgaaatgcataaattatttgggataaattatttaaaacaatgttggttgttacagaatttattgattgaggaagcaaaatcgatacattgagcacgaaagacataaaggagtgactcctggctcaaaatagcagactaagcatgtccctactgagaccctgtaaaatagaagtatagaagtctcattagtaaataaccccataataataaaggaaatggaaaggagtgtgtccagtgaatatgagattacagcaaattatttaaatcagaaatcaaatgtagttctttaatcagtaaaatgtaagtaccagacaaaaataggcggcagggagctacaacggagatgacagcctctctattaaatagaatgcccagaagtttaagtgaatatcacctttttttttttaatttaaagaaccagaaataaaaatgtagaacaaataaaagtaatcatgttcacatcaaactcagggaagaactaatgagaaggcagagaattaagcctttatgttttataccacagagttatctaaaaatgaaaatacaaaaaattgtcagtacttgatctagaatttctagaagtaatctccaggactagaaatccttatatttgttagttatcttaataaaaatggaaagctaaattaaatcttaaaaaacaaggcagggagtgatataattcagattgtggaaggggcagttattcaccatgtcatgtatacaacaacttggattgatctcagaaaggatgacatccagtatcagacctaagtgagcaacgtaaattcatcttggctagaacagaaggagaggggtggttggagaaaagtagaatataagttagtcagattaattatagctgatgaaaagcttcgaaggtatcaatatctgtgtagttgtatgactgttggaagctaaactttcaaatatatgggaagtaccttagactttgggtctgtgattttagaatgcctgttttgttggagccagcagataatgacagtaaagtattgatcaagccactcttttctttgccttccatcctatgaaatggagctaataatacctgcttgccttcaaatctcaaggctacagtgaagattaattaaataaaagctgtaaggcacttttaactctcctgcaaataattcttgtaggtatatattattgccattagttattctaggcatttcatattcaacttgcaagtttaaattatatcagacatttctcccacaggctgatacgctttaccagcaacatgcatacatacacacagagagagagagagagagagagagagagttcttgtctattgaaaacttagcagaaattaccgttgtaatttactatctttatcatcaggtgctcaagaaggagacaattttttaatatctgggaaaaatcagtataggaagtccaaagtcagcagagtagctgagttagtgtcagattagtggagaagatgctaatagatgatggcacacctccataaaaggactgtaaaggtcgtgttctctgagaattgaacagtgctgaactgtgtgccatcttttcttatatttaattacatgacaagtgtttattgaatgccttgtatgtgtaaggcatgtcagggaacaaaccagacagcctgaagctgatattgtcttaaggttcaagtttttagatatagcaaattcttcacatgatacttctagcttaaaaggaaatcacattgattttcgtttgttcaccatgatctgcctattttaaaatgtttacagcttatgcatcaagatttcttaaaatccaaaaatataggttaaatattgcttattcaaaacgcttgggaccagaagtacttcagagttccagttttttttttttttttttttttttttttttaactatttgtatgatccttaccttttgggcatcccaaatccaaaaaattgagatctgaaatgctctagtgagcatttccctttagcattatgttggcactcagaaggtttcagatttttttgagcatttcagatttttggattggggatactgaacctgtaataaatatattttgccttgtaagtttgtaatatcaatctgtcacctcctccaggaagtccttcatgatttcttgagccatattcaattctctgtttattctaatctcttatatcccatattgttagtttcataccttacaacactgattatatttagttttataatttattataaactgtataataaaagtcatattttaaaaaattttcttattgtattatatgtaagtattgtctctagaagactaagaaacttgggatcaagaacaatgacaagatttaaactgcagcaggtctacccacttgcctggagaatagttgttattatatcacaactaacatgtattgaacattgcctccaaggctcaattcttaagtgtattccgtaagactaactcttaatccttgtaacaattttgtgagttaagtcttatttaccttataagtaaatatttaccattaggtgaggaaacagaggcagagaagggtaaagtaacagcccacgatggtgaggctacaaagtggcagaactgggattccaacgccggaggactagcttcagtcttcttgcagcacgcaggggccttggtgattcagcctctgacaatccaaccttagctctggccacttctcctgtgtcctgtgtcctgtgtcctgtgctgcacccttactgaagctcatcactgccagagcaggggcattttgtgagtgctttctggggccaggcactgtgttcacagttgacattgagtatctcattctctcaagaaccctctgaggctggtttattattttccccattttgtaaatgaggaaactaggtcagagaggtgaaataacttctcaaaggtcgtagaatgaggaattcataatactagaattacacccacattgtttttcattaaatgatgagataggcaaaaatctgagacacagaaaggttgaattttaccaatatttgttggataaaggaatgattatgtccacatcttaaatgctgagtttttaacaattttaaacaaatacagatttaaataaaatggaaacttttcactttctttattctaatttctaacatcaatgaaatgaggctatttatatgttcctgcttgttggtgtatttgaattaattagatatgtgcctcctttaggctgctaaatttgactattccagaatactttaatccattgaattccaaactccttgccccagttcctacctgaacctcatcaaaacttttattcccttctcatagttttatagcttactttatttaaattctacactgaaaaggaaatgggctctctgagcttcctcttttcttgggtggctccccctttatgtcactcttcactgcccactttggctggacctgcccatccaaatccaatggtagaacccagcctctaccatctgtccactgtggggctcaagcccagataattgggtccttttacccagcttgattgacaaatcacacatcctccgtaagtccctaagctgcgttgatgaaattgagtatgctcgttgggctctcagagatgaaggcaaaggtagagtggaaggtgggcagaaagagagctgggctcgaaagagaagggtggagagcaggaagataaaggaggcatccttcacaagagaggtgtggttattgtcaattaggtggttgttggagagcacattgatgtacactgttgcattttattctcacagtttactgtgaagaaggcaagtagacagagtggcattgtacctactttatcaaatgaggaaactgaggcagaaaggtgatcggagttatctcaattgctactgcagttatttttacaactggcctggagtctgttctggactttcatactagtgctcagccacacagattataatgttaggagaacttgactcatggggtaaaatccatactccagcagccctgatgccctgagtaaaaccaaggatgtgttcttccatttagccagatgactcgacatgtattctgcttgtgggagagctcaactctatgtggtgctgttgggttatgccccccgtggcggcccaggactcttctcagatgtagtgcaccgcttgtgtcaggtagccgagtgcagtgcgttagtaaccagcttctcctttaactctcagatggaatcctctaccccaaaaccatctcttctcataaaagacactcactgcctccttccaaacctccttccatctctcaaatttcctctttcagtgaaagctttaacttaccttggaaacacaggcattgtgtttctgacccctttccctcagctctgacatctttccagacaattactgaagcctggcagttaccatctttgattcagttggagtctcacatctcaaatggcttatttccttaatcttctaattagcctcctgcctccagtcatccccagacagcgtcaccctgcactccactgacagaattacctgactacacatctctctgactgaaaatcttggctggctcctcactgcctccagcccaattttcaaacttcttcatgtagaattcagattctcccactatactccaatgcatcttattcttcagccacactgagaaagtcactctctcaaacacactgtgttcttaccttcatactttcccacctcctgttaccgtatcatttctacacttgtgagagaactggttttcctaaggtgtatcttagatgttatctatcttccacctgttcccacacagagtgaaggctgcctctccgtcctcctgtagaccttgtaatattctaccattatgcacttacatttttgtatatgatgttgctgtcccctgcatatgagttgcaagcaactaaggcttaggcacatttcctttggtcatcattttattccctaacacatactagatacaagtagaatacaagcttcttgaaagtagcagtctttgtgtctggcatgtcataggtgcctattaaatatttgttgaatgagtgagtaatcaataaatgtttgaattagcaagggtaggaacgtatggctcagatactaccagtgcaatactccttttgttgaccgtgtgttcatgccggcagtgcatggttgtggtcctgtgttttgcaaagtaaggacaggctcatgataacaacctagctttccacactactcacaatgcatgtaactggcttgatcttgttttatatcaggaggccagttcacttttttatgtattcaatttcactatgtgaattgctcctgtgaaaaaaactgcattattgtaattcttaattatactaatcactccccttccatggttattgagaattataactaaatcaaagagaggattgaatttggggaaatcaaatgaatatgtacttaacaaaaatcccgttagctatttttgtttttgggcatatagcaacacctagtggctttatcgattatttcagagactatttctagaaacagcttcttgggtttttttctcccttattaaataaccactacttatttaatattttttctttcctcttaattaacgaacaaatatctttgactattttgtatttagaaagtaaactggctctagcataggaatagatattacagaattgatgtttatccataaaaagtgtggcccacctaataaaaataagtgaagtactttaaatgcagacatcacaatgatatggcacaatattttaaacatttcacaacatctagaaccttctgaataatgacattactcaaatgggagccttttgtgggaagtattctctcccttttatatagatagaatttcttatttctttatcaaattcatgtgtagatcagtgtatccacagatatatacattttatgggttgccttacttatcaagtactcaataatgaattcttcatatttatatttgccatgtcattgaaccatttttatattttgagattttagatccccagaagaaatatgtctaacctgtatcacacagatttctgccttcttaataaatgatatattttacaatttttcttacgttgacaacttagaattatagttgtaaataattattgcattgagctgatgccttcttgagaaatttgggggctgttttccctattcaatttgttttagacagactctagtgctttatgaaacatttgtatctgttctttacagcttttctgtcttctccttctgtcttatcctgctgctggcattgtttctttccttcccaaccctcctttttcttttttttttttgtcggccctcttggccccttctgatacgctgcctctattcttttgtggactagagggtcagctaaccaagtcagctaactacatagcttagtactctcccaattctcctggctcctaattttgtgctgtttccactatactatactgaagatgtatgctaaatccgtaatgctttaaagtaagaataactaggttttaagagaggacatggtccactagagtaaaatccacagcattagtgattctattactgttattttagccattggatagcatttgttgtactcctggccaggtcactgagattcttcctattcacatacatatggagagaattaagttaatagatattcattgtgccaccccctctttgtcaggagcatgataagcacaaacatgtgtagacttatttgattgcatgctaaaattgacaaaccatgtacaggattatagatgccttcataattatgtgttcatataggaagttttatataagaccatccatcctaaagatttgcaaacagtattattgaacttttaaactttctgacttgatgtgttgtcgtggccaaataatctataaatgacacttaaaagaaagttgaattttcttcatgctgttaatgtgaactctaagccatagggtaatttacctcctcataaatggtcactatttcttgtgaattgtgggatctgaaataagcatgtatgtcatatagactttatgcagtggagcaactctaaataataatacgtttaattccaaatatattttatagatttctgtcttatgcacacctgttttattaaagttttatgaagacattttataattttcaaaaagtcctaagcttgaatgtaagtaaaattttgattatttaccaaataatctaggagccaaaaatatattttttgataaagcagagaagttgatttttttaaaatacctctaaattataaagatatattttgttctggtattcctaccaataaaggagttctcaattttttgtggctacgaatttcaggatttgttggcctttttaattcattttgtgtctccttggtgggacatttggcacagcatatcaaatagtgacaataagagagtcaggctttgcagccaaaccacaggtggcaaattaataaaagcttctgcaccttcactaatgtgcttatctctgggagaaggtgaccattactctttaaaatccaaaggtgacaattaaaatttcaaatgtttgctcctgcccagtggcctgtgacattgttagagaaacacgtcctcaatgtcttaagagggtcagtgagaaactgtttttaggagcataatctgggtaactagtagctctttccataggatttatccatcaaatataatcacatgcagctattaaaattacactagagaagacttagtgatgcagaaaaattaatattaaagtttttttaaaaaagaacattctgtaactgtggtagaatattctatttttgttaaaaaattacacaactggaagaatatataagagtattaacagtacttatctttgggaggtaacattgtaggtgatttttcttctttgttttagtggtttttttttttttttttttttttttcagatttttaacagtgaacttggattattttgtaatcagaaaacaagttattaaaaagtatttgtaactttcatttttttctttaaagtgaaagattatttttccccctagactctctaacttcattattcaggaaaagtgggaaggaatcacactgaattggggttaagagaactgttgtcagctttcattagttcactccacaaatacttgttgagtatctacattgtgcccaggcagtgttggggataatgcattaaataaagtctctgggagaggatgtacaataaataaatatttacatcttgtggtgatcagtgtttaataaagatgggattttttagcattgggagaggaagtgtcaaagtttcttcctctttgaaaagtgagaggtttagatcacaggaataatgaaatccttccctctctaacattctaagcttcctatgacttttgaataacagttgactaccaaagcagttgtcacaaagcaaatgcaaaagtgggtcaatgttagcattgagataaaagaggaaatgtatatcctgagaaaaatacttgattaaaaagtgatgtttctgtaactgttgttgataataaagatcgcaaatgaagatagagcattaaatgtttacctaacacagtaaatagtacaaaagaaaatatgatatctttctttgtttcaggtatcctctggcacatgcaggcctgatgtttcagaatctcctgaattacgtcagaagtcaccattgtttcagtttgccgaggtaatatattacaattgatacttaactaatgaggaaattgtaaagtgggcttaaattggggctgataacagtaactgaaagcaatgaagaactctactcagctcaaccataagtgggaaaatagaatcaaattttggaaaagatattttgggtctctagagttcttaattaagaaataactacatttatgcgtttatagaagcttatcattaaagtcatactaaatattattaacctcattactaatttttactcatggatagtaaggttaagaatatattgaattactattagaatttagtcatttgttgatgtgtttatttgataaaacagaagacaaaatcagctcatggttattggctatgcagctaatctatgcatttctttttcttttctttttttagtgcactttcatcttaattgaaactttagcatgaggttggcagttttcaaagtcttcttttgtcagacttgttcagctcaataggtctcttgacactggttcaaagagatggtgtataaaagcacattgtccttgatatcaagtctaaagtttaagactgctcagaatatcttaatttactctggaactcaatatgagccctcactgatacatttttttcttaaactttaagccacctggtctttccttgatcatttgaattgtctttgactacacattcttcaccactgtcatccttcctggtgtttgcccaactgttttacagttttatacagggggaacattttttgttttttatttttttttaagagagagtctcaatctgtcatccaggctagagtgcagcagcatgatcatagctcattgtaacctgaaactcctgggctcaagggatccgcttgtctcagcctcctgatagctaggactgcaggcacatgccaccatgcccaactaatttttttttttaaacagggtctcactatgttgcccaggctgttcttgaattagtgatctcaggcgatcgtcccacctcagcccgtcagagtactggattacagggcatgagccaccatgctcagcctgcactcttttttgtcaaaagcagttataaacatgttaaataagattggtcccaactttgaaagcagaacggcttaagagatgatccttgaacctctaaagatctaatgatacctctaaaatttcacaggaaattttggatatgttagcatgtgtacatttttgtggcttctaacagcatatctaagatccagagagatccctgatcctattgcttttatataaaaggtctctatctccaggagctcctatttatgttattaattgaaatctttatcttaatttataataacatccccctccccctttttttagaacttctgagatacttttcacaaaattggatggattgtaacactggttctattttgttcactgcttgatttaattcttaaaggaatatattgtatttaggtataacctacaatatttgtgtatttccccttatataaattgtttatttttttctaacttttatagagggttggtagggatgaaaagtgatgtctgaaataagttgtactgagtttataattcctaagattacaggaagatttctctgggttcatttttgcattctgtcatacttgcacatggtggtcacttgaaatgataagattcatggtttgaccaagaaaagttctaaaattttatccttgaatgtcttcagaacacttggttagatcttacaatggataaaatggtttatttctacctagtttgttaaattggatttggttgatatttgttcttcttactgatatttattctaaaaatccttatcagattaaaaagcacagtagaatgaaattttcctgatggcttcagcagtgaatacaattaattactcagtcagtctctctactaattttttttttttaattttgagacaaggtcttgctatgttacccaggcttgtcttaaactcctgggctcaagtgctcctcccacctagcctcccaaagtgctgggattacagatgtgagccacactatgccagcctcctgattctttcccattcctaaacatcacttttatatgtataactacgtggccctgttgtttttctaaccagtttaactaaaacgaaaaagcagtttttgtgatgaaagagttttgatgaagtggatttactgcttagtaagtaccctttgatggagttgttggtgaacagttacttgaaggaaagacttgtgggattgggaatgggctgaagttattatgatgcccaggctttctgctcctgtgacccacttttaccctgtattatagctgaaaaaaagtttttttcactttggaaccaaaattactaactcaccttgctcccaaaatgtccttgaaaagtatttccacatgttcctctgagcaaagttgaagaaagctaccataattgccaactggaaacaaaaggtcccctagttgaatcaagtgtagggtggcagactcttccattcattgtcacacactaacgtgtgagtgtgtgtgtgtgtgtgtgtgtttgtgttgggtgggaggacgcaggtgctatgaaagaagaaaatgcttttcatatttagtaaacaatttattgagttctggtgccatgctaggtaacatcttttatggcttattttttttcaccataatcctctaaaatgcagattattatcatcatcatcaatttacagtggtgaaaaataagtcttagaaagtttagctgagctggccaaggtcatgttgtgggtaagtagcagagctgagattcagtctcccagataccctgacccatatccatatgcttcaccaacactgcatcacagctgcctctaactagagaacagcttggaaggagtggtattgggaagagagtgagggagtggcttcacttgcaacctccagcttttaacaatatacattttttcctttttttttttttaagtaaggaaatttatgtcaacaggtctccttaactgctgtttgatatatacctggtacccttaccaaagacatggcaaatgagccatactcagtctttgttctttataatcatctgtttttagaaacatggcctttgtcttcccttatcatttatactgctcttctaaagggattgagggtaatgactcatttttaaatctttatcagtgtctacagttgaaaatatatggcagaatcttatgatctgatgtggaaaaatgtcattgtatattaaaaattgcttgtttcctttcagatatcttcaagtacgtcccactctgatgcttctacaaagcagtgtcaaacatctgccttgtttcagtttgcagaggtatggcctttttaaaatgctttttaggctaagaaaacttgttgagctcaggaatactggaatggagttttaataatgtatagtgaactttaggcatgcctgttgtcattattaacataatacacataacagaatatttattgctttttctgctgcctttgatctaatcatagtcaaatcagctcccgattttacacccattttataagtattcattaaagagttcattcagaataccagtaatgtgtttatttcattttatcttgtttttaatttattttaaaagcttggaaaaactgctgtcaacaagaatgtcagaggctttcgatttattaaatttttccaatagtgaaattagatgctataattcatgaatgactctctcacagtgattgcagtggtgaatacgacctgttaaatcaggttaaattagctttcaatgtgatgtagcttcagccagtatttttattagtatttaatcccaggctcagatcagatcagcttttgtaagatctcagacttccttggtttgtcagccgaagagagcacacaccagagggtaatttttttggttggtgtgctgcagagacaaatctgatattcttgattttgccacaggagccctggcctcaaccatatgctcatttctaatgagcactatatgacaaataataaaacgtatacagtttatgaaaataagatgctatctgctttaggtcttttcttttttccctttttatcccaactaaaaaatgcatgtcataaaccaacaatttttatagggttgagagaaaatgacaagcaggactgtgctgtttaatattgatgtattgaatcactttgattcatttgaataaagaatactgcataaatggaatataaaatgatatccttttggcagaagaaaacctagcatcttactttgaaaatgagaaaaaaatacttttggctcttacattaaaaaaaaaaagctgtttcctcttgggacaactcgtgtcaactactatgactttataccatcggttggcctgcttatgtattaggcttccctgccatagtatttgcttagctgctgagggctattgtataaaattggtaacaaaaatatataatgttatttcatgaagaataatttgcttaattaaactgaataaattaagattttgttacagttttccattataataagcaaaatgttattttcactgtctaggggaagtagataataattgttaataatactttcttgcttttctccagttgttgatgcccattgattcttcagagttaaaaaggaattttgccatattgactaaatttatttttaatgttgatgtctgagccagttctatctaacttttcagaaacatttttttcaaaacaattgatttgccatgtattctgtttgattaaattctatactgcatagcaggaatattagaaaggtagcggctcatctttgacacacctgatatttacatatccattgactaccaagagtattcagcttaacttaaaataccagtatggaatatctcagctgatgctggttctaaccgttatcaccgctcagcatatgattcagtgtatgacctctttttttttttttttgagatggagtttcgccctcattacctaggctggagtgcagtggtgcaatctcggctcactgcaacctccacctcccaggttcaagcgattctcctgcctcagcctcctgagtagctgggattacaggtgtccaccaccacgcccggctaatttttgtatttttagtagagacgggatttcgccatgttggccaggctggtcacgaactcctgacctcaggtgatccgcccgcctcggccttccaaaatgctgggattacaggtgtgagccatcgtgcctggccatgattgttattttagcaccactatcatcagattcattaggagctcctgaagcactggggacagctctaagggactggtttggtggtgtaatagccaccatcctgtgattctgcaggatgagatcccatgcctttcataaactaatttgtccttgctgctccgtacactaattcttgaatgagatttggtccttgcctcttaattatactaagttttcttctagagaagaaaagaacttcttacttggaggagagagtcatgcagggtgtcattcccagaggttgcccctctgctctacagcactcatctcctgaggactcttggggtttttagctataaagtatatgcaggatttgaggagccttttaaaaaattattaatttgaaaacttattaggagttgtttcaaaatataggaaggcatgtatgacagaaagaccaaaataaaatggatagtgtaaaaatatattattttctgttttgccctagaatgagatgtagtccctacaagatataacttttcctagttatattttgtaaccattggtaatagccctagttcctcagcaagttaaattattgtatctttggttatttagctgtaaatgttatatgtgtttatacaagagtagttcatggttctcaaaggatacataacctctctcgtcactttcctcctctgacccagcagtaccctaactttcaatctttaacatcttacaatctgaccatattgtcagactaatactgggctggttttatttaaggctaaataagagctaactagatgaactaagaaaaatatctactaaaatctgctatgagcatatgtattgcaacagaaatagaataggctctaattactcactgcgatatccctaaagctcttagaattatttcataaaacaccatcacctttgagaaaatccaaagattcttgaaattcttgttttaattagtcaaaagcaaaggttctcaaactttacaatacatcacagtcacctagaaggctgtttacacacagattgctgggccccgccaccaaagcttctgactgattaaatctggtgttgggcctgagaatttgcattttgaacaagtttcctattagagaaccacagtttgagaccactgctctatagttatgtgttttttaaaaaacaccaaattattaaatcattattgttaaggcatttattaatatttctggaacttcacggtggaagggtcaagagaggaagggattgatgtataaaagaaaattactgagtggaaagctttatatccctgtctcttttcagagggattcctggtcctattatatacacttaaagagaagtgggtgtttatgtaatctaggaaacaatttactctttaaaagtatttagctttgtagtatcattttaagatcaggcgtgcaaaattctcagaaactatttccgttcattttatttacaaactcttttaacactgggaaaaagttaactagattttctcttgaaaatgggtcatttatcgtgtaaaatatttatcttagaaacatacttttaacagtaaaccctggtgatttctttaagtcgaaaatgttttgtttgttttgattttttttcattgagtcctggatctcttccctgcaagatgagaaagatatttttccttcttaaccaaatctgatcattgaaaagctcattgaaattaatctatgtggagccatgaaactgaataaagcatatttgtttgtaggtgcctcataaatgtttacatttaagagaagaaaaatcaggatttaaaaagaaatacagactgcagggacagtttctcactcaccacccccaatttcagcctgtctcccattccaaggtgagactcatatttcatccagagtcagcttggcccatccaaagtgccatctactctgtgtttccaggctccgatccattaagttggtcagaatgaatttcctatctgtgtcttctgttgtttacaggtagagtgacacatcagttactttttaggtctggtttaccaaagactaatgaccagatataatgtcagaagggaactgttgtctttaattatttaacaggcctaaaagccatgaccaatccacatattctctgatctgctctgtggctcactcttacacctagagtatatctttgcattgaaaaattatatttaccttgaagacacagctaatctgggtgatttagatagatttggactttaaaacttcccttagaagatatttgctttgcctatataaatataactataatctcaccaaaattaaaatattgtcaccattggatataagcaataggtacaaatttaatgcatttattttcatgagggaatgctcagtttgttacactatattacagttgattaaaaacaccatatacttacactgtaactaatcagtggatgtattttgtgttttattggaagcactaatatttctttttagataagaaaggtaaggtaaagaaggccttatttgttctttgactcatttattcattcaacaattatcagtcattttctcccaagctacaatatttacaataccgtcataattgcaagacttccaccattacctaatttgattctcatctttaccacctgtttgctcacccacctcagacagccataaaattagcaatttaacatccagggtgatcatttttcttagcactttagctgtacctcatgtactgttgcacccaccctgtagctagactttatggatgaatactgtttatccaaacattacataatagtcaagagagactacagtggaattaacttattggcaagccctatccaatttgaggaaaataagaagcatacccatgaacatcctatgccgtatggcccactagtgccctctacctaccaacctagcaaacacacacttccctccatagctgaccagtcattggaaaacagatgttaactatattgttcgtatctgaaaggatgtatatatctcttaggtagaacagcatgggcaggagtgaacagtaatataacaaatcattattatatcagctatgcttgaaattgaagccatcagcatagatgagattactgagagagggtcctaagacaaaacactgaggaaaaacattgaagggattattatggaaagaagagccagcaaagaagaaccacaaggagtggcctgagacataggaggaaagcaaggaccctgcaataacagaagggcaggaaggagtttttctaaagaaagactagcactgtcaaatgctgcaaagaaattaagataaggaccaagccatggaaattaacgtatgcccagttttccacccttccttccctcaaattaagaagtttttgatttaacttttagaaatcgtatctcacactaagtaatgccataaaaatgttactgttaggagatcctggaaatgttgggccactaaaatatgttgaacctccccccacacatgcccttttgggaatcaggcttccagcaaccttgagcatttaaaatgcttccctgtacctgtaaacaggtaaaaatcctcccagaggcaataaggaaaactgttcttactaaacctaaggagagcattctcaagcctcctctctgacagctttgctttaactctaaaggcaggtagtgcatccatgcagtcagtcattcatgagcctctcagtgtgccatgcactgcattaggcacaggatatgtgggagtgacacacacggggaacaaaaacctgcagtgacaaaagcaacagcagagggagccagtggaagaaacagaaaaacagcatgggtgtgaagtgcagtgctacgcagcttgtggtccttcagtaattcttgagcatgtcatgggattatgtgacaaatttagtgctctgcaaattactaaatttaataaatatccacacacactgctatttttaattctgttcaatttcagtgtttaagtaatttttggaattgtaccaaaaaggtgtttatgtttattaagtgttaaagataaatcattattagtaataattgggccatttattgagagcataatatctcttcagcactgccctacactagcatcacacctaatcttcacagcataattgcgggcaggtattactgttcatattttgaaggtaaggtaaatgaggctcaaaatcttatttgcttaagtccacacagcagcaagtaatgaaagcatgcctgtgtggcacaaaggccatattctttctattatagagcgttgattcaaggcactggcatttatgttcagtccttcattccctgaagcactgagagccggtggtattaatgtgtttgttttctcttagtctcctgataaggtgagtaattgaattcagcatgtctagaaaaggtagaagtagcatttatcagtgaaaattcggccagaagaaaatattccaaacttcagaaagtttgagccccataaatgtatcttctaaaggaaaagtaaatgatagagatgaatagaaaagcactctgttaaaactgataacacccaggaggaaagagtcctcataacttccttaagctaggccctttttaatagcctaggtaggccattattaaatacatgcttctacaaaggcctgttattcagcaagtattctagggaaaatttcttctagcatgaagcacccagtccctcctggagctaacaacttcgtagaatcacctgtgggatctgtggtcacctttaaggatatagtcacaagcaggattacctactaaatggaaataagaaatagctctgtttttaactgagaaagaattcagaatcacaaagaatctaaaaatcttagactatagctatctactctaacaatgacagaacttcaggtgaagatgcttgtaaatgtctttaagaatgtatgtccttctcagctcttattgaggctagaaatggaaaatgaagtttttatttaaaaaatgagaaaaggcagtgttgtttatttttatcaatgcccagccactttttagccaaatttgcagaagaggatgcagtcaatgttaatgttgtacatatgttatgtactgcaacacagcataggccattaactgtacaactcagatttgtggccttgattatcagtctttgcatgtacattaaagcatactctgaaagccagggtcagtgttttatataaaactcttagattcctaagctgctgtcatatggccttgcacatatatattggattctaaacaaaatttgttgactgacttgatgctgtctttccacagagatcccagatatattcttcaaaaaaattgtttggtaaatgcaaaataactctaaatctcttttatatttgactagttattaagttagtacttaagtagaaattgaaatgcatttctcactttaaggttacagagttaaatttaaagcctagaatatccaagataatattcttactgttaaacagccatacctacttttgttattatttttgaggtcatttactaaaaatggttctcaaaatgatcatcccaaatgtgacatgttttgttacttggtacatgggagcaatgatactctcgtaactaagaaaaattcctgaatgtatatgaatgagaagcaaagattctggtatcacaactaatattccctatttggattgtctttaatatagatttcttcaaacacttcgcagttgggtggtgctgagcctgtaaaacgctgtggaaagtctgcactctttcaactggcagaggcaagttcctaagaatatattgagataagatctgcagaggtggaaattacaaaatattctaacagtgtttccctaaactgtaccatctctcctgtgaccataaaatgagttacatctaattttcaacaatgagagggttaacctttaatttgggaaaactgaattttgctactaagagtcattaagcattgctaaaggttacctagagatattgcaaaatttttttcacaggtagtattttaaaataaggttacttagattggctatgtaagtccagcctgaacacagaagagtatctgtggttattttcccttttctgattcccgtaaaccgtctataaatctccagaatgcactgcttttaaatcagatggttgatgtttgaattttttttttcctggtgaagaattcatatgacatgttctaaaatctgattttataagatcaatcagttgtacatttgatgtgatgtgtgtaaaatgctactcttccattggcaaagtagaaaacttgctttcataaagctggtgaggaacagagaccttattagtgggggatggattggggaggaagacgccggaagcatctgttgctagggtgggcaaggcaatggctttctctgccaggctgtgactaccctacctcaaggaaacatgcagaagaaatgttttcagcaccaggacattctagtagcagttttctctgttggtaagataaattaggaggtagaaagtggataaccaaaaatctcttactaaattttttttaattttctcatttttctggtttcttttcaatgagctccctttgagttcttttgtaaattttttgtagtttatttaacttaatgagctgaccaatcatattctaaaattgctaaattttatggtaatttgtatcataaaacttatgcacttaaaatatataatatctttaaattaggtttttaaagattaccaagtccaaattagaaatataaaaatacaaaggccttaaaaagtaaaattaataaacaatggaacaaactaccccattgttgtctgacactacaatgacacgcttcttgtgtaagacaagttgagaccaaaatagagggctacaagtgactggaaaactctaaggaaaactaatgaagacagcagggaatagttctcaaaagaactgcatgagtcagtgcaaagtactactccaaacagagctgaaacagtgaagatctgacaagagagtgcctttagagttagagttgtaaacaaatcctagtaaacagacagactgtgaggtcatgcatttgtctagtaactctaagactgtatatagattgtcaagaaaatttatttgaacgaagtgattatttttcttgaataatatggatgtatgaccctctgcttgtgctggttatataattgcatgtgtatgtatgtgggcacacatatataggaaaatacatatgatttcttaaatattaaacaatactaaaatgtaaaaccagctttcaatgtatgatatttacctttaaacagtttttttttgttaaaaatgtatgaacctttggggtactttgctgcatgggggggctggtaaagaagtggattcgtcattttctttctttggcatagcagtcataaaaaaaggattccttattaaatcagagctcattaaaaagaacactcttctaatttgtagggatgcatcccaaatatgaaacagatgctatggtttaacagatgtttgaatgttggtatcataatttaacggggtaaaatgactgaaataagcctattccaattatagcaaatcagcttataccaagactgagtttcttatgacatttgagcaaagatttatacttttgattaaacagaatccctaaaaaagaaaactttctggcattgttatttgcactgaatcagtgtgatgtcttaatacagtgtattttagaataacattctaaaacctcccagtttctaattaaacttaagtatatgcacaatggattaaccagcatctccaaataatcaccagcagatttatgcttccttaatttttttattgcatgtgtacttgatattcatttttcattcacaaaatataacgtttaattatttctgatgcattttaagataaataaatataagaagatattgaagatttttcctattgcctagaattggtgatggtgtctgcaatttgaagacacaaccttaaattcacacattctaaagggaaagtcaccaagaaactacttccaatttgggccacacccatctcgggatttctaaagagatagcctaatacaacttattatcctatctaccactccaggagttcctcctcttatccccactccaatctcaagtcatcctttggtagagggttatcataggctgtccacacatctggaatattttgccttttctctgtgtctcagggaggaaagaagagatattaattctcattctttatctatgtcccatgtcaagggaagtgaaggcagctccaagagaagcactgttaaagattgagggaggtacatgcaaaagatttcttcttcttctttggcaagaaacaagaaatatttcaaacatcaatttattgctggatcctttacctatctgaccaggcaaaaaagaaaactgaaggaagttgacagcatggagagactcggaatggcccgctgtactttgggcattataaagatgtatgagtttcccaagggtcaagtggataaatagaaaatagatccatgtgatcaggcaagagactattggacagtaacagagaggggttgcataaggtagtcctggggcagtctcacatcaggggagaatatggtagagatgcctttgctcgggacctctgaggtgtgcctgcaagcaggagtgatactcaactggtttgccgtccttatactaaaacaacaagatacttcctactgtcgggaaaaagcctgtaacccaaccacccgagtactcttcagcacctggagggcacatcccctctgattaggtggcacccctgcctgttaaatattttgaatatcacccctgcctgtgacatcccctgagaatgccattgagtcttgtgtagagttaacagtaacaaagaaaaaaagaaaaacataaccttgggcagttagttatacctcccccattctgtcttctattctctaaatgagaggttttaggccttgtgaaagaagggccaggaaccagccccaaactaactactcacctttccccaactccattcctgtgggctggagtaagaggagtgaatgaacagtccttccaaacatgggggttgttgcttccaacaaatgtcttctccttagtgagaagtaagaaatatttggggcatatatttactgctgtgccctgtacccatgtaagcaggcaaacaaaaaaaactgggggaaattggcagcaggcacagagatacttggattggcctgtactcccaactttagcgttgtaaagacccctttcccgttttccaggaccctggagccaggagatttcctggggaaggtcctaattcaggcatatgattggcattttaaactgggtagacttttaatagctgaaagtgacctgaaagttctgggatttgttccagatatttttaagggttttgtctgaggtcagggaattggcagaaatataatgctttatgtttggacctccatgaagttcatactgttcagtttatcattcatttaagttgtgcaggtactataaggtattgtgtttcctttcgttttgaaattaattaggtcaggtcatataaagaacagcaaagcatccccactggagatcattgtgtattatagtggctatagttggaggacactgaagagggtcagagatatctgaacctgtgtacatttcagcaaagaaaaattctacccttgaagatctctagtaccaaaattgtctaatataacaagtagagcaacttgttcatttattctcacagtagttattgaggatgtattctgtgccaataacagaggtgactgaagttacctgtatgtgtatatacacatatttttggtgcaatgagaactaaaacctgtaaaccttcttctaagatcggtgatataggaacatgttacctccaagtacagagtattttaaagtgtgactagaggctgcagcataagcctaaaaagattgctgttctgcttctcacttttctgaaacaattttgaatgttctttaaaatacattacaaatttgaatggcagatctttctacagataagttatgctatctaacctaagatgataatgactggcatttattatctgctgtgtgttaggcactaagtactttatatgtactaatttgattctcacaactatcctctgaggtagctactatcattcttcttttacacattaggaaaccaaaagctatagaagttatataacttgtttaaggtcacatggacaataagtgttagagcctacacaggaacccaggcagactgtctccacagcctgtactcttaaacaccaggctgttctttcaccttgttttagatgaatataaaagactgtgcaagttgcttgttataggagtgtgcatattataaaagtctctatggaagacagcttactcctacacatgtatgtgtggctgaataagatgacagattgtccaagactgctgtcaaagaaatggagctcatgttttctttttaaaaaatgtctgtgcttttgaaactgccaggatgcatcttacacccttaaataagtgcttgtttgtgaatgtgctttggaagatactgtggggattgtaggaaattatggtatacaactcctgtcctcaaggagcttattctctagttgtagagataagatataacaagttaaggaataagaaataaagagtgcaagtgatttaataaggaatcatgcaaggaaatgatgaaactccacttgagtgatgagtgacacacaaaaatgaatgtgtgaaactagggaagggagaaaatattagcaggcatgttctggagaccaagcacaggggaaaaaactgatgatggttttcaatcaaggagttacttaggaaccactagaagttgaaactagcagtctctgggtgacatccaacctacagagatcctttgtttggcctatattttgttgacctatatcatattctacagttcaattcatggctaatatttgaagattaaaacttcaaataaatatagatttctgacttctgaaaatttggaggacctggagacatcaagctagccttccttcatgagaacaattgctcagagttgattagtggttgcccttttggatgcttgttctccaaatgactgtcctctcctttccctgctgagccctcagtctgaggccaacagtcattgccattatccgcttaaatttgctcatttccctcctttatacctgaccgccatacatagtggggattgtgacttacacataattaagtggacagctgggggagataaagcaaagggattaaggcaagcacaggagaaaggtagatggtaacaagtctatcagattgacaggaatagaggactgtgtttatggaagatgaaggtaaagtgtatctgtgagtcagaattgggagaatgtttagtgcagagcaaataaatatatacttgaaaataatgaggagccattgaagatttgggacggtgttacacagtgataaaagcagcacttagagagatcttcttggcagctatgtatggaatggagtggaaagcccctgtggacttaaggtgtgagaagataagaactggaattgagagagctgacagtgggaacgggagacagaaagagatgccaggggtattcaagtgaattgtttgagtgagtcaatgtgagaggcaaagaaaaagaagagtcaaagatgactccaacactgaacctgattgtttgaccttgaccttggaaccctgcttcgggaaggctggttgcaaacaaagagtaagccctgctagtagaaaagaagagctgaaagatgctgagggtgggggaaagagaaattcaataatagaagagtggaaaaaggagaagattgctagccaagtaaatagttgagtttaggaagcagagacctgcattcctgagagcacagacgacagaggcagccaccatagatccctccactgctcccaattattggtgatatttgatcagtgtatgattccatttaagatttctgttgtgtcttcatattattgatgtgcattatcccttccatcctatggtaacccccttaaagcccagaacatcccacctcagctcctcctacactatcgtcatataaatgaattctaatacttaaaatgcatttaaggggacccgtgtggtgggtttctttccttatcattttatacaaaattgtgagttgtttttagaaaactcctgttctaaatcttttcacctcatccccaattgcactaggttatttttggaggaacagaaagtagaggaatgtatctaattgactgcccttaacctctttgggggaagactttagtagatgggcttatggaggaaaggccacctccaccccattcagagtcttcagaaacagtaccatttctgaggaaatggtgagtaaagaaaaatatttaaatcaccgtttcacctagtccagttgttgcagcaaactacagaactgttaaatatgcccagattttagtgttgagagaagcttagaccactgttctgtgaccagttatctcttatgataaatggaattgaattttttagcagcaatgctattctcagaaaccatcaaccagtgtatatttctctggcacaagcgttcgggttttatttaattatgggagaaatgcacatcctgaaaaacactgctaaaatgccatcctaaggttatgtctacattgttttggcagataataagccagtacaaaatgattgtaaatataccttggctgcaaaacatttgttttgtactaaaaagcagagatttggaaatggaaacttcttgattggtgtcagtaggtctgttttcacactgccttgtttttaatctggccaactcctttataatagacaatgaaagatgacatataattaaaagagaaattatatggtgcattttggaactgcttatcatttcttaggacaggttgagcatctctaatttgaaaattaaaaatccaaaatggtgtagaatccaatactttgagttctgccatgacctcacaagcagaaaatttcacacctgacaccgtcgctttttgatagttcagtgtacacaaactttgttccatatacagttatttcaaatagtgtataacattaccttcagactatttatatacagtgtatatgaaacataaatgaattttgtgttcagacttgggtcctatccctaagatatgtcattatgtatgtgcaagtatttcaaaattctaaaaagtccaaaatctgagacacttctgatgccaaggttttcgcacaggggatacacagcctccaccagttaaatggtttctgcttctgtacttctgtggtattaccttttttttttttttttgagacagagtctcgctctgttgcccaggctggagtgcggtggcgcgatctcggctcactgcaagctccgcctcccgggttcacgccactctcctgcctcagcctcccttactttttatctagtacacctaatttgttatttttccactgatcattttattacgtcttttaaagcagaacaaattaaaaatgaatatcttaacatcagtagaaaagaatacattttaaaatacatctgattcagaaagataaaagcttgttgcagccaaggtttattttatctttaaagcgagtccgtagtaacaaactgagcctaaggtatggttttacctgaactaaaagtgtgacagtccccctgaacccaggaacataaaatataatccctttactacacattttatctcaccccttcagtatttctattgaattgttttctttgtaatcattttgaagaagataactttttatacatggtctaacatgcacatccttaggaatcctaggtattaacatactgatttttctttttcttttgggagtgagttccatttcttcctgcacatcactgtcagatccttctgactacacaaaacactgagaaacctcagtgcgatttttattgacagaggtaatattaaaatattggtgattaatttcactggtattcttgggaggtataactaaggacagtatgattgctgggccggaccaagcagtagcatggtcataattagcattgtttttgttgctgctgctgttgccgttttttgagatggagtcttgctctgtcgcccaggctggagtgcagtggcacgatctcagctcgctgcaacctctgcctcctgggttcaagcgattctcctgcctcagcctcctgagtagttaggattacaggcgcccgccaccatgcccagctaattttgtgtttccagtagagacagggtttcaccgtgttagtcaggctggtctcgaactcctgacctcaggtgatccacctgcctcagcctcccaaagtgcggggattacaggcgtgagccaccacgcccagccagcattgtattttataggcttaaagtaactctttccttgtgcgaatcagaatgcattttagactcatagactacctcagaactaatgaaccatcctattaaacacaattatctgttgaatgccttctttttgaaaggtactagggtattcttgcaggagaatacaaaggtgaacagaatacattttatgcccactgagttacagttataaaaaaataaagtagtacctgagggaatagacgataggtatcaaatatttatgcccatcatttgatttaaaacattaacattttaacttctttgaatgcagtcacgggaattccatctctggaaagtgtccagatgatttttcattcttactttttaaaaaggttattgtccaatttaaaataatattagaagaataaattgtcatttactgaggcatgtactgtttcaaagcctgattaataactcacagtctattaagggcagcttgagtaaattaataacagccattaattctgtttcccacaatgtagccttattcacttgagttcacattgatttatgttcttttatgtcttctgtgtgcttgtctgtgtgcacatccatgcatacatttgtaaaccccactacagtgttgatgagtgcatccaaaagtagatgtaagtggatctacttgtaccccaaagtagaactgagctttcctacatgtttcttagagttgcttcttgaaagacaactgatttgaggtcttcctgaatctcattttgttgaatatttttcctccaatgatagaatcattcaaccctaaaatgaacacttagagcaaaacagtctaccaaagacatgtcatgctattaatgatactaatatgagtattactggtaagttagtatttattccatatggcataaggctccagagggatggttattacattattttagctctgtactaggcactattttaagtactgttgcatgtgcaactcattgaacctcacagttttcccaaggcagtaattttagcatacacattttatagattgaaaaactgaggcacagaaaaatttagggaaaatagctaatcagtagcagagcctgtctatagtcctagacagtctggctctggctccagcatccctgctttttgtgtgggtttaggggtgggtgtgggtgtgtatgtgtgtgtgtgtgtgtatgtgtgttttcttttttcttgagacagggtctttctgtgttgcccacactggtctgaaactcctgtcctcaagcgatcctcttgcctcagcctcccaaagcattgggattataggtgtgagctaacctcgcctggcccatccctgccttttgaaactgccttccagtacatcactgtcagacctttctgactacacaaaacagtgaccaccgatggctgccgactgcctttcctcagctcctgtgtcccctgcttccacctgggttcctccagtaggcggcactggctggagactggggaatgggaggatgggagaggccaaggatttgcttacatccaagagtgatgcgtcttataaatgttactacattcatagctgttcccaggttttgtttgtatcttatggaaatgcctaatatgcagtggaacaaatatcaaaaataaaaattaaggaatttatttgtaatgattttcatagtaatagacaaactgtggaatttacttgtaatgattttcatattagtagacaagaaactaaagtgctcagaagaagatgcttaaaaggagagtgctttagaaggaaaatgctttaaaaagtcaaacgtatacttttgacgtaaggaagagtgagtttaaaaaaattaagagactgaacatgcaaataagcactaaaatggaaaaaggaccaaggtcaatgagaatgtctgtctgtctctccacacacatatacacatacaatctcagtaaaagaacgaggaagattttttcaaattgtgattatgcataaactctaatgaattcatttgtaaaagaatataaatcttgcatgacaaccaaggagaaatacaaaaatacaaaagtatggtatcgactgttaagacaaaaattactctaaaatccagtatgaggtagggcttgggcaaaaacaaacaaatcttaagactatttttaactgtttagagctacataaagaaattggctttgtctggattagagaagataaagccaacaagaaacaagagaaggcaaactatgtaattattgcttttgtcgccaaaaaagcaataatttggtggggagtggggggcaaggaaaattatgatcaaaccaaaaagtataggtaaaaaaaaagataattgtatattaaatcaaagttagaaaaagctaaaatatgattcctcaaggatctagaaccagaaataccatttgacccagcaatcccattactgggcatatacccaaaggattataaatcattctgctataaagacacatgcacatatatgtttattgcagcactgttcacaatagcaaagacttggaaccagcccaattgtccatcaaagatagactggataaagaaatgtggcacatatacaccatggaatactatgcagccataaaaaagaatgagttcatgtcctttgcaaggacatggatgaagctggaaaccattctcagcaacctaacacaggaacagaaaaccaaacactgcatgttctcacttattagtgggaattgaacaatgagaacacatggacacagggaggggaatatcacacactgggatctgtcgcaggatagggagctaggggagggagagcattaggacaaatacctaatgtagatgataggtttatgttgcagcagaccaccatggcatgtttatacctatgtgacaactgtgcacattctgcatatgtatcccataacttaaagtataaaatacatatgtatttcctttccttggctcctatgccccctgcttccatgcaggttctactaatgggagacactggcaggagactgggagatgggaggaagggagaggccagggtcaacagggaactggtaaagaggcatcagggtaaggcagaggcagcttgtcttccattggtacatatccaatttaaaaaaggagaaaagctagaatacaatacacatggtcttagtatattaatttaggtttccaacaacagaaaaaacagattgtaggataccacaagaccttgcaaattgggtttcaacctcacttttgatcatctttgacaagttgtgtgaaataggagagctcaataggaacaaaaaggggaaaagttcactttaatttttaaaaagaataagcctgatttctcaaatacagacgattaattcctagaaacctttgaaaattattttaattggaaaatcattctaatcatgtttgaatccacagaaaagaagaagaaaacagggaattatcaaagtctctctgaaaagggtcattgtcaaatgtgccatcccagagtctctttgccctgcccactgccttctgccccatgtgactgctgactgcctttccttggctcctatgtcccctgcttccacgtaggttctactaatgggagacactgacaggagactgggagatgggagaaagggagaggccaggttagggtcaagagggaactggtaaagaggcatcagggtaaggcaaaggcagcttctcttccatgttccagtgctctccagataagtgccccatgcttccatcttccactggggacctgtcccatgggcttcagtgtcactctttccgcatctgtttcttctgtggctttctgctgtcactaacccctgtgttgcgtcaccgcctcctgtttgggtgtctcagttcttcatggcctgtgtaactaacctattccctgccttaaattcccgctgctagttttgctttaggtgcttccgtttccctaattagaccccgactggtacaaaagccgacctcattttctatttggtatagttacggttggtcataaaattgagtaagagaatgctgttggcatgctgtatccagattttagcaagacttttgacagatgttacaatgttttgtgaacaaaatgggaggaatttcaaatggattagaaaaaacattcttaggttgctgaagtttattaatgttcaaatcatcttcatgaaagggctctagaagtttggcagaaggccctgtccttggccatgttttgctcaacattattaccaaagatttggacaaagacatgaaaagcagctttatttaatgtgtgtataatacacagatggaagataattcacattttgaagagataaacttaataagaaaaaatggaaagtcttacatctaagtgcaaaacataaattataaaaatacagaatagaagagatcaagtttaccagcatattatgtgggtatagaaaaccaggattttacatgacagtaaacccaatacaagccagaaatgtgacctattaaaaaaaattaatctctgggtcccattaaaagagcattcctatcaactgacaagtagttaccccttctcatctagtataggctaggaacataatcttagaaagatattgctaaattgaaatagccagccagatgcagtggcacatgcctgtacttccagcattttaggaggctgaggcaggaggatcgcttgaggccaggagttggagagcatcctaggcaacatagcaagatgcctattctctacgggtggggggcggcggggggggggagccgggcatagtggcatgaacctgtagtcctagctactcgggaggctgaaatgtgaggatcacttgaaccctggaggtcgaggctgccatgagctatgatcatgccactgcactccaggctacataatagagcacgactctatcattcatagatagatagatagatagatagatagatagatagatagatagatagatagatagatagacagatagataggatagatagataatctgatagatagaaaaaattttgaagtatccattttccccaagctttgtaaagctttgtatcatttacaagttgtgtttgcatatacatttcttcacttttgcctcacaacagcccaatgtaggatgtactgttaccccatttcttagcctctgtttcctcataggggttcaagtctaagttacatagcttactgttggagctttaagcaaactaggatgcttggtcatgagcccagcccctttcaataaaacccatctcatttcaggacacctactgcatctaggtaagagggacccaacttttgaagtgtggaagcctttacatgtgatgagctgttaagggagatgggaagagacttacgggaacataaagtctgtcttcgagtatcgtatctgtcgtatgagcaagagtgaattcatgtggcttcagggaacagaactgaggctgattgatttttgctcaatattttaaaaattcaagcagaactgttgtctgatagagtgatacgctcactgtctttgtgcaaaagttgcttaactgactctcaggaatactgtagtaaaatgaattcctgccttgggtaggttaaagtagaaaacctctagagtgacgcccaactctgagagtctgattgggttttcggttaatgagtagatttgtgatttgtagttttaattcagagttatttgatttacatgtatagtttcacttccagcaatataattgtttttcctataatttaggattaacataatctgtgaaaaaatttttaagagcctgaaatgaggaagtaaagcatgactagtgttcagcgtaattacctacacaagaaatattgtgctatttcccagaatacgtccccagagtgaatgtctgtgtttgttccatttcattcctagctgtagaatcctttcaggggtgatgagagaatcattttgaaatatattgaagcctagaatagagtttgcaaaatattattaagtttgctaagatgaacctgtgcaaatgcaaactgtcagcataccactaaaaactagcgccggtaaggtaaatgttcctgaagtgacctattaaaagccaccagagtgacagtggctgaaaaatcataaaatttaccttgagaatgcctttctagccttttttccagaactagtataatttctctccccccacatgggatagttattcacgaagggctatagaagttgagaaaggaaaataaaaattatttcaaaattgatataaaaatagtacattctcccataagagtaaaacatgcagggaatattaaaggtttcagtgattcagaattaagataacattttgctttgagcttatttctggttatgtttaataaagagaagttcatagtcttcatagccacttgctgaggtctaaaggttagcttacctgaattcctgaaaaagacagctctgttgtgaatccttaatatttcatgtcttccctgtgaatgatccgaagggctgtgtgctcttgtcatgttcactttttttaattgcagtgtctgcctctctccaccctttctttaatttcttcccagacttactaatcataacataattctcacaggaagattggtgatgcattgaaaatactaagagaaaaatgaggtaaaaaagcatctggtatttaattcaatgtattatccacctaaaaatgaattttacagatggtaatgatctctgacaacttgccatttaataaaatgatggtttttaaaaacagatcagtttcctactcatgtgcttgattttgcattgactcagcaacccccaatactctttcccttctaagttgctaatacaaagtagataaaataaattatgactaagacttccttgctgcccttgaccaaatcggcatcatcaatctctttataagttcctcaaaggcagacagacctgaccttattgatttttgtatcattagtgtcctccatgggggctggcattttgggagccttgcagttaagtgtgtataaatgaaaacccaggcactgaaaacaggttttacaataagcttaaatttcccattttaaaaaatagctctatattaaagtttcaaggtatctgggagccagagaggaaaatggcaactttccccttgaatgttctgtacgtgaaatttggggagttttgatgagaaatataaaaacttaaccaaattggggccagatgggttttggtgttcagaatctttcagattttaggaaaattatacagtagatacatattacactaagtaacttccccagtgcatatttgaatgcaccactattccaataacaaaaagtatgaatggtcacagtaagtgaaataaactatttaagactataaagtttcaggttggttcaggtcagaatttgcagccagctgagttcacatcagatcaatttgccagcaagtgagttaagaaaacaaaaacaagtttgttctcagagcatttatgactttagagttgtctatcagcatttgtggacctataatgttttgttcattaatcaaaaccttctgtaattgtttagcaaatggttatatcatttctaatttcaagtggacaggtagaaattatttctgctttcctcatttcccctggaaaaaaagaaaaggcagatatctgaacagagtttgaggatgattaaatacaggttgagcattcctaatctgaaaatccaaactccaaaatactgccaaatccaaaactttttgtgtaccaacaagaagctcaaaggaaatgctcattggagcatttcggatttctgatttttggtttaagaattctcaaccagtaagtatataacgcaaacattccaaaataaaaaaaaaaatccaaaatttgaaacactttcgttttcaagcatttcggataagggatattcagcctgtgctacagttaagtacatcgtttcacttagaccacacagaatcctctgagataggtcctaggatcgttttccttttacagaagccacagaggagtgagggggtaagtgattcattctgggtcacaaagttaataagtagcaaaactaagaatcagacttgggtctttcaactctgaatcccttcctccttcttccaggtcttgttttcataggaaaagcttctgttgaagctagaaaatgacaattcagagatacgtttgacgagttaaatgactgtataacagtgcccacagccttctatcaatttgattcatttcagttagtttggcagaagtgggctgattgttgtaaagtttaaagtgtgttttgattatttttaaaacagatataattgaaaactttaattttgaaggtggaataataaggatactttcgggtgctctcccattttgttttaattgtttagatgtgcctggcatcagaagggatgaaaatggaagaatcaaagctaataaaagcaaaagaatccgatggtggaagaattaaagaattagagaagggaaaggaagaaaaagaaattaaaatggagaaaacagatgaaactaggttacagaaggaagcagaatttgaaaaatcggctaaggaaaatttaagagattctaaggaattgagaaattttgaggcattgcaaatagatgacataatggctataaaaatggaagatcccaaagaaattagaaaggaagagttagaagaagatcacaaatgtagtcattttcctgatttttcttattctgccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggtaagtaacttctacaaacctgaaaagaattcaaaaaccaaacagaatttcacctttagacctattgaaaacaactgccataaaaaacaatatggtatcaaaataataccttacatttgtatatttctttatggtttatagatcataattatttgttactttacttacatgttttctagcaccattaagggaagtgtattcattttgtaggtagttctcaggatgtaattaaagtaattttaatctcttctttccccccactggtatgggctggctgtttgttttgaaagattattattaaatattcagagctttaggtttggttttgaaaactggtggaatttcgagaatcaagcacgtatgtttgtcagaatcttcacctgtaggctctagaagcaactgcctttctctcttcattaggtaatcaaagctgtaactgaagtgggccaggcacagtggcttacacctgtagtcccagcgctttgggaggccaaggcgggtgcatcatttgaaccgaagagctctttaaaacattataatgtccagaaaatagttaacctgtttacctttattccattgagtgttttatataaattctctattttaaaatatagcatctgcctggaggactaccttttgccaagctatattccaacaagacatgtgtgagtcctaggtctaacaagccccaaatgaagatacttgggcctatttcatccccagggatgtcagttcagtgagttttagggaaattagactgaatagtgcccaccagcaaaggactcccataccttggctggtttttgaatggaaaagctagcagcagttagtctgtctctttgagtcatgtgatacctgttgaattacatgacaattaatcccagaagctctaagtcacttttctgcatgttccattattaaagatggtccagcatgaatcactctgagaactctgaaatagctacagttagcttcatgcaaatgatatgcaagcagtcaagaggttgctcgtgaagcaactaacatcatctcccctcgcccacctgtataccaaacacatcctttctcttgaattttcttaggaaaacgaagctcaggaaaaggaaactcctctgatcatgaagggtgttggaatgaagaaagctggacatttagtcagagtgggaccagtgggagcaagaagttcaagaagacaaagccaaaagaagactgtctccttgggtaagtgcctgtgagcacagtcacctgtactccacaagcctcaagtgtgggtgggattttcaaggtaaacagatcactaactacgcatgcttgttctttgactactcgctcaggacttcctacaatcttagtaggcaccctagtgaacacaaatcaagtgcatcacatcattcctgctgttaacatggtcatgtgaatgacagtaacattcacattttgatcatagtgaaaatatatagactttagacttggacctgagtttgaatcaacatcccttcaccaggatgcatttttccatccgaagcttagaatggatagtattagcatgtttacattttgcccattttacatactatatgtatttattgtttataaaatgacagctgaaaaatgtaaggtaaatgaaattatgcttctatcgccaactttattttgttccagctgtcttctgttgctctaagataaaaatatcaggtcaaatattctgctgtagagaacattcaatatattaattatatattgaaatgcagtattaagcaatggcatgcatcaagataaaatcacttaagaattattttatatttaacgttatgccaaagactgttaataaccatcttaatataaagtattttgttagttaggagatccaatactttatactggtgaggaaagtatctgcatattcagttagactattttgaaaattcttgaggtttcttgtcggctcaatttgaaaagaatactttgaatagaaataagtacattgttatattcaccatattttttcaaaagtgtgtttaaagctatgcaaattgtatgcattgggtgtattgtatttgatttattcataatatttgcatatctctttgtggaataatatatttttccttagatgtcacagtgctttaagtctggctaattctaaggctctaggtcatcacaaagtagcgaggtagaaattatttcccatagtgctggctctttaagattatttttattgaaatgatatatttataattttatgtatttcatttctaatatttttaaaaatccaaagtacttcaaattaattttgcttataattttatgtatttcatttctaatatttttaaaaatccaaagtacttcaaattagttttgcttacattttgcttaagtaatgacatgaaaatcctcgtatttcagtgtcaaatcatagtgtaaatgcagaatatcattttaaaatgacctgcaagcatctagaccagtgctctctgtagtctggaattactgccactgccttgtgggtctgctcactgagagaggagcaggtgttatgtaggcagtgtgaggtcctaggggaataaagcaagcattgaggctccccaacagaagcatttctctgatgcttctattagaaactgctgaagctgtaagagagattttcatcaattttctttgaggaacaagataagtgaaacaatcttgaaaatctgttcctgaaaagagattggtatgtggattgtatgtgtttgtttttttaatcatttctgaggaaggcacatgtgtataactgggagatgcttttttatagctgtaaattaacagtaaacttcagtgccttttcctcctttctccctttaaatattggcctgtcaggattcgagtatttgggtttgccttgtttagaacacgccagtataatacttaagcagggagaaatgccatttcctgtcagtctgctctgagatttgtagatgagcattttaaacctttttttatctcagaaaatgtgctacctgttaactgtagccaagaaaaattctctcagtattgacagatctaattttatagacttctctaagaaaaacataaatgattattattgttctctttttaagaaaagtctcaagagaccttatgagttacgtctcacattttcagttttcttttgggtattcagagtatttgaaaaattcacaacttatagacagctttctgatagtatttaattagtatccaattgtatctgattttccatcagaataaacattttttaactaaatgagaaatggtgatgttattaaggggaaaatatcacctccacccgttaccctttattgctttgacagaacttagtacagtagttcccccttagccatatttttgctttctgcagttttgggtctgaaaatactaaatagaaaattgcagaaataaacaactcataagttttaaattatgcaccacaatgagtagcatgatgaaatctcgtgccatcccacttcattccacccactgcataaatcatacctttgtctatcatatttcactgtacaatatgcatgtataggaacaaacgtagcatatgtaaggttcagtaccatcagcggtttcaggcatctactgggggacttggagtatatcccccctccagtaaaggggtgcttccataattgccatttcctgttgaccattcagttggtcatctgaccctcttatctctgcttctcaactcttgtatattcctccaaaacagttgtagttaaaaacatttttaggacaccccttagctagcagcctaacacatttactgcttataagctggtactaaaattgctctcctcttcccaatacaccttcttccattttccatctaccaggcacagcagttgtcctacagcctcttccatctgtctaggttgcatgttagtttaataagtctcacctaatgaaagccagaagccagcctaggatccagcaggcatgttgccattgctgtgggaccctagagacagtcagcaccagcccagagattgcccaactttacgggtggcatttctgaagtcattgatgatttaagttaaagcatgttgcctctgtgccattgcattcattgaaaactggctttactttgctcattgaatattttgtcttcattctagtccactctccagaatgttttcctagtattaatgctttttgtttgtgtatgttttaatcaaacagtagtcagtacatttttttaaagaaactaattttacaaaactaccaatatatcatatggtaatttaataagcttgattattaataataagcttattaatttaataagattgatattgataccaatatatcatatggtaatttaataagcttgccatatatacatgtatatgagtctgtaaaatgagaattatatgaatagagtatgctttgtactgaactttatgaaaaactcccatgccagtggagaaaatgccaaattccccacttcagaaatattctaatattataaatgatgtttctacttttctaaggtaataacataacctgtcatacgagtttactaagaaaactgtgttggtaaatctcaagcatttcagaaaaggtgtttttttccttgcacagaatttacttacctaattcccagagaccctgttttcaaatagaatatcctaaaatatatttcatgtcactttctgtgtcatatttggtcatgtgctgattgattcccctctccccttttaatagctccgcaaagctggatgaagaatttgaaaaaaaattcaacagcctccctcaatatagtcctgttacatttgaccggaaatgtgtacctgtcccaagaaaaaagaagaagactggaaatgtgtcctcagaaccgactaaaaccagcaaaggttaggtgtgacctgtaccttcctgccatgtggtcagaatctcaagtgacccttcagccaagcttttagctccctttagacatatcattggatttggaattgaggcagtagggagttagaatcttaggttgctttccaagattatctttgtccctttttttcttccttattttctgtagcctctgtccattggcatctcagtctgtatatttgcccgtgatggtgtagctaagcttttgcaaagatgttacacatggtcttcaacctcctgctctccagaattctaatttggaatgttaaccttttcttgaacagaaactgcaggttgagtccagttcttctgttccctgtgtccgcaacaggttgaactcggggactgtaaatcattcttttcacctgataagcagatgctaactactctttactggcattatagaccaaaggaaaataaaactacctgaaatcctccagcaacatatatatatatatatatatatatatacacacacacacacacatatacattggttttgttaaatttaaaaaatgctttgtttagtatattcattttcaagtaatcagcttctctactgcctatatcagggaagcttttttaaagttatcagcatgacttggatggatctcagcattcatcagtgacaatgctgcagtcctaaaggggattgtaagagggtgggggcattttcagtgctctcatcacctgagaccactgttgacatttgtgggacaggcactggagtactaaacatcttgcccttcaagcacagtgaaggactgtactacccaaaatggcaatattgctttcattgagaaacttaccttctgatttttcttaaggtctaaagattgatagggaaaatgtacctctagttttccatacatatatgaaatacttcattcagttggctctcctataaggacatggaatagagagatgaagaacttgggtggctgggctgtagttgctttcaagatcagactctagcaggatttgctggaagagttattttaattatcctgtaaaagttgctgcctattgcctgcttcatcaaattggataatttaatcaaatcagattaattccactcttttgtattttaaatagaccaattaatcgatcagatataaatattaacaaagagatataatttcatgcattttagggaatatttaagatatatagatgagggaaaattatggtttattctctggagaaacctgaacctttctccttcaaagcctaaaaaccctttgcacactggaattgacacaaccaaacagggtcaatttgagatctgtatctcaagacagaactgaaaggttgaagaaaatttccccttcatgattaaagccagggaggtatagaaacgtcattttagaattagctcagttttcctctgtggttaataaaaacaagtctagtgaataaagaactaaaaaagaaatgttgttgcatcgccaagtttgctcgtctgagaaaataaaatagggtcgtatcaagatcttccaagatagaaataaagtaggcttgttgacaggtagggagctgagcaccataatggattgccaaatgaaatgatagtctctgtgccctggagatatttaggaataggaaaagtagtccatgagcccaaagataccaagtatcttgagctcccataattcttggatttaaagttgctgataaatacctgacaagccaataaaatggaacttaattgatagatgtgcaggacattattccttcttccactcccaaaacattcacgttagagctttgaagttggctgaattatgtctcagggaatgtaacaatagatttatttttgtaaagctataaaaccctgaagttaggatctattttcatgagaccttctcttgggtcttagttgtctgtacgatttttctctcccagctgagattaacagtatttcttttgatgtgaaatagctttttggagctttggattatacttcatacaatatcatcttaactcttccattatacctctcaagccacaaagtcactggttcttatatagtatatcagtaattacatatgtgggaagtcttccaagatgagattttgttctgccttcagatttgtgaagcaaaatgcaattaaaataagcagaaattaaataatatattatctattcagcaaactaaagaaatagtatttgtgactgattgtaatttggcattagcagcaccaatatactagactacaagttattattaatgaaattatcataccagctgtgctgtaattgcctgatctttaggggacagaggagattattttcttagactctagaccctttccacctttgcataatgaatcattcagagcaaacattgtgtatgagatcattagttcattaataaaagagtatatgtccatcagaaacctaatttttcctctgataatttgccatttgtctatattttattttttcatttgtcatcattcaatattcattatattttccttcatgacttatactaggtgcctttttaggtacttcagcttacataaaatgtatagaatttttctaaagtgtaatttctaaaataaatttgtatgtatgcatttatatagttgtatatctcaaagtcatagtacctgcttggatttattcctctgttttcccagtagtctccatattcgtatctgtatttctaaggagtctcttcctgtctttcccatggtcatcctactatctctgcccttcctcttatgtctgtgtcataggtcttgtcaaaaacttgacaatgaaaagggatgaaaataactttaaaggccactttcctccaacttgggctatgttatagaacagagcatgatgacaggaataggatttccctttccttctaaaaatgaattatccagtaaattctaatctaactcacaatgcaattcagctgaatcagcccaaacttaatgttttctgagtcatctctctgttattttgaaatatttttaaaggaaagctttaaattatatgtctaaatttaattgtaacttcctaagagatttgttttacacatgtttttacatgtactgataatgtatgaagcattgtttacgaaagtattagaagtcagttctctgtagaatagtaatttttcagtggaagtaggatcatggagaaaaaaaattgtgttgaaattatgcctcatcttgacttattagactcacttcttcaccttattccttctatctttacatagttccttggcctattatcaaacatactgttgatccttcttatattttttcaatccacacttacattttaagactaaaatcaaaaatggttaaggcattgagtctttcaaaaaatcacagtgggaataaaagaagcaggtttacaagattgaaaagacagaatcctctgtttgaggtggggccaagccaatagtactttcagtcttacagagccgagatgtgatgatagatctcctattaggaaattttagcttccagattgggcagagttctgtatctttctccataactgtttgaaagtctccgctgccaccagatttctacaggaatatggtggcagcacctttgcaggtataaaacgtatacctgatacaattttgagttccttaacaatgcatgcatgtccagcccaatgaagtggctcctccctctgaatgaatcttaacttgattgtgactgattgactcagagaacttattcaagtcagtaaatgcacatgccctgcaggtgggagcacattgctataaattattgcataggaatatattttttcattgggtactcattacttacaagtccaatacagaaatggtagcctagtcttagaagaaaacccttgctctttatatatatacacatatatatagtttaaaaacatgaaactatagaacctgggcaaaagccaccaccaccagagttacgcctgacatttgtttctcacaacaggtgtaaagagcaggttcacttaattcaccttactcactgaccttgagaaagtatcgtgctaggctcatgctgaagtggctcctgtgtcactgcaacttctcacccccaaaacattcatttttcagcaaaccttgaacaagaatgttctggaaaggttattgtcagtgtccttctggcacccctcctaatctctcggcttgtcatttggcccttttgttttctgcccagctgtgaagttgaggtgcaaaggagattgataccttcagaatacgggtcatctgcccaaaaacttaagtggagacctaagccagtttgcataccagcaatgagtgatttttttttcataaggaagctgaagctgatgcagatattccctcaagaaatttggtagggaaagagatgggacggaagcttgagatatcatagtagagtgaagaacagttgtgaatatttgttttctgaatgattccttctaaaagcccttctgcattttactttctaccattcttcctcctccatggatacttctacattaatataataattgactaaggaaaagatgtaatagtaaatttccttatatttgctatttattacagattttgactttattttctgtagacaaaatacccaacatatacactatgctgattggcagaaatcaaatttttcacttcttgactctaaaatggctgcttctcagtgactacaattaaatcttatctatttgttttcgagtttgtcactttcttttttcatctgaagttgtcatttacttagagtagttttatatctataatttggggggtggccagaagaaaggaattttaaaaatgtaagtttatataagctcttctgtgtacaaaactactatgattgttattttttcatgttaaaattgacaagctctatctttagcttagtctttaaattactttttagatttctctgattatgattgggtccaaaaatatgtatttcttttcttctttcctaacacactgcatacgtcaaatcattttgcttctgtgaactacttctttatatcattcttcctatgagccaataccctattattaagttattttcctacaggtaaatcactaggatctttataatcctgagtagtaatttttctcctttctcctacgttggttttccatgattgcctatgtatcattcaggtccaccagcctagtttcttgggttgtataaaacacatgaggcagtgattgcaaatagattttagatacctgtaatattagtgtagtatgtacatgtgatatattttctttgtacttgttaaatttattttcttttctcttgttgctcactttttcccaaagaggcaaacaaggaagcatttctagtttcatttcaaaccaccgctagtcaatttagaagcatttgctattggttatttagaaggattgcttagtgtagtcatcaaaaaacacttgcacagatttatggtatcagtaataacagcaacagctgtaatttcttgagctcttactttgtgataagcagtgcattaagagctttatttgttcatggaataaatattgagaacctgtcatgtgctaagcaccattgtaggcatttagattatatctgtgaatgaaaacaaccctactgccatcaagattacattataatgggggaaccagacaataaataagcctaagcaataagcaaaatatataatttgtttgaaggtgagacgtacagtggaaaaagaattggtggatagagcaactaggcaaaagatcaacaagaaaaggctggaaccaacactacaaaccaactagaactaacaaacatatagaactctccactcagtaatggcagaatgtatattcttcacaagcatacatggaacaatctccacagtagaccatatgttaatccataaaaccaaccaataaatataaaaggattgaaataatacagagtgtgttctctgaccatagtacaatgaaatttaaaaatcagtagtagaaaaaaattggagaaactcacgaatatatagaaattaaatacacttctacataactgtcacatcaaaaaagaaatcaaagagaaatcagaaagtactttgaaatgaataaaaatgaagacacagtataagagaatttaagagatgcatctaaagcaaacttagagggagaaggggagaattatagctctaaatgcctatattaagaaagaaatctcaaataagtagcctagccttctactgtaagacactcaaaaaagaagagtaaaccaaactcaaaggaagcagaagaaaggaaataataaagattagagaagaagttgatgaaatgaaattaattaaataatactaaaacagtagagaaaaatcaatgaaaccaaaaactagtcctttgaaaataacaaaattgagaaattttagctagattgaccaagaagaaaaagagaagactcaaattattagaatcagagatgaaatagaagacattactactggctacagaaatgaaaaggattataaaacaatactataaacaactaaagccaatagatgagataacatgtatgaaatgaacaattcctaaaaagacacaaactactgaaactggcttaagaaatagataatcttgatagatgcataactaataaagacattgaactagtaatttttaaagtatctgggggaaaaaaaaaaaaaagcccaggcccagatggcatcaccactgtattctaccaaacatttaaaaaagaatttacaccaatttttcacaaatgaatccagaaattacaagaaaagtaaacacttcccaattcattctgtgagacctgtattactttaatgtcaaagacattcaagacattctcaagacaaagacatcacaagaaatgaaaactgcagatcaatatctcttacaaatgtgaacacagaaatcctcaacaaaacactggcataccaaattcagcaacatatgagaattatacatcatgactaaatgggattttacctcatgactgcaagtttgctttaatattcaaaaaccaattagtgtaacataccctactaatagaatacaaaacaaaaaccacttgatcatcccaatagatctaggaaaagcatttgataaaagtcaatgccctttaaaaaaaaaattactcaacaaactagagttaaaagggaaattcctcagcctgataaaaggcatctacaaaaaatacacagctaacatgatacttaatggtaaaatactggatgctttccccctaggcaaaggggcaatacaagaatatccactctcaccacttattcaacattggactagaggttctagccagggcaattaggtaagaaacagaaacaaaaggtgtctagattagaaaggaagaggtaaaattatatttattctcagataacatgaccttgtatatagaaaatcctaaggaatccaccaaaaaactattacagctaataaatgagtttagtagagctgcaggttataaggtcattagataaaacttaattatattttgatacacttaaacaatgaacaatctaaaaatgagattaggaacacaattccatttacaatagcatcaaaaagagtaaagtacttagaaataagtttaacaaaagaagtacagtacaatgaaaacaaatcattgctgaaacaaatatgatagaaattaatagaaaaacatcccatgttcatggattggaggacttcttattgttaagatggaaacactctcccaaattgatctacagattcaacccaacccctcttagaatcccagctgacttctttgtagaaattgacaaatgagtctaaaattaatgtagaattgcaagatattcagaaaaaacaaaacaatcttagaagaaaatagtagttgattttaaaactaattacaaaacaatggtaatcaagagagtgttgtactagaataaagacagacatataaatcagtggaatagaattggtagagaacctgtcataaacctgacatttttggtcaactaattttcaacaagggtgccaagaatatccaatgagaacagtagagtctttccaaaaaatgattctggatcaactgagtatctacattcaaatgaagttggacacttacctcatacaatgtacaaaatttaacttagaatagatcaaaaacttaaatgttaaagctaaaacaataaaactttcaaagcaaatgggcaaatctttataacctcagatttggcagtgaatccttaaatatgataccaaaagcccaagcaacaaaagacaaaatagataaattggaccatatcaaaatttaaatcttctgcgcttcaaagaacactgccaagaaagtgaaaagacatcccacagaatgggagaaaatatttgcaaatcacatatctgataaaaaaacttttatctagactgtataaggaatgtttacaacttggcagtaaaagacagctcataaaaacgggcaagtgatctgaatagatacttctccgaataagatatataacaaatacgtggccgataagtacaagaaaatccagttaatatcatcagtcatcagggaaatgcatatcaaaaccacaatgggaataataccatttcacatccttaggatggccataataaaaaagacagataataacaaatgttgacaaagatgtagagaaattggcctaagctttattatttcctttcttctggccaggatggtcttgatctcttgatgtcgtgatctacccgctttggccccccaaagtgctgagattacagatgtgagccactgcacctggcccaccaactgttgaatgaataaacaatccattaaatggaatattattcagccctgatacatgccgtagcatggaggagccttgaaaacattatgctaagtcaaaaatcacattatatgatactatttatatgaaatttccagaataggcaaacctatagagacagaaaggagattagaggttgcttagggagagggggaatacaggtataggagtagtagtattaaaaaggtttggaatttatttttgaggtgatgaaatgttcaaaaattggtgccggttgcaaatatctgaatataaacacaagttttatactttaaatgggtgaattgtatggtatgttaattatatttcaacaaagctgtttttaaaaatcagttaaaacaataggtttgtgagggaacgggagatcaagtgatgggcatggggttggcttgcagttttatatagagtggtctgaagatagttaagtaaagccttgaaggaggtgaggaagttagccgtgcggacatcttggagaagaacattttctaggccatcttggagaagaacattttctaggcaaggtaatggctggttcagagatcctaaagtcaggaacactgagactacatgtgcagaggactgccaggaggcccatgcagctagagagactcaaaggaaaggagtggcaggatatgaggttatggaggtaatggagctctggatctcttaagtcctcgtaagatagtataagattgctgacttttcatatacacccaatataagaggtctggctggggtgatgcatttttgagtcttcaacctatagctggtatttattttattttattttatttcattttattttaaagccctgacagtagaggtaatcaccagatgagtgagaatagagacaaggacaagggccaagcccagagctttccaaaattaagaggtcagggaaaataataagcaaaggagagagagggaaatatcagtgatggagaagagaaaagaagagaaggtggtatcctagaagcccaatgaaggaggcattcaaggcagagggtgtggctctagtggtcagaagctacaggaacagcctggtgcaataaggacccacaattggccttcacagcatgggggtactggatgaccccttgaagagcagttttccatgagtggcagggcagaaacctagttgtagtgagtttaagacagaatgaggctgggcacagtggctcacacctgtaatcccagcattttgggaggccaaggtgggcggattgcttgagcccagcctgggcaacatggtgaaaccccaactttacaaaaaaaaaaatacaaaaaattagccaggcatggtgatccccacctgtagtcctagttactcaggaggctgaggtgggaggattgcttgagcccaggaggtggaggttgcagtgagccgagatcatcccactgcactccagcctggtgacagagtgagaccctgtctcaataaatacataaataaataaataaagacagaatggaaagagagaaactggagacagcctaggcaacccttctgtggaatttttgctacagaaggaatgaagaactaaggcagtaactgatgtgagggaagttaggttaggagccacctttttcttttctaagttaaaagaatttgtttgtatagtgatggaatggcccattagagagggagaaatgatggtgttgagctggacaaggagggtggggctatgccatgggtggaggaactgaccagatgggagcatcaaatggttcacctgtggccagaaggcagagcatgtagttgcagctgttggtaggtggagagatgccaccggggctttggggaggtcagtgctgttgctggtatttctgattgttcactgaaaaaaaaaaaatctcaattttgtttctttatctgagaaaactaagaatctgaaacatctcccccttccaaccagaataaagttttttggcagatattttctctttttaagtcattttttcttcttagattattctcataaaaggccagaaagctatctaatgctgtcgggtcaactgctgtcctgaaagtgctatccttgttgtgaaaagcagtttcattggagagataaaacacatattccatcctttccttcatggtatttaggagtctaaagtaaaatcttttctctattacagactctagccactttgctgttattggttgtagtttgtttctactcactgtatctgcagtttctgcttagggagtcccagccctaatggaggctttgcccaatacatttctaaggaaaatctcactgggtttaaataagcctaaaaagggggctaagcaccagttaagtaggtgaagatgcaagatgacatttattgagattcaatttgcttattccacaggagggaggagggtggaattgttgagaaatacacaatattttttatgaaacattgtgaatttaaaatatatttatattaatattgtctgtaggtcctttccagtctcagaaaaagaacttattccacaaaattgtcagcaaatataagcacaaaaaggagaagcccaatgttccggaaaaaggtattggtgccctccatcctccatgaagggttcttggtcacctccattgtgattcatctttgagtaatgctcccatgcactgcctttgccttgtcctcccctctgcttgcttcagtgccatcagctcctgacgcgggtgttctcattctttccggactctgcagctaatgcaaatctccttcacttggattgctgttcaaatccatatttgtctctattttcagagccccatatgaatcctaaaattgcctcttctcatctgtatttggtgcgttttgcaattcagtcttcttgaccacttatccatttattttctttgactattcttggttttcacatgtttggcagcccttcataccatgaccacattttcctacttcatgaaatcttacagtttcgtgttcatgtgaaagtgcccccgtttctgtacttcctctgacacttggggattcttgcggacctttttctccactcttaagttgtaacctgtgtctcttcttccaccccccctcgtttgccaggctcttgttccgacctctttcagtcacatgcctgttacttgaaagggcagtagagactgattgtactctgtcccctctttactcggaacgtctgtctcattggtatgatcttgatgggcctttaaacctcttcagggctcatcttaagatctctttcttcccatagtgcaggactcctattcttatttcacataaaagataaatcttcccatctggctcagtgcagccaagtattctgtaggtcgggttttctttagcatctccctgcatgttagtgtcgtgactaccataaaccaactcatccggtgcccatttgcatcctacttgcatggccagatgtgaagcattccgtgtttcttgaatgaggctttaaacgcagctgtctcctgtgtgtagacatgtgtgcctgtatgttcctgtatgtaaccttttacttactttgggccttcttttcacttccacttcagcttcttagttttgttttgtatattgatattattttttcttctgcttacagtaaagaaacattattcattaggtgaaaacatcagcttttttcattccgttttactgatcttcagattactttgattaaagttacagaaataatccaacactatatttcataaaagacaaaaattttatttttaatccattttctgtacagcctcattattttagttggcaaataccattttaagaattaagtaattgacataaaattcagctttatttgtgtgatgtttcaaaagttagtttgtatatcatcttgtttttgtagtatggggaatctactaagagtagagtttcacttttctttccttttctgtcattgtttttaggaagtggggataaatggtcaaacaagcaactcttcttggatgccattcaccctacagaaggtaagacaagcaatgttatttaatttgagacaatcggagctggaaatgacataagttgtataggtttttaaaaggtataatttatataggtttaaacaacagcactagacttatgtgttcataattaggttatttttaattttcacatcaaagctgctatttgggggactcctgccaagggtcaggcaatgtgtcatgtggtgtttaatctgttaaagggcgatttgtaacctttgaatcgcattaatcagagattggagtttttcatagctaaatgtattcagcattgcagttcatgttgcaggcagatgcttatgcccagtgggagctggaataacaacctggttggctgggcatgggcaggcctgcaggagtaacttctgacctgggtgttttcctagcccattaaaataaacaccccagcaaggcacagtggctcacgcctgtaatcctagtacctcgggaggccaaggcgggcagatcatgaggtcaggagttcgagactagcctaaccaacatggtgaaaccccgtctgtactaaaaatacaaaaattagttggctgtgatagcgcatgcctgtaatcccagctactcaggaggctgaggcaggagagttgcttgaacccgggaggcggaagtttcagtgagccaagatcgtaccactgcactccagcctgggcaacaacaacaaaaaagaatagaacaccctgaggcttatgggtagcccaagaaaaatccaatattaactagtcatgttataggtcctaggtgcagatttgattttgaaatttctcacggccatatttatttgtgactttatattattactgttaagcattgagcccttaggtgaagcctaatttcttcaatggttaagaggccacctctcccttcttcctgttgattctctttttttcattgcagatattttaaaagagctgacatttttgtagggcttaattaggagtcacttcatttgaaaactagaagggattttagagatgatttgtttcaactcctttgattcacttatatccagaaatgggaacttcatgacctagtccacatcttttgactctcaaatatgctatcattcctttactgaaaatgagaaaaaaaatgcacaattgacgtaagtcacttatcagaaatattcatgtttttaagatagctagcaaaaatggtcaagtttgagttcatgttaaacataagtatttttgatttagtaggcatcatttacatgagccacatcagcttccgtgtcattttacttttacagaaaacgccagcactacatctattatctcacttgttgattcacattcacagcctctatggaatattctgcttcagtgctggcaaaacaaaatatgaattctgctgttcacagcattaaatcctaacatcctcaaattgatacattagctcttgtatattttaaaaatatattccatatagtttttttaatgtaaggcactgatgaactagcagaagagtttgaaggacatttaggaccactttactctttacttaaaatgtttactctttacttaaaatgatactgttctaagtactttgttctgtttttttaaacactgaaaaccctacagaggtaccagagcaagtgcagtgtggtagaaagagcacttacctgggagttaggaaatctgggttctagtctcagacctgccactaatcagcatttttcagtatgacaaattgtttaacctcactaggattactctccacattggtattaagtacatatataatttgtgtgtttagagattgggtgaatgatgagatgtagtagtacacagactgtaaattctgtttcccctctaacacttgataatgattttattgctctgatatcttgagtaagtattgtgttactagaagtactatattctgtagccctaattttctgcttttgggggcagaaaagtaaatcacttttgagtcttacaggcagtcccaggctttagcagaaatatagttataattggtgatatttaattatatttattattaatgtatatgaaacaacttttggagaatatgcactgaaaaatgcatgtccattgtttagtgtagagtacaaactcattttatgtggccaggaaaaacaggaatcaatttgagcatcagaaattactagtaatttaaagtaaccatttttggtttttcattttcttactatctccaacatttacttgtttgtgtagtgactatgtgctttgtgagttttctaggcctttaatcctctctctcgtctatgactatatcactgcttattgaaacttcaccttggagagggtataaatatatgacagaaaatatagcaataatatagaataatttaaacatgtctaaaattaaaatcctgctcaaatgttagacaggcattgtttgtagctgatgtctttaatagaaatattgagtcaactgatgctatataactgttcagctattctgatttcttctaaagtagatgacttcaagttcactgtgttttctttatactgccctgtgtacaggcaccttgcaatctttcttttttttcaaaatatcagaaatatttagatgcttagtaatatgtttaaatgctaagtttataatgtgtcttaaaccctgggcttttacaattcaaaattgttaaaccactttttgaaatttcggtatatatgtattaaaaaaaattgtccacaggctagaattaaaggtaggattttcaaataaaccaagaacactacctcctacctctgccactgtgtttatctttccacctagttatggtgccatatgctcatgctttaagctagaagtttctaattgcaataataatgatgatgataactaatacttactaccactttatagtttacagggggctttcatatatatgtatatatttttttcaatttcatcttaacagcattcccagtgaattaaggagggtttatcagccccgaatacatggtaaggaattatggcctgagcaacacaagcagatagggaagaaaccatatctccatttaagtacatcagctactacattttccgtttttcatatttgtagacttttaaccctcatttggttcaaatattgaaaatataaatggtatttcacaacggggaaaaaaaaaaccccaaaacctaggactaggaatctctgttaaaattcacttctttgcagtgtataaatctaattacaggcaggaaaattctggtttatagttagattttcacacacgatccacagtgcccaatctaactcgatctcttttcttaagtttgaaatagttgctatataacttcagcaaagtctcccaggatgttggataaggctcattcgtttctttttcctgtgttctattcagcatctgactgctgtttcagctcatgggagacctaccaaaggcaattagattccagatctggctataataatttcagtgcaagtttgaaaccccagttggaatgtgaattcatgactctggagcactctagtggcctcatggggtacaatacaagagcaatgctgctttcccaaaaaacctactccacattttgggatcagattttggaaaacaagacggtctcttattgctacattcctgatgtggctccaggagtgagcttgcatcatcactctcagatgatacgcaccaagtgtgttatggttattgtttgggtgtaaaaactagcccagtggatttgttctgaagtgttcgggtagttttgtgtgctcaattaaaagctggaaaagaaatgactaatttgttttggagccacaaagcctttcttttcttacatttccattaggttgcgggttgtcgggaggaactagcttgctatctttgtactcaacttttgtgcttgtttccctctctgaacttttttcatctcatgtccctcaccaccaagcttttgtctgctttgccaatgtcgttggactcagatctactgttttgttccagaaaattacttctcggatacagtcccatctgccttccctaattcttctgtcttaggggaagggtctccctgagggctgatcctgaaggctgtcctcagtctaaaccaccaaacaagaccatacgttctggggttaacccttgggtcagaacattagtctggacccttatcctctttcaaactctaggaaggtcacattacataccttttgcaaatgtgcatcatctgcagggcccatcattgcattttgatgtaatagtaggtttagaggagacctctggttaattggcattaccttcttttggggaacttatgagaacctccgacgtagtctttttttttttttttttttttttttgcctcttccacttggtctgcagtctgattcactcctttactttcctccaatatactgacccttgggacttgggtattgctggcctgctttgggccctcaggctctttgcctgctggtttctgagctttccatagtcacagtctggttttaggcagaaactgtacctccatttgcaatcaacccttttgcagctgtgccttacgcttcttactgtgtttttaccaattcatctggaacaaactagaaaaggaacaactattaagtagaaatgaaaccatttgaaggctcaccaaacaaacaaaaacagtgctagtcacaggagtactgtttcccagcctatgactctggagctgactggtggtttgttgttgttgttgcccctggccagatctctgatggtagcctatgtagcaaagttattttagggctagatggctcctttaaagctaatacagtccaacctccatctctgaatgaagaaacagaggcccatggttggttggactgctgttagtaaatttaaaagtcagtagtagaattctggtctctctgtgactgttacttccattaccccatggtctctgtgtaaaaagcaagtcatctttcccaaccgacttggcctttttctggtatccatgccttttcattgacctccttggttcttctttccgcagtcagttctaatgtaagatatgatacacctttccatctttggaaccccactatatacccttatttctacatgttctgtactttcctgggaaggggaagtagaaaagggaagaggttaatgttctttctggaatgtccatccacaatgtggtgattctattggagaggtaaacaagactcctgtaatcagaagggacagctgatggatctggataagaaattcgaaatctcgaagcttatgaatgtgcaatagatgttatttaatgctcattgtaaattcagattttgggcttctttatacttaaaggaggctttgaattttaaggctaaaatagaatcatgcatcttctttggagtgtttcttaccgaattattttttattttgctggaagcttttattgaagtttaaactaaaaaaaaaaaacttaaaatatgtaccaccactggcctatgttaagctaaatatcaaagtataaatattctaagactaagtataataactgagtaaattaatccaccattgaggtagatctatttgacctgggaatagatctgcaatctaaaaggagtatgttttctgacctttgattacttacttgaaaaggtgtttgggagcattgccaagtagttttttaaaacaactgttatcttaagcctgtctgcacacagccatctgttatgcaatattgaggtaaggccaaaccacaaatgatggtgtgatttctgctttacatactttcttttgatgtaattgaaattatttcccacttgtttaggaatgtgaagcctggaatcagcctttcttttgaaacatcttttaaagacaaggtgccatgatttccaggacaaataatcttattaattcatagccttctttcttgaggatgtacctaaatccattaaacacctagattaaacattttaaatgagggctgtgcaagtgtttataccaacaagttcattttttcacaccctgagttattcttgctctagtttttttttcctcttagtttagcttttcttccaaatatatatatatatatatatatatatagctttattgccaatatctaccttcagatatgcctcctctggatttagtttgcttagggcttgttatgtctgacattagttttctgacccacattctccttttctttgtcaaaaataatttctatgtctatcctaagaaattggatagttaaaaattatgaaagtgcatcttttcccggcttaaaagcccttgggtcactggaatttctttaaagtcccaatcataaaactcaactatggtatacccctaaacacttactaaactcatatctacacatcttgtcttacttttaagttaaggtcaggagggggtaaactgctaagaaaatgagtatgtaagaaaagacacaagcttccccaatctgtgtaaaccaggagaaaagtctgtggtacaggtgtcttccttgctcttgacagagtgactcagaatataggagtgtgctatcaaatgattcattggggttacaattaggatacctaaaactagcctctccacaagccaggatgacatgtgggacttcattaaattatctcactaagtgtattccttgttttagaattcagtgaatgaaagagagtttctttccttggcgtgctggcttcaacaatgtttgtcctgtccttactgcacagtcaatctacatgaaagaaagtcaggcctcaatttcttttctgatcaattcaacctggtgcttaaaagcaaatgtcccaaccataaatataaatttaagaaggacatatttaattttagtgtcctctgaagaaatttcttttaccatcctctctaggccaactggccaaaaggatctctcagatagggaccctgatcacaactaggacataatttacaagaggacataatttactcagatttacctaaattatcgtccccaccaacgtgcaacacccagagacttagaaaatgtaaaaaagagggggtgtcttaattcactgcatttaatttatcaaagcaaatatcaattggtagtaaacaagttaggggcaacgttttatttcattttttccatcagtactttgaaaactctgagtgtaaattctccattcagacgggtcagaaatttagacatgtttccttctaagagcaattttggtgccttctgtttttgtgcataactatgcatggtatttcctatttcagccatattttcagaagacagaaacaccatggagcctgttcataaggttaaaaatatcccatccattttcaacactccagagccaacaacaacgcaagaacctttggtgggcagccaaaagagaaaagcaaggaaaaccaagattacacaccttgtcaggacagcagatggccgggtatcaccagcaggaggtactttgggtaagaagagagagctttagaccagaggtgtccaatcttttagcttccctgggccacactggaagaagaattgtcttgagccacaatgaaatacactaacaatagccaatgagctaaaaaaaaaaaaaaacaaaaacaaaaaaaaccaggccaggcgcggtggctcacgtctgtaatcccaacgctttaggaggctgaggtgggtggatcatgaggtcaggagatcgagaccatcctggctaacactgtgaaaccccatctctactaaaaatacaaaaaattagccgggcctggtggtgggtgcctgtagtcccagctgcttgggaggctgaggcaggagaatggcgtgaacccgagagtcggaggttgcagtgagccgagatcgcgccactgcactccagcctgggcgacagagtgagactctgtctcaaaaaaaaaaacaacaacaacaaacacaaaaaaatctcagaatgttttaagaaagtttacgaatttgtgttgggctgcattcaaagctgtccccagccacatgcagcctgcaggccatgggttggacaagcttgctttagacagagataaccagagcaagcagatgaccaccatgtcagcaaatgactgtaagcaactgtggttcctactgaaaaatgagtctattctgcagctttctacagacctccaaacatgttttattccatgtttaaaatcatagctagttttccaagagcatatctgaattcctagaaaagaaaggtagtttttaggactgtcatcttccctttatctttctcaatgtgcacaaaagcaatcttaattccaggagatcctatacttttaaagatactagatgaatcagtatttgaccatggtctgctgttcgggtcactacaagccagattaccaggcattcaaaccagtagattaagcttaaaatgcatccaacattcacttcctatataactggtttagaccatgcagggagcctgagaatgcttctggatttcttgagttatctgatttaattcaccaactggtgaatttctccattttcaatcatggcctgttgtctgtttgctgttcctggtagcctctttggcagtagaatgaccggaggagcccaaggtaaggggtgtggccgaagagtgatactgagaccccccggccgcaaaatcttggagtgctataccagctaggtactagtggccttggctgttgcctttctgcctctcagcacctccgcaattttattttatgtgatttgggttaatctaggtgttaatagaggggaactgtttgcttagttagaggacagtttatgaattttgtgcacttcttttgtgtgttttgaatatttagattgttagaaacatagagtatattaaaggccctgattttgccctgtcatataagagaaaaaattcaaagaggtggaagtttttgtttgagtacattcaatacaatagaagtagaatgaggactaacacctagatgtcctgatgtttagcccagcagtcccctccctccttttctgtccaatctgagttctgttctgtgactttcattttgtagattgttacatccacatttgttttcacttggaggaggagtgaagaaatatgagaacagtcccatttacatagaaaagtgtcataccacttttgtgtcctaatagataatatttaaagcttttatcagtcattttctatatttacaatttttttaaaactatgataaaaatttcccttctctataatggctacataagaaagaaagtatactcatttgtagcaggcatacttgcacagcatttcatccacctctttgtaaagaccagagggctttgtcttctctccagtaggtctttagaacaaaataacaacttgggctctcattagaactggttaatgtgctgtataggccatcctaagtgttggtatcacagcatacccaatgtccaagttgccatagtagggcatgctacagcttcatgagaaatgcttagtcagttgggtttttaagggctcttttacagcatctacaggcccctctacagaagtcccttgggttttattttagctgaggctcatttttccttctcactccaagactgacccattctttgacctcagataaaacacagcttctcttcagctcagcctcagggcacagtgctgtccatagttgcaactaagcttaataaaagagctttgttactgaggagaagagattctgtaaaagccttaatattcgatggatagcaaaagtgaatggtagagaatgttagctcttttcatgttgactggcacagcgttttctatgtctcttctctggagagaacagagtgatcctctcatgatggatttctcttttgttacagatgacaaaccaaaggaacaactgcagaggagtctccctaaagcaactgagacagactgcaatgacaaatgctcacacaacaccgaggtcggggagacgcggagcagtactccagaaatgcctgccgtgtctgcgttctttagcctcgctgcgctggctgaagtggcagccatggaaaatgtgcacaggttagtggtagaaggtggaaggagaaagcaacatggaaaccagatcaacctctttgatgtgatttgtgacattttttacagggcattggggttcaaacttggttcaagagcactattggttatatgaggtattacaaaagcatatatgctaattagcagtgcgggaaaataccagggaatatagtcagccaagtattttattttgaatatgttatcctgtggctaaacttcatttccgtaaaaagcctgagagcagggaagcagtattatctgaccaatgagctttggagtcccattgcagactgaggtttgagtcctagctccatcacctgcaaaccgaaagatcttgaccaagattattaacctctctacccttggtttttttcctctaaaaaaacaggggcaggtggcactcatttcacagagatgttatgtggggtaactctagcatcccagtgctggtgtgtggaatgccccttattggtgatggtgttggtgccatcaccagccatcagaagacagtgcagttcaagggaaagagcattttggcatctgactcatggcagccagaggcctggatttttcttcaactcttctgtgatttcctacaaagtaatttttttctctggactttagttttctcagcacacattgagcatagtgatatcgccaaagaattacgaagttgtaagcatcagacgagatcatagatgtgaaaaccctttgaactcagcgaagccccacagaaagtatattaagttctaagtgtataattgggtattctgctacttaatggatcctttgggaaggcaaaaaagcctgttgtaaattcaggtattttatattcctattcaaagtggattacccatggatgagctgctttcttagactttcagtcttcagtacaaaagagctctcaacccagtgcagcttgtgtagccagctgtaggccccatgctcctttttgacatccaggtaaacctggagtcccctgacgtgagcttggtttgcttcttgctatttacctgtcatattacagtttgagtacttcctcacaaatagcctctagatatttccaagaagtcaaattcctctttatgtgtacactgcaagttcctaatagcaagtgaatgctcacagacattgttaaaattcagtgaggtctctgagggagacaatgcacagatacttctccatttgtggagttgtgcagtcaaggatagaggacaagcacatacacgtgcagtgagaacttaaaatatctgcctgaatgttattaagtgtccctgtgaattgtggaaataagagggaatctgagaattgagagagggataataattcaagggtaggaaaaggctagcacataagcagcttggctgctgcctgtgttctaagcgtggtcacaccgttgctctgttaaccagccctccatggttcccaatttgcatcagcagaaagccacagcaaacctttccaatctcattgtctctgccctccacactccctaccctgcagttaggtggaatcacttacccctttccagatacgccaagctcttgccttgtacatcctctgatcaggtgaactgctctccttctccccaccctagtccccggtcctcttctctcagtcctcctgatgccctaggctgtgtgtttcttgttgctcctgcatgctatgctcacacctctctcagaccacattgggatgtattgatttgtcgatacttctgtctactttcagtatattttgaaagcaaaacagtggttttattctctatgttaccagcttgcttagttcctgttataacaattgataaatgaacaaatgagtgggtgaatgaataaatgaggtagtttctgaagtatgactgcctaagttagataacaggtatagaaaaaataatgtgagtaaagattctttttattttttttaaccttccattagaaagaacagtaatgattactagaattttaccatcaacctaataaatggttagtgttcttaatagctagaaggacagatcaccctggagagtcttagctgtaacttgagcccctacctgttaaagcagatctacccaccaggcttctacctgtaggctcactgttattgaacctgggttgcataccaatgaagtaagcattacttcagcatcaactcggttcatagtttaaagggtggcccatggagttaggggtggaaatatacgacctgcactcatgccatgaaaaaatctaacgttaggttcagaaacctaacttagacagttttacaaaatacacaaaatagagagttggaacaaacctttgttaagagaccagtttatttactagaagttaaattagccctcccaagtgggcctttttagtcccattttaatgaccgttaattaacttgccaagagcacacagccaatttgtgcccaagtcaagatttgaactccttatctcgcgtactgccaaaggaaagcttcagtcatgtcagagaaaatcatgaagaatctcacctgacccttcctctgggagctagaatcatcagttgcagcacatagtcctctcccactgtgattctgacttctttcctttttccattgatttagctggactttcaccccaatttctctctccttcttgccatctttttttacattgcacttttcatcttttttgtttttttttttccttttctaatacttattaaaattcttttgggtcttttaatatcttaaaagtaaaaagtagcattttaatttcatctttcttgaacaaagagctgaacatattgaacaggtggtatctataacatccacatgtgaatagcttaatccagaggtttgattctaaaatgttttgcttttctaaaatcctaaatatcttgggctattaagtgatcatttgattctgaaacccccaaatgttgcaatttgtctacattatttttcttttttgtgcatcaagagaaacttgagtatagttatagagcaggtacaagctaaatcttgaaatagctccttttgttctatgtactctgaagaagatacgattttgaaaggtcatcccaatgaaaacattgctgatacatcacatattttcagcacagtgttatgcactacagaccattgtaggttacagagcagtgagtgtgcattttctaggattggtaggcctgttggaaaatgtcaaggaagtacccagtcctatctttttagaatgagaagctctgtagaaattaccaagaattttggacagttttctcataaccatgaagtaaattgtatttttactactaattatacaaaagctgaatgaaaaatcagctatgtttggcataggttctatccaaatgatgaaaatttccatgaattttctagtcctgtctggagttctccctccatgtgtattgattttcacccaactagggtagattttgttaaaatctaaaatccagcatcagtgcttgttttcttcctctaaacactctctgtccatgtgcatgtgagttcagagggttttattgtttcttcattcctttttttttttttggagtcacagtccatctctgtttctcttccagagtcattgcttttattatcactaaattacctgaaggttaccaattactataggagaactttcccttcaggcaagtcaagaaaaggaatgtgtcatttttaataccaatggatcaacaggaaaattattgtccaagaaccccagtccttgattgaaattttcccacttcttaaagagttgccccaaatctgttggtacttaaaatttcatctcttcaaaatggaagtggttagttgtttgaggccagagggtatgctgttgagttgtatgaggggaattcagatataaaatcttaggaagggagacagaatgggaaggaggaaggggaaaaaaaggataaggaaggggacagaagagaaaaaactctaaagcaaaaacagttttcattaaatgatgtaagtaacagcagtaactgttaaacaagatattggaacacacttgttattcatcgtcctctcctgtctctaataacatatgctgaataagtgactttttcttccttttattttacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataattagctaaaatccaaaacaaaaaaccaacaacaaaaattgtatggtgcggaacatgcaccttgacaatggtactaacttgttattctatagaacacgttagaatagatctatttttgccagagcaccctccttcagtcctccgattacatttcactagagttccttacgagattgctgtatattcctgggaccttttttaaaaaaaaaaaaagcaaaacaaaagattactttttttctatgtgattaatatcttacttgatctgcttttcctaaacctcagtggcttttcccttaggcagggttgggggtgggagggcaacttactggagatgactgttttcagatactttaaaacaaacctttttgtagaaatgcttaatttttaagcggttaggcactgagagtagcagaaatcctgcaaagctttatagttccttagactcaccttgtcgattctctgagtaaagtcttgatttcaataattgtgcttctcatgccctgaaactgctggagaggagtgttgttattttcaggtaacaacattcgttagcacaaatatttcagaccaatattagtgctctccaccccaccttttgttatcattttcatttcatttctctcattcttttttattttggaaaatcatattgctatagtgtgtactttaatctgccagcagataccatctacactaacatttgtcccacagcatcctcaagagaaaaagttgttgcaccttatatatatctcaagcaaaccaaaatatgatgctcttctgctttgttttattctaaattgttgtatcatatctttctgaaaccattctgaatttagttgaaattatcaatatttatgcttttaaccttaatttctggattcaagcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctttaaaagttaatttcagtaagtcctgtttcaaaagtttgtctttttttgcttctaccttcagtgccactattttccactgcagtgttttgacttcacaaactgcctcctccagagagaacaatgtattgctgaaaatgggcagtagaagcaaatgctgttgttacatttgacctataaagtattcagagtgactgctaggtagaaattaaaacttagctttcccaaatagctccttattttgcaccttataaaaagtatactaattgttaattagatgttgcttttgtttatacaagcattcccaaagaactagatttggattttgttttgagtttttggatttttaaaaattatcttatttagattgactaacagcatacttacaattttaaaagaagctgttgttcagttcatcttaccagatgtgtctggcgaagtattcagggtttgatggactgctttactttcgtttggaagtgatagctaagtttattatactctatattaaacaactttgttcatttcactgaggaccttatcttccttatatttcagaacaaagaagcaacaagcgtgaataaaaagacaaatgtatttgactccctcataatccccatctgtatgtgctacccttccttcaaatatataaatgtgcatcttttttttaaaaaaaaaaaaaaaaaaggttcctcttctggccaaatttgatctatggtggtatgattcatactgttaaattgagagaggaaaccttgtggttaaaaattatatggctgctgttttctttttgcagtcagtggtcaaaactgatcatgtgcttaaatcgatttttatgcacagaactagttattgtgaacattactgctccctccaaagatttcctgataacttgggccagaggtggttactgagtaacaaggatctaattcaatgcctcaaaactcttccacccacaatgcaaatcttacctcacaagctctaacctaaatcacagagacatgcatgtttcatgcattaacactgatttcgctctgtggcccaccagaggggtgggctcatgtcccctgactcctcacatgagtgcctcagctctaagagccgtggaacggggggtagggaaggtttgcgatctggagctcagcaactggctcagcaacgttttctccatttcattagcactaaacaagtctcttgctctcaggaatttgtcagaaaaaagaataaaatcacctgagactccacataccagattataaactcttctcgtaggtttgaattgcttactcacatgtcataaattaaccacagcttcatttgaccaccaggtctaaagtctgttgacagtttcagcatgactgaatcgctcattttttttttttgctttcagaaattggcttggttctctttagagttggtgtaaacatgccatgtaataaatgatttccacttaatggtacaacagaattattgctttcttagatgtatgtgtagtaaaagtcaatatacacatttatataatttctttcttcaaaatcttatacctaatttgatatttctaaaaattgcacatgtaagtcatgtgtataacatgctaaagtactttaactgtgatcttaaaactgaataaaaatatttaataaaactttgaaatattttaaagatattattcaaatatatttctttatgttcacactactggccgtagagtatgtgcctttaatgtaccattttcactaaaaacagtaggaaaaatactaataaaagtaagatatttcaacta

SEQ ID NO: 477 - DNA, 15045 bp, Homo sapiens
gttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctgtgagtgctgggagcgaggcgggttaggcaggccgccggctagtcgggctgggcggggacgtggcaggacccggcgagcagggaaggcgtgggtgccggccgggggtcggcaatctctccagctcccctgagctcggggaggcacggagcctcttctttgggcacagtgttgtcgcttgggattgtcctgtgcagcactcggggaggtcacttgttaaaagtacgcacgttcccgagctccaccccaggagaaggtggttaactagttctggggtggcggccccgaatctctatttaaacagacaaactcaagcatactgcctctgcccttttctatacaactgttgcttgccgttacgaaattttaaacttattacttattttgcataaattagttaggtgagaaacccatgaagtgacccactgaattataagtgcatctttacgtgagctacttcacaccattgcataattttcctggtttttgcaaaaagagagaggttgaagtgccaggggttagggatctaccttatttatactttttaataatcctactggaccaattctagaattctcacttggttgggaaactgcagacttggacaaggtcgtttttagtagagctcaagtttccagaactcctgtcttttgctgcactgttgttgggcatttaaaactaaatgtatttttctcttttgtccttatacaacccagcgtgccattaacgtgatgtgaagccatatgatggctcactaattggacatagcactgcttggagttctgataacagccacgtcagcaaggaaactatggtttggggctgcacgtggcattttggaatggcctgtgtttcgcatgctagtaccctgatgaatgaaatttgaagtctgacttgtgattacgttgagccagagtttgttctcattttagaagttgaaatctcatctggactagtaataggaaggtgatgtttttcaaatgttctgaactggaaagcttgagactatactgttactggttatctcgcttctgaagatcctcagatactattggattgcataactaataacctggtattttaccaggcttagctataattaatttcgcaggcttttgttgcggggttgtaatgttttgcttctttttgtacccttcccccttttattttaattcagggttatactggcgaatatggcatatggatcttattcagtctgctgttttgtatagtgtgatgaccctagtaagcacatatttggtagcctttgcatacaagaatgtgaaatttgttctcaagcacaagtaagtatgtttttcaagtgaaagtacgtactacatgttatatttttatatgtcttcttaaagatcatttgtgtgtgttggttttaataagcattaatttgagatatatatattaataaacattttgggggaaaggaacattgatgctaggaagaattattaactaactgaagtagagacaatgatcattctgacacggctacagaagcagattttgagggtggaattagaacacttaaacacaggccttaatatgaggttcatcagagaaacaaacccaccaagtaagttaacatttcagaagctaaatgtaattccttatggagagaattgttctgggctcttcacgtactatttttggaagttaaagaaatgatctttttgtcattattattttttgagacaaggtctagttcttgcccagtctgcagtgcagtggcatgattatggttcactgcagcctcaaccttcccaggctcaagggatcctcccacctcagcctcccaagtagctgggcctacaggtgcaggctaccatgcccagctaatttttttgtagagacaggccatgttgaccaggctggtctttttattttattgcttttttttttttttaactctctgtcattttcaatgctaattacgtttgttttcatacaagtgtataaaatgtaaaggattaacatagtctaagatcacacatactgtaaaatacagcttttagagaagaaaactcaagcctcaccacaataaacttataccttaattataagcaattaaatattctagtttcatagaggttaaaatgcaggatcacgtagacttaggaaagatggtaacatttattatttctcagcgtcatggtcctcattgtctcattggaagtggtataaattgtttaattgacgccctttgatgttgctttcatgtacactgtgatacttgggtagggatagcaggattatttccctccttccttgatggggtcatctaggtgctgtattgctttgaaagtaatttcttaaaaggcaattggaatttcactgagacttagtacgaacatactttgtatgtgcattatcttttcatccatagttctcactctagtttggatgctgtttttacttgtattgctgtaacaacctccatctggtcttttaaaacaagtttagggcccgccctgccatgcactgtatgaagcacattgccctatgtaatccttatagcatccatatgaggtgcaggtattttccttgttttatccaatgaagagtatgtatttctccttatgtgacatcatttttatcatgtcattctcataacaactcatcatggcttttttttttttttttgagacagactctcactctgttgcccaagttagagcgcagtggcccaatcttggcttactgcaacctctgcctcctgggctcaagtgatcctcccacatcagcctcccaaatagctgggactacaggcacgcactactaccacgcctggctaatttttgtatattttgtagagatggagttttgccatgttgcccaggctggtcttgaacttctgggctcaagtgatccgtctgcctcggtctcccaaagttctaggattataggcgtgagctgccgtgtccagccatggcctgttttttttaaatgtattaaagccaaattcttctagacccctggaatgcaagtcatctgcttccttcctatgagtctggcctcatctttcagaattaggctttaacccttctgactcagccctcacatcatcctttgaatatgtcttgtgccctaccctatttaggattaacttacttcctttccattcttacctgtgttttatttctagacctaggaatcttttccagagaaatccttcctgattttgatcatttctttgctttattgtccctgtgttagactctttcggggaatgaggaatagaaacatgttgagatgatctcagttaacaggggtttattttaagaaatgtcccaaaatggcctcagtgactgaagtggccttagcagtttcctccctactgttctggacacaaacgagctcaggttttcgtggctgctgttctgatggaccagcagataaattgggttatctttgttatctttctgcttggcagcccctcaaccagctgctattccaggattcagctcatgtgggcctccactgtatgggactgtttcctgtgaggcatggccatctgtgtatcgggaagccctcacaagtgggcatctggtatgacccatcctttgtaatactcttggaactcagtccctttgagactcgtcattctttacttattcttcataacatttttcattcatctctttagaatcaaagtcatgttctttttaccttttcctttctactttaggcttcttgaagacacccgccatattttatactccttaaaacagttaatggtacatttagttcagtaaaatttcaatgacttactgacttaatagactcagaatggaggttttttttttaagtcatagttttggctttatattaaatatgctactgactttgaaatgcctacagatttgcaagatggttaaggttcaaagatccagcaagatgctgagtgtgggtagctgttggcagtagaaggaagatggcttcagcgttgacagtctgggttccagtgccagctctgccactcttaaatgtgtggccgtgggcataattttacctatgtagacttcagattcctcagctataaactggggatgctagtggaatttcagagggtggtgaggattcattatgatcatacatgttaagcatagagtctggcacataataaatgtttatgtgcagggttgaagaggttggggctaagagagcccttagaagttgtttttgttttttaacgtggcataatttaaaccatgtttgcaaagatgtttttattttaagaaatcaggtagtgtctttttttatttttaattttggaagtgttctgacatactgatgtgaaagagtaaaggaagaaaaatacaattgattttatgggttatcttagttgactaagtgctaggtcactagcgtgacctctattttgttttagagtgttcagcactgagtgaggtttattttctgagagctctaagacagaggggagggcttcctcctcttgagttgcagtaaacctgcagtgtggttgttatgcccctggtaggtgaggataaaattctagacctagaagagaaattgcttagttatctggtgtaatgtcttcatgaggatttatcatgtggacaatcggttgactgttcgtcctaaagacacatagtgacaaccaactcttttgaaaatgcagtagtttattcctgtgtgctaacaacttgatagttggggtgtgtgtatatattttttatattaagctaagaaaggtttctgcagtaaactgtgtccatttcttttcagttggtcttttgtggaaaaaaaagttgtctgatgttaagttcaagaaacacatttatttatttttaatttttcttatttttcctgttctcacaatctgttctcatgaagaaacatatttagtgcctggtctgctaaagaggttcagagagaagaatctctgcctttggagctgagtgtatccgaagtgcaagaagcatatgaaaaaagatagtttttatataatgaaatgaatcaaatgaagttggatcttcggagtaaaaagttcattttagtgtcctaaagtgtctcttaaaaagacagctctctgcccccttagcagccttttactttaggtttcagaattgatttcctcttaattgtgtgtgttttgttttgtttttttttagaactattttttcctctttccagttaccaatttgtgtggggtaacaaggtttaaaaagtaactttgtaaaccttttaaaaaatacattatttgaaactgactaaacgttttctttttattaataacaatgtcaattctaactcagttcttgagtgagagagctaaagatggagacaggtaaaaaaataggtaaaatcagttgcaatttgtgcttaacttgtatcccagacacccttgtagttgaagatcaagattgaaaactcctgccttgaatgacctggggctttctgtccatcacacccagcttaaattgtcctttggagtaaagttaaaataattactttaagatattacagctgttatttccacttcgtttaagcctagttttcgctcctgttatgtacttggaattgaaataatacatcatttactaatgccttatgaaatttattagttgaacagttagatgataggttaaaacaaaatgtagttaaaatgattcttaactaaattgtgttaatagcatttgactttattaaccacattaattcctaaactgtggaaaattcttctttttaaggggaaatcaaaacacgtcactaataaaccacatcttggacatttctcgaacttctcttttggctagtgcagtgtaataaacttggaactttctgctcagcttcttttcttgaaatgtgaaatatcattctgttgccagtacgaaatatgagtacggtgtgtttctgagagagtgtgatgttcacctctgtagcatatggaaactttttctttttttctttttcttccagagtagcacagaagagggaggatgctgtttccaaagaagtgactcgaaaactttctgaagctgataatagaaagatgtctcggaaggagaaagatgaaaggtttgactcctgtttaaagtatggccatcataaaagggggtactttgaagagaattttttgatttttgcttaaagaatttggattttggaattgtctgaggtaaattttggaattgtagtagtagtagtaatggaaatagtaatagctgacttttagagtttttattacaaccagatacttttatctgtgctgtacaatagttgatttattcctctaaagagtcctgtgaagtaggtactatttttatctcctttttatacctgaggcaacaaaggtacagaaagcttgagtaacttgcccagggtcctgaattagtacatggtagatccatgataagaacacaggcagtttaacttgagagcttgtacttgtaactgtctgctggaattgaggaggcaacagagctttgtacagagcaggctttgtctgttaataggtgcacaaccttgaacatatcgcctaacccctctgggtctgaagggtttatgtgttagcatgtctatgtggtggtatttctgttcctgagcttcccgagggatatcccataattagttatctgtattggttgggaaaaagaaaataactgggtttttctcctgttgcccaattctgtgccacgtttgttaacccctagtcccaattttttctgccggctgctcttagaaggcttattggacaatcttaacatctgagtagcagaagtccctgagtaaacttgtgctgaagaattgccacatagtttaatagttgtggatctgctggttttcatggatcttttgtttcagtatcaagaagatgctttgttggaacatattttttaccccactttgctccagaactttgtgtgaacttccattgttaaagtgcatataatatattttctgtatttaatacggttttcttaaaatgcatataaaacaagtaacacacttttaaaggaccagaaaccatttaaaaggaggaaaaggtggatgagcaagtaccttagagttagttacagcaactgagcactgaacttagttgtgggtttccaggtgtcaggggaagcatctgaggtcacatagctttcattgtctgacgagaagcagcatgcaagtccttctgaaaagaaactttcctggcactggatcttggaaatactttatcaagtggatccttatttaagggacactgagtaacttaatgaacaatgtcttctatagtggttttggaaaggtaccaaaacattattaaaatgattatcttctatggctcctttataaaactgaaggcacagtattatgacaatggaggcctttctgcatggagcagctttaatgaggtcgggctgcatagctttccaattgcttgttttttgcatagggatcaaggttagaaaatctaggtaactgttttagaaaaaactttttgttgtatttttcattacagtggtgtttcttaaactagggtatgcatagttacctaaatttcaaaatgtttgttacagcttttaaaggttttcagtgattaattatgtcagggatagtaaatgggtttcctctgcccactgcagtcttgggcagatttggtctggcacttgttcttgatcctgggttatgtctcggaatctttctcagtttagtgttcaggtagtcactactagtgactcagttgaaattgggaatgaaacctttgccatttgctggattaggtatttcaaagtggggtgaggtggaggtttcatggatatatataagtgcagagtgtcagaacattataaaatttctcttcttttcattggtagaaatttggctgtttttatttccaccataaaagccatacgggatacagtttgtactgtattgattgaccttgataactgggaccagagcctctcattaagatctagcttgtttctctctgaaagaattccaggagatttgatgtaagaagaaggcttatcagcatttctttgcttagatgtgtatctctcaaagctctgtctacattcatttggaatatatactccatgccgcttaaaagtactttaaaatgttcatttatccaaggatggaaataagcagaggagaatgtgagattcattaacattcattccagagtgggagtgtggtttcttcttgatttacaggtgatctatcatttaacagttgcttggtctcaacatttctcttgtaggaagctcttcctgaaaacatccttaagatattgagaagtgctctcccaaaccacgttccctactaggaagaaaatgtcttctactaggcagaaccgttggcaatgagggcatttgggggtcctaaatttaaaacagaaacaaaaacaggatatgggtggactcagtaaaagttctaaaggctgtcaggcagtcctgactttatacactgatgtaactaacacgtggtcatattgggatctagggaaatctaaaggattgggccacttctttcattaaaagctttttgaaaatggttcttgtattagtcgattttcacagtgctataaagatactaccagagactgggtaatttataaagaaaagtttaattgactcacagttctgcatgactggggatgcctcaaaaaacttacaatcatggtggaaggtaaagaagcaagtgccttctacacaaggtggcaggagagtgagtgagcacaggggaaagtgccatttttaaaccatcagattttgtgacaactccctcactgtcacgagagtggcatgggggaaaccacacccatgatccagtcacctcccaccaggtccctccctcaacatgtggggattacaattcaagatgagatttgggtggggacacagagccaaaccatatcacttcttatttagggcttgacagaaaagaagttaaggagaagcactgtgatgcaagtgagataattttatcatctagagtaaagtcagcctaataacctacgtaagcaacctgacttcactgggtctcatgccggagtcttaaaaatggaggcagttgtcctgagtgttcattctagtgttaaaccatgttgagactatgcatcttactaggctggtatcattgatcagtgttagaatgacatgtttcctggaactccaactcttgtgttttaaaaatttacatttaaacttctatgaaattagaaggtgttttatagttgatggctgcacttaatgtccttcccttcctccaaacttacagtaaatggaagagttattaagtcgatggtgtctgtagaattgaggaaatatggcatctgttagagactacagatttcttaagatgagcataagatgttaattagccttcatttagctcctttccggcaaaacttgttttctttggattagtatacttaatgaatataatgtgtcagttaccaatgacttacttaaagtgctgtccttagggttgaggggatgtgtcatctgactccagagtaggtttatctttttgggagacaaagtgtctacaaagtggccttcaacctttttgataatgacctacagtaaaaaatatgtattttaccttttgaccagataaactcacacgtggacacatgcacatgtttcataaaacgataattatcctactctgtgcgatgtgctgctgatgtttttctattctttcctatttcatttttttaaaatgctggtctcaactcaattaatttctatgggcattcgatccacttgattgagttcacatcccactaatgggtcacaacctacccttttaaaaactgctttacaaagttaattaaccaacaagaatgaaggctcccttattcacaggcatcctataacttccttttgcatgtgtgaaggggtaaaagaaaagatggatgaaataccagtaaattaataagataaactatcagaacaagtaaaatagaataaaaagtagaaggattttacaggcattaaaaagtcctcctaatgattaagcgctctttttttgtttgaattaataaagatggctaacaatagcctacttctgtgagaccacaggtaatttttgtcattgggattgtcttctgaaggtgtgatattgaagtctgaaatccgtaggctgtagaaagcctcaagcccaaggtatagccaaggaaactccacaggctgctaatcatggagtttgagttttaggtaagggccaagagaaagatatttgacttagctgctgatgaaaccgtgcgggttgccattaatgagtcctttcttccataaccctggttgcctgggaaaaatggtaacataaccagcatgatgttttcttcactatcatagagtgacatattttttttcagtggaagaaaggggacaattctgactaaatctaatattacaaacacattcttaccctagaacactcaaggaaaaacttgttttatgatgaactagagccatatggtacttaaaagtttttttaaatcatatttataagcttgtttgacttgtttctgtgtctgtagaatcttgtggaagaagaatgaagttgctgattatgaagctacaacattttccatcttctataacaacactctgttcctggtcgtggtcattgttgcttccttcttcatattgaagaacttcaaccccacagtgtatccttttcaaggttgattatcttttttagaagtcaagaaacagtagttcattttggttttgacttgtctggatattttagtggaaagaaaaactgctctgggagtcagtccattaaatagtgctgactttagataactttctggacatttaaaataacagctattggtttaagattcttttaagtttatgaattatgactgtatgataaagtattacaaagtagtctatgggaatctgtgtccttgcctccttaaaaaaaagctccaaagagccaaagcaaacctgtcatttttgatagcttctgaaataataagcccctgtacctgttatttttgggctctgggggttgggtggatggccaatgcagttaaataggttcattccagtgtatcttaatagtgtttcaagctgctgttaagttgagcttttgggcaagaatcagtcttctcttattaatttattaaagatgttatccaggaatgtgcagccaagattttaacaattggtgattatgatgtaataaaatatcagataccctccaacgtgtaccttctgggaatgctggagtgatttgctgaaaattgtagagttctgaggctaggagtagcttcgaacttttagaacctccttgctgttgcaagccaactgcagcaaaacactgatttgcagggaagacttatttttccattgctcttaggggaagaaaaggaaaacaaatctcttttctctccatgttctttgatcagctcttcgtgaaggttaaatggaattcagattattctttgtgatcatgtgttctaggtttctgtctaaagtgttttttttaaattggaacacatttcctgtgaatgttttccatttttttttggtcttctgtcttgcaaattgtgtttgcagacaatggggctgcacatcattatgattacaccaagtgtcaggaaggaagcagtacattccaaagagatgggctctttattttctcaaaaaaccaatttggagttactcatttttccataacattaaatttcttacaggaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcactgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcacatatcactgtaaggtacagttagggtaacactttagaggtttattatttttaaaaaacttttcttgaactcctggccaacatggtgaaaccccgtctctactaaaaataccaaaattagccaggcgtgatggtgggcgcctgtaatctcagctacttgggaggctgaagcaggagaactgcctgaacccaggaggcagaggttgcggtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttgatgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtagctgggactacaggcgcccgccaccacacccggctaatttttttgtatttttagtagagacggggtttcaccctgttagccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaatttg

SEQ ID NO: 478 - DNA, 16587 bp, Homo sapiens
agttgtggccactaggcttaggcggatagcctcgcagaggagcctaggtggggagggggacgaagaaggaacatttgggactgtgggatgttgaaatggtctcttcggaggctgccgggattgaaactgggcaaggtcccagggcccgagtagagccagagcgtgctacgcggcgatccctgagccacggggttttcagcgcccgggaagccaggcttgccaggttggggcggctggcggggcagggcttctcggtccgtcccaagtccaggtaggcgctcgcgacccgcgcgggcagggagaacgcgctcccacagtgctcgcgaggtgcagtgcgcccctgggggctccggggccgtcgggccaggtcggcttggcgcccagggactggccggacgggctgggcctttggcgggggtggaagaggaggttgccgcgccctgcccggcccaggtgtcgtctccgggggcggggtttggagccccgcagcgggagattcccggccggactggcggacgagcgtcgagagacagaagccgaggagaggaggctaagccgggcggcgcggggagcgcactgagcaggcaaagtcgcagggccgccagcatgttctcccgaaaccaccggagccgggtcaccgtggccaggggctccgccctggagatggagttcaaacgcggccgcttccgactcagcctcttcagcgacctgcccgaggtgagagactcgcgtccctgccttccccttccgcggctcccgggggcagccccagccacctcggcctccttccctcgcccgcgtgcacgccgaggggcggagacgcacggtctgggtacaaacccgacggagttgttgacttaaaaagtaaggtgtggacggtctgcattttcatcggatccatgctgcccattccgcggcctggttaggattatctgcctgagcctggaaaaagcccgggttggtctcaatttgtagggccccagctcgactcctaaaatgtgcctgaaccccaaaatgtcttgggcatccccgggccaagggcggtgggcagctaggcgggccccaagcgctcggactcttggcctgggctcccgcttgttccccagtcgccagccccatcccacaacctgtcgcagccatctgggccagcctctgtcatcaaccccgactttaggccggggccgctcgcttccccgaagcccaattcaaaggctcctctatgcccctgcagggcttttaactccttggggttacttcccacacgcaaaatttccgcctccttttctggggcctaagaggagtccagcccctaggctgagcgtttcccccgtccgccgtccacgcgttaacctgttggatccccacctgtaacgccctaagggctagggcggggctgaaggtgtgtggttgagcggggactgagagggcgaatagctaccccgaagactcttctgtccccaaggtcagactcacactcgcccaaggagagcccagttccaagccttcccttccgggtctggaaagggttaagtgaggtgggccttccttccgccccctctacctcccggctgggattccaggcctggcttctgccctttccctccagcctgcccagaacaaagaggctctttcacacccttgtcccggcgtcccgggccttctctgactcagaagctagtggacctggggagagggggcctttgtcgcgtccccttgcccccaagcgactgggcccgaggaacccgcgtggggccagcgtgggggagtaaggggcgaggcccgggaccagggggaggggcctgtgagctggggccgcccctgggattagcccggccttcggggacagctcggaggagctggggcggagccgcagggcctggcggccgccgagtgaagtgtgactccgtgggcctggcgtggaggcgggggcgctaggctgcagctggctcggaatcggggctggtttcctgtctggaagggaaggggcctgcagaagggagcggggacagcagcagacaggcacacccctgccttcctctctccctctcctcccttctctggaaaagcgaggtaattgtgagcccagggtggagcgggctggatgggggccctgagttggaaggggtggccctagggctgggctgctttgccaactcacccctttgtcccattccctgggctcactctcccctgaggtcctcacctgtgtggctctttttcccaactttctcaaactaagctggaacccctctcgggaagctccaacctcctgcaaaccccatgactctagaacctgcatgaggcgtcgtttccctgcccccttccagttgtgcctgcccctcactgccctctccgcacacagattccctgtccaccaggccagggatgtgggcgggggctggggagcggccagagtcggaatgaaagggcctttttcttccacagctgggagaacagctgccaccaaagcgagactggacactctgtgcctagagccccctctgcagctggcctttcctcctgggaccccacttatcctcacttcgctttctttttcttccctgcctggctcccggcagggccccggagcagcagtgggcgaggaaaatttgtcacagcagccagaggggtttaacaggagtgcagagggataagggcagcttctgccctctgcccaagagctggccacctctttaaagactgagggaacagtgggaggaggaactgtgggacagtgtggtacctatctgtcccccctctggaggggttgacaagggaaagggcaccggggggcacagagatgcaggacagattgcacatcctggaggacctgaatatgctctacattcggcagatggcactcagcctggaggtaatcccccgacccttggagtacacacctccttcacttgcatcccagccccaatctctgccctgcccattcctgctacagcatggtggggagagccaggcctgcttaaagtgggaagagggacaggtggttccctatgccttgtgttgggtgcagtgtgtggacccaggctcagttctgcccatcatagtcttatgtttgcagcagggtctttacacctatttcaggaagctctgtgggtgagtgtaaatgtctgttctggggacaagggttccttttaggcatgggaagaagagaggagttcaatgtgagagaggtttacagaaaggatgtagccttgctagagaagagaaggactctgggctatgagtaaggattctgctggcccttgagacagcaaggtgctgtttattcgtgtatttgtttttttcaattctttacagagacgaggtctcactatattgcccaggctggtcctggctcaagtgatctccctacctcgacctcccaaaatgccgagattacaggcgtgagccactgcaccttgcgctatgtattattaaacacatgtaaattttatgtactatctgccaagctcttttcgaccataggatacctcagtgaataagacaagaaagttccattgtagtgggagaacagaaatatacatacgaacacataaataatatcacataaagaaattatgatgaaaatggggatgtaatgaaaatcagatgagggaggcaatgttagatgtggaggtcaggggaagcctctgttgggagatctttgagctaagcccaggaggatttggagatatgtgaagactggaggaagggcaaaggccctgatatgaggatgagggtaatatatttgtgggaaagagagagccagtgtggctggaatatagtagttggggtggagctgatgggcaggggccagatcatgcagggccttgaaggccatgataaggcacctggatttcaccttaagtgtgatgttgggccatggaagggttttaagcaagggaatgactcatgccatgtttttaaatgatggctgctatggagaataggctggtgggaagttgagggtagggttgggggtggagggttggcaagagagttcgcaaatgtccaccaggtgggaggctgtttcactcccacttcaggtgggagtgaacctggtggtgtgaattaaaatgctcatggtggagaaagggagtagatttcaaatggtggtggtaggtctgacaggatttgctgatggattggatgggagggcaaagaaagagaactccaggatgattcccaggtatgtggctaagcaactgggtggtgtggctgtttacggagatggggaagatggaggaagttgtggaagtgactgcctggaccaggcaggggctgctgctgagaggtcagaggcaggactgcaaagagtctagatcaggaatggcaggatattgtatgtgctgtcccccctcaagccctgcccccactccctggatcatagtagatgttactggtcaattttggcactctttatcaacgagcccagacctggcctcagaatctttctcaggaccgtcttggcataaactgtgcaggttgtgtccttcacacaggtgccagccagaggtgagagtcctggtctggtttcagcggcatcaggagggagcacgtttatctaatttgtttgcctggagagggtcagctttttctaatttgtggaaaggtgtccagtgaactcgttgggactctacctaattatcctccatcagtgcatgagataaaacctatttgccattcatagtcctctgcactgtccacatcagttacatatggctatttaaatcttacttttagttcattaaaataaaacaaaacattaattccttagttgctgtagccatatttcaagtgctagatggctactgaacatttccatcaccgcagaaggttttattggacagagctggtctaggtatgtaaatgtttaaattctgcatcctaccctcctccaaaaaatgtaaattttctctgtggaaggcctgttcaagttctggggcagaggagatgcttagtttcactttggtcactctcctttaggagagtggctgagggtgctgtgttctttctcaaccaagttcagcaggtcctcaaaagagagacccattgatgtttcagggaatggcaaaagagatagtcgtggaagagtaaatccaagaagactttctggaggaagtgactcaagttgcaagtaaagggggcttattttaaaatatgtgctaggcccaggtagagatgagactttcccatataattctcaaacaatgctacgaaggaggtggaatactccccattttacaaactcaggttccaggggtcaaattctgtgggcttgtcaagtccctaaaccaggatttgtacttagccctggtggagattctgaagggaaaaaagggtagtgagaagcagagcaggaagtcagagacttaagagagtgggaggggtggaagggatatcaacagggggcctaatgtgtgtggggcccatgactcatcctctagccccttgggatctgacccgggtccagctgacacccagctctgcgctctttcccaggggaaatgctgcccgcttggggagagggtgtgtttgggtggggagggggcaacaaggaactatccctgggttggggaaacgctagaagcacaagggtccagatcctgagccaggattcccagttcctctgcctgaaagggtgggagccagtttcctagggcgctcccggccttgggccttgggagagtggatttggggctggagatcagtagggaaatagaggaggtgtctggactcgtggtcccactcatccatgctgggcccagtgacctccctagggccccagctctcccaatttatacactattcgccctccatactctcaggcaaggggtcaccttggagggcaaacgctacgcgggaggggcctcccggagctggagcacgtcgtgaaggccaggagccttttccagggcggcgcgggcgcactcctggaggtccggtcccgccgcgatggagtctcggtggaggcaccgccttgagccaagcccagccaggtgcccggagggacctccagcgccctggtacccctcagttgctctcgcggcaattgggagctgatgtcaccggcgtcctgagcgctgcagctggaggcggtgcagctatgctggcgccctggctcctccgatttcccgcggccctcggacccagccggctccccaggccagtgcagctctctggacctcgcgcgcctctgcgcgcctctcgcaatggagcgggctggggaaggatccgtgagtgctgggactgggatgagactagccaagatgggggttgaggacacctccgtgtccccctcctgccaggctcacccatttgggatgtttgtggctgaagctgggtgcagactggggtgggggttgtcgggcagcgcagaaccctggtgcagacaaaactagactgggaggacctatgtagtctgaaagggcttcctggtgaggggctttgggaaagggttggcttattacagaaggaaaacgggtggatggtgatgggggaaggtgataaaagtccggcctagcacagtggcccagaaaatagccaaggaagcatctgtaggcaggcaggacaaggctttttagaagagggaatttagggtgttcgggtctgagagacttgaaggctggagccactagggacagatgcaagggcacagtgtatggaggagagctggtgtgaggaaaaagacaggtttggagtggtcacattagttcccctgtttcaaatggatggctcgacttgtctcctgaaccaatctgtacactgtgatagagttagtcttccaactcctctctgaagctttccttgatcacctcagccagaagcaaacagaggctgtttcttgtgagcatggttgtgccatgacatggcacttatggagcagccattaaagtcatcatctctcacctcccagctggattttaaatgtacaaccttggacagtacagggatgctccagtgttgactgagtaaatgctgctaccaccaaagtatagcgtcattaaaataagcatccctgccattaatgtataccacatgctgggcactgtgctaagtgctttaagttcctgcctcacagaattctcacagccctaggactatttccattcctgatttacagatggggaaactgaggcttagggaggttgagcaaattgcccattgctttttaagaagcaggacctccagggctcctttctaaatgaatgttcctgagaatcctggtgtctcttccagggcctctcagctggcccttatccacagtccctcattcctggaccacctaccttcccatccccattccttgcctctgacctcatctcccaagctcagagggccggtaggtggtgattctcttaatttggggtgtataggtttctgtgcagcgtcagtgaacactgtaggtggtatgctccttgtccactgatcccttgccaactagatgtccctggcatcacttgagtctgagggataactctcatttgcctttccttctgtccattcccatgagttggtggttctcaacctgggtgtacctcagaatcacttggggagttttccaaaagtacatatgccccactcctagagattcttattctgcaaatcttaggtagggcctgatcatttttttttaaactccaaagatctaatattttttaaaggaaatacaatttccagtagtacaaagggtatatataaagtatcattaggctgggcgcagtggctcaagcctgtaatcccgcactttgggaggccgaggtgggaggatcacttgaggccaggagttcgagactagtctggccaacatggcgaaaccctgtctctactaagaatacaaaagttaggccaggcatggtgtctcacacctgcaatcccagcactttgggaggccaaggcgggtggatcacctgaggtcgggagtttgagaccagcctggccaacatggtgcaaccccgtctctactaaaaatacaaaaattagctgggtgtggtggctcacacctgtaatcccagctactccggaggctaggcagaagaattgcttgaacctgggaggcggagtttgcagtgagccgagatcatgccacttcactccagcctgggcaacagagtaagactcggtctcaaaaaaaaaaaaaaaaaagaatacaaaacttactcgggcgtggtggcacatgcctgtaatctcagctactcaggaggctgaggcacaagaatcacttgaacctggaaggtggaagttgcagtgagctgagatcgcgccactgtactccagcttgggtgacagagtgagactcggtctcaaaaaaaaaaaagtatcataaatgttttccatccctggctcccaggcctacaatcactaatattttatgcataaacatgcatatctatatctatgtatatatatgcatgcatacatatatatatatcatgcacaaatggtagtatgtgcaatactacccttcttttctcacatcatttattttggagattgtttcatatctgcatacatgtgcatatctctttccttaatgtctgcaatactacagggtacagatgtactgttacttatttaaccaatgtcctactgaaggggttttaattttggtgtttaaaacaatgccacaatgaggccgggcgcggtggctcacgcctgtaatcccagcactttgggaggccgaggtgggcggatcacaaggtcaggagatcgagaccatcccggttaacactgtgaaaccccgtctctactaaaaatacaaaaaaacaattagccggatgtggtggcgggcgcctgtagtcccagctacttgggaggctgaggcaggagaatggcatgaaccccaggaggtggagcttgcagtgaactgagatcgtaccactgcactccagcttgggcaacagagcgagactccgtctcaaaaaaaaaaaaaaatgccgcactgaatatttttgtatgtatggctttacctagatatatgtgaaattatatgtgtaagataaactgctaggtattggatagctgaattaaaggatatatgaatttgtagttttcatagatttttttccaaattgcactcaaaagaggctgaaggaatttatacttccaaccatcaaatgcatgagggcatctctatttttcttatttgttttatatatatatatatatgttttttttttttttgagccagagtcttgctctgtcgtccaggctggggtgcagtggtgcagtctcggctcactgcaagctccgcctcccgggttcatgccattctcctgcctcagcctcccaagtagctgggactacaggcgcccgccaccacgccctgctaattttttgtatttttagtagagacggggtttcaccgtgttagccgggatggtctcgatctcctggccttgtgatccgcctgcctctgcctcccaaagtgctgggattacaggcgtgagccaccgtgcccggctgttatatatttttttagaggtggggtctcactatgttgcccaggctggccttgatctcctaggctcaagggatcctcccacctcagcctccctcacacaccactgcacctggctacaaagcttctctggttattcgtgggcagctgagattgagacccaatgcctgctcttgaactgcctaaaacattagtttcttgtcagttttactggccacagcccacctggggactggggagtgctttagcctgtccactgactgacatttccttctcacccttcccccaaccctggctaggacacggagttgcagaggaagctagaccatgagatccggatgagggaaggggcctgtaagctgctggcagcctgctcccagcgagagcaggctctggaggccaccaagagcctgctagtgtgcaacagccgcatcctcagctacatgggcgagctgcagcggcgcaaggaggcgcaggtgctggggaagacaagccggcggtgagcaagggggagacgaggcctcgatggaggcaggaggccttctgggtggtggtggtgcagcatgtgcgtgtgtggcatgtggaccaccttaaagatgacttccccatgaagtcttatcagggacctgggagagaccttggtgttttaccaccactgtgtgttgcccagaggcgcatttgtgagtagccagggcaggacttagaaaagtcggtgtgtctggtgaaaggtagctgatctgaagggtagcaagtaatgcaaaagcactaatttgctaagccctgtctgtgatccagtaagactggctatctggcttttggaaaattaatttcctcaacgctggttcacaaaatcaccaatttaccacatactgacaatagtttgttatatctggggttcaccttcagaggcagggagtgggaaaggaaataagaaaccacttaaggaaagcctacccattcaaacaaattagattgtgcattctaaaagggctcagcttctggatgtaaaatgtaagcaacactgacattagactgttgatctgacaagtctataatgacttaagtgatgccatgataaaaccaaaatattggggaaaatatttggcaaattattctaagaatatgccaatttggataaagtggtcatttggagaactggtttttaggaaagtggcctacttactccactgaggctgctaggggaaatagtcccagcccctcacaggtatggtgcccattccagccatgaaggctgacacaagaggaggttgccaggagctcacccatgaagctaccagaagaaggcagaaaacccactgtatggctatcccatgaagctagaggaagggcaagctggtggggggacagcctctgagaggcagcatggacagactctgtcctgccaaagtcctcacacagcccacacaggtgatttgaggtacaccccaagtgcctggcagctaaacacattgccattagtgccacatcatttagcttaaggctctactaagtcagtaattactttagtggcattatgagtaagtacagatgaactggcagtcgcttcaggaaagggacacatggtgagtcctgatgatgggcagggagggaaggaaggtggggtgtcgggccctgcagtggggtgtgggggagctgcagaacttggggcactagtagggtacaccatatcaggccaggaggaaaaaggagaaatcaaagttggggagtggtagggaaggaaaagggtctgtagtgaatggaacgtaactcttccctattggtgattttcctttgaacaaatgttggccaaattattttctgacccagtaccctcctatatcaaagaagtgatgggatggtgggaaataagcagctttcctattgttaaaaaaaaaaaaaataaagactggagacccctctaagccaggggtttaatggagagccctggaaatgaagtctttctgtgggcacctgtcccctcaaggctgcacctgtccttggcagggatctggagaggtggtcagggaggttgcttggagagaggagccctgagcttgtgccttatgtgtgagttaatgtggcttgagtgtccctggtgtccccaagcctggcaaactgctgggttcaatgaacaactttcccttatagtccctcagccctgcctgtcggcctggctgggaacctggtggctgaggcgctgggatcagggggatcctagagtcgttgggaccagagcaagggggaatagtggctagaggccaggccaggacattgtgatttatccacaggccttctgacagtggcccgcccgctgagcgctccccctgccgcggccgggtctgcatctctggtaagaagcacagctaccccagctgctggtaccccttgcccaagcacacggcctcctgccccatctcaacatctattcttacccctctgccccttagacctccggattccactcatgtggaaggacacagaatatttcaagaacaaaggtggtgagttccacacaccctgggacaaattcaggggaatgaccctgaagtaggaggctctcgtgggacgtgttttttgttttgccctttgtccccagacttgcaccgctgggctgtgttcctgctgctgcagctgggggaacacatccaggacacagagatgatcctagtggacaggaccctcacagacatctcctttcagagcaatgtgctcttgtgagtacctcacactgtggctacctccttcctccactctgctccagttctggatgagcgagttccaggggaggaagctgggatgggggcagggtggagaggaggggcacctggccttctctgtggagctgtcctgcacttgcctcacccacatcccctaccctctgcctccctggactttcctgtgaccaccctcctttcttcctcccaccagcgctgaggcggggccagactttgaactgcggttagagctgtatggggcctgtgtggaagaagagggggccctgactggcggccccaagaggcttgccaccaaactcagcagctccctgggccgctcctcagggaggcgtgtccgggcatcgctggacagtgctgggggttcagggagcagtcccatcttgctccccaccccagttgttgggtaaggccttgcacaccgacaccaccctcagctgcctgtattctgcccacaggtgacctttgaactgtgttgagtgtgcagaacccattttgcattgctgccaggatgtgcagacagatatgaatgagcagtggccacgtagctgggaggcattccagcccacgccccagagctgggctgaagccagtccagaagaccagtgggaaggcagggagacttaggccctggggtcttacctttttagcagcagcaaatacattttatttttagagacagggtctcactatgttgcccaggctagtctcgaactcctgggctcaagtgatcctcccgcctcggcctcccaaagtggtaggattacaggcgtgagccacagcactcagcctagcaaatacattttatgtggatagagcagagcttcttggttggagcagagtaccctgggacctatggtggtacctaaatgcacctggagacaccgcatgggaccactgagactctgagaagcagtttgagaacctttgggtagtgaacagaatactgattttggacatagatatgggttcaaattcaaactcccccactttccacctataaattatgggcaagtttcttaacctctctaagcctcaagctgcctcatctagttgaagaatgccaccaacctcacagggctgtcataggaatacagtgggataaaacatataaagcatacgtcctgacacttagctggagctcggtaaatgttcattcctaaccctctggggaggcaagcgagttttctgtggggcagtctgaacaatggggcagatctgctcagcccttagagttcctgctggccaacatgcccctcccttggctgatgctctctcctatctccctcagtggtcctcgttaccacctcttggctcacaccacactcaccctggcagcagtgcaagatggattccgcacacatgacctcacccttgccagtcatggtaagtatgtgtgtgcatgggggacatacacatgtgatggtgagaagaggggctgtgggatggtccccttctcattcccctacctcaccctgcacttcctcctcccccagaggagaaccctgcctggctgcccctttatggtagcgtgtgttgccgtctggcagctcagcctctctgcatgactcagcccactgcaagtggtaccctcagggtgcaggtgagggggccctgaggagtggaagggagcagggagaaggcagaggagagctggataaccaggaatagaagagctaatgaaaaatcaagatttgggtggaagaaatggggtatggccagacgaggggaggaatggacagcagggtggacaaaacgaacaggttctcatggggggctgagaagagggatactgggggccgtgacttccccagaaaatgttgagtcatttgtgcagcaagctggggagatgcagaactgggcacaagtgcatggagttctgaaaggcacaaacctcttctgttaccggcaacctgaggatgcagacactggggaagagccgctgcttactattgctgtcaacaaggtgatgggtcccttggtagtaaggccaccaagggcacaggcccaggagcctctccttcaggccccaggagggtgggcacatacctcagagagatagaagcaggcctcctgctcctgacagtgccacatccagcttcaggggcccgtattttccccaactacagcatcactgtgagaggatcgtcccattcacttgccatcctcagtccctgccaaatctcagagagggttctctcgcctgcaggttcagggcttttcatcctctctccctcttctccctcagattccaatttatatctactttaccacttcccatttctctccaggtccaattgcccttctttgctccctatcccttttatgggctttcctgcctactttttgtcagttctgagggacctctggctggagcatccttgcctacctttgtgtcttccctgccttgctcaatccctttttccctgtctcaagctgctcctcctcccctgactcaggactggctgtctcatccccagcccttttttgccattccttcctactctggtcagtaggaggcaaatgagagggctcagcaaaagccccacaagctcattcttctaaggcaggcgtgatcaaggctgcctgattgtcactgccaacttctgtgaccaaggtagacctcttctttctcctgcaggagactcgagtccgggcaggggagctggaccaggctctaggacggcccttcaccctaagcatcagtaaccagtatggggatgatgaggtgacacacacccttcagacagaaagtcgggaagcactgcagagctggatggaggctctgtggcagcttttctttgacatgagtaagagagaagggggctgggttgaacctttgggaagaactggagtttgtcatttttactaaaggcctctgtttcaagattatgtggaagggaatgtagcaggagaaagggcagcctggctctctcttttaatcagcgctcttcttccaggccaatggaagcagtgctgtgatgaaatcatgaaaattgaaactcctgctccccggaaaccaccccaagcactggcaaagcaggggtccttgtaccatgagatgggtaagtgagaggaatgtgaactccaggaagctaatgggaagtagggttggggacttcaagagaaaccagataatggaaacagagagaaagcacactctgggctacaccagatctctggggacccaagtctcacccaatcttgtgtgttcttttctcctctccaactctttttagaaccacctccaccaaagttcaaaacaaaaccccagtgagccaggatcatttcattaatttctttcctaatttcttcttttctgtttccctttctgcatgtggattcctgtctcttcttctgacccctcacttgcctggcaccgctttcattttctcctcttggtttcttcacccacctctgctccccactcctccccttcccatccccatctaccttgtgccccatgtcccacagtcttatcagagcctgtagccccagggggcccaggtgaggggctgctcctgcaggataacgcaatctccactgagatccaggctttgctttcctcctattacagtgacaggtgatagggctgggtaggcttggggcctgagctctgactagcccaaccctcccccaaccccttcctggtgccacagctattgagccgctggatgacatcgcagcggtgacagacatcctgacccagcgggagggcgcaaggctggagacacccccaccctggctggcaatgtttacagaccagcctgccctgcctaacccctgctcgcctgcctcagtggccccagccccagactggacccaccccctgccctgggggagaccccgaaccttttccctggatgctgtccccccagaccactcccctagggctcgctcggttgcccccctcccacctcagcgatccccacggaccagaggcctctgcagcaaaggccaacctcgcacttggctccagtcaccagtgtgagagagaaaggtgctggcataggatctgcccagaagagaaaatgacccatgcgcagttgggctctggatacggcgctgtctatagcaagttggccagtctggcctcctgttcctctgctggacctggggtaggctgcaggggtgggcagaagcccctcttaaattgtggttgccatggtaccgagggactcattcctggggctcgctgggacctccctaaacccttcctggaagaaaactggaaccaactctgccctacctccctgcactaaccagctttgaggatggcactgaagaacccttggagcaaacatacctcccttgtgactcccacatcaaccattaaagttatttaacagcagccttcacctggctcctgaggacagggtgcctctctctgcctggtct

SEQ ID NO: 479 - DNA, 12758 bp, Homo sapiens
cttgatcctagggcgcccctgacctttgagccggctcgggttccggctctggcgcgtgcacactcgcctcgccgttcgggaccagccagatcgcggcggcctcgcgggcggtttggtcggtgaggtcttggccgcgcgcggcaatgctgaggctgctggcgtccgggtgcgcccggggcccggggcccggcgtgggcgcgcgtcctgccgcagggctctttcatccggggcgccgccagagccgccaggcttccgacgcgccccggaaccagccccccagccccgagttcgtggcccggccggtgggcgtctgctccatgatgcgcctgccggtgcagacctcccccgaggggctggacgctgccttcatcggggtgcccctggatactgggacctccaaccggcctggggcgaggtaaggccggaaggacgggggccgggtacacgtggagggactgcttgctggctgtcgggcatggaaagcaccgagacaggcgcccctgctggccccgggtcgagttggaagctggtggccggctccaaaatgccccttatggtttgagatggttgatttacctggaccctcaataagcaaaccccagggctcaacatgggcgtggcctcccacatcttagtgtcatcattggtcaagaagggattttggccggcccggtggctcatgcctgtaatcccagcactttgggaggctgaggcgggcggatcacgaggtcaggagttcgagaccatcctgaccaacatggtgaaactctgtctctacaaaggtacaaaaaaaagaaaaaaaaagccgggcatggtggcgcgggcctgtaatcccagctactcgggaggctgaggcaggagaatcgcttgaacccgggagacggaggttgcagtgagctgagattgcgccactgcgctccagcctgggcaacagagtgagactccgtctcaaaaaaagaaaaaagaagggattctggagcctgaaccttctctgtgtccccatcctggggccttgctgggatggctgctgtggattcctcccctctcctctccccagcttacagtggcaggtgacattgcatttgagagcagaaactggctgccccttccccaaatctgaagatgtcacctgactcaagaaatgctcaaatgaaggcaattttcctaggatcaagtcggaggaagcaaaattcatcttcctagttattgaacgtcagcaatttctgattcagctcagcaacactatatctgaccgtactgatctgaattatgaaagccagcacttattaaatgtctcctaagtgcaaggtgctttgcatagattacctcatttaatttttactacagtgcaaggtaaatattttacaaattaggaaactgagactcaggtagatcatgaaattcactaatgccatttagtacacttatttagtctcttcgatacatagcctagatcggtgattctcaagtggggcggttttgcactccggggacatttggcagtatctggaggcgttttgggttgttacaccttggaggaagggtgctactggcacctagtgagtacaggccgggatgctgctaagcattccattatgcaatgccgcgacacggaatcatctggccccaaattgctgaggctgagaagccctggcctaagcaaagcctgaaatctctgcagatgatggctgacaggatgattcttccttctgcagattcggacctcgccgcatccgggaagaatcagtgatgcttgggacagtcaatcctagcacgggggccctccccttccagtccctcatggttgcagacctaggcgatgtgaatgtcaatctttacaaccttcaggacagctgccggcgaattcaagaggcctatgagaaaattgtagcagctggctgtattcctctgaccttgggtaatgtcagtctgcaagagccagagtagttccctgcactcagggtttacttatcctgtactcaggggcttgagtacagctacttctcccctgcaagccactgcaaatgtgcagacagtaggaaagagagcattgtaattcatttattttaatccctggggagagaatatttcacgtgtgtgtgtatgtgtgtgtgtgagacagtctcactctgttacccagactggagtgcagtggtgcaatctcggcacattgcaacctccacttcctgggttcaagcaattctcctgcctcagcctcccaagtagctgggattacaggcgcccaccaccatgcctggctaatttttgtatttttggtagagtcggggttttgccatgttggccaggctggtcttgaactcctgacctcaagtgatccgcccaccttggcctcccaaagtgctggggttacaggcatgagccaccgcgcctggccaagatgatgtttctaatgactttatttgcgaggagaactgcaaagagggtgtttttgtcctgctcagggtctacatcaacctatagggcagctttccccttatcctcacccctgacccactctcactttttctcttgttcacaaatacttaaaatgacagggatcttttcctaaatatccaaattcatttttgccaagttagagagcctagcctgcatggcatagtgggaggagtgtggtttcccgatggcatggtttgaagtctcagctgcacttctccctagcaatgttgctgtataccgtgcttgatgcttcacaccctcacctgtaagatgggaatgatcacagtaacacctactcactgcatgatgtgaggggcatataatgaaagtgcacatgaaatgcccagcatcaagcatggcatatcttttttttttttctttttttttgagacagaatttcactcttgttgcccaggctggagtgcaatggcacgatctcggctcactgcaacctccgcctcccgggttcaagcaattctgtctcagcctcctgaatagctgggattataggcgcccgccagcatgcccggctaatttttatatttttagtagagacggggtttcatcatattggtcaggctggtctcgaactcctgacctcaggtgatctgcccacctcggccttccaaagtgttgggattacaggcgtgagccattgcgcccgacctatgcatggcatatctgaagcttcaataaatgttaactgttattattatcagaaagaatactttcctaggtctgtgctgtccagtaaggtagccactagccacatgtggctacttaaattctttttttttttgagacagagttttgctcttgttgtcccgcttggctcacggcaacctccgcctcctgggtccaagtgattctcctgcctcagcctcctgaatagctgggattacaggcgcgtgccaccacgcccagctaatttgttgcatttttagtagaaatagggtttcaacatgttggcaaggctggtctcgaactcctgacctcaggtgatccgccgcctcagcttcccaaaatgctgggattacaggcgtgagccaccacgcccggcctaaattcaaattaattaaaataaaatattcagtttcttaagtcatattagctacatgtatgtcacatgtgtgtcacatgtggatagtggctaccatatgggccagtgcagatagaacattgtcatcatcatagaaggttctattgaacagagctattctaggcattttcctagaatactgtgaaaaggcaattcctagagtagctcttaacttgtctaatttcctcttttatttatttatttttgagacacggtctcactctgtcacccaggctggagtgcagtggtgccgacatggctcgctgcaaccttgccctccctgggctcaggtgatccttccactccagcctcccgagtagctgggtctacaggcgtttgtcaccatgcccagctaatttttgtattttttgcaaagacggggtcttaatgtattacccaggtggaccttgaattcctgggctcaggcgatctgcttgtcttggcctcccaaggtgtgagccactgcgcctggtctatttttatttttattttttagagacgtggtcttgctgtgttgcccaggctggtctcaaacttctaggctcaagctatttatttatttattttattttattttttgagatggagtttcacccttgttgcctaggctggagtgcagtggcgcgatcttggctcaccgcaacctccgcttcctgggttcaagtgattctcctgcctcagcctccagagtagccgggattacaggcatgcgctaccatgcccggctaattttgtattttcagtagagacggggtttctccatgttggtcaggctggtcttgaactcccaacatcaggtgacctgcccgccttggcctcccaaactgctgggattacaggcatgagccaccgtgcccagcaagctattcatttttttgagatagtgtcttactctgtcgcccaggttggagtgcagtggcacgatcacagcttactgcagccttgacctcccaggctcattcagcatcctgccattctataagatcttactgtagctgtggttataactccccccaggctgaaagggtgaaaattgagttaagattattcagctgggcatggtggctcatgcctgtaatcctagcactttgggaggccaaggcgagtggatcacttgaggtcaggagtttgagaccagtctgaccaacatggtgaaactccgtctctactaaaaatacaaaattagccaggtatggtggtacacacctgtaatcccagctactcgggaggctgaggcaggagaatcgcttgaacctgggaggcagaggttgcagtgagccgagattgtgccattgaactccagcctggacaacagagcaaaactacatctcaaaaaaaaaaaaaaaaaaaaaagattattctatgtaatcctccaattcactttccagatgttttcttcttcctctttgcaggtggagatcacacaatcacatatcccatattgcaagcgatggcaaaaaagtaagtctcaaatggcttgggcccagcaagatttcaaaagccagaagctagggaatgagttatttgctgtttggtggcattaggtgactgctgctggctcaggttatgagctgcttctggggatcaaaattaaggttgagctccaggtgtctctgtcagtcagcagctagaagccaagacaatttattattaacagttctggccaccctcccttgccctagatctctcctggtatgtgtgctcagcattttcaacttgcttctgtttttggaagatgagcctctagtgaaatacacaacctcagttaacttcagtttctgttttgcttcaatggccaaaaacaaacactgacaggcacaatggtggaccttgctgagaggcccttgtttcctcctgaaagggcacctttctcaatcaaaagactgatttgccagtagtggaagtctacccaggattggccgactttggctaatttagtttgagaaagagacagaaggacccgggtggagggtggcagctccagaatgtgtctgtggaagcacatgtgggtggcattctggttggaggtgggagggtgcaggtctttgctcaaagctgcatttattcctcacggatttggatcagatgtttattttgggtggctggcaggggttgatggaggttatggagagagctggattaaagcttcctcttcctcggttggagaaagggtgtgtcttggtttagttaagccttcagccaagctcccctgtgccaccacccttgattctcatcctgtctctaagtgaagcaaattctgggtgataggtgtgggtggcagccaaaacatgtctatttcctgcctgacttctgtgagtttattgttcctctgagatgcaaagtgatctcaagaagacaggaaccagttgcaaggcagaaaacggatgccaggtctcccctttttggctgtgaattgtcaccaagttttggtggcccgaagggtggctgtgctagggccccacagggagggttggcctctgagctgccctgttgtcatcaggcatggcccagtggggctgctgcacgtggatgcgcacacggacacgaccgacaaggccctaggagagaagctctaccacggggcgcccttccgccggtgtgtggatgagggtctcctggactgtaagcgtgtggtgcagattggcatccggggctcttccacgaccttggatccctacagatacaaccggagccaggtgacagaccgaatgccccccacccttgcccctcaaaatgtcttcctctccgttgcctcaccagtggcagccagggattgagcgggggctttactaatcaagtctgaagcagggatacaaggctgagtttgcatcatcaggggcataaggagcataggagtgaggaagttggtttatgggccatgggaagtctatcgctgggcgggggagacaagcagaaatcgaccaacccctcggacggtgctggcttagaagaggggaggaggccgggcacagtggctcacacctgtaatcccagcactttgggaggctaaggtgggtggatcacctgaggtcaggagttcgagaccagcctggccaacatggtgaaaccccgtctctcctaaaaatacaaaaattagccaggtgtggcggtgcgcacctgtaatcccagctactcgggagactgaggcaggagaattgcttgaacgtgggaggtggaggttgcagtgagctgagatcgcgccactgcactctagcctaggtgacaaagtgagactccatctcaaaagaaaaaaaaaagaggggaggaagtccggacccaagatgagttgccaccttcttagttctggtcctcgtaccctctaggcagaatggctctcagatagacgtgtatgacaagaccccaatggaacagacccaaatcccttgcttttagagcgtgccaaggccagtcttctggacagagcaattcaaaaggtgctagcgtgagctgctgtttcccactcttgctttagcaaagcttctctctgattccaactccatcagtcagctttgaccctgcttccttaccactcattgtccctcccttcctcacctgtaaaataggatagttccctcttcatggagatggagggtcaagtgtcatgtgcacacagagctgagcatggggctggcaaacaggaaatgccctgtaaatgctgccagacagaaacctcagtccctgtctctgcagggcttccgggtagtcctggctgaagactgctggatgaagtcgctggttcctctgatgggggaagtcaggcagcagatgggaggcaaacccatttatatcagctttgatattgacgctctggatcctgcctatgcgccagggacagggacacctgaaattgctggtctcactcctagtcaggtaaggagattccaccagtgaagatcctgggggtggagacacttaacacccattttcctgggacttgaagcgaatctttaggaatcaggataggatttttgtttgtttgtttgagacggagtctcactctgtcgcccaggctggagtgcagtggtgcgatctcggctcactgcaacctccgcctcccaggttcaagcgattctcctgcctcagcctcctgagtagctgagattacaggcacatgccactacgcccggctaatttttgtatttttagtagagatggggtttcaccatgttggtcaggctggtcttgaactcctgatctcgtgatccactcacctcggcttcccaaagtgctgggattacgggtgtcagccaccgcgcctggctgccaaggtaggattttaagagcagagcacctaggccttttctgttctctgggctgaggataagtttgaataccctcttactgaagggtgattgattttggcaagggccttcatttcctatctgggatataatagtcccttattttgtcctttatttgctcttcctgccttcagttcatctgtcatgaaaacaacagttcataggaacaacattatagtatcctctcttaagaacactaaacttggccgggcacggtggctcacgtctataatcccagcactttgggaggctgaggtgggtggatcacgaggtcaggagatcgagaccatcttggctaacacggtgaaactccgtctctactaaaaatacaaaaaaattagccgggcgcggtggcgggtgcctgtaatctcagctactcaggaggctgaggcaggagaatggcatgaacccgggaggcagagcttgcagtgagccgagatagaaccactgcagtctggcctgggcgaaagagtgaaactccatctcaaaaaaaaaaaaaaaaaaaaaaaaaaagaacactaaacttggccaggtgtcgtggctcacgcctggaatcccagcactctgggaggccgaggcgggtggatcacaaggtcaggagttcgagaccagcctagccaagatggtgaaaccctgtctctactaaaagtacaaaaatcagcccggcacggtggcaggcgtctgtaatcccagctacttgggaggctgaggcaggagaattgcttgaaccctggaggcggaggttgcagtgagctgagatcgtgccactgtactccagcctgggcaacagagcaagactccacctcaaaaaaaaaaccaaccaaccaaccaaacaaaaacactaaacttggccgggcgcagtggctcacacctgtaatcccagcactttgggaggccaaggcatcaggcgggtggttcacctgaggtagggagtttgagaccagcctaacatggagaaaccccatttctactaaaaatacaaaattagccgggcatggtggcgcatgcctgtaatcccagctactcgggaggctgaggcaggggaatcacttgaacctgggaggctgaggttgtggtgagccgagatcatgatattgcactccagtctgggcaacaagagtgaaactccatctcaaaacaaacaaaaacactaaacttatctttttagggttaaatttaaataaaagtgcatacaacgggccaggcgcggtggctcaggcactatcctcagcactttgggaggccagggtggatggatcgtttgagcccaggagtttcagcccagcctgggcaacatagtgagatcccatctttactaaaaataaaaataaaaattagtctggtgtgctagtgtgcacctgtagtcccagctactagggaggctggggcaggaggatcaactgagcctggcaggtcaagccttcagtgagccgtgatcataccactgcactatagcccgggtgacagagaccctgtctcaaaaataaataaataaataaataaataaataaataaataaataaaagtgcatgtgatggcacaattacctgccaaggtaagctcaagagttttagaaacacccaaataaagctccaataatgtgtgctgggagtaaatgcacgggggcagaatggttatgactagaatctccccaagggcaggacctatgtattgttccctaccttgtccttggagcctaggacagtgcctaatacaaatagtaggcactcaaagacatttgagagtaaatgaatgaagactgcttaaacctaatcaagtaccttacatcctctaagatcttaaaggagggtggccataactctctctcttgaaatggctgtaaccatcctctcttctcatgagggatttctgaaacacattcctcatccctctgcttagcaaccttctgggcttttcacctgcaggatgggaaccctttcagacaaggtcactctcttcccatcagtctccctcacttactctgtcttctggccacatcttactacctgaacttttcccatcttggtgcctttgcctgtgtttttccctctgcctggcctatcccttgaactgggtatttccaccttggggaagccttacccacctctccaggctattacctatgctgataccattctgggcttgctttccttgaagcccttggtgcatgacattgaaacgattggtttccttgtctccatcaccacaccatgcagccctgaggagcagggactgtgtacgcattatctgtttctctgggaggcctgccagtgtgcctggcagtcaacaaatgtttatggagggaaagccaattccaagtcaaagggtggcgtgggctgggaaaagctctactgggtgcttttcactgtaaatgattaccactgtggacaactcagtcttgatcttgaataggctctggagatcatcaggggttgtcaaggcctgaacgtgatgggctgtgatcttgtcgaagtttcaccaccgtatgatctttctggtgagtaagcaaagagactgagatccatgggcagccggtagcttaaattacacgaagctagttaataagtagaaaatggggccaggcatggtggcccaagcctgtaatcccagcactttgggaggccaaggtgggcagctcacctgaggtcaggagttcaagaccaatttggccaacatggcgaaaccccatctctctaaagatataaaaattagccaggtgtggtggcacacacctgtaatcccaggtactcaggaggctaaggcaggagaatcgcttagaacctaggaggcggaggttgcagtgagctgagattgcgccactgcactccagcctgggtgacagagcgagactccatctcaaaaaaaaaaaaaaaaagatgagtcccttatatgacttggggaagcagctgagcatgtccaatggtgaagaaaacacacctattactgcacaccttacaaacatgagctcattaaccctaacaaaacccccaggaggtagttaagtatcattagcttgcccaccaatcagcagaagagaaagaaaccagcctgtagtctagtgacagggtggcccaatccccgtctcctttgatgtttcattgcaaagtgaattctaaagcataaataatatatgttaatatttatcaaataggaacttagctggttaagatcttcaaagcagacgccatcccaataattttaatgtagacaaacttatggaattaggcctatcgacctcagaggatagataatacagtacacatcattattataggttctcctttgggaaaaatctgttctcagagtaaacaaagaactttctgaattttaaaatatgattcccaaatgatgcttgatggaggcagagagcctgggcaagcgtgttcacagctggcgggcaccctagaggggtgcacaagacagggctctggaaaaggaggcacaaggggaagagaaagctgaggagtcccaaggcttggctcagcgggtcgtctgcagggtattcatgtgaggttttactttttcttagggaacacagccctgctggcggctaacctgctgtttgagatgctatgtgctctccccaaagtgacaaccgtctgagtcttgtgctcttcaagacaaaacagattgcgtcgctgacaagttctcaagaagaacttatgagtaagcagtctgagaactaaagagtttatgccaagaaaactttctgctgaaagtgtcattgctggctgtgaagtcgggataatcagtagaattctcacccaaacagcaacatttctaaggaacttggattaattgggggaaaaaaaaaggagtacttgtactgctttgattttttttcctttgatgaaagatggaggataaaggggaagtgaggagaatttctttcaagattatctaaacattagaaacatgacatttaaaaaaactatgaaataatactgtataagcattccatatttctatatcttccttttaaacatttttttttttgagatagagttttgcttgtcacccaggctggagtgcaatggcatgatctcggttcattgcaacctccgcctcccgagttcaatcgattctcctgcctcagcctcctgagtacctgggattacaggtgcctgccaccacgcctggctaatttttgtatttttagtagagacagggtttcaccacattggccaggctggtcttgaactcctgacctaaggtgatccgcccgcctcagcctccttaaagtgctgggattacaggcatgagccaccgcacccagccgctttttaaaattttgatgatctgcttcctagagtattgagtatcttcctttaaactacagctcctcctcggacgctgcagtgagctgagatcgcaccactgcactccagcctgggtgccagagcaagactccatctcaaaaaaaaaaaaaaaaaatacagcttctcctatgaggtgcttagggctgcatcttggttttaggaccactgtgaacgtaagtaaaaagtataaagtaacacggagagcctaatgaagaaacttcttgctcagaggcctagaagggtacacaaaatgtcttctaaactagaaaacctaaggctggacacggtggctcatgcctgtaatcccagcactttggggggcggaggtgggcagatcacttgaggtcaggagttcgagaccagcctggccaacatggtgaaaacccatctctactgaaaatacagaagttagctgggcgtggtggcgcgtgcctatagtcccagctactcaggaagctgaggcaggggcattgcttgaacccgggaggtggaggttgcagtgagctgaggtcatgccactacactccagcctgggtgacagagtgagactccgtctccaaaaaaaaaaaaaaaaaaaaaaaa

SEQ ID NO: 480 - DNA, 39196 bp, Homo sapiens
ggagacagctaaggaaagaagctggggcgcatgtttctgcccaaagccgggttttggccgaggtgactacacaccccctttcctggctcccataggctaagtgcctggcttcttgagaagcctgcttcttgagaacaaaaaagtgatttaaagcctcatgggagatgagcaatcctcaagacacaagcagaaaaagtcccagtgatacaggaagcgggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgagtgttcatctgcctgatggtttgagtcccatgttagctgccaggaatcagcgtatcttcgtggatggagagaaggtgcagggctgggtattgtgtttggtcactcttccttagggactggctgtcagtttcaactgcctctttcaaagaggaaggaacattataagttcctgggcccttgggtttccaagactcagccccaccaaccccagtttccaaggaaatgaggggctctaagccaaaggctccagtcacttttctgaccagtcttagggtgacaggccctggtagaagtcttgcttgagtggttggttttacatgggcatcttctggcaaagacccagcctagagagactgagctggatggactgagctctgggagaagatttgccctacatccctgccctgggagggaatctgtgcacatgcaggctgacaaaccaggagcatgggtcaacagaaagcattggctagagtgggaagagagagtagaagtgaaaactccaggcttttggctgagaaccagcagtggccacagtgcggtcatactggtgtgtattttcttggaagagaaggtccaagaaagcaagagggaagaagttgggatttctgaaggctagggctggttacagtatgtgggaaatgcaaattgggaaccctcagagagtagctccagcaggaaggccagacaagagctacctttggatctggactctgttcctgtctttctgtctatcttcttcccaaggcaggctattgctttctgtttagaagtatcagggctatgagaaaaggtatttgagaaagaaaaagccaagcaagaagtggactttggactgcctgtgtgagtggggtgagaatctccttctgcttatttgtttagactgtgggaggtagcctggagtagaagaggtggcattacggacacggggggaaatcctgaggcccagggtgttttaagcttggggttttcaagaccgcaaatccaatatggacttttccaggaaaagcaccgtgatatgccagggatgtgggggtgctgcacaatggatgtgtcttttaccagacagccagacgaacagggcttgctcagcccactttcttttggaatctgcagatccatggctcgtacttcccaaggtctaggggaggaagaactgagctcggggctcagaaaaccaaatcgagccactttaagtggtcacagggaaagccaagcctccgttgttgcaaccaatttgtgactgcaccatttctggagcacctcttggtgactgtaaggtgtgatggagtgatggtgctgaactgtgaactggacttttccatctctgtgcttgctagcctcttggccagcctggcccatagcatcttaggcactgctgaccaatagctcgtcttattgaggctttggaagtcgccggtcagggagaagcaacccagccccacaaggcaagtctatccaatcggaggctgctcacttcattgcatgttttcttctttgaatcttcacaaaagtttttcagtgtttttatttttaaatacacacccttttgtgaagccccaataaaacccagacagaaatgctttgcaaatggggcaggttagtcatgacagatttgcccaagcaagaagcttgattcttgtaaaactggcatccactcccattctcatttctactcagctcaacttctaattcccagtcagaattgtaaaaatcaaaaagtccacatgtcccttccccaagtaaagtgaatttttcatttcccccgatgagatttgttttaatagactttattttttagagcagttttaggttcacagcaaagttgggcagaaagaacagagatttcccatatgccctctgccccatacatacatagcctcccctattatcaatatcccccaccaggatggtacatttgttataattgatgaccttatgtcaatgagttttttttattcctccatgcagttcctctgcacccccttcacacactttgggggaaggtgagggacaagtgcgtgggttctagacttggcctaaccttgcgtgttcagtggcccattctatcccaagatgtcaatctaggcacttctatttctcaaaaatattaatactgtgatgtgatgctgtcactttcactgtctccctcactggactggaaatcagagtatcagggctaattggtttaatccatagatttgactttgaatgatcccattcagcaactattaaggacacatgatgtggcagccactgtgcaagggtgcaaggtgtggggaaaacaaaatgaacaacagccactgcccagcacctgacactgtgtctgtactgagagcctgtccacaaatatttgttgagtgaataatactggtatatactgcatacttgccatataccaggcactgttctaaatgctttatgtgtgtcagtcatttcattttcacaccaaccctataagaaatgtatgtattattggtaccattacaactttataaatgaggaaaggggcacagagtagtttagcaatttctctgcgctcacatagctgcctgactccagaggcctcaatgagtaaaactggacaagcctatgtttgggaagcaggggtggagagaatgccaaaatttgtatccaggtcccatggtaaaaattagaatgtgctatctataattgaaaaatatgagttgaattgaattggaataaattgaagtatagaaatgtccaaaaggtgagagactgataaaaatcacagaagaacgtagagggcatataagaagtatttgacctggaatttggaaaatgaaaactttttttcatcatgcaaatgttcatttaatttttttttgttaactagtttgtttattgattatcacatctataaaacatgtcatgtctatgaaacttcaacagtacacaagagtatttagtgaagactaatttcccttccatacctcatgctggaggcaaccactgtgaccagtttcttgtgtgtctttccaaatgtataggtcttcgtgtttgatagatcagtacggtgactatagttaacaataatctattgtacatatcaaaataactggaagagaataattcaaatgttcttagcataaagaaaagagaaatactcaaggtgatacatatcccaattaacccgatttgatctttacacaacatgtgagtgtatcagacagcacatgtgccctgaaaatatatacatctattatgtatcaattttttaacatggcagagaagaaatcagagataaagagggtggggaaataaaacttctctcgacttttcagtgtcctggtgaagagtactagctctgacattttttcataccataagaattaaatctgtagttatttgcataggtaattgctctgatccaaacgaataataaaatttttcccgagaggagcaaatggttatagcctgaacaaggtccctaggtagagcgcccagggtgccatgaagcctggagtcactatcttcctaagcaggccagcataagcttgtgccatcattatgcagcatgcaagaaggaatgagccccagaacttggagtcaagtcccaggacttgccataaaagccaagacatgtaacggactatctggctcctggagagatttatctacctaccaaagtgttggaataaggagcagacctttaagacggggaggggggatagctgcctcctccctcttttataggtagggaaaataatttgtccttgtttcttacctatggagtgtctgtttactcacatagagcaattgaccttgctcttatcacatcatcctagggggaagtggggggccaaagcatttactatttactgtgagtcatttaataagaaatttaactctaatccagtatatctcatgtgcacatttgggataaagttaataaaaatgaatattaaaaacttagccccaaataaatgggtccgatgggcttgatttttatggaacttgagaaggagcgttctagaaggaggcacaaatgcagaggtaaagggtttcaagtgttcttggcaagttgtctgttgtacctgaaacctagggtttatatttaaggcacttccatgtcctcagctggcaagtggggaaaagggtccccaccactttcttccataatatacctcttagggatactataaaggcaaatcagagtacattctgcttttggagggaggagaacttggactctgtgttgtcatttgctcatttttcattcatcccattctgttttattaattcacttgggcaacaaggatttactgagctcctactatgtcccaggtgggtgttagggatactgtagtgaataaaacagacacagtccctactcttggaagcttataagagtgggggattacaggcattgaaccagagttgaacacgtgatgaatgatatgaaggagtgcgttcattgtccattggaagtctgtgacaggaaaacccaacctaagtcaggagtcaggaaagtcttccctatgaaagagatgtcaaaatggagaccagaaagatggaagttgttagctaggcaaataaagagtggttatagcctctaaggctagggaacgtacatactaatagtctaagatagaaagacccagcagtgccaaataataaaaataggactttgactgatggggatacagtttaaaaagcaaacacagacaagatgtcttttctttctgagcctaaatttaccaaaagaactgtggggtctgtaagttctgttccttctgtacctgaaagaatactgtagcaagatgctaaaagcacatatgaaagtgtcagggctaggcaaaaaaatataatacaataaaacaaaaagagttatcattaggtagaagcccatcttgtgagagggttggctaaatcctactattaataatttttgaccaaactccataggcccatgtgaatcactcatttttcgaagtagaattacccatgaaggaaagtgagttggtgttaacagctacaaatgtttcctcccagactcttttagtaaataagggctggctgaatcacagacacactggaaaacactcatctagcaggatgtttcaggagcagggacgccactcgaggggttttatgaaccactttaaagcccccacttatttttccaccttgtgcttatgtgagggtgatctcaagtaccccctccagaccccaacactcacacactcaggtattgcgtcatcattctttatgtgggttgtggggtataagggtctcttcctgatgaagttttggttccactcctcatgactgagtgtgcataaaaccactcagcctctctcatctacccctcccttttcctcttcctctttctccttctatgttctttcgtttattttatttttttatttttttatttttttggttattccctacctctcttatatccctctttctcctcccccaatcaactccaagttctgaaagcaaccatggcgcaaagagtgtgcaaggttaggtggggaaggagtgcatgggagccattttggggagtggtggcgatgggttatggcctgaaaatgggattttttattctttttttctccctatcaaagttggtctttaaaaatcaacactacgctagcaatttttaatcttgttttgaatctcagatccctttaagagatggcatttatggatgtgctcccagaaaaatatgtatacgctcatctatacaactttttatacaaaagtctggaagttcatacttgcacatatggctttaaattttttctcatttctttatacacagaagtttaggttcaggattcaagaagttactcttttaggtactgtgcctacaagtcaggtatgtagccaccaaaggggtcacattatctagacagtcaggcatccataagtgtggtggaagaaaatccaacatgcttcccagtatattaatgtaaaaacaaccaccaccaccacaataactataatgttcctcatgtcatcaagcagcaggggagagcactctgttttaagcttaatatattcgcaatattttaaaagacaaatgcctaattgcctttctcacttttcctcaacaattaagaatttcaatcactctaggccagattttagcccagatagacttctttttcttcttccccaatcactgaatctctagtctactattagctgagccctttactgagcaacatggggatttcggggtattttggtgacaagaatatttgggccagtgtgtccaattttccaatagctcatcttagccacaagtcagttgtgaaagagtctcttctaggtagctgcattacttaagctgatggttctattttactctctgactttcttatcagctagaacaatctatgctctctttgagtcatgggctccttcttttatgaacactagcttatggttaagttcagatatatatatatgtgtatgtatatatatatgtatgtgtgtgtgtatatatatatatgtgtgtgtgtgtgtgtatatatatatatatatatatatatatatatatatgacaaacctaataacctaaataagaggctttggtcaggtattatggttttcagcattcattcattgaacagatatttattaaatgcctcctatatactaagcacatagcacctgtttgtaggtcttggggtcaaaatagtgaacaaaatgaagttcttcctcttgaggcttttgcattctagtgggagagacaaaaataaaacaaacaaatatacagtataatataatgcagtgataagtgcagaaagaaacacaaagctattttagatagatggtcagaggaggcctcttggaggagaaactgttttgagcagatacctaaaataaagtgaaagaatgagctacccaggtatggaagggaagaaattcttcagagagaggaacagcaaaagcaaaagttctgagacaggaatgttcttggtgggtttaagaaacagccaggagccagtgtggccgtagcacagtgagcaaagaggagggcaggaaatggagttggaacagtgccacggactgggcatgcagggcctttgaagccatatcaataatggactatggttttattctatcggtgctagaaagccacagaaatttaaaagcaggagagagacaaaataggacatggtttttaaagatgattccatctattgtatgaatgcagggagatcagctggaagaagacggcagtacccaggcctgggatgatggtggtggaaatgcaggaggtgaaaagggttcagataccagacatattttgaagtcagagccaggaggatttgctgttaaaatgagtgtggagtatggctgggcacagtggctcatgcctgtaatcccagcactttgggaggccgaggcgggcagatcacttgaggtcaggagttcgaaaccagcctggccaacatggtgaaaccccgtctttactaaaaatacaaaaaattagcagtgcatggtggcaggcacctgtaatcccagctacccaggagactgaggcaggggacttgcttgagcccgggaggcagaggttgcagtgagccgagatcgcaacattgcactccagcctgggcgacagcacaagactccatctcacagaaaaaaaaaaattgagtttggagtatgcgagaaagaaaggaatcaaggatgtttccagtgttttggcctgacaaattggctgaattataatgtttgcagaaggtgttctggaaccaagagtttgtttgctaagtttgaaatgccctttagacctccaagtcctgtcttgtgtaggcagttgggagtgcagtgaaggttttggttgggagatataaccctgtagcatcccagaaatatgtcagactgtgcaattgggtgagaaactggatgagtgtggatgagaatgagaactccgagtactgagatgctccagtatttagaagtccagaagagcagaaggctcctgccaagaaaactgagcagaggcaacctatataggataggagaaaaaccgggagagtatgttgttccctgagccaaatgatgacagcgtttgaaggagggatggatgaactatgtcaagtacccctgagaaagcaagtaagataagaactttgacttggcttagtggagtagacagtgaccttgacaaaggtggttccagcgagcagtggggaagaacacctgtttatagtgggtccaaggaaaaatgggtctggaaatgggaaaagaaactataaacacacattaaagcactttgctgtaaaggaaaacagaaatggagaggtatctggggatggacctgggatcaggggagatagttttaatataaggaaactacaagtttatatgttgtgtattgatggaaataacctagtaaaaaaaaacctgataatgtgagggacagaggcaattgccgaaacaaagccttgaagtaggtgagtgctccgtggaggaagaggctcgacttaagtgggaatgtagaccatccatccaggtaggtaggttgatttagtggtggtaataagtggaagttctctttttgtgttttctattttatacttcagtgaaacaaaaagcaaagtcgtcacatgagagaggagggggaaaggcaggttgtgggtttgaggagagaggaggtgtgaaataatcagcagcaggaaccctcatagtggtttgaaaggctcttggtatttttttttttaaccttgttgttggctcagcttttttggaaaagagaaatacagtaatatctcactgtcgacattattaactatctcagggtgtttggagagagaggattccacagtttgaacactgggcttatcacttcctgactccacattcctcagatttttctgttttcctcatgatctgaaatgcttcctgggctcatgagctcagaatcacttttatttgctctccatccttcatcctgtatattcaatggtggaaaaaaccctggtagaggaattagcagaactgaattctaatcctgactctgccacttactagttagggaagccatttaacttctctgtgctttttagatgcctgaacaataaatctgagttgataaagacccagtactctagttaatctatacaactctatcctaagtaatttgaagatttctattgacagttttgaagtattgagaatatagtggggatcctcaaggcagttcttatagaccacgaaggacttggcaaccccagggatagccaaagaggaagagggagagcctccagtctgtccttcctgatctgctgacacgatgttgtctaaaggccttaataataagggactctcttctcctccctcccacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatggtaataatggcggcttccccagtccacactaaagggccaaggtgctcctttgaccaagaatttaggtctctcttaaaagcaaagggtattcagaattggaagtaactagaatgatcttctagtttgggggtatttaaacctgctgcatggaagacgttttaaaggttgacatttttttttccaaattgcatattgatggtagctgattaagcattagttactcttactcccatttcccaaaggaaaggggcacagctccttgtgggctggagggccgatagacccaaggatcttggtttgcaagtaatattttatttgaaaataggatttttttctgattaaaagaagttgaataccacagatcaaacccagtctctcctacatgaggacagtgaaatctaaccagaagcggttagcacatttacacacatttgtgtaggtgtttcactgcactgggggttctggataaagatggctaaaattcagcccacacaccacttgttaagccctgcattccggcaccagatcatacctacttggtggaagaagtgccttttggcatttaaacaaaggctttggttataaagtcttttagttgctgtacttaaactaggaaccaagtccacctgaatccaaggccagtgcttttttgagcctttttaactaccagtccctcttgagtgcacccagggattgtgtctcttaggcccagagactcatctgaattcccagggatcctgatagccacatggggctttcctgcttcttcaaaatgacttccttatctctggggatgggacaggaattcccacctaaccagcatttctttgaaattctcaaatatctagagggaaggcagcaatactctcaccaatcctccctcaacccagcattccctttccttcaaacagtgcctgcggaattcccatggccctcccccaggtacctgagagtcatttccagcagtggctccaggcacgactgccatgagcgtggaggctgcacatgatgcattttccaaaacggtgtggatgccagacattctgtcctttggttcctatgtttcctgtttttgtcacatcttgtgatcaaattcttactttggaaaatgtggtctctgcaaccatggcatttttctcaagccaaaggaagagtttggattttgaagtcagacagacctaggttcagatcttaacttggccacttagaagctgtgagttgtaagatattccacctccctgggacttggctttctcatctataaaatggggaataattacaactagagttataattgttgagaagattaaaaaagatgatgaggtggctcacgcctgtaatctcagcactttgggaggccgaggcgggcggatcacaaggtcaggagatcgagaccatcctggctatggtggtgaaaccccatctctactaaaaatacaaaaaaaaaaaaaattagctcagcatggtggtgggcacctgtagtcccagctactcgggaggctgaggcaggagaatggcgtgaacccaggaggtggagcttgcagtgagctgagattgtgccactgcactccagcttaggtgacagagcgagactctgtctcaaaaaaaaaaaaaaaaaagatgatgaatgtgaaacaccagcactgtgcttgtcctataatagttgctaaataagcaagaatttaccttttatgtggcctatttcatggccttagagtgggatagattgatgaggcctatggttataattgaggacctatcactatctcagacacacaaaagcacttactacacacccacccactcactcacccatgcgcccgtgtacatgcgcgcgcgcgcacgcacacacatacacacacacaccctcccacacacatcacgatagatgaaatcccaccactaaaaagccattcttttaggtctaggaagtaacaacgtaagccaactaaaaaccatggtggattagttgacagcaaactccactgataggagacaggagaatagcaacttaggtcaaggacatcaggaagggcgagtggagccctaacaatattggtagaagaggcctaaaaagcaaattcttattttctattttatcccaaggtggtcttagataggatgtagtggggcatgatggacagtgtgaagcaatagattccccactagaaataaatcacattgagggggagggaaaatgccattaggctgtactttgttctaacaaaaaggtcaagtgagaattcccaggggttcacttcagtgatggctcccttcctcccactcctgacagagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcaggtgagtacactggtggcagcctgtgtgccaccttaatgagcatgggctcagtcttcacatggtccaattgctccccagccatggcattcaccttagtaacaatactttacattttctttatagtttgcaaaagtttaccatgtgcatttagtgagctcactctcatattgaccagggtggcatttttatgctcagttcacagttgacgaaaccaacaggaggtgatagagacagacccagagcctaagtctccaaggcgtagccttctctgcctcttgccttgactccaacctgcaaggttggctgggtgagggattgcaggtgggagggcctggctcccaagtctatgctccactaatgctggggcagttctacaccgtcaattagtatttactgatcacctacctggtaagaaattgtgaataaatatgatatgtgatctctcctctctaacaattcattgtaaagataagacgtaaaacattgcttaataatgaaacacaggatatagtgaaggtcctcgttttatggaatggactgtgaatcccatagcagggccaggggagtcagaacgagagactaagacctggactgtgaagtttgaggaaaaataataaattgcacagcgcttcatcattagcaaagcactctcaactgtgtaatctcttttgatcctcacaataaccttgccagataggtgttatactttcattttacagatgaggaaattgacgttcataccatttaagtaccctcttcaagtttctttggcatgtagatagtggagttaacccctaaacctacatcttctgactgttcttcctctagaaagaaaagcatcattattctgtcagcaaaaggaagacagaacttactaagtaagcccatttaaccacttggatacaggacagaacacaggcccttttcactaacagatcttgtgtccctgcctcaggcaggttcagggactgtaggaccagggtgttgctctgcaaggcattgcttacaccctgacattctcctctctgcatccactggggggacataggaatcgttccaatgggtcttctgcctacagtagccatggtgtccatgtggagggctttcccaggtggtcatggttgagggacaggggaactcagccaagtaatgcccttccacatagcactgcctgtcacagagactcccctggagtattcccagatggactgctgggaaaatcccacctggcctccagtgtgcccctggaagttcttgaatgagtctaaccccctgcatgtttcctccccagacatttcatagccagagtcccccgtcctctcacttactggatatgtctggctgcttgcccaccttgcatacaaaccacattcagaggctaccccccagttcagagcgctctccccacccacagtcatttagaaggtgctggcaggacaagcaagctgtgcagcatagtgggtagcttacagaatgtgaccccggaagtcctagagccaatgctgccctttctacttacaagggcaagtgcctcaatccctctgagatttagattcttcatctctaaataacagcaactggcgggtcatcatggtttactatgtgccagttatgtggcatctcagttaatcctcacagcaacaaaataatattgatagtatccccacttcacagatgaggaaacaaagctataacatggttaagtaaggtcacacacagagcaagtgatggagctaggctttctgattctggaagcctcataggcattagtgaaagagataaagcacttaaaatgccttataaaccataataaaaatgtaatttttattataaaagctacaaaaatataatgtattttttaattgtaaatgaggaagcagtagcccttacctcagcacagccctctctgggtatagctgccctattagagtacaaaaacagggcactgaatattttaccctggcctaacccaaaaaaggggcagaactttcttcatgctcctcaatgtagtttaaaaagaatttaattagggcataccaaagtgttggtgggccataaagcttatactaagggcactcagctcaggacgttctaagaaaacatgtgaagatggacttacccatctaagccactctgaggaccaagaatgcaccagtgggaaccagatttactgagtaggaagctggttcttgtgaggagtggagggacaggaagcagtagaaacctggcaccacaggaagggccctgtcaggatctcggctcggtttgtaagagaactgtccagccgttcccctctcttgggtctctgtttcatccccagtaaaatgaaaagggcgaacaaatgaagtccctcccagagtagacagtccttgattcagtgtgtgtgtgtgtcaataagaactgccaatagaggcttgccactgtgtatgagtttgctaaggctgctgtaacaaaggaccacacactgagtggcttaaacaatcaaaatgtattggctctcagttctggaggctagaagtctaaagtcaaggtgtcagcaggattgttcttctctgagggctgtcagagaaggatctctcccaggcgcctctccctggcttgtaaatggctgtcttctccttgtctcttcatatcatcttctctctatgtgtatttctgtgtccaaatttcctcttctcataaggacaacagtcatattggattagggcccacctgtctcagtttgctagggctgccataataaagtacaacagattgggtggtttaaataacagaaatttatttttctcctggttctggaggctagaagtttgaggtcaaggtgttggcaggtttggtgtcttctgaggcctctcgccttagcttgcatatggctaccttctcactgtgttctcacctggtctttccttcgtgtactcacaccctgatctctctctctctctctttctctttcctggtgtctctttgtgtgtccagatttcctcttcttataaggacaccagttaggttagattaggggccaccctaatgacctcattttaacttaataacctttaaagaccttgcctccaaatacggtcatattctgaggtccttggggttagagcttcaacatagaaatttgggggaggggagacaaaattcagcccaaaacatctccctaatgacctcagttttactcaattaactctgtgaagacgctatgtccaaataaggaaatcaacatatgaatttgggaaaacacaattcaacatgtaataaaagtagagatgcctcctccccaccctgccagcctgcagggataggggaccagaccttccctgcctcagaaccagatcacacagctggtttgtggcctgccctgcgcagtataccagattgcctaaatactgaaaacagaattgtatcagtaccttgatttgtgtttgcgcatgaataacgaatactaccagttcttaaaacactgcacttagtttgacaaaacatttacactctacattgtgctaggggccagtacacaaagataaaaaagacatgatccttgccttaaggcagaagacagctgtataagtaaacaatgatccgagattagacagtgtgacggatgtaaaatggaaatatatgcaaggcaacaaacaggagggaattattaacactgtctcgggggattagagagagcatcccagagaatgtgacataaactgggttttaaaaataagtagaaattacccaagctgatgaaagacattccaggcagagggaggagcagatacagctgggtcttgctctgtattatcttgtaggtgataggaactaataaagagttttagatagaggagtgacaccatcagtcttgcttttcaaagaggaactccagtagtatagagaacagactggggcagggaagtggggaagaaagagaaaccagttcctgggggccattattgcagtcatccatcaaaatgatgggacccgagccaaagcagcaactgtcagttaacaaagacatttttcctagggcatacaaaggaaaaccccagccttgggatgaaagggtggggtccgagggtttattagaggttgctttgccatctgtcatcaggacagtgattttaagacatttttcattttcattaatgaaaacctcacagcggttaatggtgtgatgagacggaatgcaatgtgatgtgagcactgaatcttgacaggactcacttaagcgaaactgtgcaaaaacttatatgttccttgaaatctttttctttaggtgacatttgttcaggtcatgtattcatccttgttccaattgccatttcagtgtgttaatgtctatcataatgaagcatctttattgcaaagtccaattcttagggtgctatgaagtactctggctaggtcatgtgaagccagtggatgtgggtcagctgtggacagtgtgtgacttgctgccatcctcgatgactgtattctgaaatagatatggctgtgctagaatgaaggaatctagaaaggaatgcccctggaagctcatcttgaagagaggatctttttcagcagatcagcaaaccgctggctcagcacctctgagttagctcagtgaaagaaaaggctgacgcctgccagtgagctccggaggcttcccctttctaacaaggtcatttcttcaaatagggagttcccattgtttcagagtcacttagatgttccaggcactaagacaggtctctctctagggtcttcccaatttagcgagcgtaaaaacaatggtggaaaggaaaaacctggaaactttgcacagcccagagcctggtcatgggccacacccgctataagggaagctgagacacatagctcctagctgagcagctacatgcccagaaaagactcgtattaccacgaaagcatgagcgcaatctcactggagctagtagcctctgcaatgctgggtgggataggcaggttgtaagtgatttttctggaagctgtgaactccgtaaaaatgtttacttggatggtcccagaacttaaattagtatatggttcatgaggatccttccccacccccagttctgaatggaaactgccacgaacaagaatgtatctcttgaagatggcagcctttgctgacagaaccacatgaaaggcaggaaggagatccggcacgctcccaccgttacgctaacgtcgcagtatctcctaggtgaactgcatttgtttctcagattctttttagttttctttttcatcttccctaaaaaaaatattaataataagattttgggacttgagaagagagagagagagagagacacgcttctgtgtttctgtgacaacactttcagagacaagaaaaaaaacgccctctggctttttccttggatgtgtgactgtctgccaagttatcacgtttaaaccacagacaataggtggagagggcccagggtggagactcgagcaaagcactcttcccaaatggcatgtgagttattgaccagcctgctcggccgcctctaagagcctcgggagtagggggagttccaaacctctggttcagaaatgttcaggtagcatttctttgtgaatgaaggagtcaggagcttctagaccccaagacaactttgatttctcagcatcaccatccagagaggcctcactacatgactgagcaaagagaagaagagctggagcttctgccacaggaaatggtggtttgaaaatgggagcacaggtgaagcgccgatggcacagacacacacttgcctcctggctccatcttgttattgtaaagtataagccaagtgggtcacttctccttccctttgattcctgccttgggccattcagcaggtgaccctgcattccttctggtaatttttaaacagaaagctacgtgacagtctttttctagatccatttttgtggactctcatttaatttaacttagttcatcgagtgcatattgagtgccctcctgccctatattgtttccggtggaatggaggatacaaataaagaataaggtacagggcctaccttcatggaatttgcaatcaaagtgggacttctacatcttactagctagaaaaatataatatttaaagaaacatattataatcaaggaactgctactagaattcctctttgaaaaggaattgtatttgtttatgatagtaccttaataaatgctagaaggcaggtggagaccccccaggaatctgggtgtgggttggatggttctgtatgagaatggaggaagatgatacttgtgcagaaatgggaagagaaagagagagtctgaacctgctaggtggtgaaagctgcctggttcacaatggaatttgctccctgggacccttcaatcttcagcagagaacttaaacccacaaaattattggtgtaagtttttaaaaaaaagtttttttggtttgtttgtggaaactgattgtattagtccgctctcatcctgccaataaagacatacctgagactgggtgatttataaaggaaagaggtttaattggctcatagttccacatggctggagaggcctcacaatcatggttgaaggcgaatgaggagcaaaatcatgtcttacgtggcagcaggcaagagagtttgtgcaggggagctcccatttataaaaccatcagatcttgtgagacttattcactcccatgagaacaacatgggggaaaccaccccatgattcaattatctccacctggccccacccttgacacatggggattattacaattcaaggtgagatttgggtgggggcgtggccaaaccatatcactgatgaagtgactaaaccttgcacccaaggaagcacagagtagagcaagcagagttataggagcaaagacttagagaaccatgaggaaattactcccagaaattacagaaatcatgtgcagcttgacctgaacaaactgtaatagtagcacttttttcatacttatccaaatttctaagagcatggggtctctgacatttgatttccatgtaaatataattaaagaatagcaacaaatggatgagcaccaagtataaaaatacttgggcctactatacaggtagggaaactaagccataagtaaagaacagatgggactgaagcatctctggacactggtgaagagactcctttggacttaagatcaaactcattttcttgtctttccaatcaatcaacaagaatttactgagactctattatgtactgagtactaagagagctgttaaagtagtgtaagagatggtctctggcctcctagaacctagcaactatttggagaattgaggctagcagaagtaattgacacttactgaccacatgatggattccagatattgctctaggcactttccatacattactatatgggtttctcagaacaacactgtgaacttattgttatgctcattttacagatgaggaagttgaagccacagagggtatgagtagcttatctgtagtcacagagctatcaagtggtagacccagaatttgaacttatctatctggctccaaataccatcactgaaaatggtctgcatggtaaagatgatgttgccaaaactcaggttctaagatacatgacataaaccacaggtgctgcaggagtccaagggacagggaagaacaagagctgggatggtcaggaaaggtgacacaaagaaaggaagattggcctgggcatcaaggctaggcaggcatggtggacagcttagggtgcagcaggaaggagagtatggagtggagcctggggccaggaatgagcatgtgttggatggaggatgatgaaggatgggttggctgctcagagggcttttgactcaaaaggtttgagtcaaaagggctttgacatcactactgccttctttatggggaccgcatctccagaggctaaagcacaaaccacaaaatctgcagttcccatcttatccagctctgccactgactttttctatgactctggatactcctgtctgtgtctcagtgtcctcaaaataaaattagtgggttgggtgaaataagcactatactatagttcccttaaggttaaaaaggtctatgattcatatttgtatccaaagatgaggaaaaaaattagagtttatgaaatatctttcaggaccatggccaacttgtctctcagatctagatggactggcagaagcttgtcataggacaaaggtagcagattgctttcatcctctagagaccctagaaaagatagagagggccggcgttgtcatgtcctgaagccttggtgctgcacccagtcatcgttagtttctgtgagttggtgggcagcagagcaaccggcgtcgggcgcgagggagaggaggctgactcaccaggcattactggtgcagttttgtcttttattttccagttcagaggtactactttgtctgttggttttatttttttaatctcaagtgaaattggaaagaaatattatcttttaaaatgatataaatggtgggggtgtttcttctcaaatcagttgttgtattggaagttcccaaagtatctatgatagaagaagaaagaggaactagtcaaaatagtaagtgctactataatggtttgctggatcagttccataggctgacgaaacacaaagttcaggctactggctttgcttcttatcctagtattagagtgatttctccagtggttcctagtgtcgatatcataaaccttgaatgaatcaatctgtctcaaacacacacatacacacatacacacacacacacacacacacacacacactcctgcacagagggttctcagtgaccataagtcactcagagtggagctgctccttcctccagcatcagcaatgattcaaaatgtcatgctttatacaaattcagaactctctgcctgcctcctaacttttttttttaatcagagcataagactgttgaagttggtatctggcaaaattaaaacatttaatttaggggatagaacctataaccaaggtgtttgcaaagtcagttcagtgagattccttgggctaacttgatgtgtgaaaggcctaaggagaaaaagaatcttttcaaatccagaaggcaacttcttgccagctatcaggctggaggcccctttggatcttgtaggctgcattttatgaattcattgagactgtctgtatctttggtcaactctgtaaacatctgattgtgtccaccatgattctttcctttggaacccgactatttttctttcaatttctgccccacaaattcctcacaggttcaacaacaagcaggcttattccacaatcatccttataagtttcccttacacattaatgttaacatctggtgttactctatttagaaccttagtgcgaatattctacttagaaccctagggcttcagctcggtccccactgttcattaccccggtataactttttccaagcccataagtctctctaactctccaagaagtctgtctttagtattcagccacatttctactactaaaccaagctctagttcttgaggttctccaggctgttttccttctccataaaatgagaataatgagtgtacctaccttgtaagattattgtgaggattaaatatgttagtacacatgatgcactaaaaatatgtggcccattgcaagtgctcaataattgttcattataatcttattgagctacatgtcttgtttactgggggtgataattctcattcactgtttgtcaaagtgttgctcctagttcaaaaggatttgataaagtgggtaaaggagagaaaacaataaaagttttctctctgattttgagccttgatgattagttctcgggctaattttaaacatgaagatgatttagaggaaagactaaatactttcctttcagttcaggtctgctgggttcaacccagttatttgcatgaaaggacaacaatagcactattatgtttatttttaaaaaagataagtagatctttcttcctcccagtgtctcatgagaatagcgtgaattcacagggacggcacatggaaccattatattctctttacccaaaatggatacaggacacattagcaatcttaagatggagaaactgggcagagagattgacttaggagagatgaagataatttaatgttagacatgtggtagttgagttaaaaataaagcatttggatagaaaaatcttcatgaaattaagaatgtgaaagtatagtgagagaaattagaataagaaaacagatacaaaaattttcagtggtctaaagctgacctctaaaaccatgaaaacaaacgtctcccttgggagagaatgcagaaatagaacatgaggctccattatcccactttcatgtaagatgtttttaagctcagaatacttttgagattgctctttgacttctttttttttccagaaacaaaaccatgggcagtgtatgctgggctgttagggggtgtcatcatgattctcatcatggtggtaatactacagttgagaagaagaggtaggtgtctggcaataaatagattcttatcacactctctgtggtaagcaggggacctctctccacaggctcggacttgctctcacaactctggctttctgcatggggccacctttgcaaaaatagtagataaacatatcctgggaccttgcttaattcagtctaattcaacatgtcttgatcccctctactaggctgtggaaagaaatagaagagccacaggtttctaatgtgagagacattattcagataatttcagtttagtgtgactagcactgccatcagggtaaacacaggatgctgaagaagtgaacaagaggtttaagagtattcactgggaacagaattcagaaaattattggatctcatccaaaaagtcaccagggttagaatgaaaccaataaggcacaattattcccctgcagttgaagtgcctagaggtaccatcccctgtcctctcttccaaatttccctatgatacaatatctcagggcattgtgctcccctcagccaccttgactactaccaaccaatactggagtcaaaatgtcctgacccaagaccaggagagatgccccggctgccttcccatggtaaggatagaacttgatcctcataacactgagctgatgactgatttcattctcaagtagatcagtgtcatctacacacaaccttcttagaaaagcccttacctcagcactctgatgttggttttgcatatataaaaaaatctagatcatagcacagcgacctacttgtgtctcatttcctccatctaagagttagccaggtaggagggatgggtgattcagatagaaattaggttgacagcctatggggctcggggtagggcaatcacatttagctcatactataaggaaatagtgagatgacccaggatgagaaaactgaacttaacttatccacattaacctacctagtaaaattgctgggatcctacgccatactctttcctcaaccacacttggcttatcacatggttgtgctctaagggaatagtgctccccatcccacaattccccactaccttccccaacacacatacccatcctcacctcaaccccattcaccatttgtcccttgtaagttagcaacacacaaaactgcctcaaacttgcggtaaaatttatatttagttgctgcacctttcataaaaccttgctaaagaaattatattggcagcttctaatgctataatcatcagaatgcagcctgacgctgaaggcttttcaatttcatgactctttggcaatttcatgtccaggagaatacactgataaagaatgtgggtataggcattagacaaacttacattcagatgcagattttgctactgacaagctgtgtgatcaaatgacttaacttctcgtctgcaaaacaggggtaatactatgtacttcatggtattgtggtggagattggtatcaatacacagaaaacactgaacacagtggttcccatcgatgggtgatagatagatagatacatagacagatagatacatagacagatagacagatctcttagtgtagatgaattaaaatggcaatgtgtaagtgctatggccaggagaagctgcactggaagcatctggaaacaatacctagaacagattgaaaatattttaagtcatggtaacataagactttatgcttcaggtaaaagctgaaaaggatattagatactctatgccctcattttacagttatggtaagagaaaagacccattgagatgacgtgatttgtccaatgccacacagctaatgatggctacaatgtagatgtcctaattttaaggccaagactttttccttagagcctaagaccttgctgacttggagccgagttaagcttactcctaaaaacctgttcttgcactggggaaaataacctgagactaaattatcttggtccaatggtccttttaagcagcaacaatcaacctcacctcttccatctgtctgaccatttaggactgtccttccagttctacatttgactctgagctgacctgcaagactgaaagtctttgaggactgtagtctgttctctactctatttgtagccactacagcacctaggagagtgctgggcaggcatgtcttactttgcaaacactcgtggggactaacttgaacctcctctgctacctccaactgcttcttgagtcctcccctccattttacacacacacacacacacacacacacacacacgcactcacgcacactcctcagtcaggatcaactctgaccaaaaaagcgaagttgaaaccactaggcacaccgtgctcatacccacacacaaaaaatcccatgttgactttccttgaattcctggaacttcatcagtgtctgccccacatttcctccccaagactcacaccctcacgcagcacattccaccatgctcaccacatacacactgggcctttcccttccaaagaaaaatgtgcctctcctaaaaatgctatttcctcagagatgtgcctttttttttttttttttttttttgagatagattcttgctctgtcactcaggctggagtgcaatggcatgatctcggctcactgcaacctctgtctcctgggctcaagcagttcttctgtctcagcctcctgagtagctgaaattataagcgcgtgccaccatgcctggctaatttttgtatttttagtagagacagggtttccccatgttggccaggctggtctcaaactcctgacctcgtgatctgcccacctcagcctcccatagtgctgtgattataggcgtgagccactgcacccagcccagttttttaagagaataaattaactggtgttaaaataagtctaccttaaaggctgtgattttctgggtccagcctccattgcctctgcctggactttgcaataatcccataataaacctccatccttcagtctgccactttcccaccatccttactgctgcatgatgtatacaaaggatactgtgcaactttagaaagaatgagataggtctactgtgctaacatgaaaaatgtcctcaatacattttaagtgaaaagatcaagttacagagaagtgtgtgcagaatgacacctcttgtgtggaaaaaagtctatataagtatagcaaatatccaaaactgcattgtctaatatggtagtcactagccacatgtggctttttaaatttaaattaatttgaattaaataaaatttaaaattcagtgacattagtcacagttcaggtgctccatagccccgtgtctgtaagctgtattagacactgcagatatggaacatttccatcatctcagaaagttctgttgcacagagctgatctacagggatatacatcaaacttttaaaaatggtttcttcttttttttcccacttcttttcacaggtattgaaaaatacggtttcttttgggaatgaaattgggttggttaatggaagaaggggatttatactttttactttatactttatatatttcttcacaatttttattttatgatgagaataaattactcctataatttaaaaagaaagctttttaaaattggctaaaaattaaaatattctgcaacttattaatttccagagaccctaggccctgagcaaaatttccagatggtgggcaacagaatgacattgttgctttattttctaaatagtcccaggtggaacatccctcttacacgtccccccgcccttacctcccacacatcaattcccccagaaatagggaggtgagaaagctgtgagtgaagcaacatactaccagctggaaaatacaaaagaggtataaacaactagccctgccctcaaagaacttagaatcctattaggagaccagatatgcacattgagcaacagagattaaagtaattgaatggtacaccaatgagaaaaacacctaatgcgtattgggcatttgttatgcaccaggcagtgttctaaacactttacaagtggtatctcatttaattatcacaacagccccgtgaggcaggtatttcaaatcccatttcacagataggcctagagtgatcaagtaactaacctaagacaatatgacaaatgtgcaggggggctgggactcagggctttgtttccattgtgcccttggggaaagtgggtatgcaaaggacagtaaagaccaggtctgagtaaggagctcctgctggggaccagagggagataaccattatggtttcttttcaccaggtaaaacgaaccattaccagacaacagtggaaaaaaaaagccttacgatctatgcccaagtccagaaaccaggtgtaagttctatattttgtttgagatgaacctgtcatgtttcctagagtattcctggccagtctaccttgcctgttggacattcacagttttccatccagagcagaggaaggtagggaacaggagtcaagaacaagagttctcctaaagtcactaaacgtcagtgtttgaaataatgggcaacactggataattttctggtcatgagtcttcacaggaaaaaaatgaagaagctggaaatacatactgtatgactctttccagctctggcattgtaggagtctaggttccatgttagtcaattatttccttttctagggaaaagagtgcaggcttgaggagagaggaggtttggaaaagctattgtgtgacatgttggactgatccaagtttaggatttactaagtgcaaaagtgacaaggaaggtaggatcttcaaaattctagctagagtgtggttaaagagatgaaagatgagatggaagaaagaaaactgtgacagagtgatcactggactaagaagtgaaggatggaaaaactggatgcatggtgaagttgagaagcagatatgcttgaaggaagggatagagacgctaaaaggatcgtggttagatgtagagacactgtagtttttcaacatgaaggcaattcttggtattgtataggccagaatctggacatttggggtgtaggtagaggcaaattcttgagtaaaggatgtgaaggtaaagatggttttgatagtaccttagaaaattgcatgaaaagacagcaaatgcacttctgagaaccaggagatggactcttgaacaaagttcttatttctgctgtcccctagtggcctggagggcttattacacaacccagctccatccttcccccaactaaactccatttaaatagatgagaatcccaagagtaaccctttcaccccacgctctcatctgcctgtttaggtaaccaggttcaccttgaccatagtgtcttccctcactactctatcctatgctgctagcatccctcttttttactgtgaagcatgacatatggtagtcactagccacatgtagctttttaaatttaaattaatttgaattaaataaaatttaaaattcagtggcattcatcagttcaggactgtcctcccagttctacatttgagtctgagctgacctgcaagactgaaagtctttgaggactggagtctgttctctactctatttgtagccactatacacctaggagagtgctgggcaggcatgtcttactttgcaaacactcgaggggactaacttccacctcctctgctacttccagctgcttctaatcacacttttagtcctctcctccattttacacacacacacacacacactcactctcacatacacacactcatgcatacccactcctcagtaaggatcaactctgaccaaaaaaatacacaacacattaatgtcagctcagtgagttacccttaaacacatatctcgatatttggtaaagcaagtcttcctaatttgtttttctgcaaaagtttttggctattcttgttcctttatactttcatatgtattttagaatcaacttatcaagtaccacaaaaagaaaaaaaaatattagaattgtattgagtctacagatctatatgaggagaaattacatttttcagtgttgcgtgttttttgttttttgttttttgttttttgacagagtcttgctttatcgcccaggctggagtgcagtggtgtgatctgggctcactacaacctccgcctcctgggttcaagtgattctcctgcctcagccttccaagtagctgagattacaggcacctgccaccacacccagctaatttttgtatctttagtagagatggggtttcaccatgttggccaggctggtctcaaactactaacctcaagtgatctgcccacctcagcctcccaaagtgctgggattacagatgtgagccactgtgcctggcctcagtattgagtcttctaataccataaaactaccactcagatcaaagactagaacattgcccgtacttcctgaaggcctcctgtgccacttcccaatcattacttcctctctcctccccaaagataaccactatcctgacttctagaaaaataggttagctttttccttttttatttttgaactttataaaaattgaattctttattcttttttctctcatgtctgatttattttgctcagtattatctttatgagattcatatatgtctttgaatttagatataatgcattctttttcattgcttcatagaatataaacgtatgaatatactagagtttatttatccagttgactattgatggacatgtgggttatttccagtttgaggctattatgaaagttgcagctgtgaacattcatatgcaagtcgttaagtggacatgtgcacatatttttttgggtatatacctagatatacctggaagtagaactgctgaatcgtagagtatgcatacctccaaattgactagataaggccgagctgtttttcaaagtgggcgtatccatttacttttctatcagctacatatgagagtctcaattgctatgccttttttttttaaatttttttttgagacagagtttcactctgttgcctaggctggggtgcagtggcgtgatcttgtcttactgcaacctccgcctcctgggttcaagccattctcctgtctcggcctcccaagcagctgggattacaggtacgcaccaccacacctggctcattgttgtatttttagtagagacagtatttcaccatgttggccagggtggtctcgaactcctgatctcaggagatctgcccgcctcagcatcccaaagtgctgggattacaggcatgagccaccactcctggcctcaattgctatgcattctaatgaaaacttggtattaacagtctaattttagtcctactgttggatgtgtcttattatgcttttattccacatctctgtaattattaaggaagttgaacaacttttcatatgtttattggccatattaaaattctttcttaaagtgcccatttaatctcttgcccatttccctttgaggtttagtctttcttttatggactagtatatgcttttcatatattttggatatgtgccctttggcagatatgttagcaaataccttcacccatctgtagcttgcctttggaatttctcagagatacctactgataaagagaaggtcttaattttgttgtagaccaatttagtctagtcctttttaagcattactggattttatttgctaatattttgttaagagtttggttttccacttatgtttctgagtgaaattggcctgtaattctcttgtataatgcctttttttttttaagaaggcactgcagtggctggtatatagcattcttgtgaatatatctaactgggatacaagttgaggtagaaatatttcaaatgtccttaaaaaaataagtaacagagttcttcctggactcttctttaatcacaagcctcagattgatcccaaaatgacacacagctactctacctaatacccacatcacggtaaagttggtcgctctcctgttaaaaattcagactttaagaactggaagggacctgggtagtcatgcccaaccagtggggttttgatataaagatttatgctaattcacataaggagttggggtatatgttagtttcctagggatgccttaacaaattactggaaacttggtggcttaaaacaacagaaatttattctctaacagttctggaggtcagaagtccaaaatcaaggaggcacatcctcagggccacactccatctggaggctttaggagaaaatcctctttgcctcttccagcatctggtggctccaggctctccgtggcatttgttggcttgtagttgtgtatctgcaatttttgccttcatcttcacatgacctccctctctgtgtcttcttcttttccatctcttataaggacagtcatcatcagacttcggacttattctaatccaggatgaccttattttgaaatccttatcttgacatctgtgaagacctttattcaaataaagtcacattttgacattctgcctggacatatcttttggggccacagttcaacccaccacagggtgcatttcctttttgttattctctgcgatatttgggtaggatgtcttatttctccccttaaatatttgctagtagagcaaattgctagtaaagctatctgagactggggtttctttggtggaaatttttttaagttatatttttattattaaattttctcctctacatattagtgaacaacttttttcagtctttttagtggctaccctagaaattataaaatacaactttgacttaccaaagtctaaggtttacttccctcctgcataatacttcaagtccacaataatttcacctcttgatttaagtgaccgttttgtcattatttgaatttcatatatattttaaacacacaagacataattattattgttttatatatataaatatatacttagacttacccacattttcacaattttctttgttcatatttgcgatgtctttattatatcaatataaagactgtaataatgtagacaattatttaaaaactaacaatgcctttattcttatttttaatggctataaaataatcttataaagaatataataacatgaaaatcactaaacaagtgtttactgtgtgctaggaactcttctaggacttatcagagctagtatcttgcagaattaattccagcggccaccattcacaaaaattatgtgaaaataatgcctctggagttgcttgtaaatgatgctccctaaagatgtacaaatcagtggtcctaacagaagataataagatacaaaaatatactaacttattatatttatgtttaaaataattccctatgcctggataaaaatcctgaagtgaacatttaagcacacacagagtcttaataggactatgggtgacttcttttacatatttttctcctttctaaaacttctgaattaatgttaaaaatgtaagttatttgcctccttctgcctctaggtcaggttatgctaaagttctcccaaacaggaagaccagcagaggttgcatctgttgataaaggtctctcttcttttttttttttttttggtgatgcggagtctcactctgtcgccaggctagagtgctgtggcgccatctcagctcactgcaacctccagctccctggttcaagggattctcctgcctccgcctcctgagtagctgggattacgggcatgcaccatcattcctggctaatttttgtatttttagtagagatggggtttcactatgttggccaggatggtctcgatctcctgacctcgtgatccacccacctcagcctcccaaagtgctgggattacaggcgtgagccaccacgcccggccaaaggtctcttaataaactgttttgatagcctctttatctcatcactgcaagaaattctttcttaaactcaaaatttcttcaaaatgtatttaagaattgtatgggatcttgaaagccatctatctgaaccacccaattactgcttgaattatctgctacaacattacttccaaagtgttgcctagctcctttttactgaaatatagtttgtgaacaagcagcatcagcatcacctgggactttattagaaatgcagaatcaggccctgctccagatcttccgaaatagaatcaaccctttaacaagatccccaagtaattcatatgcataataaaagtcagcagcactggtctagaccatgcccaagcacttataactataggagctcattgcctgccaaggcaattcatcccacatttgaacatcttttaccattagaaagatcttcattatattgaatcaaaatattttccccaaatcctaatcttggtttaaacctgagatactttataggcaaattgaattccttttctatatggcaattcatcaaatatatgaagagaaaaattatgtcccatccctttttcctccaataaactttcctaattccttaacccttccatcacatgacaaaattccaagttttctcgcattaaaacacatgtggtgtggcttcaagtctggctctatacccagggagagtggacagcagcattatcccataaccagtgtccccaaaatgtgttgaattaatgacttccctattgtaagtgatggcatccgcatcttacaaggatgtggtctcaatttattttgaggtctttgtccaggaattgtggattttaattcgttcaaagtaacatcaacaaatatcagctgaagagtttatttttatgtgtccaatactgttctgtggggagtacaaaaatatatggcttatttctcaaggaatgtatagactggagaaacaacacataaatatatcagaatgttttaaatatagcatagagtgccataaagtgtaaattagactttaaatacctgaggaatttaagtaagggataggtcattataagttgagtgaccaaaaaagaatagtgatagaaaggacatgcaccttaagttaaaagagcttaaggcaggggactcccggctttgacacttcttgcttgtacacattaggaaaacatttggtctttctgagctgtagcttcatcatcggtgaagtgtgagtaacaacagtatttaacacagagtggttgtgaggcaaatgagaagacatatgtgaggaggaggaagagtaggaatggcagtgtgggatgcaagaattctgcatgtagccggtgatatgagtgagacggactaaattctgttgctattctgtcccctccagctgcccctgtaagagccacaccaatttcagtttcttgtgaggaagacatttaaaacatttgagaagcactgacaatggatgaggctgccttgggaggttgtgcaccccaagacgccacttggggagtccaagcaaagcctggggaattgagttccagagaatttgggggagaattcccacctgagaaggaggttggaccaaatgactggaaggaactttctgcctcaagtcttcttgagtctgtgcttctctatcggagagttgggtgagaactagctctctctgttcagctaatctgctttctttgcttctcttgtagcctcttcagaagaaacttgactccttcccagctcaggacccttgcaccaccatatatgttgctgccacagagcctgtcccagagtctgtccaggtgaggcatctctctgcctactctccgtagagagggaatacatgaaggaggggaaaatgaggaagttttttttttttaaggtgggaagagggagaggatcagggaaaatagctattgggcactaggcttcatacctaggtgacaaaatactgtgtataacaaatcctcatgacacaagtttacctatgtaacaaaccagcacatgtacgcctgaacttaaaataaaagtaaaaaaaaaaaaattaaaacaaaaacaaattaaatgaaacagattgatgagtcctggactggggaagggaggccacagcatgcaggcaaaaaggagtctctgtggctttggttttccagtttccatgaagcccccaatacctgctcacacggggccactgctaaccccctgctggccagtgtttccctgagagttgtccaaggaccacatcagaatcagccagcgtacttgttaaaaataaagattcctagggacttccacctaggattctgttaaatgaaaatgtctatggagagtagccatagacctacgtatttaaaaaacccacaccccaggtaattctgatacacactcaagtttaagaacagcagctggagtccaggagttctcaactccagctacaaaacagaatcaccagggaagcattgtaaaaatgctcatgcctagactctgtgcagccccatttaatcagaatatttaggggtggagatctgcataggtgttaagcctagaagagaatatggggtgcagctcaaaatgatacttgcatattctaccctattgcaagatcagcagggactaagtttacttcggacaggaatctttcctttactgaatgaatagaaataaattctgggctgaaatctttgctccatttgggctctttcagaagagagcccaggatgatagaggcacaaaggtcacacaaatgcctgcatccaccttatttttcaaagctcctaccgcacacacactcatccagaaatgcctgggcaggtgccctatatttcaagatgaaaccaatcttcaacttgaggtccattctcacttcactgtcatatctaagaaggaagtaaaaatataaacctgacttcaaagcttcaaaaaaatacatagatttttaatgaagtttacttaaggacaaaaacagtatgctatagttaacattttatggcaaaacccttaaattctattttctttgtttctttgacatgagagatctttgcgcataaccctcttctccccttcctctctcctgccaataccacttttctcttctccctttgagtcccactagactttttaaaaactcaataatttacaactctcttggcttcccagattgtgacccatatgtaacagcaaaacaaatggttttccttacaaggggatggaaggggagagggcaaagagggagacagggcactgagtgctggtcctcagatcatgctccccataatagcatgcttatgcttggaagggagctgtggcccttgttgcaggtggagaagcagtgtgggaacccaagtgctgtcccagcaaggccctgtctgtgacagaccctgcacaagccatgatctctaagaccctttccttttcctcagcagtgctgttttcatttgcattctgtgaagtgagtatccagtccctctactcacagacttctgctttgtccccaggaaacaaattccatcacagtctatgctagtgtgacacttccagagagctgacaccagagaccaacaaagggactttctgaaggaaaatggaaaaaccaaaatgaacactgaacttggccacaggccccaagtttcctctggcagacatgctgcacgtctgtacccttctcagatcaactccctggtgatgtttcttccacatacatctgtgaaatgaacaaggaagtgaggcttcccaagaatttagcttgctgtgcagtggctgcaggcgcagaacagagcgttacttgataacagcgttccatctttgtgttgtagcagatgaaatggacagtaatgtgagttcagactttgggcatcttgctcttggctggaactggataataaaaatcagactgaaagccaggacatctgagtacctatctcacacactggaccaccagtcacaaagtctggaaaagtttacattttggctatctttactttgttctgggagctgatcatgataacctgcagacctgatcaagcctctgtgcctcagtttctctctcaggataaagagtgaatagaggctgaagggtgaatttcttattatacataaaacactctgatattattgtataaaggaagctaagaatattattttatttgcaaaacccagaagctaaaaagtcaataaacagaaagaatgattttgagatctctgagttttgaacagtggactggaaaccatgtaagagccttaaaagtacagttctgtgcaaatggcattcagttttaaagaaaaacgtagcaaatgtttgatggtgctgttacaaaggagcttggaatactcagaggaacttgtcccatggtgatttttcacttctcaaaatgatgtttaaatcccagttctctgttgattcccttgaacaacaaacctggaacctcagctaagactctctgtgaccagattctgaacctcttatatccagggcttcaaggggtattgcaggtcaaggtctttcctaggcactttctactccctgcatacctctcctcacactaaatttatcctctagtagaaaattaagttattttggtctaacagcttcaaatctttgaatgctcaataacttattttgcaagctgcaggcagaaagagactttttaagtaaagtcctttgttttttcctattctctgcttttagacaggctgtcctcaatttaagccctgctttttcttattgtttcttatataaacttggtaagtactgtaagaaacagccactatcataccattgcataataaggagcaccaacttcccagctcaaaactcaggtccttattgccttgtatcttacctcctctatgaggtcaattcacattgtaagcctgttgcttagtgcatctcgtttcctggtaccagcttctttaatagagttcttagttgcaatcaacagaagctggctttggcttttttatgtagaaaaggaacctattgaaaagatactgattggttccaataactgctagaagtttctgcaaaaccatgctttgaaagtgagcaggaaaagaagagactaggctgtggctgggagcacagccaaaattacaaaaccagcccagggatgatgatcctgttcatgcacagccactgtccccagcactaggcacagactctaccactgcctcactgtctctgctggacttggaaacttgatattactgttactgctgcactgtctgccatgaaaatgaattctccagggtcccttcttcatcctttcatctctagcttataattcaaagtctgggattgagtggccaatcctaggtcacatgtccatgtcctatctccaaggggggctgggaattgaatatctggcattttccactttcacttcttatgaattaaggaattctacaaataatagaagtgggattcaggtggtaggcagacaaaaaagcctcacaattatccactacgccacccttgtataaccttaccctcattcactgtctactctcaaaactgtggagctactaatgaagatttgtaaacccgggcttatgagcacccattcctttactacaactcagattgctctagaagctcagttcccagcacttggatttttccagtagctgaattctacctgaaggaagggcagaaacaaagggtgaagaagaggctatcacttccaagtatcctgcacccctgggctcaagacctcactggggagggagtcttttgggccacccaccaaacagcactggcattatgcctctcaccctagaccatggttacacgtggtaaaacaaccccttctggtgatacattcacaactctctagtttcccccaaatggcactatggggagcgggagcttgccttttcctcagacttaaaacaataagttttccccgtgtttcccctctaatgctgttttcttttgaccaagcatgtctgaattctagagaagtcaggaggaacacacccattctcggtttgaagggactgatgttctgaagtacaactgggcacagtcccaggctcttcaggacgcttcctccattcacacagcggggatgtgattgttacagcgggtggtgtgtgctggctgagaagccactgtgaattgattcttcttctgaagtttatgtttctactttttggaaatgaataaattacagccagtccatcaaggaaattgcaa

SEQ ID NO: 481 - DNA, 5183 bp, Homo sapiens
aaagggcccgcggctcgggcgtaggaggcggtgcctctgcagcaagcgtggggcgcgggaacccgagcaggttcgggagacggaatgaagggccgggtgggctcgcgaggggccggggagtccgcggggagcgagggagtttccgaggggcgggtcgtgttcctggcagcgtccctccagggcaggcccgccccctttgtcccagttccccgctgcccgggctggggcggccggggttcattcattgccggcctgaggactcctagctcggccccgctccgcgctacagcccaaagcccagcctgagacccagccgccctcgtatgcccacggcctagctccccttccctccaacagacagactgggaaaaccgagtgggcgacggctgagcaaggtcactccgctgtcgggggcgcagccggcctcagaccagctttcgtgcttcccagggcctctctgcgaccactttcggggtccgcgccaggcgcggggcgggggcgggggcggcttcggcgcggcgggcagagtccagcgggcagcggtgggggaagggcgagccgcctggggagagggccgggctgcgagcctggcgatccagattccagcccgctgtcgccagctgtgggaccgaagggcaactgtttcacctctctggccctagtatctgtatctgtaaagtgccagtgataacacctgtctcaccgagatgctgggggaattcaggaaaatcatgcaaaagtgcctggtacggagcctggcacgcagagggctcttggtcaagtgggttggagctgcgtgagcccagaaggggatagaggcagcgtggaggaaggcggcagcgggcccggtcgctgggaatgaaaggcctcagtgtctggggcttcctccccgtactacccgcagagtttgttcagggtggaggtgcgcacctggccaagtccacgtctacacggcccacccagagtagcctaagttgggcgggattcctaactctgagccaggagtgaccgggctggccctggcatgggcagaggctgagcgggggttggggtggggccccctccaggaccaaccacggtgtggttgcccctgagctggcctcagcctgcctggcaaaggacctcacccttgaggccatgtgatctatttcctgcttcctcccagctgacccttgagggaaagggggtgggggccgcctagagcaggaggtattagtcactgcgcccaggagccagtttacacctagcgaaggcggaggcattggacaagcctgggtctgagcagacagaaccccttcctgcgaccctggagtcccaatcgtgctgccattttccttctgcccaggactctccagtcctcagtcaccttggacaaagaagtgtggatcctcagattccatcttttccaactccaaggcaagtggaactagaaaataaggtgcctgtgtgtcaggtctccccagctctgctgtggcgggcccttaagatcacctcactgaaccctcacgctgcctcatgaagtttatacaattattagctctgttttacagagatagaaactgaggccaagaggctaattaatttccaaagcctaaggccagaaagtgatggtacccagacttgccccagggctgacttctgagccagtctggtacctagggcacactgccgcctccttccaaagcgagcttagggggcaggattccagtgggaaggaagctctgagcaggcagcctcagccacctctgagactctgtatcctgggccaggtgccatggcagagaaggtgctggtaacaggtggggctggctacattggcagccacacggtgctggagctgctggaggctggctacttgcctgtggtcatcgataacttccataatgccttccgtggtgagcggggcagtggggctggggctacttgaggggatggcagaagcaaaaccctgggttccacctccaccaccgggcggggaatgtgtgtctggctagtccctgggaacacagcaccccatgtcgtgatgatgtggcctacatgtaccctaccaggagggggctccctgcctgagagcctgcggcgggtccaggagctgacaggccgctctgtggagtttgaggagatggacattttggaccagggagccctacagcgtctcttcaaaaaggtgggtgcaggctgggcacggtggctcacgcctgtaattccagcactttggaaggccgaggtgaggagatcacttgagcccaggtgttcaagaccagcctgctcaacacagtgaaaccccatctctacagaaaaatacaaaaattagctgggcatggtagcccatacctgtggtcccagctactcgggaggctggcatgggaggatggcttgagcctgggaggtggaggttgcggtgagctgagatggcaccactgtactccagcctggacaacagagcgagactgtcaaaaaaaaaaaaaaaggtgagtgcaggcaggcaggctgagggcattgccaaggactaaaaccagtagagcaacctctggccatgtcacccctgcagtacagctttatggcggtcatccactttgcggggctcaaggccgtgggcgagtcggtgcagaagcctctggattattacagagttaacctgaccgggaccatccagcttctggaggtgagaggcatgggacagggcacagacactaggagggtgtccagctggaccccagcctggcaggcagtgccaaacacagagcccaagctgtatcatcctggactcatgtctttacctcccagtctcagtttccccatctgtaaatgagagtgctcatcacctcagccccattctcctgtggaggagtaacagggtgggagtaatgtgtgaggcagaggtcactgatgccatctctccacggccagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaaggtgagggcccccttgacagtgccctggctccactgatcgatggactcctcagggcccaccctgagcccaggggtgggattccgaacacccccactaaggaggaagctaaggctcaggcagttgcagtggagggccccatcccctgcttgtttctaaagataataaatagacaactggccgggcgcagtggctcatacctgtaatctcagcactttgggaggcccaggtgggcagatcacctgaggtcaggagttcaagaccagcctggacaacatggtaaaacccccatctctactaaaaatacaaacattagccggccatggtggtgtgtgcctgtggtcccagctattcgggaggctgaggcacaagaattgcttgaacctggaaggcagaggttgaagtgagccaaatcaggccactacactccagcctgggccatagtgagactccatctcaaaaaaacagaataggcatgaggagggctctgggttcagctgggacacgctgcctgtgcctctggcctcaccacctgacccacatcccacagacttggaacgcagtgctgctgcgctatttcaaccccacaggtgcccatgcctctggctgcattggtgaggatccccagggcatacccaacaacctcatgccttatgtctcccaggtaaggcaaaagggaagggacagaggagtggccctggggttaaagctggtgcctgggatctgggacgaactgacctgatctccacctccaggtggcgatcgggcgacgggaggccctgaatgtctttggcaatgactatgacacagaggatggcacaggtgagcctaggaccagggggacctaggagtgggagccaggaaggagagtcagggggaacagactccccatccaacacactcccttctctgcaggtgtccgggattacatccatgtcgtggatctggccaagggccacattgcagccttaaggaagctgaaagaacagtgtggctgccgggtaggaagagaagggagaagtgagggaggggagggaccagatccaggcagagcggcccagaggcgtggtcagtccagcccgctccataaaccctgttctccgtgggccagatctacaacctgggcacgggcacaggctattcagtgctgcagatggtccaggctatggagaaggcctctgggaagaaggtaggcccccccgccccacccacctcacccacctcaccccacccagctctcagcaacagagcagctttggcccttcccactcacctctctggagggtacctggcactgcccagtctcctcagcctgcctagcacccggtgcctgcgggccagccgctgctctgcacttctgcttcttaaagacctggccagcagctgggccagggccggctcagctaagctccaactacctcctgtcttgcagatcccgtacaaggtggtggcacggcgggaaggtgatgtggcagcctgttacgccaaccccagcctggcccaagaggagctggggtggacagcagccttagggctggacaggatgtgtgagtgctggcctgacccctgcagttaggggccagggaggggctaaatcagatctgggcatgcccacccagggcgggctgtggggtgggggaggctctgcattccaccgtgggccctgagcacacacctcgccgtgttgcaggtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 482 - DNA, 43457 bp, Homo sapiens
gctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccggtaggaccccggggcgggttcgcgcgtccgcggcgagactagagctctcctcagtcgggcaagagtcgcggggcggggctcacagcaggccgtgcctgtttggggacagggttctctgaggggtgcagtgctcagatcccgggggtatgtggcggggaatgcggggaccacgcagagcccgaggtgaagcttgtttggtggcgtcgtgtgcgcggccagcatttacgcaggatctggctgcgtccctaaaaaaagcgtgaatcgtgttttcgggattgagccagtcggccaggggagcgcggactgggcgccctaggtgagggcttgttctggagtgcacaggtgcgtgggagtgttgctagggcccgtgctgtgtccgtggtgagagtttgccctgtgttcccttggtgccttggtgagtggggtgttcattagggcttggacagtacccgcggtaagggttgcagtgcgtctgctgtgccccatgtgctgggctgggcgagcaggggcctggccaggtgttgctgggagcgtgctgtgcgtaagtggcctgtgtgcagagttcactgtgggcaagacagctcaactgtttgctttgaatggagtgagcgcggactctggggctagggagggcatgttgagtgagagcaggctctcggtgcctggggttagagaggtggtaagggcgcgccatgctttttgtgccttctgtgaacagtctccgtgttacctgagctcctattagtttgtaaatggctgcttttttggggggtgggtgggccatcgagtcttcttcctgttcccaaccaatatagatagtatctgattccattgcctaatggctttttgacattgttttccttcttttcattactttgagtcatatttgagagatgtgaaacaacctaaaaaacaatggtagccaaacctagtgagaaattagtatcctaacaaaggaaggcagataatgttaatcttgttttcccctgcagctcataagctaaagcttaaggcctatcccactaaatttattttgtatttcattgaatggaatcaatacttttaaaaatgcatgctaggccaggcgcagtggctcacgcctgtgatcccagcgctttgggaggcccaggcggggtgattgcctgtgcccaggagttcaagatcaacctgggcaacatggcaaaaccttgtctctacaaaaaaatacaaaaattagctgggcatggtggtttatgcccgtggtcccagctactctgggggccgaggtaggagattcacttgagcccaggaggtgaaggctgcagtgagctgtgatcatgccactgcactccagcctagatgacagagtgagaccctgtcaaaacaaaacaaacaaacaaaaaaaaaacccgctaagaaatacatgcttattgtgcgatacgaacagaatcaaaagacagctatttttaatattttggcatatttgtttctgccttcatgtgcgcgtcatgtgtatctatgtccaaattatatttaggatccaataacatgtatagtttctacgttgcatttttttccttaggagcattcattcaacgaatatgggtcttgtatgtctggtgctattacactggtaggcaataacaaaccattcctattttcttgatccttttttcactatttgtttacacacacattcatgcaggaagataagcagggactttgttttgctcaatgataagtgctcagtgccgggaacacagtagataaccaataaattatttgctaaaatgtattgggattggcagacattaaaatccaaaacataatagtgacaaataaattatgaaccaagggaagtgctctggaggcaagcagtataattttcagatataaatctgacagcatttaacaaatgattggagagagggaaggcttctctgctcatcaaacagactttggggcatctgtgcttgctgttccctcagcccaggaacattctcctcctgacctgctgcagaaacagtctcgctcttctgcaaactcagctggaatgttacaccctcagagaccttctctgatcaccccacctcgcgacccccccatctcaggttgaacacatacaacccagttcaagtccctcttcacttgtaatcacccttttaaaatgaccttttctgttctttgtctcaccctgtcagaatgcagggatcctgtctgtcttgtcgcacttgtggttccaaaagcccgatttgtttacctctgtatctgttaaataccagaaaattaaatatactatttggctggggcttagagcctaggaaaaagttcctcctgcctccaagaggaaggttctttaaagagctatgctcaggatggtctttctgcggtacctaaaaagctagggcagtggcagctgagagccagaaaggatctgtctcccctatttgttgactctgcagggcttccagtacttcagtcttgcatctcactgatcattaaaacgttcattttgaaggagggtaatgggagtagggagtagtggtgataagaagaaaacaaaaggacttttttttttttcttttaagattaatgtttagaataggcttagtgctagaagttcagcctggacagcataagcagacctcacctatacaaaacatgtaaaaaaaaaaaaaaaaaattagccaggtgtgatgttgcatgcctgtggtcctagctacttgggagactgaagggggaggatcactggagcccctcatggtcaaggctgcagtgagccctgatcatactccagcttggataacagagcaagagaccctgtctcaaaacaaaacaaaacacacacacatacacacacaaacaaacaaaaaaagaaacaaaataggaagctgaagaagataatgaaagcgatttgaaatagaggaacatagaattatgaaatgaatagggtgcaacatggaaaataacaaaactaagaatgaagagaaggaaaagcaaggttaagtttgaggttcataagggtaaatcaagacaggtatgaaacctagagaaagtaaaaatgagaagtcacgatgctaggcagagagaatacgtgaattaaaataaacattcaatttttggagcaactcactctcacaaggagaaggtttcgtaagcagacagtgctgtgcatgggagacctgccctctcaaaggtagttgccaaatggttccagatagttgaaggaaacatgtatcaaatttcaggccagtctcattcctccagaagaggagctgcttttttggacaaaacccgcaatctcctgttgtgcgtggtctcttctgcctattttaggtgttttccttatttccagtgaaagaagccaagatcagtaagcacttacacagtagcgtctcagtttccttactgggcatactacaatgcaaagagagcagtccatatctggtcacctgccaggataccagaagactgggagataggcagcacaagaaatggcctaatcttctttctccattgtgctgtagaatgattattttcaatatgaaattgattacaatatattcttcacattgttttgtgtttgacagcagtggattttgaataccaaattttttttgaatagctactctgagtgacatattgtgctgggtgttgtggccacatggatgaatggagttggccttgttaactattaaacacaaaagcatgtgatagttacctgagagatccatgcaggggagagtccaggggaaggtgactgatcactgcttcccagggggaggcagaaaatgcttcctggaggagatgatgggtggattaaggaagatgagttgagcaggagttgtagctaccagccagggaggaagggtattcagagcagaggaagcaaggtgagcaaaggcaccaagatgtgacactactggactgccaagctattcagtgtggcagagtagggcaaaggaggcaagaaagaaggaagaggattaaatcacagggtgagtaattctgaaaagcaacagactcatcaggagtaaacactcaccatcataaattcagactttcacgttattacctgtccttttagggcaacttgagccttttgtttgacttagcacaacatgaatccaaactagggttgttttgattttcccaggcacggtagcagacaatttcttgaatacttatttgcagatagagtttgtcagtgtcagcatttcttgtgcacccacaaggtgagtatagtagaaaaagaagaacatggttcttgacccccaggaacttgccttttaagagaagacaccctgaagtgacaagctgttataagttagtgttttaaactatggaagaacaatctgagcagagtactctatactgtagaagacttcttagaggagaagttacttttgaaatgaatttagaaaaatgtggggaaagatgcatccatatatattttaagatcaaagacattaatgctgtctcttcagtttattgtcgaatgtttattcccaaacaaaccaaaagctaataggatgttacttaaaacatgcaagtcccatttcctccactgctatgagcactcaggtaaaagcatggaacagtcatttaaaatcttgccaagggcctttctgttttttctgtactacctgctgccagaccacagtccatggctgatgaaagtgatatcagtacttcatcttcatgttcctattctcttatccctagatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagtaagtaaacaaacctcttttttttttctgcttgctctagagatttgcatacattttggggtacatattccactacggtgatgatgattttcttcttgtaaaatgaggttcaagataacaatgcatttttgcaagctttgagaaatcaaaatctccaagaaatcattttcctggcaatagattgcctgggtgaatatgaatcttaagtttgcccttataataagtaaataatgaaaattatattcccacccattcaaaagagcactgcagaattttgattttgattcagatctgttttataactggattgaaaactatcaaaattattttctttcaggagaaacatgtccatatatacgggatcctttaaatggccaagcagtccctgcaaatgggacttacgagtttggttatcagatgcactttatttgtaatgaggggtaagttgctccttagaggaaataagggaagtgttagtaattttatttttgttttgcttctcttcttaagcattcctgtaaacttaattttgctttctatgtgacaagttatacttctagccaaacaactcttggatgttttatggagataggcaagatatatagtaaatagaaagtaattgatatttaaggaaagcaaaactacttgctgtttctgacaataagtctgttgtaagcattaagaatgtagtaatcatgagaatttgtccttcacaactgagtgtcccctatttaaatctgccaactcttagagttgaagtagggctcacaaaaatgagaaatagaattgccaactaaagatacacttgtatccagatgactctgtaaagtgttatcagaccaaaactgacgcggttagcctttaccatcatgttgatcaaaatctctcagttgaaaaaccttatttttgagactgctacagtgtgaagcatctcaagagcaggtactgagccctcggtaatagcctttgttctgtagggttttgaagttgtatatattggagatactagacatttaagataaatgtgcatttatagagtaaatgtaagtattctgctataacagaatacttgaggctaggcatttataaagaaaagaaatgtatttggctcatatttctggaggctggagagttcaaggggatggcagtagtgtctggcaagggcttttgtgctgcatcataacatgctggaaagtgaaagggaaatttagcatgtgcaaaaaagacaaagcacaagggagggggttctcgctttataacaacgtgctcttatggtaatgaatccaagcctacaagaatgagaactcattccctgaagaattaatgaagaccctctagaaaggcattatacctcttaatgacctagtcatttcttaaaggccccaccacctctcaatgctgttacactggcaattaaatttcaatatgagttttggtagagacaaaccagattcaaacaatagcagtaacacaccataatatagaaaaagtaagtgagtcttggaggaaaaatcagctgtgactatgtaaggcaactgacagtttttaaaatttggtcaagtagaaatattggaatattcagttgacacatactgcttgctaggcacaccgagggataccaaaactttaagacagtgaccttcctaaaagaagttctaaccttattgagaaataatatatactgagagcaataaaagcaaaatactaaatgagaaataccaaataagtagaattattcatgataattactctaagagtccagaaggaggagagattcctgtgaatttaaatcagggaagatttcattgagtataggggtatacttaatgaaagtattcttatactcagtgagctattcctagaaatacactctgttctaaataatattaatagaagctaaaactcatgtagcactatctatgtgccaaatgctaacttatctaatcccctaaacaaccccatgtactgttatccccttttaatcaattaggaagctgagtgaaggaactttaagtgacttacccaagctcaagaaactagataagttgagaagcagggacttgaatctatccattccagctctagggcctgttctctctacacagtccttgtccttactgtgcaaagtggtgtgagaaaaggcacagaaatgaatgtgtaatgtgattgcaggaggcagcaaagaggctgggtggaaaggcacagcagatttatttagacatctttgctcttggccaatatatattcaaatggggaaactctatttgattaaattgcagatttatttagcactttcgttatatagtatgttgtttaagaaaccaccccctcaaactactgtagtgtagaaaagaaaccatataaaaaattccttcattattatgtgtgtcttattaattgctatacaaaacagtaaccctttcttttctcatttagttattacttaattggtgaagaaattctatattgtgaacttaaaggatcagtagcaatttggagcggtaagcccccaatatgtgaaagtaagtaaattctttttttttaaatttagaccagtagtcctcaaagatttttgcctcctttacaccctttacactttaagattaacaaagatcccaaagaggtttcttttatgtgggttatatctattggtatttatcatattggaattcaaacggagaggtttttaaataattattgattctttttggttttgtttgtttttcctaagacacggtctcaggctatttcccaggctggggtgcagtggcacaatctcagctcattgcagcctcagcctctccagtagctggggcttcaggcatgtgccactatgcctggctttttgtaatttttgaagagacggggttttgccatgatgcccaggctggtcttgaaatcccatgctcaagcagtctgcccccgtgggcctcccaaagtgctgggattacaaatgtgagccaccccacctggcctgattaatttgtaagaataaatgcaatacaaattaacatatgtaacataatttttatgaaaaataataattttccaaatcaaaataaaattagtgagaatagtggcattgttcacattttttgcatatctcttcaacatctggcttaaagcaagattgtatttggcctgttgtgttatcacacaatatgtagcctttggaaaaatatcactatattcttattaggatcagagtgaaaaaagacaataatattttggtggtattgtgaatcaccaatttagaaaatggatatatttataaattgcaaaggatttcttaactagcaccgagttaagcatattttctcattaattgtcagcatttcttgtgatgactagaacagaacttagcatggccttccaaataaatacaggcgtattaggccgttttcgtattgctctaaagaaatacctgagactgggtaatttataaagaaaagaagtttaattggctcatgtttctacaagctgtacaggaagcatggtgctggcatctgctgggggtttgggtaggcctcgggaaacttaacaaccattgggaaagacagaaggagagcaaggtgtctcacatggcaggagcaggaggagcaaggtggggaggacgggaggtgttgcgcacttttaaataaccagatctcccaagcactcagtatcacgagaacagcaccaaggggacggtgctaaaccattcatgagaaatccacccccatgattcagacccctcccaccaggccccacctccaacattgtggactacaatttgacatgcgatttggtggggacacagatccaaaccatatcaataggtatttacactttaagaaaatgagatttgttctgaaagttagttactacattaatggtttgaatttgggatgatatatttgctcatagaaaccttcttttaaatccatattgaattcacaaacagcttgtagaaaccctatattgacaaatttattgaagacacagaaattttactaatgctgtcttaatcttttacatttcctttcctctttttcttcatttttaagaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaaggtagtgtttcaatttatttccttcttcatttgtaaatactatggaaacattttgtaaatagtttcatctacagataaacaaagcaggtgtatgtgcttcctcctcctgtataattggtttctaatttattttaattcaggtcaattcaagtcaaaaaatagttctagctagagttccctatttctcacccctacatgttcttggcatttcattttatacagtgtgaactactgtgtacctgcatgagttagaagtttttgtttgaaagaaccaaaaaaaaaaaatacacactggcttaaagaaagtttcatcttgtattacaagaaatctaagagttctggctatggtagtggtaaactgtgacagactaatcgtctcacaaataaaaatgataaactctggataaaaaaaattttttttttaaagaccaaatgtttaaggcactctggagtgaccaaaagtatgaagaccatgtaggggacttgcccatttaaagaaagaaatcactgaataacagtgatttaaaagtatatactccccaagtacacatgaaacattctccaaagtagaccatattctagacaataagacaacttttaacaaacttcagaaaattgaaatcattcaacatgcattatcacaatagaatgaaagcagaaatcaataacaaagccaatccccaaagaattggaaagtgtacaggacacttctaaataacccatgcataaaagaagtagtcagcagggagattagaaagtgttttgaattgaataaaaacacaacatctcaaaatatccaaatatgtaggatgcagctaaagcattgcttacaggggaatgtatagcataatatacttgtgttagaaaaaaagaaaagtctcaaatcaatgatctaattttccaccttaagaaactaaaaaagagcaagttaaatcccaaactagcagatgtaaggaaatgataaaaatagagccaaaatcaatgaaattgagaaaagaaaaaaaaatagaggaaatcagtgaaaccaacagttgctacttggagatcaataaagtgtgtaaacctgtagccagactgacaaaaaaagacgcaaattaaccaatactgagaatgaaagaagtggtggccaggcgcggcaccccagccagcttgaagaccctgccctcctgcagccggcaggggcagtcactcccggacttgtccttttagaagttccagctttaccacttgctggtggagcccaaccactgccgcagggtcctcatcgccaacacgcctggcagatccaagaggagatggcccaggatgagacgtggcacacacaggcacccgagagtgtggggttggcgttgttccactgcctggtttctgcagagatcctgtgcctgtggcctgtgcccgccatgtggaagccagagggggtgtgccatgccccccgctttggacactgctgcgtgaaggggccagttttcagacctttgctctgtcacctcagcactggcgccaggagccctgaagagcagcatctgggagacggacagccctggggaaaatagaggaggcgttcagaagtagctagatgagatatttgaaatactgaagaccaaaaaccccagtttgcatggaagaactggcctcagatgtggtcagttcctatgatgacctggacacacggtgctgacccacacgatgggaggtggccctgcaaagcattcagaggcttgggcctgctgccgtccggcctcccacctccagctgcaattgcattctgacctgggcaagtaggaacacgtagtggagatcctgatggagacctgagccaggcgtcccggagtgctggccaggcgtggagtacgggatccagctaagggagactggccagcctatagccccccagccttgctggctcctctgctaattccagcagggtctgcagccccagacccatccccttccttcccgtctgcagagggcaggccagaggctggtctcagtgggagctagggctctcctcaagggctttttgaccttgggccagtcttgacatccccacagccctgcgcccctcatcacttttcgtgtctctcggagacggcgagctgcaactgcagcaatcttgtttaaatttaggtaggtgaatttcttagaattaagtttcatatgttttgagcaataagttttcttaagatatatatattttaatctttttagttttatctctgaatattttttattttttttcaatgtattttttttctggaaacattctgtgctgctacattagagcctacacagtttagttggtacatttcattcttttaaggttcaaataagggattttattttccagtgagtttccttgcattgttaacaagtcaacagcgttaacgtatgattttttggttttttttttttgtatactttaaatttgtgtgcaacccttctcatttatgccctgtgttacagtgagagcttggtcaaagtggggaaaacacacacagctgctacactttttttttttttttttgtcattggaacatttgtgccatgtcttcctagacttaagtgtaaattatggagggttttatttgacaatttatatgtaaatgtcattgaaggctaaggttaaatctttggaaatcacaggcaccagttgatctttagagacctcagatcccctcaggtggcgccttgtgataggcggtgttctgggaggcttcctgtcaggttccacagcacaggcacctgctctgggcacggactgagctcctggggtgtgcacggagctgcggtgcgccagtcacatgcgcttggaaacagcgtgtgctgctggattggaaatgcctacgttgctctgttaaattggtgctggagccaaaacctaaggttaaatttaagtctagaatgaaagaaatctgaatccatgtaattaatggccgctcgatcttgagagtccttgacggccctgcctcaggaagtgaggtgggggtgcctacacctttcactttccttcctcacgtccaccccgtatgtgtttctcatcctttttctgacttccccccatcccttagccaaaaagctttatattcttttgtgcatatggtcattctttaatatcagtgatgtaaactttacttgattactttacaaaattattcaacagacaaacaaaagaatgaaaaagagaatatcactaaatatcctacagacatttaaaggatgacaagggaatattataaacaactttatgcctacaaatttgacaactgaaatggacagattccttgaaagatacaaaatgtcaaaactcacttgaagatatggataacctgaatactcctatatctaccaaagaaataaaatttgtagttaataacctactgaaggtccagatggcttcactggggagttctaccaaccatctaaggaataaatcacagcaattctacacaagcgtttcaagaaagtgcaagaggagggaacacttctcatcccattttatgatgatagcattgtccttatacgaaaaccagaaaacaaaaacattataagaaaattacaaataatatccttgatgaacacaggaccaaaaatcttcaacaaaatattagcaaaccaaatcctgtgatacataaaaagaaaagtaaatcatgaccaagtaggatttaccctatgaatgcaagattagttcaaatgcaaaaattaatcagtgtaatttgccacatcagtagactattaaggagaaaaaaaatcatgtggttatcttattagatgcaaaaaacaaagaaaatgtttgacagaattcatcatcttattttttcatgataaaacttctcagcaaactaggaacagaagggtactatctatcttaccctgataacagacatctacaaaaatctcacagctaacattacacttcatggttcaaaaaaattatacttagtggtaaaaagtaacattgtacttagtggttaaaaaaaccttacttacatttctgtctaattaataaagacctaattctggaaggaaaacagtgaggatgtccactcttaccactccattcagcattatattggagatcccacccagtacagtaaggcaagagaaagctattaggcacacatgttggaaaagaagaaataaaaactgtctctactcacaatgagatgccactaaatacctattggaaaggccgaaatgtaaacacacacaccccaaactgacaataccaggtattgacaaggatatggagcagatgaaactctcatatactgatggtgagaatcaaagtgcaatgaccactttgggacatttttggcatttcttataaagttaaacatactcttatcatacaactcggcaacccaaataaactgaaaacattttcacacagaaacttatatgaggatgttcacagcagccttattcataatcaccccaaactgcaaatcgccacatgttcttgagttggtgaatgaatgaaccacctgtgctacctctaaaagatggactcgtactcagcaataaaaaggaatgaactgattcatgcagcaacacaaatgaattttgaaagcatcatgcttagtgaaataagccatactaagaagactgtaatttcatttatgtgacattctgaaaaagtcccactatagggataaaagcagatcaatggttagctggttgtggaagtggggatgagggggaagaggggtaactcacaaaagagcatgaggaaattctggagagtaatggaacttttctgtatctttactatggtggtagttacatgattatttgcatttgtcaaaactgatacagctgtacacttgaaatggtgaattttactgtatgtaaattatatccaataaaccaacctttacaaataacattaggtacaattagacacaacaaaaggtcagtgaacctgaagacaggtgaatagaaattgaaccttatttaagaagaaatgttgactaaagaaagagagaggcttacagacctgtgggagagtatcaagcagtgaaacatacatgtaattggagtttcagaaagacaggagagagaatggtgtaaaatattatttgaaaaaatattggccaaaaattatccaaattagatccaaaacaacctcagatccaggagattcagtgaaccttcagcaggatgaataaattattaaaatttaccaccaccaccacccccctgcagtagtttggtaaaaactaccaaacaaaattttaaaaagcagccagtgagtggggaaaacaacaaaaacccgtattacatttaggagggcagggacaagtaagaatgacagccagccaagttttcttaagaaaatgtggttacaatatggttatctctgttagtgctgaaagaaaaataaaacaccctagaattctgtatgaaggagaatatattagttaacatttaaagtcttttaaaaaatgtttttaacatcttgcattccattccttgtctctgttcacactggaaattactactttgtactactttttctgctaaagcagatatccattaattctgaggtttctctaattttccagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtacaaaggttatcttttttctgtcttggtttgttattgttgttgctgttcattttagactttatttctttgatattaactatcagtcatacaaaataactgaaaagaaacaattttagtatttaactctgtcttgtattcatttctatgccagatgaatgacacgaaattcacataaaattctgctgttgtgattttttgtgcttttccagggttcttagcacgttatgtacattgcatgggtatatgcttttaatatttttatgtataaaaagtgaattacaacaactttttggaattgaaacatgggcatttttatctaagtaagtcaacaatggcataattcatataaatgaaatgagagcaataactcccaagtggttgatcttctaacattattttgtttcctagtgctgcctccatctagtacaaaacctccagctttgagtcattcaggtttagtagcttcttccttatatgtcttcttccttatatgttacaagatataaggaattcctggagaaattgccagcaataactcccaagtgtttggtccaatctacattattattttgttttccagtgtcgacttcttccactacaaaatctccagcgtccagtgcctcaggtttagtaatttcctgcttatagtttttcaaaaatcctttaaattcctggtgattttttataaaatccttcaaatttctggtgatgttcacttatttttagtaatgaaaggagggaggacatttgtatagccattttagttgttatacatagtgattctaaaattatttgccataatctgatataaacaggaatatgaccttgggaaagttgtataaattttgaatgtgtttatatatatatgtttacattatatatagagaaattgatttagtaccttccttattgggtattagtaaggtataagtgggatgcatttaaagcacttagcacagtgcctggtgtagagaaagctcttagagctagccaatatgacttatcctacacttaaattaatgttagggaaggggaaggttcatgtatgtttgttagtatgtgtgtgtgttaatatgttaatatgtttgtttgttaatatgtatgttttgtgtcatcaactttgctattttattcttttcagaagtgatctgttgacacctttactgagtttgttcctattgcaggactctttcatttcctggaatgcaactagtttgagtcttctgatgtaaaacatttaaacagggaaatttctgctgtcctcagaacaagatctgtatttctgcctcttccctacccacccctcttccacacctcataatgttatttattttttttctctttagtgggcagttttatctggcaatagcaactcaattttatagcaactgaaaggcaggaaaagtccttatttactgaaataaaatagaagacttttgcagggactcctggtcaaccactgtgcttatgactggagagattattttgatatgatggaaggaattatcctgatttcagcactaccatctctggtttcactttgcttccagcagaagcaagagacaatagtaattgtgggtagcacttcagtctgggcagactgtgcttagttaacatcatttctgtggtcttcagtttccctttagtataatgtgagtgttgaactgaaatctcaatcactggcttctaatttggttatatatttcctatctccctaatattttaaaggatcgaagagaattatgcatgttaacatagtaattaagataccttcttataggctgggtggggtagctcacacctgtaataccagaactttgggaggccgaggtgggtggatcacgaggtcagaagttcaagaccagcctggctaagttggtgaaaccccatctctactaaaaatacaaaaattagcggggtgcggtggcaggcacttgtaatcccagctgctcgggaggccgaggcaggagaatcgcttgaacccagtgggcagaggttgcagtgagccaagatcatgccactgcactccagcctgggtgacagagtgagactctgtctcaaaacaaaaaccttcttataattcctgtaagagcttggtaactggtagcctcctgagttgagtgctgtagggtttgaggggcaggaagagatgagttttttagtggactgatacatgagcaaaacaagattgcatgtgaaatttatactcagtgaggcatccgggcttaactcacatgctcctagtgggtatatgcactaatactacgtttgttgatacagtcttttgaaagagttgatgataagcatttcataaagtatttataaaacactggtatagcttagtgttggagagcagaagagagaattgcttgggattgtcaatgatttcttatcatctgctagaggaagactaaataacaacatcatgatgttaaggtagatctaaatgtgttaacaagaagaaaagttgaggaagtcctaagtggaaaagagaaagatgtaaattatgtagtatcatactacttacagtttttaaaaagatacatatgtttaccccaagcacattccctttttttttttttgagacagagtcttgctctgtcacccaggatggcgtgcagtggcgcggtcttggctcactgcaacctccgcctcccgggttcaagcggttctcctgccacctcagactcccaagtagctggtattacaggcacccaccactatgccggctaattttttgtatttttagtagagacggggtttctccatgatggcctggctagtctcgaactcctgacctcaagtgattcacctgcctcggcctcccacagtgctgggattacaggcgtgagccaccacacccatcctcacattactttcatgatggttatcttctaagatttccattataaaatacagagtgtggtgagcattcttgtacatacatcttacatacttgtgcaaatatatatgtaggttaaattctaagatgtggaattgcaaagtttgtaaagtgtgtagttttcatttgataaacttaaaaaatcaatatcaaaattaaagtcataattttatattgataaggccctggtgaatttataaaatcaaacttatttttctaggtcctaggcctacttacaagcctccagtctcaaattatccaggttggttaactctttatcctactgatattgttaagaatttatttatttatttttattatactttaagctctagggtatgtgtgcacagcgtgcaggtttgttacataggtatacgtgtgccatgttggtttgctgcacccatcaactcatcatttatattaggtatttctcctaatgctatccctcccccagcccctaacccctgacaggccccagtgtgtgatgttccccaccctgtgtccatgtgttctcgttgttcaactcctacctatgagtgagaacatgcggtgtttggttttctgtccttgtgatagtttgattagaatgatggtttccagcttcatccatgtccctgcaaaggacatgaactcatccttttttatggctgcatagtattccatggtgtatatgtgccacattttcttaatccagtctatcattgatggacattcgggttggttccaagtctttgctattgtgaatagtgccacaataaacatacgtgtgcatgtgtctttatagtagcatgatttataatcctttgggtatatacccagtaagggattactgggtcaaatggtatttctagttgtagatccttcaggaatcaccacactgtcttccacaatggttgaactaatttacagtcccaccaacagtgtaaaagtgttcctgtttctccacatcctctccagcatctgttgttcctgactttttaataatcgccaatctaactggcgtgagtggtatctcattgtggttttgatttgcatttctctgatgaccagtgatgatgagcattttttcatatgtctgttggctgtataaatgtcttcttttgagaagtgtctgttcatatcctttgcccactttttgatggtggtgtttttttcttgtaaatttatttaagttctttgtagattctggatattagccctttgtcagatgggcagattgcaaagattttctcccattctgtacgttgcctgttcactctgatgatagtttcttttgctgtgcagaagctctttagtttcattagatcccatttgtctattttggcttttgttgccattgcttttggtgttttagttatgaagtatttgcccgtgcctatgtcctgaatggtattgcctaggttttcttgttgggtttttatggtgttaggtcttacatttaagtcttcaatccatcttgagttaatttttgtataaggtgtgaggaagggatccagtttcagctttctacatacggctagtcagttttcccagcaccgtttattaaatagggaatcccttccccatttcttgtttttgtcaggtttgtcaaagatcagatggttgtagatgtgagttgttatttctaaggcctctattctgttccattgatctatatatctgttttggtaccagtaccatgctgttttggtcactgtagccttgtagtatagtttgaagtcaggtagcttgatgtctccagctttgttctttttgcttagggttgtcttggctatatggactcttttttggttccatatgaactttaaagtagttttttccaattctgtgaagaaattcagtggtagcttgatgtggatagcattgaatctataaattaccttgggtagtatggccattttcccaatattgattcttcctatccatgagcatggaatgttcttccatttgtttgtgtactcttttatttcgttgagcagtggtttgtagttgtctttgaagatgtccttcacatccatcccttgtaagttggattcctaggtattttattctctttgtagcaattgtgaatgggaattcactcattatttggctctctgtttgtctattattggtgtataggaatgcttgtgatttttgcacattgattttgtatcctgagacttcgctgaagttgtttatcagcttgtggagattttgggctgagacgatggggttttctaaatatgcaatcatgtcatctgcaaacagagacaatttgacttcctcttttcctaattgaataccctttatttctttttcttgcctgatcaccctggccagaacttccaacactacgttgaataggagtggtgagagagggcatccttgtcttgtgccggtttccaaagggaatgtccagtttttgcccattcggtatgatattggctgtgggtttgtcttaaatagctcttattattttgagatatattccatcaatacctagtttattgagagtttttagcatgaagggctgttgaattttgtcaaaggccttttctgcatctattgaaatagtcatgtggtttttgttgttagttctgtttttgtgatggattatgtttattgatttgttaatgttgaaccagccttgtatcccagggatgaagccaacttgattgtggtggataagctttttgatgtgctgctggattcagtttgccagtattttgttgaggatttttgcatcgatgttcatcagggatattggcctaaaattatctctttttgttgcacctctaccaggctttggtatcaggatgatgctagcttcctaaaatgaattagggaggattccctctttttctgttgattgaaatagtttcaaaggaatggtaccagctcctctttgtagatctggttgaattcggctgtgaatccatctggtcctggactttttttggttggtaggctattaattattgcctcaatttcagaacctgttattggtctattcagaggttcaacctttcctggtttagtcttgggagggtgtatgtgtccaggaatttatccattgcttctagattttctagcttatttgtgtagaggtgtttatagtattctctgatggtagtttgtatttctgtggggtcagtggtgatatcccctttatcattttttattgcgtctatttgattattctctctttacttctttattagtcttgctagcggtcatttttgttgatcttttcaaaaaaccagctcctggaatcattgagtttttgaagggttttttatatctttacctccttcagttctgctctgatcttagttatttcttgccttctgctagcttttgaatttgtttgctcttgtttctctagttcttttaatggtgatgttagggtgttgattttagatctttcctgctttctcttgtgggcatttagtgctataaatttccctctacacactgctttaaatgtttcccagagattctggtacgttgtatctttgttctcgttggttttaaagaacaactttatttcagtcttcatttcattatttacccagtagtcattcaagagcaggttgttcagtttccatgtatttgtgtggttttgagtgaatttattaatcctgatttgcactgtggtctgagagacagtttgttgtgatttctgttcttttacatttgctgaggagtgttttctaccaattatgtggtcaattttagaataagtgcgatgtggtgctgagaagaatgtatattctattcatttggggtgtagagttctgtagatgattagtaggtctgcttggtccagagctagttcaagtcctggatatccttgttaactttctgtctcattgatctgtccaatattgacagtggggtgttaaaggctgccattattattgtgtgggagtctatgtctctttgtaggtctctaaggccttggctttatgaatctgggtgctcctgtattgggtgcatatatatttaggatagttagctcttcttggtgaattgatccctttaccattatgtagtggccttctttgtctcttttgatctttgttggtttaatgtctgttttatcagaaactagaattgcaaccccttttttttttgctttccatttgcttggtagatcttcctctgtccctttattttgagcctatgtgcatctttgcatgtgagataggtctcctgaatatagcacaccgatgggtcttgactctttatccaatttgccagtctgtgttttttaattggggcatttagcccattttcatttaaggctaatagtgttatgtttgaatttgatcctgtcattatgatgttagctggttattttgcccgttaactgatgcagtttcttcatagcatcgatggtctttaccatttggtatgtttttgcagtggctggtaccggttgttcctttccatgtttagtgcttccttcaggagctcttgtaaggcaggcctggtggcgacaaaatctgtcagcatttgcttgtctataaactattttatttcttcttcacttacaaagcttagtttggctggatatgagattctgggttgaaaattattttctttaagaatgttgaatattggcccccattcttttaaggctcgtagggtttctgctgagacatccgctgatagttggataggcttccctttgtgggtaacctgacctttctctctggctgcccttaacatttttttccttcgtttcaaccttggtgaatctgacgattatgtgtcttggggttgcacttttcaaggagtatttttgtggtgttctctgtatttcctgaatttgaatgttggcctgtcttgctagtttagggaagtcctcgtggacaatatcctgaagagtgttttctaacttgattccattctccccgtcactttcaggtacaccaatcaaacgtagatttggtgttttcacatagtcccatatttcttggaggctttgtttgtttcttttcacttttttctctaatcttgtcttctttttttcattaatctgatcttcaatcactgatatagtttctttccacttgatcgaatcagctattgaagcttgtgcatgcgtcacgaagttcttgtgccgtggttttcagctccatcatgtcatttaaggtcttctctacactgtttattctagttagccattcatctaatcttttttcaaggtttttaccttcctcgagatgggttagaacatcttagcttggagaagtttgttattactgaccttctgaaacctacttctgttaactcatcaaactcattctctgtccagttttgttcccttgctggcaaggagctgtgatcctttggaggagaagaggcagtctgttttttggaattttcagcttttctgctctggtttctcccatctttgtggttttatctaccttttgtctttgatggggttttggtgtggatgtcctttttgttgatgttgatgctattcctttctgtttgtgtgttttccttccaacagtcagacccctcagctgcaggtgtgttggagtttgctggaggtccactccagaccctgttttcttgagtatcaccagcagaggctgcagaaccacaaatattgctgcctgatccttcctctggaagcttcgtcccaggtggggcacccaccacctgtttgaggtgtttgtcggccgctactgggaggtctttcccagtcaggctacatgggtgtcagggacccacttgaggaggcagtctgtccagtgtcgaagctcgaatgccatgttcagagcaccactgctctcttcagagctgtcagacagggacgtttaagtctgcagaagctgctgcgttttgttctactatgccctgcccccagaggtggaatctatagaggcagtagcccttactgagctgcggtgggctcctccagtttgtgcttccagttctctttgtttacactgtgagctactcaagcctcagcaatggcagacattcctcccctcatcaggctgcagtgtcgcaggtcaatctcagactgctgcgctagcagtgagcaaggttctgtgagcgtgggacctgccaagccatgcacaggagggtatctcctggtctgctggttgttaagactgtgggaaaagtgcagtatttggtcaggagtgtactgtttctccaggtacagtctgtcacggcttcccttggctaggaaagggaaatcccccaagtccttgcgcttccgggtgaggcgatgccccgccctccgtgggctgcactcactgtccagccagtcccagtgagatgaaccaggtatctcagttggaaatgcagaaatcacctgtcttctgcatctatctcgctggagctgcacaccagagctgttcctattcagccatcttggacaagatttttttttacttaaaatttttttaaattaaaaacttaagacatatctaaaaaaatgttaagaatttttaaatgatgggtgaaaaataacatcttgttttaatttgcatttcttggttcttggtttttagttgtttttgtttttgcttttttgagaccgggtctcactctgttgcccaggctggagtgcagtggtgcaaccacggcacactgcagcctcaacctcctgggctcaggtgattctcccacctcagcctcccaggtagctggaactacaggcacctgccaccacacccagctatttttttgtgtgtgaattttttgtagagacagggttttgccatgttggcaagtcttttctccaactcctgggcttaagcgatcctcctgcctcagcttcccaaagtgctaggattacaggtgtgacccaccatgcccggccaatttacatttctttaattatcagtgaatctgaactttttttgatctacatttatttattcatgtgctttgtctatttttctgttaggtttctaaaatatttttcttagtgatttttgagagctcattatgaattaaagcccttttaatatgaagtgaacagttttttccaggttcttttgttttgtcagttttaagcttgttatactactggatatagattactttttataacttttaattacatgagtagtgtatgaatatacttttgtagaatttcaaacattacaaaagtatatagagtaaaagattagttttatttttaactcattacccaagttaatcactgttaatagtttagggtttctttttaaatctatttttgtacatcaacatctttttttaaaaagttttattttagatttgggggtacaggtgaaggtttgttacataagtaaacgtgtcacagggatttgttgtacataactatttcatcacccaggtattaagcctagtacccaatagttaccttttctgctcttcttcctactcccaccctccccggtcaagtataccccagtgtctgttgtttccttctttgtgttcattagttcttaccatttagcccccacttataagtgagaacatgcggtatttgggacgttcctgctgaagacatgcgctcgttcttttttatggctacgtagtattccacggtgtatatgtaccacattttctttatccagtctgtcattgatgggcatttaggttgattccttgtctttgctattgtgagcagtgctgcagtgaacattcatgtgcatatatctttatggcagaatgatttatatttctctgggtatatacccagtaatgggattgctgggttgaatggtagttctgcttttaggtctttgaggaatcgccatactgcttcccacaatggtggaactaaattacactcccacgaacagcatataagtgttcccttttctctacaacctcaccagcatctattattttttgactttttaataatagccattctgactggtgtgaaatggtatctcactgccgttttgatttgcatttctctaatgatcagtgatactgagcttttcttctgtatgttttttggccacatatatgtcttcttttgaaaagtgtctgttcacgtgctttgcccactttttaatggagttgtttttctcttgtaaatttttttaagttcctgtaaatgctaaatattaggcctttgtcagatgcatagtttgcaaaaatgttctcccattctgtaagttgtctgtttactctgttgatagcttcttttgctgtgcagaagctcttcaatttacttcaatcgtacttgtcaatttttgcttgtgttgcgattgtttttgatgtctttgtcatgaaatctttgtctgttattatgtccagagtgatattgcctaggttgtcttccagggtttttatagttttgggttttacatgcaaatctttaatccatcttgagttgatttttgtgtatggtgtaaggaagggatccagtttcaatcttctgcatatggctagccagttatcccagcaccatttatttaatagggaatctttttcccattgcttgtttttgtcagttctgtggaagatcagatggtcatagatgtgcagccttatttctaggctctctattctgttccattggtgtatatgcctgtttttgtaccagtaccatgctgttttggttagcgtagccttgtagtagagtttgaagtcaggtaatgtgatgcctccagctttgttctttttgcgtaagattttcttgactattcaggctctttttggctccatatgaattttaaaatagttttttctagttctgtgaagaatgtcgttggtagtttgataggaatagcattgaatctgtaaatagctttgggcagtatagccattttaatgatattgattcttccatccatgagcatgggatgtttttccatttgtttgtgtcttctctgatttctttgagctgtgttttataattctcattgcagagatgtttcacctccctggttagctgtattcctaggtattttattctttttgtagtaattttgactgggattgcctctctgatttgactctcagtttggctgttgttggtgtataggaatgctagtgatttttgtatattgattttgtatcctgcaactttggtgaagttgtttatcatctggagcagcttttaggccaagactgtggggttttctaaatatagaatcatgttgtctgtggacagagatagtttgacttcctctcttcctatttggatgccctctgtttctttctcttatctgattgctttgcctaggaccatcaacatacttttatgtgtaattatacatgtagtttggtgttttctcttttcttaaaaatgatattatgctgtacatatttttctgcaactttttccacttacactcttagattgtagttgtgtttagatttattctcatactttctaatgatgacttaagtatataccataccttatttaactattctcctatcagaggtcatttatatgttcagacgttttatattaataggtagttggatgtattgatcttttccctaatggctatgactttggtgtctttcttactaaaactttaggtcttctgtatgctgaaattgtatgaagatttcaaccatgtgttctgactttggtctttgcacttaaatcattagtaaatctgaaatttattctggtgtatataatgagatatatggttccacctcgccccaccccagcaaccaccatccaatagctaaatagcaccattttttgaataagttgtcttctccccaactgatttgaaatgtcaatttgtatcatacattgcattcataggtgttccatcctcttttctcctttgaactttgtccattcttctattcttgtagcaaaagcaagtctttttttttttttttttttactgtagtactatatgttttaataactgccgggaacacttccttttcagaaatttctaaggaactctatgttattttttccaaataaactttttatcttatcattttgaccattttaagtttacaattcagtggcattcagtacactgacattgttatgtaaccatcagtaccatccatctctagaatattataatcatcccacactgaatctctactcattaaacagtaactctccattcctccctatccccatcacctgatgataaccactatctactttttgtctcatgaatttgcctattctaggtaaatttatataattataataagtggagtccacttatatggcatcccactatttgtccttttgtgtgtggcttattttacttagcataatgtttttaaggttcatctagatctatcttgtgacatgaatcagaacttcattcctttttatggctgaataatagttcgttatatgtatatactatatttcatttattcattcatctgttgctagacacttgggttggtttgtttttaccttttggctattttgagtaatgctgttataaacataggtgtacacatatctgtttgagttcccgtattcagttcttttaggtatatacctgggagtagaattgctagatcataagggaattctatttttaatattttgaggaactggcatactgtattccacagtggctgcaccattttacattcccaccagcagtgggaacctttaacaaaggttccaatttttccacatctccaccaacacttattaaattgtttttttagtaatagccaagtgtcttagtctgttttgtatgtgataacagaataccacagactgagtaacttataatgaacagaaatttatttcttagagttctggaggctgagaagtctaatatcaaggcatgggcatctgtgagggccctcttgctttgtcataatatgatggaaggcatcacatggtggaaaggaaaagagacggtgagagagagagtaagagggacaaaaccatgccctaaataacaaacacacccctgcaataacgacattagtccattcatgaggacagagccataatgacccaaacacctcttaaaggcgccaccccaataacattacattgacaattaaatttcatcatgagttttgaaggggacattcaaaccatagaccgtcctaatagatatgaagtagatatgcatactagatatgcatttccctaaaaattagaaatgtgttgagaatcttttcatgtgcttattggtcatttgtatatcttctttagagaaacatctttttaagtcttttgcccattttcaagttgggttgacatttgttactgagttttaagagttatttatatgttctggatattacttccttatcaaatatatgatttacaaatatttcctctcattctgtgggttgccttttcactctgttgatagtgtcatttgatgcacaaaatttgcttttaattgatgaaatataatttttttcttgtcttgcctgggcttttagagtcacatccaataaatcatagccagatcaaatgtcaagaagcatttcctctgttttcttctgagagttttatagttttacctcttatgtttaggtctctgatctattttgagtttgtgtttgtatatgataagggtccagcttcactttttttgcatgtggatatccagttttaccagcaccatttgtagaagagactccctttccccatttgactgttccttgtcacgcttgttgaaaaccgtttgaccatatatgcaggggtttatttccgaggtctctgttctattccattggtctgtatgtctgcctttttgtcattaccattgttttgattattatagttttggaatcagaaagtgtgagccttctcaactttgctctttgtttctaggattgttttggctatttgtggtcccttgagatttcatatgtattttggaatggatttttctatttcagaaaaaaaaaaccaaaaaataccatcatcaggattttcataggggttgcactaaatctgaagattgctttgtatagtattgacagtttaaaaatactaaatttttccaatccataaacacaagtgtctttccatttattttatatctttaattttttttagcagttttgtagttttcagtgtacaagtctttcacctccttagtttattcctaagtattttattctttttgatgctattacaaatgatattgttttcttaatttccttttcagattattcattgttagtgtatagaaatacaactgagttttgtatgttgattttgtaacctgccacttaactgaattcatttattagttctaagagatttttgcatgtgtgtgtatatgtgggatccttagggttttctaaataaaagatcatgtcatctgcaaacagagcgaattttatttcttcctttctaatttgaatttctttttcttacctaattgctctgattagaactttcagtcctatgtcagatagaagtggcaaacatggacaccctgtcttgttcctgatcttagggaaaaagccttcattcatttaacattgagtatgatgttagctgtgggtttttaatatatggcctttattatgttgaggaagtttccttccatttcaggtcaactctaaagcatttatttttattaatccctcttttttttttttttttttttttttttgagacagagtctcgctgtgttgccagactggagtgcagtggctgtgtctcggctcactgcaacctccgcctcccgggttcaagcgattctcctgcctcagcctcccaagtagctgggattacaggcacgcactaccacacccagctaatttttgttttttttttttttagtagagacggggtgtcaccatgttggccaggatggtctcgaactcctgacctcgtgatccgcctgcctcggcctcccaaagtgctgggattacaggcgtgagccactgtgcccggctaatccctctatcttttaattttaattagaatcacattggatttatagactaattttgagaaaatagtacagataaatttgcatgttgaaccacagaatgttgtcacagaaaatgtgagtggggaggaagaagaaagattatgacattaaatgtaagtttataaatttttatgatactactttgagaaacattaatatagtttataaggaaaattatattttaagggattttctacaaaggtgaaaaaaaatcaccctatgagtttaaaggattttaagctttatatttaattctttccttcttttattaatttaatctatatttcttcttttttcctaggatatcctaaacctgaggaaggaatacttgacagtttgggttggtatagctatcatgacaaatataagtggtagtatgtgtagaaacgtgtaggtaattagtttttatgaggtgcccaaacataggatccttggtagggtaagataactttcttaaatgctgtgtttgtatgtaggttaaaatatataaaacacaattttctttccacattatattgttattttgtgatggtaatctgtcgataaattttctttctattcatatcttatatacatgaaccttaaagcaatctaagttgggtttattttttctgtaacacgctgatttaacacacttgatgtaggcttacgcagtttacacaatgcatgttaaaaaaaaagatgaagtgcagttgtgatataggccaatgaaaaataaagatttcttaataagtaaaaacaaaaatctattacctttcatttcttagactagtttggtaatggttaatcattttatataatgcaccttaggcttgttttttagtatttgccttacctccaaaatctgtggtccaagtaaatctgttgccatcttaaactgttaaacacttgataactgtttatgagatgagaagagcagagttgaacatagcactttatgctttgacttatagcaatttaataaaagtaatggcagtttagaagcaaaggtactagggacagaaacagttctaaaaattaagattttataggattattttgtgttctctagatagtcaaaaatgtattctcaaatttctctgtatattttttatccatgtgccctggtgtttcatttattatgggaatcctattggtatttaggactatgtcttaattttggggcagggcagagtatggaagtagagaggatgggaaggggattgataagataaagtattgtttgtgaagactttgtaaataccatctgggcaatagaataatagaaatttatttatgactcactctacagatcacttttggaggaaaaaatacaaattaaatgtctaccaaaataagaaatgacagaatgactgttgaactaaaccaactctcatgggataatacttttcaaaaatcattttcctttactatagtgaattctaattactctaataactttaccgctaaataacctgatgtggtagctatagagaaaaacagtgaaaaatgaggttcccattaagagtttcacaagtggaacccttaacctggaaactggttagaagggttctatgatcaaaatgacctggatgccctagcagtcatgctaaaactatataaaaaatttttttttcctctgtagtcttgtattagtccattctcaatgctgttgtaaggaacagtctgagaccgggtaatttataaaggaaagagatttaactgactcagttctgcagggctgaggaggccccaggaaacttataatcatggaggaaggggaagcaaacacattcttcttcacatgatggcaggaaggagaagtatgagaaccaagtgaaggaggaagccgcttataaaaccatcagatctcgtgagaacttactatcatgagaatagcatgggggaaactgcctccatgattcaattacctctcatggggtccctcccacaacacgtggggattatgggaattgcgattcaagatgagatttgggtggggacacagccaaaccatatcaagtgtttagatgatctgattgaaataaatgctatctggagatccatgtgttcaacatcttggaactgttttctttctcagatgtttgggtcattgctgtgattgttattgccataggtaagtatcacaaattttgacaccacttaagtcaaaaaattattgtgaagacatgcattttaaaaatagtttttcagtttctatagttttttcagcttgtaaattggttaaaccgatttaggaaaacctgactttttatttgatatacttaactacctaccttgtgttagtgattttatactctgttatattctgtatatctacttagtaacaaagcctaagtaatacatattttctcaagatgatcagtaatattagttggcttcccaaatgtgcttttgatagttttctaaattaagcaaggacttttctctgacttactatggactgtgtaagtgattatggggagttggatttagatagcaaagagtctggatggaatataaatgtgtaggtgcttaaataacatttgaccactgaaatgtaaccaacatttatttcttctgctagatgttgaatcttggtgattagttttcagaattatatgtcatttgtttcctggtttcttatagttgttggagttgcagtaatttgtgttgtcccgtacagatatcttcaaaggaggaagaagaaagggtaaattaaagcatgtttcttttaacttcttggtccttcttatacttaacatgcttttgtgcagcttcagtttgtaatctgtattgcatgctatcttttttttttttttaaaaaaatgcctgcattagtttgtcctaccaattgcatttctttgctaaaaatattttcagctacttctaacatcactgcaacataaaaacatctgtgcagagttcctacagctattatgactttaagaaaaatttcttttggatttgaggtttaagttatttagcaaatcatggaccactcactatgaggccttctctaccctattccctatttccaaaattgcactaatggccaaaattaaatttaaagtatttcactgtggagactttgacagttgtattcactggaatttttataatgaaagtttccacttgtctatatagcttagctagttgcaagaagctatgtaggcatatcatttaaatacccaatttggtgtcttttcatttaaagttgttatttatacatgttaaactgggggattcaaaacaacactatccgatttccctcttatgttctctgaatttaccagattgcagtaaaactgatagggttaaagttaaaattgctgagaggggttagatctataaggtacctcaattaactgtgtcttttaatatataaaaatgtaaaaagtgagtgggtttagaatagaagaaaaatgtacaagtacatatcttctaaagaaaatagggttttaaaacatcaaactcaaattttagttaaagagcttacagtttaacaaaagacttagaatgaatcctggaacacagactaagattaggtgctttgaaatttctgaaagataatatacattcatttttactgatttttaaaaactgttttcccctatagttttagaaatagctttgaaatcaaacctaataattttaagacttttggtactcatggttttatgatatatattccttttatactgatcatcaggtttgggctaagtcataaaagtacaagctttactcataaggaactcaaacttttttcatattacttggttatcttttgaaatacccataatcccttcacttgaatcttaaatcttgtattaatggaacacgatatgcatatttgatttatctatcagttgtatattctaaaagttacatatctacaacgtgagtacaaaatattatcaatggaatatttttacaaatccataaggtttgcgtagaaacaagttctaaagaaaacaaaacaaagtcgcattctgcttattttccttctttgtttaaaatatcactgcatcagaatttttaaaggttcattaacaagtattaatcaaactctctctagctagcagttaatggtttttctgttgttgttttttgcttttttgtgatggagtcttgctctgtcacccaggctggagtgcaatggcgcaatcttggctcgctgcaaccttggcctcctgggttcaagggattctctgcctcagcctcacgagtagctgggattacagtcgtgcaccaccaccaccggctaatttgttgtacctgtactagagatggggtttcaccatgttggtcaggctggtcttgaactcctgacctcaggtaatccgcccacctcggcctcccaaggtgctaggattacaggcatgagccaccgcgcccggccttaatgggtcttttaaagctcaacagttatctgactgttacactcccaaatgaaaggttcaatagcagtagtgaactgagattccaaaattaatttgtccagtgatttttttttaaagcccatattttacagcatagggtccaactgacagttgccattattaaaattttaaaatattttgggaaggtatgatatctttagccaatgcaacataattaatcctgcaaatagtagcacaacttgaggaaaaatagtccagaaaatggtgtgagagacgaaactcctaattgcctttgaactttaaaatataaactgcgtgggaatcttttagaatagatgttaccctttttatgacaggaacatactcgattggaaattcagcatatgtaatggctgaatccaaagctaggctctctttatggatctattattttgtagttccatgttattttgatagctgaactgaatgtgagggtggtttatctttcttcttcagagtctagaggaatgtttctctgactttaatgtgcacattagtcacctggaaatctgttaaagtacagattctgattcattgggtttggggtggagcctgagaccctgcctgtctagtgagctcccagtgctgatgctgctgctgtgcctgggctacactgaccagggtgttgcccactactgatgtgcctatattgttgaagtctgaagaaacactatgaagcttattggcaaatttttctaatatttaagataattgaagtttttaagattcctcatccatgtgtatccttaaaaaaaggctatggggtaataaatagtacttggcttttcttaccttctttaactcttaaaaaacaaagatttccagccgggcctggtggctcacgcctgtaatcccagcactttgggaggccgaggcgggcagatcacgaggtcaggagatcaagaccatcctggctaacacggtgaaaccccgtctctactaaaaatacaaaaaaaaaaaaaaaaaaatagtggcgggcgcctgtagtcccagctactctgggaggctgaggcaggagaatggcgtgaaccccggaggcggagcttgcagtgagcgagattgcgccactgcactccagcctgggtgacggagtgagactccatctcaaaaacaaaaaacacaaaaaaaccccaaagatttccattattttctttgcactgtttaatgtccataatcttgtccccccagattggctgttgtggccttagaaacttcttataaagactataaaatgtctggaggcacttctccacttccgggggtaactggaagcaggctagcaggcacaaataatctcaaattgttgttaaagcctggcacaaaatgtatttcttgtaaactggtatttatggtgatttgggaacgtaattactcttctgcagccttcatctcaaaatacaaaaatagtgtaaggagtcattttaagatcatccaacatcatttacattacttgataaaaagtgggcaaaaggttaaagtattctgccacttttctgtttcatagctctcagctgagaacagtataggataccagtgggtccgaaacaggtcccatccacatgctccctccttttcccttcccatttcctttctttactaattcttctaccatactttttagtcttggaagccacagccctgtctttgctactgcttcagtcctgtattgcatggcatgactgtgcttctgaacaacagatgccttttgtttacataaatatttaagtaatggttttttttaaatgcatgattattttttaactctagttaagcatccctggataagtgacagtttggctaagttagtgaaagttatttacataatttatatatttattacctgtgacaaatagtttttccttttttccattaatggtatttattattttgtataacctaaactgacttttaatgttacattaatattgactgacccaattactttattaaaaatagtggtcagttcaggtaattggggcatatagtgacatggggcaaaaaaaggatcaaattaacttaaatgtttttctagttggcccttaaattcttgagcatttaacccttcaaaaatttttgagcaactacaaaaatgttttgtaattagtttagaaagcatccttacaaaattagatccatctcagaaatatgagacgccatgtaatacaaagttttgcaacgatgtctcctcaggttgaaaacagatgtgccacaggaagacacttcttaatgtaaaagtccagagacatctgaaaatacatgatgtcataaagttgatttctagataatattacatggatttgatacatactcaatgtattccctcaaaattgagggtgttaggccgggtttggtggctcacgcctgtaatcccagcaactttgtgaggccgaggcaggccgatggcttgagctcaggagtttgagatcagcctgggcaacatagtgagatgctgtgtcttgaaaaaaaaaaaaaaaaaaaaaaaaaaaatcaagagtgctagagaccggtaccatttctccccaacaatctgttattccttgaaaacattttgacatgaatcacttcatgcaaaatggcttcaaagataaacatattaaacaggaatttccagtctgtttatctgctggatgatctatatgacttcaaagttcaagtagcttctagcacaaaattcatgtttccagtccttcagtgagaatgagaaagtcttaagttatgaacctaattctcagctttcctgctactctcttacactggattttatcccacttgttatgctactcgtttctttttggtttgaagtcactattttattcagccgttttctcttcctctgttcagcacatacctaactgatgagacccacagagaagtaaaatttacttctctctgagaaggagagatgagagaaaggtttgcttttatcattaaaaggtatctgttttctgttgtttattttcagatgtcctttcttttgaaaaatattcagtggatatatagatatcaataacctgagcaaagagatattggcagtaaatatcaaagaggaaatttacattcctgttccctttgctaaattattgatgtgttcttataccattccctttgaaaacataatgtgtactgacaggctttgacgtaggctttaaatagagttatgttcccctagtccttttatcagacgatctcacttctaccttgtaaaacagctgtgaatccaaaagtaagaatttgtgagccaactgggaaataaccacagaatcaactcattttaagtgcaaggaggaaaaatgcccttttatagaaaccaaaatatattttacttagttttgtaaatttattcaattccaacgtataaataactctgtaaagacattttatcagtttccctgggctgggatatttttagcatatcaaaggaaaacaaaaaagtcctcagattttgaaaagtaatggattgcattgccttaaacccttggaccctgtccaccttctgtctttgaactgaactggaattattcctctgtttgtgctagaatgtgtgtccgcagagctgggaagagatggagatacatatcccacctcttataatgtgaggccctaacctaggttataattaaaagtttgggagcaggatctacaaaggccagctggaaggacaatttcttagtaaaagcaaagtgatgtctttggttacaggaggaaagggaaagacaaaacataccaaccagaattggcggtctgggcctacccagtcctatatacagtagttccttcttatccacgggggatacattccaaaacctctagtggttgcctgaaacctgggagagtactaaaccttatatatactgttttctcttaagcatgtatacctatgatcattcaatttataaattaggcacagtaggagattaacagcaataactaataactaataatatcaattataaaaatatgccagcatcactactcttgtgctctgaggccactaagtaaaataagggttacctaaccacaggtactgtgataccgtgacagtcaatctgataaccaagacagctattgagtaacaggcacatagtgtccacagcatgggtatgctggacgaagggatgatttatatcccgggagggatggagtgggacagtgtgagatttcatcatgatactcagaatggcacacaatctaaaacgtagttctgtaattttccatttaatatttttgaccgtatttgactatgggtaactgaaaccgtgcaaagtgaaaccgtggataagggaagcctactatatcttcttagtctcttaggacacttttgagactaaagccaactaggaaaatagtttttagactctctctgagcttcagggtatctgtaaacatttgaagataatttaatgaatgctgtagttaatattttgccatcttcaaaatagcttcattgttatatccaataaatgtttctttaaatttatgttaatgccttttatctttggcatagattggatttttatttaaaactttatttaaagaaagagattctactactatgggaaaaaaatatttacttagaaaaatatagtggtggccagtcctggtggctcacacctataatcccagcactttgggaggccgaggcgggcggatcacttaaggtttgagaccaggttggccaaaatggtgaaaccctgtttctactaaaaatacaaacattagctgggcatggtggtgcacacctgtaatcctagctactcaggaggctgaggcacaagaattgcttgaacctgggaggaggaggttgcaagtgagccaagatcacaccacactgcactccagcctgggtgacagagcaagactctgtctcaaaggaaaaaaaataaagaaaagaaaagaaaaatatagtggtcttggagaattcagtgacaggccaaaccattaagtctgtcatcacaacagtccttagggaactgcaatattataagtatagtaatgacgcagtagagaaccataatgatggcctccccggcaaagaagaaccaacccgtttacgcctgaggttgcaattttttgaatttttgcagtcagaccctggcgatgaccttgagcagtaggagataaattccacatgcttagcgttccagtaatggaacactaggcataaatgggttattaaagtatccagaattaacatgcttagctgtgacattggaaaggcaatgtgtttgctgtggcacacatactagtaaataatgactggtccgaatttggttttcgtttgtctattaaagtcaatttactaaggcagggagggcccagagctgtgctgtccagttcaatagccatgcgtgactgctaaggacttccaaagtggctagtccaatgtcaggtatgctgcaagtgtcaaacacacactggatttcaaagactaagccaaaaaaatgtaaaatacatctcaatattttggttatactcggttaaagaaaataaaattatttttgcctttttatgtttttaaaagtggcttctggaaaattttaaattacatgtatgactggcatcatctgtctttggccagcactagactagaataataggttttataaagatgtctattgttatactaaaagtgtgacgtaaactttagttatttaggagactcttagtggaatacatgattttcttgacagtgaggggtagatgaggcatcacatacttgaacagttagaaccactatctttttaaaggttctgtgccagagctacagctttaaaatggagggatcaggaaagcatgcgtttgtctccagtctttcccattggccctacatcaaaatgaggacatagttactaagtactttgtgtgctactgctctatttcttgttttggaggggatcaaaaatataagacagggataaaggaaggttttttttacagtgagaccagttgaacatttgaaattattttaaaagaataatttatttcccaggttggtggctcattactatatttttttaattgttcattttctgaataggcttctggaatttaatttctgtacttaattatatttatctttgacatgatctttataccttggtttgcaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 483 - DNA, 22811 bp, Homo sapiens
cgccggtgtcggtgtagggtgccgggggcagggggccctgcaggggcgtggagtggcattgtgctgtcacaggggctcgggcgtcttaggcacccatgtgggtggcgcactagaaggggcactgctctgtccgagtgctgcccttggggcgaggcgggcatgtggctctacaaggtggagtccaggcggccaaagtttggaaaggtagggaaggacccccccgccctccgcctgctccgccctgcccttgttctcgagaatggggagctggttcggacctagtccggggtccactgccacgccctcttccacggcgagaccacccccctagtcccaggcccacacctggggatgctccccaggcgccctgcaacccccggcattgtcctcctgccctccgggacaggactacacttcccgaggtgcttcggggtcccggggggcggcgctccacgcgggttgtggggggcgggggcggcacgtgccgccgctctcggccaatgcggagccccgcgcggaggtcacgtgcctctgtttggcgcttttgtgcgcgcccgggtctgttggtgctcagagtgtggtcaggcggctcggactgagcaggtgggtgcggggctcggaggaggcggcggctggctgaggccagcaagagggacgcggtcggcgggaggggctgggccgtggcagcgaccccctgctgcagggcggcgggcggggctgcgggcctcggaggggttggtgggcgggggtcgctccgctttgtgtgtggctcgggcggagcctcgcctttgtccccgctctccgggggcgcggctgttcgtgggcagggggctgggcgatcaccgggcgtccgctccggggtgccgtcgaggagacaatagggggcgtgggccctcgtttacctccctccctccctcccttccctgcgggccccgccgggttccccattgtctgaagggacggggcggtgccccagggaccagcggctttaggaccaaactgcgggcagccagggccgcgaccctccctgcgaccgtcccctggcgaccgcagctggtgattgaggggcggcgctcccgggccccacgagggttcttctgtcttcgcggccggacgcgcggacagcgtgggtggcggcaggttgggcatggggacggcgggaggcggtggcgagctcaccgcgggaccacccgggggcctgttcccggggcctgccccacccgctgaactgtgaagggggtggtggcggcggcctggaggtgtttttggcgggagttggggggggcgtccgcgcagggggagtcaggcaggggcggagttacccggattggaccgttagccccgcccacccctccccttcccacgcgcgcgggctccggggtgttgagttcggggagattcgaaaaggcgcggggaggaagggggcggggccaggggccggagcgcaaggcgtgctctgattggccgggggcgaccggtcctcttttcctcgcccggaccagggccacgcccatcctgggtccggtgctgcgtctaattctctgcttttcttaaatcttgtcgctgcctctgattttaattcctagcttttgggaacctgtcatcctacgtttttggtactagctggcgtctacaaaagtcataatgttaaaaagatcaacaagagatacagcatttttcatgacataacggcagcaaatataagtcaaaatctagaggttcataaacattttgcttgctgttgggcaaggaagcttaaacctgagggacaataggagttcaacattattggttactattagcttgggcgttttcttatccaccacgtcagacacagacaaagcaggggtgggtatttcatttgcacaatgagttgtaggcagtattaagatggctccgggggcactgttgagttgaatctggaatatcttcttacagtttcggtgaaatgttaaagagtttatgggggaaaaattcttcacccttgtgactttgtctgattttaaaaatccaagagttttatgaccgagaaagctcagttaacttgattttctggaaccaatatcatattcaggtcatatttcccaatgtttatttagtagattttgataatttttttcgtggttaatttagacgtctttattccacgtatttttctgacgatgtatgtagatgtgatgtgagatttttttgggttgatgacatatagaaaggcaaagaaagtgattgcatgtttttgaaaatcattttcaggactttccttatcccagttgattgtgcagaatacactgcctgtcgcttgtcttctattcaccatggcttcttctggtaggtaatctatttggaaaatctgaaattgtaatgggcttatgattttagattgagatggctcaggtcttcgcctttgatttggcacttatgttttggtcttaccaaaacctattttatgaataggagaagaatttaaaaatgattatcacttgaatgtgccgagagctcgtaattgtttattggacagtttggcttagtctgaagcaaaattgtggagtttgcacaagtcttttgtttatgaaagcgattgtcagatactgatgtctcaaaacagtatttattaatccaaaaatgttgagctttgtttttctgggagatggtttttattttttttgagacagggtctcaccttgttgcccaggctggagtgcagtggcttaattatagctcattgcagccttgacttctggagctcaagtgggctcaagcgattctcccacctcagcctccatagcatctgggactatcgacatgggccaccacacccacctaatcaaaaaaaattttttttgtagagatgggctttccctttgttgcccaggctggtctcaaacttcagggctcaagggatcttcccatgttggcctcccacggtgctgggattataggcatgagccatggtacctggccttgggaaatggtatttagataataatatcttgcctgcaaatacatcttcccctagtgtcagtagactgataggaataaaaaggggaaaaaaaacacaactttcctcatcagccctagtttaatacattaaattgatttgggttttagaaaattatagtacagtttattagaacaggagaatcctggttttctgaattataaatataatcaattctagatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaaggtaaacgaagcaattcacagaaagcaggatattaatttatgtaatgggcagatcaattttatttctataacaggaagaaaacagaattgtagctacactgtgattattacatatgccagtgactggaaggaaataccagtcctcatttattgaactcctgttacatgcccgctcctttgtttatatttttctcctttaatacatggtgttgcctcaaataatggaaattagaaacagtttcaggaatgttaagtcgtttttctgcagtcatacaactagtaagtgttggggtcagaattcaagccctggtctatcttaaaccaaagctcatgcttctctcatgcttcctctttgaaaagatttgttgccagatgattctttggcactttggttttgttttttgagagctgtacaataacattttaaattgctagtgtgattgtgttgctcagctggtatcatggtagcttttctcttatctaaacaattctattataaagtaactatctttaaaagctaatcagaagaatcaataaatattaatatgctagttgtagaaaatttgggaaatacagaaatttataaatggaaattaaaagtattcattatcccgcttccgagaagcaaccagtgttaacattttggtgtgtttctttccattcaatgttactcattaacaactgtacataacttttcatttaactccctttctcaacaaccctgataggattgattttaaagctggggcaagtgaggcacaaaaggtaaggtaataaccttccccagaccagcatagtgatttgtagtatacacacacacccgcccgaagagcctcagtgcttacactaaggagtcgtcttctatgcaatagtgtgagttcatggagtaggaggaagcaatacaaccaaaggttggacagtggaaagctttttagacatcaaccctggccctgtagtcattagcctgtgctttacatagtaactggctaaatataatgaaactcccatcatgactaggatttggcagaagagaatcaatagaaccagtgtcagatgctctgtggttatcctgcaagtcagtggttccaatgtgttttgagaacaagctgttctgttgaaggggtcataccaaggtatggtctggtaattaatgcagtttcctgagacaaaagctaataagccttttccttgaaacaaatttttctgtcttaaatagtaatctacagacttagtcttgaatttcctatcattgttttatcagttatggttaaaatttttacaatgagctagttttctttgggtagcttttgaagttaaatagtgaaattctttacaataaaagtgccactcgcaagtacatattcctcaagtcatccagataccattaagcagtaaatcttacaaggatttccttaaggactaattgggtaagatttctgaacagataagcacttttccaaagttaaatacaaatactagaaaaagaatatcattttcacagtattttatgatagggataattcaggtcctaattttggtgttatttaaagggaccttattttctgccccttttcaatccccttagtaaattatttttattgtaattttaacttatgctgaatacattttattttttgaggcagagtctctgtcacccagggtggagtgcagtggcacgatctcagttcactgcaacctccacctcccgggttcaagcaattcttctgcctcagcctcccaagtaacttagactacaggcacccgccaccacgcccggctaatttttgtatttttagtataggtaggatttcaccatgttggccaggctggtcttgaactcctgacctcaaatgatccacccaccttggcctcccaaagtgctgggattacaggcgtgagccaccacacccagcctgaatacattttagagtgcctagcctattaaacttttttttccagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggttggtttcttactttgtaaaagggttgagcttggagtttgatgcaccaatgagttggcttgaactaagtgctttgataaaaggtgtttggtgtctttttgtcatccattttggggcttaacatattaaatgaaaggtatattttaagatggaatattcagtaattcccagcataattgcacagtccttggaagtccagtaggcagcttgttaggttctacaagggacccaggagatttgatgatgatgtctcagaacttaaattgtgtggttcccacaggctgtaatatatgcactgaggttgtgttgggcctctttgaggtgggggctgggggtcgtgacttgacaggcttttttttttttttttttttttgactgatgacaccttacccttcctttacaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtagcaactcctgtgaaatgactaaagggaaccttaattatttctaaagtagcatttgactcgggtggttaaggttggcagatacgtcatcttgtatccagaggctgtaatagtccccattgtcagtgctttgcctctcaattcagggaacgcctttggcagctttcctgtgctatttgagaaatagcctaattatacatattttgtgcctctcagacatctgtataaaagctcttggaagccaagcacttatagcaaaagatgattgctaatactgcggtggggtccatgtgttgctaacgcatgtgcctctgctgcttgggctgtatcttgagattggggttttaccaaacttattcatgagaacaataacagcctacctcaacttacctcctaagattgttaggattaaatgggtttgtggcaagagagcacacttagaacatagatatttagcattccgtataaatcacgattactgttttcaaccagaggctaatgagtgatctaagtttatactcttgagttggaaattatgcagtttttatattccttaaattgacttttaaatttacttaaatgatcaatcagaggaattctgaacaaagcttggtttaaggagttacgcccatgtagggcaaataggagcaagtgcaagtatagttgaatacaacaataggttctgagcaatatctaaaccaagaggacaggatgaggcttgtgtgcagtggtgcagcacagttcatcttggctcctgtctctggcacatagcaggtgctctgggatctttaaaataccagttctgaatagatgggaatataaagagggcctgagggtagaaacttggcataatgatacgaggtgtcctacaagtggcagtgagcttttgttcatctaagacatttagggagggaaactggcctcaggagaaagcaagggaaggatcaacaggcctgaaaggatgcctcatcagttaccacccatcccatggtggccctgacttcctatcagagggcgatcctgagcccctgccttgtgacaggcttaagtcacaggaaactgaaggggatgcatcttaccacagaaatagaagctctggcttttctatttcaccttgacctttggagaagcacttagtcctgggcccccattttctcctggataaaatgagatggttgggggagatcagttaagtaactttcactcccccattctttgcatctggcttggagtgaagaggaggagcggtggcacctacgagcttctggggaagtgtctctgggtatgcattcccgggcccggcattctctgccatcacgggagtctgcgtctgtcccagtggggccagcctctcccagcagtacttccaatagattggcctaataaggccagagtggtttgacaagcagttggggctgtcaccaaggagcagactccattccttttgtcttgaatggaaaatgaggcttgtcccttcctgaggattttgtacttgggccttatggttgactgggctcagtggagagaggtttgaaggacgtgaaggaggcccttaaattaacatttgacaagcacctagattgtgctccacactggcctttgcgctagggatggagaaaagatggggtgggaccagcatatcacgtgcccatgtgaggggaaggagagctgtagaatgcttacttacctgagggtgaggctctcgaccacatacttgtactcaccagggtgctttagtgctttggtgaaaggagtgaccacagagggctttgtggtctgggaagctttgagaggagaaaggacatgagcttgtccttttggaagtcagatgaaccttccaagccaaaccccaataaagcacttaattgttaaacacttagtaagcctgtgattgccacgtgcacagagaacctgccatagttaatggcctttggcaggccctccaggcaggccccctccccatttttttattctaagcagtggaggctctttgaaggcttttgaatgtggggggctgcagtggtcagtaacaaaaccattttaaggaagagaaagtggaggcagggtgagttgactggagagtggctgccgttcaggctacggtggccatggtggctgttggggcagcacagggatgaggtgggagggcctgctgggctctggagcaatccatgtgactgacactgcactgaggaactgggacatgtgctctaaacttgggaagctggaggagaaagaaatcactccacttgggaaaatggcagtgctactatttactgagcacttaacgtccaggcatcgtgttcattttctccaccatagagaagtgaacaggcagagtaacgtacccaaggtcctaagctagtaggagaagcttacccaggcagatctgctctaagccctgcacaggaaggggggctgctctgacagctcagcatcccctcgttgcccggaacaattcccctctgcctcagacctgctcacaagtctcagcaaatgaaagccctactattcagccgttcccacctccttaaaaaggcagggcctcttatccttgcatgccttggagtgaggtctcatcccccacccccagcacctttataaaggtgctcctgtctactctgtatcattctcccagtggagaattctgattttcagtgatgttttagctgtcccggtaaacctgtgcacccagatgacagtttggctaccttactgcgaattcatttgtttgaatcactgttaaatgtggttcatttaggaatacagaagataaaggccaaattttttcttttctttttttttttttttcgagacagtcttgctctgttgcccaggctggagtgcagtggcacgatcttggctcactgcaacctccgcctccccagttcaagcgattctcctgcctcagcctcccaagtagctgggattacaggcgtgcaccaccgtgcctggctaatttttgtattcttagtagagacagggtttcaccacgttggccaggctggtcttgaactcttgacctcatgatctgcctgcctcagcctcccaaagtgctggcattacaggcatgagccaccgcgcctggcaaggccaagtttcttatagaaaagcttccccctttggatggaggttggacttagatgccctagaagttcccttccaaatccaagactgattctctacagggttggattgcagaccacctgagatcagagaccatgtcatagacacagagctgaactccaaggacccagacacattgctggtgagccaagtctcttgacacttgcctcctccctttttgcccaggtgaaacgaaggtccaaaatgtccctgtggctgaggcctctgccagcagaagctggtattctgtacttaagggcgtaggaaagggtttctgacttgtttcgtacatgcacttagatttttaaaacttagttgtagggtttgatgagctccaaaatgcagcagcttcatggaagggctctggttcatagttagaaaggcctggcctgcttccatcgtggccaagagcagagcagtacctgcccagtccttgggcaccatatcctactgagacaagtaggctgctgaaattggatccataggaagaaaaaacagacaggaaatgagccagctacctcatagcagccatctcagcagaaaaggactgagcctctcctgggcctggagcttccaatccctgtggcctcctgctcccctcactggcagaaagccccagtattcactgggatggggaagtccccatgctaagcctagcctcccctcttccctgctctcacagctctctatttaatagcagcaactaataattatttgcattgtctcagtgaatccccagaacagccctatgaggttatcatggccattccataggcgagaagtaaggcaactggacctagattaggggatttacctaaaatgacaactagcaagcagtagagtcaggactcaaacccagacttttaacccccatgctgtactgcaactcctcatgtatcacaagtgttactcattaattcaagtgtctccccagctagaacacagggtccctgaaaacagggactcctcctgtcacattcaccactggatctcctggctcgtggtgggaggttaatgtgctggattaaataatgatgagtgggtgggtgactcccacggtctacctcagggcactggctttgtcctcatcctttgcggaccccatgtggagtaaacccgattttctagaagcaaatgaagggtctgcaccagctttgcagatggctctgaggtgcacaatccttaatggaatcctcctggatccgaacgcacaaactggtggcctgcagccaatgttgaaccataggcatgttgcattcagcccatgctgtgttttaaattgttgaattagctgacaattccatgtgaaaatctgatttcaagcttatcttgaaaaaagctgacagatctggcaaccctgggcttgcagtcccacccagcggccgtcagcggactctgggcagttgctgcccccttgaggcgggacttgtgttctgcagctctccatccccttgggcccacccacttctgtctttcgctggatccgccctgcccctgctggaggcccagcatttgcagtccctgacacagagactagtaactccatcactccaagtcagccaaactgttttttagatcaaaagtccagtcagtataaaaggacgtgtaatagcctgtaatcccagcactttgggagaccgaggcgggcagatcacgaggtcaggaaattgagaccatcctggctaacacggtgaaaccccgtctctactaaaaatacaaaaacaagattagccgggcgtggtggcgggtgcctgtagtcccagctactcgggaggctgaggcaggagaatggtatgaacccgggaggtagaggttgcagtgagcatagatcacgccaccgcactccagtctgggcaacagagcgatactgtgtctcaaaaaaaaaaaaaaaaaaaaagacgtataataaaagtgaatctccctccctcccaggtcacctagctgtctcccgtgtctccttccagagatgtactgtacctctaagcccagtcaccaaacacttgctggcacctctatgggccagacaccagctgggtatcaggatcacatggtactttttcaaaatatgagactcaggaccctcagacctttggaggtagaatttctaaaattggagccagcctgttgctgggtgtggtggtacacacctgtaatcccagcactttgggaggccgaggagggaggatcacttgaggccaggagttagagaccagccttatttatttagagacatagcaagattctgtctctaaataattaaaaaatgaaagtaaataaaaaaataaaattggagccccagtgtctagaatttttttcagacagggtctctctctttgtcacccaggccggagtgcagtggtgcaaacacagctcactgcagcctcaacatccttggctcaagcaatcctccaacctcaatttccagagtagcttggactataggtgcatgccacaatggccggctaattttcgtattttttgtagagacaagatttcaccatgttgcccaggccggtctcgaactcctgagctcaagcaatccaccagcctcaacttcccagagtgctgcgattacaggcatgggccatcgtgtctggcctagatttttttttttaagccagcgtttctgttgctcacctaggcagagacccctcaggatgcaacatctaaacaccattgccatctctccagtccccaacagcctggtggagatgggcctgcagctgcacccatcacagcccctgctcacagtgtgcagactgtaccctgcacaggagatcccactgaggagatgtggggcctgaaatccagtcataccctacaaccaaggcacacagtacattccctcatcttcccaggaacaggcaccacttcctaatttaccatgttacccattcaatacaaatacagggagacctgtgctctcctctgctgtgggacacagataggggctcctcaggatgcaggcccaggatgaattcctgtaggagataatgcttgggtcaagtttggtttagggaatagaagcaaagaagtcacctctctactttttacctccccaatccaggctaccccaccccatgactccctgtggttatcagggacatcaccattctcctggccactgacagggacactttaataacagtacacattggccaggcgcagtggctcacacctgtcatcccagcactttgggaggccaaggtgggcggatcacctgaggtcaggagtttgagaccggcttggccaacatggtgaaaccccgtctctgctaaaaatacaaaaattagccaggcgtgatggcgggtgcctgtaatcccagctgcttgggaggctgaggcaagagaatggcttgaacctaggaggcggaggttgcagtgagccgagttcacaccatcgcagtccagcctggtcaacaagaacaagactgtgtctcaaaaaaataaataaaaaccactgtacatcaacaaggcccttggggacagctggggcataagtaggtgtcagccatacatcagagcagtgtgcctgccctgagctgcttggggttgaccagcctggtgtccagaaatgcctgctggagggagtcgtggtacaggaaccttgtgctcttagaaggtctcctgagaggccctgtaaagccagagtccctcttagcagctcagatcagtgctatcaaagtatagctcggggattgctgccagcatacaaacttttactggtctgcagcgagataagtacagaaattgaaagtaagcatttagaaacttttataacaattttacaaggtcttgtcaaatgttattaaaacaaagctgaggctggaatttcacctttttcatttcgtttttttcaatttaaacaaattgtagtaaaatatagataatataaatgtaccattttagccatttttgagcgtacaatttagtagcagtaagtgctttcacaatattgtgtaaccactagtattatatagtatatatttttaaaattttacagaagtattaagttagcagcagattaaacatttttttcttaaattgagcttgagaagcgctggcctaaatggtaacctgtggggaagccttgatggtttggaggctcctaattgagtccattgcttggcttttttccccaaatcacggagtggagttaggtcccagagaatggtgttggctgaggcccaggctcccacccgggctagaaaactgggcagatgggcaccacccttgaagggaggccagccaggcactgcaaagcctggggtagtgctgtcccgtgtgcccgggccaggaaggctagatgagaggcccgggggcgtttggtttagaggcccagcaggctttccttctgactcagtgtagggaggcggttgtttagaatctcaagaatctcagctccagctgggaggggaccctcagcggctcagcggctcagccgtggtggcatctaccctccctgtttaaagaaggaatctgaggtaagagagaaagaactggttcaagcttgcaaccagttagtgatgtagtagtgatggtctcaaatacaggccttttaattcctaggcagaggcagggcagagattttatttaaaaaaaaaaaaaaaaaaaaaagtcttgctctgtctcccaggctggaatgcagtggcgcaatctcggctcactgcaacctccgcctcctgggtttaagcaattcttctgcctcagcctcccaagtagctgggattgcaggcaccccaccaccatgcccagctaatttttgtatttttagtagagacgaggttttgccatgttggccaggctagtctcgaactcgacctcaggtgattcgcccacctcggcctcccgaagtgctgggattacaggcgtgagccacagcacctggcctaatttatttttaattttaatttttaaatttttctcagactttagtgagcataagaatgggcagagatttttagagtcacacagaatagtattccggttctggctctaagagcttttcagggggcttgggcacccataccctcatctgtaaactgcagagaccccctcgcaggctgcatgagtattgagcccagtgctgaaatgcccagcacagggctggcccctccctgcccagtgttcctcctgccagcttcatgggtctccccagcctgccatttccccctcattgtgtgtgttggtggtggggggtggcggggtgcagatgaaggcagatcctcttccccagaatgaggagagcagggggctcacagcctgctgcactggcccacctccacagccctgtccccactggccgcctctctgtacttgcctctgccaactctctgggtctttggcctttctttccaagatgcagaacgtttgtaaaacgaaggggttggaccagaagaactcagaagtccattttgagaaggggaagctaaagttcagatgccttaaagttctgtgtcttttctaggaggtccaaactcccagcatatctgactgggctgcccccaggggactgggacatctgcttttgtgtcacctggctccatcatttctccctcctctcttttctttctcttacatgactgaagttgtttgagctcttaaacaatttgccgtgcattgtataggcattttacataatccatctgaattttttttttttttttaagatggagttttgctcttgttgcccaagctggagtgcaatggcatgatctcggctcactgcaacctctgcctcctgggttcaagcaattatcctgccttagcctcctgcagctgggattacaggtgcctgccaccatgcccggcaaatttttgtatttttagtagagatggggtttcaccatgttggtcaggctggtcttgaactcctgacctcaggtgatccagccacctcggcctcccaaagtgctgggattacagacatgagctgctgtgcccggccccgattgaatccttaaaacaaccttgtgaagtaaatactattcttttttatcccattttatagatgaggaaactgaggttcagagagggtcaggtcactcatccactgctaattagaggcagagccagcaggctgcttgctctctcaatgccattttccagatggcgggggtcccattctggcttgaattcatggggctcaatatggcagtgcctgtgctcacctcttctttccagttttttccaaatggtctctgactcagtccctggatacgctcgcctagcaggatctcctgggctgctgggtgtgtcccgtagaccctggccgacctacggatgaaatgagtagtcagacaggtatgcagtgtaacagcagctagatgactacctggctctagtggccagagagcagccccgagaagctggggctgcttgcttttattccgtgcaggcacaatgccggaaacctggagccaacacaacctgtaggtaattaacatttattcttcccctttcagggaacttcatgtgcagataatcaaaggtcagtttctggtcaacataagtaaacaagcctgtttaagataaattcccccacactcccttgtacctactccttgccctctgcctcagggttatggaacagctgccttcagctgttctctcctggagctttgcagagccctctgacctttcagaaggcctgctccttttccctgtagtttctcccaccactctgactgatctcctacactgggcaatcagggaagagggctgggatgttagtccagtttcggacatacctcatgtgttgcgtccccttccccaagctccttcttctgctttctctttagatcttcaagagctagaaggttccctaagagaccacccgaaacaagcctctccatccacgtattcattgaatgaatacacctccagtcctcctacttaccaggcagtgttaggtcctgaggatacagcgatggacaaggcagacaaggtctctgcccttgtttacatcctggggggagaagacagactataaaagagattaggatgagtgctgtgaggatgaaaagggtgatataacagacaatgactgtgggcaggtgcagtgtgttcctggcaaagggaactgctagtgccaaggcctgatggcaggaactagcaggtgtgaggaaggagcctaagtgaggccctcttggctggatgaggtgggcaaggggaccccatacaaggaggtgctcagggtccagctgtgtagcctggggccagggcgagggtttggttatagtctgcatgatgcagttttgaagggctttaaggggggagtgatgtgatcagattacatgtgtaaagaattcttcagccaccaggaggagaatggacggtaaggagagccggagtgcacaagggagagagatgagagtggcttggacagtgaggtggagggtcatggttagattcaggatctaggtcatggtgaagataacaggagctgttggactggatgtgggcatgcagtgagggctgactcttgggcttttcccttggggagctgagtgaaggggggtgccatctactcaaacaagcctggagaaggagtaggtgtggggggatggatggaggggaacaatggtttcatttggccatcatggcagaccttgctggctgctctcccaggactgagtctctcctcccttataacagaaacctgaaaagtgttttattttgttgtttttgttgtttgaaatgaaaggtctcacatatttattactgaacccagccaaccaacgcattcataacagattcagagaggaaaaatgtattcccaataaaacatgtctaactgcagataacggtgacattttcagcttgatatggtaatgtgattgtgaccttcagacagcataaatgtgtgtgccatctcatgtggaattccttatagacccagcttggttctcctccgatgtctccttttggagttgtacctgattttattgccagttttcatcctaatccactggagaatggaacgattttgcttttgtttcttgaccaggaagtcttgtgagaagacatggcaagaagcggagtcaagcacacaccacgatggcagagaaagggagagaggggccattgtttttgttgttgttaagtagtcacctgtctggctccttgtaccttttgcccttttcccatcctcctttttcctggaacagagacgtgatacctagaagtacagcagccatcttgtgatcatcagggtaaaagtcacatgatggctgggacagggagatggatagatcgtgggtccttgataatatcattgagctgacataccagtctaggcaagttgatcattttacttgtttaagccactgtttttgagccaccacacctggcccattgtggcttttcattgcttgctgctgaatgaagtcatagctgatggagtcatgttgagttcaagatttttggaggagggacgtgggtctagggaaggaggatgaggttaccccatacactgagctagtcaacccagagttcagtcgtttattcattcaagaaatatttattgaggacctactatgcaccagcactatcccaggtgccgagaatttagcagcaaataaagcaaggattctcacccttgaggagtttgcattctgctgtaatcaagaagccagcctgacttatgggcaattgcatttcatttaatcccaagggtggtggggtatgaggtgtgaacaggtgatggtggtcgggcatggcatgtctattcccacagccctcctcacccactcgtgatgttagcaaatcaaaatagtcaacatgtttcttcagtgttttctaggagccaagcactgtgctgtgttctacctctgacggaggtgttctgattatccccatgttataggaaggttaagaaagcagctctagtcacacagctaaccagcggttgtgctagatttaaacccagggctttctgactccagaaattcactgacccccctcccacccctgggcaacctctttaaaaaacaacaacaacaacaacaacaagggccgggcacggtggctcacgcctgtaatcccagcactttgggaggccgaggtgggtggatcacgaagtcaagagatcgagaccatcctggccaaaatggcgaaaccccgtctctattaaaaatacaaaaattagccaggcatgatggcacatgcctgtagtcccagctactcaggaggctgacgcaggagaaccacttgaactcgggaggcggaggttacagtgagccaagattgcgccattacagtccagcctggcgacagagcgagactccatctcaaaaaaacaaaacaaaacaaaaaaaccccaaaaaacacatctttattgtctagaaatctatattttcaaaatcccccagaaaagatgctgttctctcacttcccccattttcttccttttcttccatacctctactataaaggacatttttataccatattaaaacttcacccagatgtccagacagctccccacctatgtatttctcttatttgcaagctgcatgttcatgtagccatctaagatgccagatagcccttgtactccattccccactttgtttcagcatcaccggctttcctgttaacccactgaggaaagcttcgggattgaggggtagacttaccgtaactatgggcaaatgctgcaggctcctggacaacctcttggccccttttcctgtacccctttttgtcattgtttaacaaaccacttcctgatttcccctttctccttgctttggaaagggacaatgtctcttgttcattcctgtggtccaggcacctgaacgaaggcctggcaaccttcattcctccatcccactttttaagaagctttctctatgctgagtgctgggaatatagacaagtcacagaacaagacacacaacccaggagggaaacaggtaattaacaggtgtcacagtataatgggtctggtaggataatcagagggacctacctttccttggtacaggaaagggcatccaagtcagaacagggtggtggggaccggtcaacgagggctgcctggaggagttgacacctgagctgagtcccagatgagaagcaggagttgagcagataaataaaagcagtggggccaggcacggtggctcatgcctgtaatcccagcactttgggagaccgaggcaggcagatcacgagttcaagagatcgaaacgatcctgtccatggtgaaaccccatctctcctcaaaatacaaaaatattagctaggtgtggtggcaggcatctgtagtcccagctactcaggaggctgaggcaggagaatctcttgaacctgggaggcggaggttgcagtgagctgagatcacacgactgcattccagcctgggcaacagagtgagactccatcccccaccaaaaaaaaaaaaaaaaaaaaaagtggtgggggtgttccagacaaagggagcagcacatggagggtggagagaggcgagatggcagcatgtgagcatggctggactgtggatgcaggtgcactcgtctcccactaaggagtcccgcctaagcatcctagaaatctggggccagaaggatcttaatcatcaacaaatccaacctcctccttttccaaatgaagcccagagaggggaagccatttttccaaggtcacatagaaagctaatgatggagaatagactcaaacttgctgcactgcctgagttttggattttctttttttccttccattccttccctctgcccttccctcccactgtcctccaattcatatttgtcacatgcctactttgcaccagcccagtaccctgacctccttgccttagaaccttaggcttccagagcctaggtcatcaccacctcttcctatcaaacctcctccccacaccccgttcctgcctgacctttcctactcgttaaaaatccagatgcctaggttgcttcccataccaacaagatcagaatgtctgggggtgggggccaggtgtcagtattttttaaagatccctggatgattccatttgtagcaaagtttgagaaccactgttttagccctgatgaagggcccctccacctcctgtcccttggcctctgggttgcagatgacctggtgatttttctttttcttccagatgtacttctggactcacgggcctggggcccacccagcacagatctctgctgagcaatcttgtctccactctgttcctgccctttgcccagccctgggcctccaatctgcattgattacctggtctgatctctctcaccatcactaggtacttaataaatatttgctgttgatgatagcaatgaccttgagactgatgaacagtctggccaagaggatccttgatgtggaagatagaaaaagcctttggggtcaggcagacttggattctaataccagccagttctgcttgctgtgtctgagcctcagtttactcatctgtgaagaggaggtagcaagaatgaaaatgcctgccttgtggtttgttgtaaggacagacactgccaacgtagagggcccagcagctcacagaccagttgctctgagagcagaccactcttgccttgatggtagggaactatttttgtgcgtggcaagtgggaccttaggaaggaaggcaactgtgaggcttctgagaaggaccctacacaagggagtttcctcccagggcaggtgaatggagagggtggcagaagcctacgggaaggggtcacagggatcagctagagagtgccaccacccttcctggggaatgcagggcaaggtccctggtgggagttttcctgggaagccaaagaagcgcccaacaaagacagaatcaacatttgggtacctttggtacccagaggcagcaatgccaactacaaccacactggaagaagaagaccttctccgcatagattctctgatctcttcctccttcatggcaccagccctggggaaccagcatggtggggaaataatgaagctggaatacaaccacttacagacttcacaacctcctcctgtagataccaaagggattttaggatcacattttatttctcacctgagcaagaaaagctacaggagcatctcaagcagagggcaggagtctccagaggagttcaaggggctctggcaagaaaaatcaaggggctgtgttcaagaactggctcccttggtgattgtattacgaagcccatgtgtgctggatgctgatgaaattgctgccaaatgcctgtgcagccttggcaaggccctttatttctctgggtctccatttctctctctcttttttttttttttttttttttgaggcagagtctcactctgtcgcccaggctggagggcagtggcgtgatctcggctcactgcaagccccaccttctgagttcacgccattctactgcctcagcctcccgagtagctgggactacaggcgcccaccaccacgcccggcttattttttgtatttttagtagagacggggtttcaccgcattagccaagatggtctcgatctcctgacctcgtgattcacccacctcagcctcccaaagtgctgggattacaggcatgagccactgcgcccggcctgggtctccgtttctctagctgtgaaatgactgttctaaaagagccctgccggactttggcagtctgtaagaagacctgagttcttctctcagttccaagcaggaaaattgaacataccctgagcccagagcctgcaacaaactctgggcagcctcaggaagtcaggcagtgaagtcggaaaaatgatctcttctgtatagggagaaaataaaagtttaaaaatttgtagtttg

SEQ ID NO: 484 - DNA, 69235 bp, Homo sapiens
ctggggagccggcgctggaggtggtgagtggcgtggggactgtgtcgagggggtccccaaggtgccggaccctgcggaggggcgaagtttcggcactggggagggcgtgcggacgctttccctacaggcgaccactgctctgcgggcgggtggtcttagctccagtcccccattcagttcctcagcattccaggtcggcggcgaaggggtccccgaacgaagggcgcaaggcagcgtctctgctgggaccgggaagccggacttcagggcctctcggcccgtgggcttctccccgagtctccccgagtcggttggcattaagaggtaattcttagtcatagcccctggtaatgactagcagagaaagaacagaatcaccggatgttttggtttggattgtgcttattttccttgtattccttccagtcctctttaaaatctgatggcgaaactcctcaaacagaaaccgtattgatttgtgcaaatcgcaaatggtttttagttgcaagagaatttccagaatcttctttttgcctttaaattcatttcataacaggaaaattctgtattttgagttgaaacgttgatgggagatgcttataagctgacgaattttttttgtaatgactgttatttatgtaaaaatttaaaagcctcatttaaaaatgaacttccattaatttgttcctcgctagcaataatctttgcaatagtttgaaccagtgtcattttacaggttagaacccggcatgcaaatttaaagtcttgtttacatccttgtaaggagttggatacaaagctgactaaaagccaggtctcttagctgtcactgctgttccctttctttaaaacgttaatacctgatagatattgttgctgtatatttacatacacctctgtctaatttgttgtcttactgctaaagggcaggttgtctgtttatctaatcttgcatggtttttctcaacacaattaatttacagtacttatcgtacttactgcctgtggtacttgggaataatctgcctcgtgacaccaatcaattcaatcttctctataggcattcctgtattcaacatacatgggccggacgcggtggctcacgcctgtaatcccagcactttgggaggccgaggcgggcggatcacaaggtcaagatatcgagaccatcctggccaacatggtgaaaccccgtctctactaaaaatacaaaaattagctgggcatggtggtgggcgcctgtagtcccagctacttgggaggctaaggcaggagatttgcttgaatacaggaggaggaggttgcagcaagccaaggtcgtgccactgcactccagcctggtgacagagcaagactccatctcaaaaaaaatatttttataaaaataaaataaaataaaccttcttatggaacattggcaaaaaaaaaaaatacgtgtagcaggtatttataaaaatactttgctccacactctgatttaggtgctagggtttcctttagtccttcccattccccacactggaagtacttgaaaatctatgttggcatgcactttttacatcttctaagtcacttgacacatttggcctgatatatggcttatcagtatatttcttctagactaaagaaatgggaattgtattcttgtctttgaagtctacagtatctatcagagggcctggcactaatggaaacttagtcaatatttgttgaataatgatggtaagttctctgagagacttgcctgaagttgcttggaagcagtatctgagctgcagattgtgatctattgtaatgtatgcctctgggaatttacttacacaatgggatgttctctctatatttttaaagcttgtttgtagtctgtgtgatctaaatcttttttttttcttttagtttagcagatactttcagaaatggatacataagaaatggctggaaatcaaatgaatgtccaaagaagagcttagggtcttagtaacattcttttttaaaataactgtctgccaaaatgtcattacacagtactcataatagaaataacagcggtgatattcttgatattccttcttcccaaaatagttcatcactgaatgccctcacccacagtagccgacttaagctgcatttgaagtcggatatgtcagaatgtgaaaatgatgatccattattgagatctgcaggtaaagtcagagacataaatagaacttatgttatttctgccagtagaaaaacagcagacatgccccttacccctaatcctgtaggtagattggcacttcagaggagaactacaaggaacaaagaatcatctttgcttgttagtgagttggaagacacaactgaaaaaacagcagaaacacgtcttacattacaacgtcgtgctaaaacagattctgcagaaaagtggaaaacagctgaaatagattctgtcaaaatgacactgaatgtgggaggtgaaacagaaaataatggtgtttctaaggaaagtagaacaaatgtaaggattgtaaataatgctaaaaactcttttgttgcctcttctgtacctttagatgaagatccacaggtcattgaaatgatggctgataagaaatacaaagaaacattttctgcccccagtagagcaaatgaaaatgttgcacttaagtactcaagtaatagaccacccattgcttccctgagtcagactgaagttgttagatcaggacacttgacaacgaaacctactcagagcaagttggatatcaaagtgttgggaacaggaaacttgtatcatagaagtattgggaaggaaattgcaaaaacttcaaataaatttgggagcttagaaaaaagaacacctacaaaatgtacaacagaacacaaactgacaacaaagtgcagcctgcctcagcttaagagcccagctccatcaatactgaagaatagaatgtctaaccttcaagttaaacaaagaccaaaaagttcctttcttgcaaataaacaggaaagatccgcagaaaatacaattcttcccgaagaagaaactgtagttcagaacacctctgcaggaaaagaccccttaaaagtagagaatagtcaagtgacagtggcagtacgcgtaagacctttcaccaagaggtatgtgatgccttttaaaatctaaagccaagcagttacatgtaaggtacctttaattcctctctgcctttggaaggtcagtgtattcgtgcatcttcaaacttgttggcaatacttttatatagaaagaacttttaggtctagttgtagtgtgtgttgataatttttgatcactgactataaaattaaaaaattgaatcaccatattttgtatattgaagtttctctagatatattgcttttaaaaagtctgaataagtcacttaggtctctaatgaaatctgctttcagatctgcaatatatgctggaatgttatacctatcccttaaaaagagccataacaggccaggtgtggtgggtcacgcctgtaatcccattgctttgggaggtcaaggcaggcagatcacttgaggccaggggtttgagaccagcctggccaatatggtgataccctgtctctactaaaaatacaaaaattagctgggcatggtgttgcacacctgtaatcccagctactcgggaggctgaggcaggagaatcacttgaacccgggaggcagaggctgcattgagctgacatcaggccactgcactccagcctgggcgacagaacgagactgtctcaaaaaaaagaagagccataacaaattactggttccctaaagaggtcctttcaaaaccctttccagagtggtgattatcatcatcattgtctccgattactatatagtagttataaatgcagtgatacattagatttgattttgatggcaaaaaatctctctctaaaagtggttgtgggtggggaagacacagattaaagataaggttggaaaagatggacatgacaaaatgtgaatgtgacaaaatgtaattgttttaaaatattttaatgtagttgtttaaaatattttaagggacagtgaaaaacttcacagagttagtagtgtttaacttgaagctgtgtatctaagcaagttagaagaggatttggtgaccactgcatcagggcaggaacctccagtttgaacctaaggggtcagtagttaaaggcaagttatacagtactgtagaatctttttcgtgcaaatgggttagtattaagagggagaactgagggtgagttggtttgagagaattggaatgtctaatagagcctcaagaaccatgataggaagagaaacaatagaaagagctggtagggacaaaatgcaagatggatgactatactgaacttagtaagggaccaagtgcctgattccaaactcatcagacaagccttgaaagcagggccagggtagagtacttgtcaaattgatgaggcaggtgttttttccagaataaattctgatttaaagcagtctcagagtcagggatggagcggggagggagtgtatatctggagccagacaaagagtgatgatgtttttctgtagatctaaagtaaatgaaagatttccacctaagtctcaaagggaaaaaggatatacagaaagattcatgattttaagggagagaatctagaggaaggaggagagatctttagtagccaagagagacttatgattgaaacttacagtcaactgagtttgttaaaattagatatttgtattttatgccagctttatttagattggtacccccccaaatttgtataataaagatgtagatttggatgaagagtataggtagattatagtaggtgggatgggaaaaggtatagttcaagagaaaaaaaaaagaggaaaaaatcttgtaaaagtaggataggttttctggaggaatctgggattttccctttggtggcactggagcctcaggaaatatattttggaaacccactagaattatgtttgcttatctgcattttccacataaaactacagaattatcttgccttggaagattgtttaaatagttttgaggtatttattatgttctgtgagaataatacccttgatcattttagttacttgatttttttctttgtgcttctttcaagagagaagattgaaaaagcatcccaggtagtcttcatgagtgggaaagaaataactgtggaacaccctgacacgaaacaagtttataattttatttatgatgtttcattctggtcttttgatgaatgtcatcctcactacgctagccagacaactgtctatgagaagctagcagcaccactcctagaaagagccttcgaaggcttcaatacctgtctttttgcttatggtcagactggctctggaaaatcatatacgtaagttgtattggaaatgcaattatccagaagtgtttaaatatacttttgtgagaagtggcataggggtgatagaaagaatatagttttgaaatcacacagatcttggcccaaatctcatccattttatataccagttctgcaaacttgggcaatttacttagcctctgggcttcagtttatacatttaccttgatacaattcatcttgtaattatcattggccccattttactgtactttatatattttacataaactaaggcctagagaggttatcttttaagtattttggtgagaattaaaagtaaggcatctaagctagatgtgatggcacacacctgtagtctcagctacttgggaagctgaggtaggaggattgcttaagtgcaggagttcgagtccagcctgggcaacttagtccccatctcttaagaaaaaagggtggaggggcatctgataaatggtagctatgataataatacctgtcctagaaagaaatactcagcattttaacagtagctaacatttgagttcttttttttttttttttttttttttttttgtagcaaggtttgttgtgaagagcgaaagaacagagcttccacagtccacagcgtggaggggtcccaagcgggttgcccaacatttgagttcttactatattccagacactgtgctaaagactttgcttatattctttcacaacaattctctgaattagatagttgtattattcctgttttacagtagaggaaattgaagtttagtgaggttaaatatcttggagtcaagatttggactcaggcagatttgactccagagtccagattcttaattatgagattcagtgaacttgcttcctactcccttcccagcctatttccccaaaaagaattttaaagaaagaattagttttatttcccccttattcataatgtatttttcaggatgatgggatttagtgaagaaccaggaataattccaagattttgtgaagatcttttttctcaagtagccagaaaacaaacccaagaggtatgttcttataatacctgcaagcttcttttcagagtagaaaatagtcaaatcaagttcaaatcagtcatggccactaaggaaatacttaatggaagatcagttctaatttgtagatcactcttctttggaacagtggtatggagagggagggtggaaattctaaattcagaatcagtttcacctagtgggcagtgatagtgaagtcatctcttctgtcttttctcccttgtttttgctttacttttgtgtatacgtagaggctcacaaacatggtagctatgtgctgttatacgtgtgtttgtagtcagataggtgtacagtttaactaaggacagcaggcataaccttttggacaacgtgaatcagaaagagtagtgaaattgggatttgaacccagagttgacttcaaaagccatgctttttccactctactacacctgaataggctgtactggcttcctatttcacttattcatttacacattcagctaccttttactgagcattctgctgttgccaggcagcttgttagatcagtttttttttttctcaaattttcttggtcataagaatcaccggggattcttggcagggacatatatgtgcatgtgtatgtgtatgtacacacttgctaaaaatctcttctgggggttctgagtcagttggtctggtgtagagcttgggattttataattttcatgcttttcctccagtattttttatgataaaggaaattgggaaaattgtgctagattaggggtgtggagttaaaagacccagtccctgtattcaaaggagtgtagtgggagaaataagttaacagccaagtacaatcaattaaatgctaaacaaactaaagtagatgctctaatagaacatgtaagtgaggacatataaagttggagggagacattctctcagaggaaggagcagctgagcttatttttgaaggatacatagcattattagcttggtaaagaaggggagaaggatattccagggagagggagcagcatgtaccaagatttgaaagcaaaaaagtagggagcctttgggaatctataaattgttcactgtgttttgagcatggaatttgagggtggaaagtgataagagaagaaactagaggctgggtgcggtggctcatgcctgtaatcccagtactttgggaggccgaagcgggcagatcacctgaggtcaggagttcgagaccagcctggccaacatggtgaaatcctgtctctactaaaaatacaaaaattagccaggtgtggtggcacatgcctgtaatcccatctacttgggaggctgaggcaggagaatcgcttgaaccagggagatggaggttgcagtgagccgagatcgcgccactgcactccagcctgggtgacagagcatgactccatctcaaaaaaaaaaaaaaaaaaaaaaaagagaataaactagaaaggcctgcagaacttggctcatgaaggactgtcttagtaaggataactggtaagacttgctgattattggaaatggaggatgagggagagagaaatcaatgtttctggttggacaaccagattagatatcgatgtcattttttgagatcacaagaggaaaagtagatttgagtaattgatgagttctgtctcttctgtggatatactgcctctcctctgtcttcttctaccctcaacctctcattcccagtaattaaattgaaaataggaggagtatggggatcaatagaaatatggtggtattgagactatgagatgaaatatgattcaagtccaagtttagtgggcataagagaaagctgtgggcttgtggggcagagttctctattggctctccagattttagagggatagtaatttgaaggtaaagccaggaagacatagataagtgtagtggaggcaaaggtctttggaatgatttcaaaggactaggaggctcagattttgcgtggaatgactatgtcattgaataacatagtgtaatgaatgcttaagagcctggttggccaggcatggtggctcacgcctgtaatcccagcactttgggaggccaaggcaggcggatcacctgaggtcaggagtttgagaccagcctggccaacatggtgaatccctgtctctactaagaatacaaaaattagccaggtgtggtggtgggcgcctgtaatcctagctattcgggaggctgaggtaggagaatcgcttgaaccctggaggcggacattgcactgagctgagatcatgccactgtactccagcctgggcgacagagcaagactctgtctcaaaaaaaagaaaaaaaaaaagagcatggactttggagatacattatttgaatttgaatctcagcttcatcactgcagtagaaatgtgatcttgaacaatttacttaatgtctttctgtgtttcagaacagaaaatagagattatattgacaatgtctttctcataggtttgttgtgagcattaaatgagttgatctatacaaaaggttttgaagagtgcctggcacatagtgagcccaactaaatgtggttatatcaactttggaattagccaggatggtagagaataatagtatgtggatgggggtaatagaaggtggtatagcgagcatgatggcaggagcctcagaggagaagaaaaaagtaggacctctccagtgtggccccagctaccttttccaatttgtttcccacactacattttcatttctaagtcctcctggagcctctataacataaaatactattttacataaaataagcattattacgtgtttattgaattctgacagcccccatccctgttcatagcatttgtcaatgaccttataattacttggtgttcccttatacctggtctctttggaagtgttttgtttctctctcatgacaccagctatattctgccttgtattactcatgtactgtattgcatctccaattagcttctgagttttttcaggataaaaactatgtccagttcatctcatattttcccacagctcctagaagagtgctttgtacctagtagggcacaataaatatttggtgaattgaacttaaatctctttgacactcccttgaagcttccaattctgttagatgcttgctgactcacttctgggtcagtggatgaaatttatttctctaataaggaaaccatgccctaactgtcagaagagctgtttggaagcaaagtttcccgtttttggcctctacactgtatctttcagagtcaaaaggaggagaagctcagcccacttaatctaatgattgctttctctcccaatcaggaagaattgttgatttaaggttccatcttaccagatcaaatgtcaacctacagggtgtctttcctattctgagcacatgtgatgcacagatgctgctgtccttgcccgagaatgccctaccccctctttctggttcaatctactctgtctctcatgcctcacattctatttactccttcccttttctctggccatcctaaattttcccttttctgattagtcatatttatagtcatctcattttgattcttaattaattttctattgctgtgttttatctattggaaggtatgttatatgtctctgagatcttagcctcatgagcaagaatcttgtcttatacttctttatgtcctgacaataacctaaagccaaacatgcagtaggtaggtacttaagaaatgcttattggattgaattgaaccttatgcagaagttaagaagaaatgcaaggacttttgttgttattcatattaaatttttttttttttttttttttgagaggaagtctcgctctgtcacccaggctggagtgcagtggcgcgatcttggctcactgcaagctctgcctcccgggttcatgccattcttctgcctcagcctcctgagtagctgggactacagatacccgccaccacgcccggctaattttttgtattttgtattttgtatttttgtattttagtttcaccgtgttagccaggatggtctcgatcccctgacctcgtaatccacctgccttggcctcccagagtgctaggattacaggcgtgagccaccgcgcccagccaaaattttttttattgagatcaaattcacataacatcaaattaaccactttaaagtatataattcagtggcattcagtacatttataatgtacaactgttacttctagtgccaaaaaattttcattgccatcaaaggggaccctctacccattaagcagtcacaatccattcccccttcttcccaatccctggcaactactagtttgcttttgttctatgaatttacctgttctggaaatttcatataaatggaatcatgcaatatgtggtattttgtgtctggcttctttcacttagcataatgtgttgaggttcatctacattgtagcacatacagtacttcattccttttaatggttgactaatatttcattgtacagatattgccagttttgtttatccattcatcagttgatggacatttgggttgttgtttataccttttggctattgtgaatagtccttctgtgaacactggtgcatgtttttgtttgaatacctgttctcaattgttttggatgtataggagtggaatttccaaatttctatggtgattctttttcttttttgagatggagtctcactctgtcgcctaggctggagtgcagtagcacaatctcagctcactgcaacctccacctcccaggttcaagcgattctcctgcctcagcctcccgagtacctgggattacaggcgcccggcaccatgcccagctaatttttgtatttttagtagaggtgtggtttcaccatgttggccaggctgttcttgaactcctgacctcaaatgatcctcccacctcggcctcccaaagtgctgggattacaggtgtgagccactgtgcccggcccggtaattctatttttaacctttcaaggaactgtcaactattttccacattggccgcaccattttacatccactagcaatggaggagggttccagtttctccacatcctcacccacactggttggttttcacttcttattattactgccatcctagtgggtgtgaagttgtttttcattgtgattttgatttgcatttccctactgagaaatgatgttgagcatcttttcatgtgcttgtttgccatttgtacgttcttctttggagaaatgtctattcaagtcctttgtgcattttaaaattgggctgtttgtctttatgttgttgagttgtaggatatttttatatatttatatattttggatactagttcctaaccacagatatgatttgcaaaacatcaaaataaattatatgctgtgtttctattcctactaggtcagctatcacattgaaatgagcttctttgaagtatataatgaaaaaattcacgaccttctggtttgtaaagatgaaaatgggcagagaaagcaaccagtaagattaaaacaatttattatttgttttgaatttctgttcttataaatgtatctaattatttgagttctctggatggtatagcttaaagttttactagaattatatgaaagcaaatgcttggatctacagtccaattagattatttagaaaataagcagagcactggccgggcatggtggctcactcctgtaatcccagcactttgggaggctgaggggggcagactgccagagctcaggagttcaagaccagcctggacaacacagtgaaaccctgtctctactaaaatacaaaaaattagccgggtgtggcggattgcacctatagtcccagcttctccagaggctgaggcaggagaattgcttgaacctgggaggcaggttgcagtgagccgagatcaagccactgtactccagcctgggcgacagagtgagacttcgtctccaaaaaaaaaaaaaagaaaagaagcggaacattatcactagtagaaattaaattagttatcagatttaacctctttattttaatgaagaattgtataaaactaaagataaaatatttgttctgagatttagttggaccatgtaagttgaacaccagatccctaatagtctataagccaaaacatagtaaaactttttaaaattatatttttattatagaatatgtatttcagtggattatttagcaaattcataccttgtagataatctgtgaaatagaaagtttcacaattatataatcttttttaaaaactgctattcaaatttaaaatttttaattttgcaatggaccttggagcacaataaacaaaaatctaaagaagacggctgggcgtgttggctcacacctgtaatcacagcactttgggaggtcaaggcaggtggatcactaggtcaagagatggagaccatcctggccaacatggtgaaaccctgtctctactaaaaatacaaaaattagcttggcatggtggcgcgtgcctgtagtcccagctactcaggaggctgatgcaggagaatcgcttgaacccgggggcagaggtttcagtgagccgagatttcaccaccgcactccagcctggcgacagagcaagactccatttcaagaaaaaaaaggaagtcagctgtcttcttcacttgcccatgtttgtgcagtttactattggcaacatcaagaaacttaaacaaaacttgacatttgcttctatgatttctatatgtttaaagcttctggtcacaaagttgaaaatgtataatgtaacaataaagaaaaattttaatgtctgaaatttaacgaatatgttttagagagcatttaaaagtatataaatcatagctactgcaagatttaacattcaaatgtcttactgaaaaactaggaagacaagctgggtacggtggctgacgcctgcaatcccagtactttgggaggctgaggtgggcggatcacttgaggtcaggagttcccgaccagcctagccaacatggtgaaactccttctctactgaaaatacaaaagttagctggtgtggtggcactgtcttgtaatctcagctactcagaaggccgaggtaggagaatcgcttgaacccaggaggcagaggttgcactgagccaagattgcaccactgtactccagcctgggccacagagcaggactctgtctcaaaacagacaaacaaacaaacaaaaaactagtaagacatctgatgctaaaatatattgttctaattattgtctattagacaattctaatagcagttttttaagaataaaaaaactagtaagacttgatgctacaatatattgttgcatattgtgctactatgaacagttttttatattgaagctgtttcctaatgccttacagatttgtttttgtgagagtttttgtggtttttttttttcctggataaaataaagacaaatctcttaccttaaactcaagatgtagaaaaagtgatcatttcaagttacatgaaatatttgtcatactcctaatgatgcatgtatttgcttcttctagctgagagtgagggaacatcctgtttatggaccatatgttgaagcactgtcaatgtaagtatttggctcagcaagggcaaagaggataaaacaaatgaatagagtgaatgttactctcccataatctttattgtattctcattggccttcctaactttgaaaccctgggtaactatttatttagccttctacccttgatattgtccaattaggttttccctctctttccatagagtgttagttacttgttttaatacttgcatgtgtctttcatagtacctgtaaagtgtctgccatggagtattcattatactatgaagtaaatatttgctttttctttcttttaccccttcctttcactattaatttaatcttccctctcaacctgctttttatacctatgactctaagctagacagggaagagggtactaagaagagttaagagtttgatgcatgctaggagtcatttacttttttttccaacactgcaaatgctttcttaaaggaaaggaaaagttattaagtattaactcagctgcatttaatacatctgggattgtattgggacccatatacacccacatataaatatacctatgcatatacatatgtgttaaagtatatcttttggtattgtgacttagacttgaatattaagatgctaaggtgcttcattgtattaagaaaaatcatactttttgttaaaattaaagcattattttatttcctgtccttcaagaatggggaaaataaaagattctgggagaatcaataaaataatattcatgaattagtccattgtgatcttcagcgtaaatatgtaattgaaatgttattgttttatgagaacaagagtataatcatcagtaaaattgattttgtcttttcacttcttaaaaataggaacattgtcagttcttacgctgatatccaggtaagattgattttgttttcttttcactagatagaaagagcataatcctaaatatttataagaatattttttcttaattgctgttttacaaataaaaggttagtttccttaatttatcacaaaccgattttgttaagttttaatcaaaataattgctcttctttattaaaaatgttgaccttcatgtaagcttagagttatggaaacagccttttaaagttattatttcctgcctcagatttctatgacagaaaaaaaggcaatgggaatacaaattattaaaagataaatatttactcatttcattttataaattaattacaaatgtgtatatgttatctctcttaatttttatatcattgagttacagtctgctgatctgaattacaaatgtgtatatgttgtctctcttaatttttatatcattgagttacagtctgctgatctgatcttccttccttttttcttataagagttggctagaattgggaaataaacaaagagctactgctgctactggtatgaatgataaaagttcccgatctcattcagttttcaccctggtgatgacccagaccaaggtattttttttaaaagttcccgatctctttcagttttcaccctggtgataacccagaccaaggtatttttttaaaaagttcccgatctcattcagttttcaccctggtgatcacccagaccaaggtattttttttccacaggcaagatagtaaatacatttaagtttcatgtttttcttattgtcttctttaaatcaaaaggtaaaagtacagtcatataaatatataaacttaatttgattgtaggaaatatgccttagtttcaatgacttttggtcaatgaccaaatgacttatggcagtataccgtttaccagatttttaaatcaataatagatgcttgttatcatgataacattgatatgatcatatcaatatatgatagtatattttcatatatagtaattatgcagagtatttagaaaaacatcagaaagtaaaagattttttaaaatttagccataggttccaccattcagataaacccctctaaacattttggtatatagtctttcaatttttttaccatcacaattaaattcacttaaaatcacactgttaaaatctgtaacaattttatgttattaaaatttttataaaataatttttaatagctatataatattccattaactattacagttcctcaagtttttctctactgttggacatttatattatttttaaatgttttgctattataatgctgggataagcaacatctttgtgcattaaactttttctttatttattgttatttccttaatataactgagtggttatggattttaatctctttgaagtaatttatttaattttggcataatctatccactgctcaatatattcttttcagtagaccgtgtgaatatttttgtgttataaattatcacagattcatgaagggatgatcttaggccaggtgcagtggctcacgcctgtaatcccagcactttaggaggccgaggcaggaggatcacttgagctcaggagtttgagactagtctgagcaacatagcgagaccttgtctgtactaaaaaataaaaaaaagtagcaggtgtagcagcatgtgcttgtagtcccagctacttgggagcctgaggtgggacaattgcttgaacgcaggagatcaaggctgcagtgagccgtgatgatgccactgtactccagcctgggcaacagagtgagaccctgtctcaaaaaaaaagaagagactatttaaaaaataaaagagtgatgtgtaatcttttacagctttccctttaaaaaaacctatattgattggaagtaatagaacttaatttaatttaatatcattttgctgtagacagaatttgtggaaggggaagaacacgatcacagaataacaagtcgaattaacctaatagatctggcaggcagtgagcgctgctctacggctcacactaatggagatcgactaaaggtaaatggaatgctttttctccttttgatgaaatttattcctgaggtcattattttaaggagaatacaaactgaatacacttaacctccccaaatatatctttatctgcagtttatagactgcattgctgtggttgaaaaagagatacgtactttttggttatgattaatttttaaagaaaatacgtttgagtcataagaaagttggtagtttatagaaaaaagtatttatagacaggcattgtggcatgtgtctgtagtcccagctacttggttcaggtgggaggattgcttgagcctggatggtcgaggctacagtgagccatgtttatgccactgcactccagcctgggcaacagagtgagactctgtctcaaaaaaaaagaaagtaaaaaagtatttactcagtaattatatgaggggagaaatatattttgtgaaataaatttcttgctgagaagtattttaagttaaaaattttttttttcttgcatgcaggaaggtgtgagtattaataagtccttgctaactttgggaaaagttatatctgcactttcggaacaagcaaaccaaaggagtgtttttattccttatcgtgaatctgttcttacatggcaagtatcttttgaagtataaagaattgtataaaatatagtgaatactatggggaaaagaatgatagactgacttcattaactttgggatggagaaaggtggtaagcattatgaattctagagccaaactacctggatttgaatctcagctcagcatcttataagctctgtgactttgggcaaattacttaatattctagcccgtttcctcatctgtaaaataggaataaaatcaataccttttaggggtaagtgagaattagattattagtgtacaattcttaatacataatatgtactatatgagtgtaaataactgttcttgtacttaactattatttgtggctgatgtttgaacatatatggtactaccaaacatattgctagttgtataaagagaagttgaataattttgtttgcttactacacagtgactaatacatgggtgctcaataaatgttttcattagtgaatgtatatttaattttcaatatgttacattcagattacatctgtatggatttaatattcagttgtgataggcattaatatacagttacaataaggactgcatctttacttgagggtaatgtgtctttataattggtttattacaatgtgattgccaccttgaaacctataagggaaaatctgatttttttcatgtcttatgaaagttaaaaatagtgacattcattctgcactaatatatgttttaagtctcatactctttttctctaaaataaagattttgcttttagtacaatatagaatttttgtttcaatgttcatcattttcaacatttattgagcacctgcttcaaaaggttgtggtagcactggaaatacaaagatgaccaagacacatagtcccttccctatggtagctcacagtcatgaaatacttgatgatccaccacattttagaatctctgcacagattattgcctcttgaaacaatataaaaagtgtaagagagaaaaagtgtttatgagatctagaaatagttacaaataccagaaaagttttaaatggtatttgagtagagtataataatactgtattatataccctattagtttgttttgtgctttctagataattactgttattaagttgttgtagaagcaaagtcttatgactttttttcttgtaggctgttaaaagaaagtctgggtggaaattcaaaaactgcaatgattgctacgattagtcccgctgccagcaacatagaagaaacattaagcacacttagatatgctaaccaagcccgtttaatagtcaacattgctaaagtaaatgaagatatgaacgctaagttaattagaggtgaatattttctcagaatttaaaaattgttttgccacagtttagtcccagatattagttgcagtcttaaaatatgtaatttatgaacatcaaaggtgtttttctatacctattttaatagattctagtcatcagcctatagtgatggaggatgataggtagaaggacagataataagtaataaggagaaaaacaattaggaaaagaacatagaaaacagagtgtgagtaagggggaaacagtaagcattaaacaataaatttacacagtcatagacgtgtgcagcaaaatgccaataaaactatttactatttttctcttatgacctctcttccattgacgttttatgtactagctctgctcatgcttagttcattgatccaaaggcaattggagctcgagtttctagtataggctgaacttcatttatgctaaatactgctttctatttatctctaggtaatcatcaatttaggatagactttaatgcctgcaagaaatcttgatttgtacagttttatctttgctgatgtagaactatcatcttttcatgcccctttgtcctctggccctttttagcagcagaaggtgatagacacttcagatgtatgagccagagaagaatctgatttgtctatcctggtccatcctttcccttttggatcccttctgtttcacaagtgggactgttttcattaaaaataagtattctgggccgggcatggtggctcatgcctataatcccagcactttgagaggctaacgcaggcggactacttaaggtcaggagttcgagaccagcctggccaacatggggaaaccctgtctctactaaaaatacaaaaattagccagacacagtggtgggcacctgtaatcctggctactcgggaagctgaggcaggagaattgcttgagcccaggaggcggaggttgcaatgagccgagatcgtaccactgcactctagacagtgagactctgtctaaataaataaataaataaatattctgaattccagcttgaaaaatctttgatcttggctgttctgcctagtgaatagccattcttttatttctttactttttaaataaactttcactttaacaattacccttttgcctctcaaaagtgttccactttggtcagtacattatacagctttcctacttatgaacagggaaagttcattaatatgggagcatatttcaggttaagactaagtaaagatttataggttatataaagtagagctgatttctccaatattctattttatttagtaatactgtatttaaaacttcaaatgaaatagaagattggaggattatgcttactgtggaaattgttatatattaaatgttattattaatgcatctttgtataaatcttcagaattgaaggcagaaattgcaaagctaaaagctgctcagagaaacagtcggaatattgaccctgaacgatacaggctctgtcggcaagaaataacatccttaagaatgaaactgcatcaacaggagagagacatggcagaaatgcaaaggtagagtacagtcagtactctaaatgttaagtgtgttgctctggaatcataggaatggcagggacctcaagaggatactgagtatttttccgaccttccttatgaatagagcagcccactcccagattatcatattttaaatattactaggtagttgcctaattttcattgattgtctcttgactctcaatcttatacatctggatgtttttaactctgttattttctttgtctttggaaagagtgtggaaagaaaagtttgaacaagctgaaaaaagaaaacttcaagaaacaaaagagttacaggtattatttcaactttctaaactgattagaaaataaaagaaatatgccaagaaataaatattgccaatatgccaatgcatgtaaatttaatgtttcaaatacttactatatactgactctgtacaaagcaataccgtaaggaaaattaatataaagaaatgttaagatcaagactggttgcttagagccagcccataaactagttggaaagttaaagtatgaataaaccatcttgttatatttactttggttctacaaatatatattaaatgtctatgcttttcaggaacaggggaagccaaggtgattaaacacagtttcatccctcagagagcttgtgatccagagagagatttacaaaacgtaaatagaagactgaaatgcaatgtgatttcagtagattgagccataagcaattgccatttttgtaggtaaagcatggttgaacactggcagtttcatatggttgaacctaatgtaatgaaaagtatttcaagtgattggtagtgggggagtactataagaattcaggagaagaagggaaaattccttgcgcatggccaatccaatctcataaaagaggtggcatttgagatgggctttgaagtttgggtaagattttaataggaagagaaaaggaagagcacattcttggaagagaaaattctctgaaagtaaaggtagaaaagtttgagttgtctttagaaagggtacgtagatcagttttactggaagcagtttatatgagatcataaggagatacaattggaaagatatgttatgattagtttatgaaggacttgatttccaggccaaggaaattaagttttatcctgtaggaagtgagaagctgttaaaaagtgaccagggaatttacattttgagagcaccctttcgagagaattaacctggcataggatataagatggattgaaaacagaagctgttgacggtgatcaagaggctgcttcagtagttttggtgtgagttgacaggggcctgtggtgaaggcaatgaagatgcaacaaaacaaactgatctattctaaagacggtcagtcaataagaagacacaatttggtgatgatagattgatgtatgagtagactgaggatggtgaaggacaaagaaggtagggaggtcacaaaggagagattctaaggaaggaggagagagtctaaaaaacctttatggccgggcacggtggctcacgcctgtaattccagcactttgggaggctgaggcgggtggatcacctgaggtcaggagttcgagaccagcctgatcaacatgacgaaaccctatctctactaaaaatacaaaaattagccgggcgtggtggcatgcgcctgtagtctcagctacttgggaggctgaagcaggagaatcgtttgaacccaggaggcagaggttgcagtgagccgagatcgtgccactgcactccagcctgggtgacacagcgagactctgtctcaaaaaaataaaaataaaaaaataaataaataacctttaatttagtgagacttcatatagaattgttttaatgtttaatatagaccatttgttttaggtgaatttaacaatttcatactgtgattaagattaatttctttttctgacttctaccagaaagcaggaattatgtttcaaatggacaatcatttaccaaaccttgttaatctgaatgaagatccacaactatctgagatgctgctatatatgataaaagaaggaacaactacagttggaaagtataaaccaaactcaagccatgatattcagttatctggggtgctgattgctgatgatcattggtatgttaatcctctaaaaaaaaagaaaaggcacctgttctatatcttgataacatgtggtttccttcatatggcatattcgttgatactgatcgtttggtagaattcttcaaacccattgtttagtcaggaaaaacatacattctgagtgtgttataaggatgataggtcagttactctcaatataaagtacagtgtaatgctctctctgtttttgttttggcatacttgatctgttgattgaagaataatttattttcttgcaattataatgatgcacatgcaagtaaactatctatcttacataacagaatttttggttggattgaccaatttaaaaatgttactttatgtgaattttgttcatatgaatggaatacttgtatatattgttggaatgatagcgtatgtaaacttttttgactctgcattgtgtttccaagatttgtgtacattggttcctgttttattttcactgctatgaagtattccattgtatgagtttatctcttataaagtttaggaagtgcttttaaattgtatgtctgagagtagagatactaggttgtagaatatgtgcatattcaactttagtagctaatttcaaattattttccaaaatgaatttttactcccattggccttgagaatacctgttactccacatcgttgccaatacttagtactgtcagactttatgccaatctgatgaacactaaatagtatatcattatggattcattttacatttctttgattaataataaggttgaacatcttttcatgtgttgattggccatttttgtttactattgtaacttgcctcttcatatcttttgttgatttttcaactgatttgcttatttcttaataatttgtaggagttgccaatctttcgtgagctttttggtataaatatctttttttctaacgtgtaacatctttttactctctctggtgcctttgattgattgaagttcttaattttattgtagtacctggcatcagtcttttcctttatgattgtcagtttttatgtcttaaagaaagaatgttctggctgggcgtggtggcttatgcctgtaatcctagcacaggtgtgtgggctcaggagtttgagtccagcctgggcaacatggtgaaaccctgtctctactaaaaatacaaaaaattttctgggcgtggtggtacctgcctgtaatcccagctactcaggaggctgaggcatgagaatcgcttgaacctaggaggtggatgttgcagtgtgccgagatcatcatgccactgtacttcagcctgagtgacagagcgagactatgtctcaaaaaaaaaaaaaaaaaaaaaaaaagagagagagagagatagagtgttctggccaggtgcggtggctcacgcctataatcctaacagtttgggaggctgaggcggcagattacttgagaccaggagttcaacatcagcctggccaacatggtgaaacctcatctctactgaaaatacaaaaattagcccggcatggtggtgggcacctatagtctcagctacttgggaggctgaggcataagaatcacttgaacctgggaggtggaagctacagtgagccaagatgactctgctatactccaccctaggcaatagagtgagactctaactcaaaaaaaaaaaaaaaaaaaaagactgttgtacattgaggtcatagagatgttctaaattttcttctagatgttttgaagttttgctttcacatttaagttattgaatgtctggaattttttatttggtgtgaattagggatctaaattcatttattttccacatgaatagccatttctcccagtaccaaatattaaatagtttattgcttcttttggaatctgtagtgctcctacaaaaaatttctaaaaatatcagaatctgtttcttcctactaataccccatggtcgtaattacttgagctttgtaatgaatctttatttatttattttttgatttcagagttttgctctgttgcccaggctggagtgtagtggcaccatctcagctcactgcaacctcctggagtcgagcaattctcctgcttcagcctcctgagtagctgggattgcagatgtctgttaccacgcctggctaattgttgtatttttagtagagatggggtttcaccatgttggccaggctggtctcaaactcccacctcaggtgatccgcccaccttgacctcccaaagtgctgggattacaggtgtgagctaccacgaccggcctgtaatgaatctttatatctttttttttttttttttttttggagatggagtctcactctatcacccaggctggagtgcagtagtgtgatcttggctcaccgtaacctccaccttctgggttcaagcgattctcgtgcctcagcctcctgagtagcagccaccatgcccagctagttttttgtatttttagtagagacgatttcatcatgttggccaggctcgtcttgaactcctgacctcaggtgatccacccaccttggcctcccaaagtactgggattacagacgtgagccactgcacctggccatgaatctttatatctgttagggcatatccttttgttctttaggttcttttgctcttttattaattaattattttctttaacaaataaatacagtattattaacatctgtggcaaagatacagaacatgctcccaaagagttaagagtccagtaaggaacttggaagcctcttgcttgcctctaactctctacttccatttttcgtaccttcctcagtttatcttgttcactagaccatgaactttatgaaagctgatttcatgtctgtcttcattgctgacacataactggctcttggaggcttaatgaataaaagaacttcatggctgaggctggtcatgtgaaagagaaaaaaagaacttcagtatctattaatgcatattaagtgttatgagtactgcatacttactgcttagaagtgaagagaaggaagagttgacttctaacttaaaccctaaagaacagcttcttagaggactctaaattgggccttcaagaatggttgcaagaagggagaggatgtcctatctggaaggaatgactcaaggaaaggaggaaagctgacattaaggcaaattcagagtattcatatggttgattaagtgtgaaatggggttcttatgggaaaatagtggcagatgagggaggttggtggttgaagccagattgtggggcgtccagaatggtaggccatggaattttgagagcagagtagatagaattaggagaggaaagggatcagaacaagtacacattgtataaaccttcacctggataagacactagactggtaggagggatgtagtgcctaagggtgaactattgtttccatgtacttttctctagatgctttaattaaactattattctctaatcacagatcttggagcctaatccacagctaaaaagatctttggttaggactcagcttttgttgcagtttttctttctatcccgttaatccaaagatgaattggactttggagtttctttcctattctctgaataaaaagactcaaatatgtagcacttatagctgattttccacagtatcaccttatcatccagtaaattagatgtcttaaggggtacactttgatctccatgtttttccttcctctgtagtaccctacttttcaaaaggggagaaatatttgttctttctgttattaaagctcatatgtaaaaccagaagcttagaaaattaaaaaaacacttaaaactgttttattcataagaaatcactggcagtatgttaatgttttttgctagtttttttttttttttttttttttttgaatttttgggggaaggtttttgttttcaaagaagttataataaaaatacacccaatgaagaatgttcccaccacaggtggatcggattgctagaggccaggcttttttcaccaaacttcaaaatctaattggaggctcgatgcagtggctcatgcctgtaatcccagcattttgggaggccgaggcaggtggatcacttgaggtcaggaattagagaccagcctggcgaacatggcaaaaccccatctctactaaaatgcaaacattagctgggcagggcatggtggtgggtgcctgtaatcctagctactcaggcagctgaggcaggagaattgcttgaacccaggaggtggagcttgcagtgagctgagattgtatcactacactccagcctgggcgacagagcaagactccgtctcaaaaaaaaaaaaaaaaaaaaactagttggaggaaaataaaataattttaaattattgttacatattggtatgaatcttaacaccaaaggaatagcccaagcagaattatcccatattgcctttttcttactttttagtgtgttctataattgttaactatgtgcttcttattttaacagtactatcaaaaattttggtgggacagtgagtattatcccagttggggaagcaaagacatatgtaaatggaaaacatattttggaaatcacagtattacgtcatgtaagtggatgggtgctataatataagaaactgttcgactttggataagtcatttaatttctttgagttctggttttctctataagataagggtgttgaagcagattaaggactttttcatttcaaaaattctttttcctattaattgctttcttgtgcaaagacaaaagttacatttatatgaatcagtacctgaagagctgaccactaatagcatcattatgtgtcctataaagagctaggctttagaatcagacagacagggttgaaatcctggctttgccatttgctctgtgacgtctggcaagttatttaactagatgattaaacaatgtcacccaagtcaggacacttttgagatcattattaataattacatcaagagaacaaacatcagcagtgtgttacaggcaaacccagacctattgtgactctatatatcctgcctttcagagatagtgaaggattaactgaaataataatttgtgtatatagttcttagaatagtatctgcaaatagtaagctctcaatgaatgtctcttgttattattaagctttgtgctgtttagtttcctcattcctaaaattgggatgattatatgtatctcactgagttgttgtgaatcgtaaatgagataacataaagtcttgcacttcataatgatgttttgggcaatgagggaccacatatgtaacagtggtcccataagattataatactgtatttttactgtatttttttctgtttagatatacaattatttaccattgtgttatagttgcctatggtattcagtacagtaacatgctgtacaggtttgtaacctaggagcaataggctatgccatatagcctaagtgtgtagtaggctataccatccaggtttgtgtaagtacattccatgatattcacacaactatgaaatcacctaacagtgtacttctcagaacatatccctgttgttaagagacatatgactatatgtgtaatgtgcttaatgcagtgtttggtatatacaaagtaataaacgttgggaggccaaggtgggtggatcatgaggtcaggagttcgagaccagcctagccaacatggtgaaaccccatctctactaaaaatgcaaaaattagctgggtgtggtggcacacgcctgtaatcccagcagctcgggaggctgaggcaggagaattgcttgaacccgtgaggccgaggttgcagtgagctgagattgtgccattgcactccagcctgggtgacatagtgagactctgtgccaaaagaaaaaaaaagtaataaatgttagttgctatgatgtttatgtttatcattaatactagactatattgaattgttgggcaaaataaattttctcatttaattttttggttgagactcacctcaagtagtacatttttttgtgtgctttagggtgatcgagtgattcttggtggagatcattattttagatttaatcatccagtagaagtccagaaaggaaaaaggccatctggaagagatactcctataagtgagggtccaaaagactttgaatttgcaaaaaatgagttgctcatggcacagagatcacagtaagtatgctgttgatatgaaatagtaagtgtatgagagagatctacaacagagttaatcacattgtgccagtctctagtaattaactctttgggtgctggtttctagtgatataattttttctcttagtacattcattagttcaccaaatatatattgaccatctattatgtgtctgtcactgtaccaaatgctggagatataaagaataaggattgaaatttagctcatgtgctgaaagaattcatcatctcgaggggctgacagttataacagtgctatgacacagttctctgacaagagtcccgaactgtgtggtgtggaagctcacggggtgacacctggccctgaccggttatcagggaaggtttctagaagatgagaagacgtcccatagaggagaatcccaatagacgattagaatttagccagaggaagactgggagagtgtacttttgtttttcttttcttcttgtgccccagttttagttcatgcagtatcgtaggatttctggcataagtagtatccttgtaagctaaatggtaaagtatatacaaataaaatgctaaagagtttggactttatcttaaaggataagggaaacattaaagaattttgagcagacgtgagacactcataatcagaattacatttttagagagatcactggcactcaaatctggagaatgcattagagatagagcaagcttaaaacctgcaaatgcagctaagagactattgaagtaaggtaaatatagtgtgattaggtaggaaggaaacataaaggagataagattgacaaggcctggtgactaaagaggatgaaaggaggaggaatcaagaactggttataggctagactaactgctttgtcaccttttaagaagcctcaacctgcttttgccctttaaaaagaatttttttaattgaatacaatataaatagcacaaaatttaccatgttagccatttttaattgtatagtccaaaggcattaagtaccttcacattgttttgtggttttttttttgtttgttttttggtttttttttgagatggagtctggctctgtcgtctaggctggagtacagttggcatgatctgggttcattgcaacttccacctcctggcctcaagccatcctcccaccttagcctcccgagcatgtgagactataggcgcacaccaccacgcctggctaatttttgaatttttttgtagagatggggtttcaccatgttgcccaggctggtctcgaactcctgagctcaagcagtccacctgccttggcctcccaaagtgctgggattacaggcgtgagtcactgtgcccaccctagtgccttcacgttgttgtgcaaccatcaccatcatccatctccagaaatgttttattattccaaactgaaactctgtatttgttaaacaatagccattctcctctctccctagctgtgatatccactaaccttcttttttatactcttattctttttttcagtaaaattgggaatggaaatttctgtataatgtagttactaaagcactgattttatttaaatgtcaggcatctgcaatagtaactaagttagaaataagcaatttttcgtcctgcgtgtttaaattttgagtgtaaacaattgtagagccagtgaaaattttaaaaacactgttgatagaatgtcagaaatcaagttttaagattgaaactttcattcaatggaaaacttttcagtaggattaagaactattatgatgtataaagaattcttaacatgtaccctataaacatcttgctacattgtagacttgaagcagaaataaaagaggctcagttgaaggcaaaggaagaaatgatgcaaggaatccagattgcaaaagaaatggctcagcaagagctttcttctcaaaaagctgcatatgaaagcaaaataaaagcactggaagcagaactggtaaaaggcagaattagttttattttttttttccgacagtgtaccccaagtgatgtgttgcctataaagttgattatgtccctataagggaactgggagagatcagagattagtgaatcaaagccacagtgagtcttggccctctttaattttactttaagaaataagtcagggctgagcatggtggctcatgcccgtaatcccagctctttaggaggccaaggcgggcagattacttgagcccaggagttcaagaccagccaggggcaatgtagggaaaccggtctctccaaaaagtttaaaacattagctgggtgtggtagcatgcgcctgtagtcccagctactcagaaggctgagctaggaggatcatctagcccagggaggtcaaggctgcagtgaaccttgacagagtgagactctgtctcaaaaaaaaaaaaaaaaaaaaaaaaaagaaaaaagttggtggcgataatagacaatggctactggaataaaaataaagagaaacttctgtcctctagccgcttgagtcatggctgtctccatggtttattggaaatcttgggttcccagaagcccattttagataatactcttaagtatttttagttaacctgaatgaagtggagaagctttaatagggcaacttttctattagtgagtaatttcttgtacattggttaaagaaagggacttttgtacttttttgctacggtttttgcctgagatattttttattattgttctttaaagagagaagagtctcaaaggaaaaaaatgcaggaaataaataaccagaaggctaatcacaaaattgaggaattagaaaaggcaaagcagcatcttgaacaggaaatatatgtcaacaaaaagcgattagaaatggaaacattggctacaaaacaggtaattttattgtgtaaccagttaactctattctgagaaaaagctggattttttttttcaaagaagtggcttatggtatgttgacagaagagagccaaatccaggtttgtagatgtgtagatgagaaaagtacttcttgcctgaaagcttatatcctggtactgctcacagatcacacagagattttgaaagtgacagagttatttccatctagttccactccagtgttctctttttatgcatctacaactatctggtcatcagtcatgccaagtaatttaaataagtgaaatagcactaggtcacatatgaggaaggaaaaaaggcacagctcttacactgggtcacatcctgatgtcacaatgaaacatctgcctgtggagagagcagcaagcatcctgtttccagaactcacagtagggcattcattacctcagtcttatgagctcaggcacctgcctgcttttatcatgtcattgaggatagaggcatctttcatgggccacctcaactaatcaatttcacaagcctaagggataaaaccagaatgttaataccttcaagcaccttactgtcagtattttgggccattctttctattagcggttcttgaagggtggtccctagaccagcaacatcaacatcaccttgggaacatgttagaaatgcaaatatttaggccgggcatggtggcttacacctgtaatcccaggactttgggaggctgaggcgggtggattacgacgttaagagatcgatgccatcctggccaacatagtgaaaccctgtctctactaaaaatacaaaaattagctgggcatggtggcacacacctgtagtcccagctactcaggaggctgaggtaggagaatctcttgaacccgagagtcagaggttgcagtgagctgagattatgccactgcactccagcctggtgacagagcaagactctgtcaaaaaaaaaaaaacaaaacaaacaaacaaacaaaaagcaaatttttaggccgcactccagaactactgaagcagaaactgagaatggggcacagaacctattttaagaagccctgtgggatgttctgatgaacactaaagtttgcaagccactgttttgattccttatatcttaatcttaaggttttactctctcaaatggcaattttatttctcttttttccaagtttgtggggtcagggaaaccagggtgggagttgggggtggaataaaatactcctagtaattgcaaagtattggtaccataatacagttattatacatctactagtcaactcctggacacaaagtggctagtgaaccacctcagagagttttaggagaaaaacatagaactgtttaaatcttgaaaaacaattatgattgttaccatttttggttttgttttattttgagacggagtttcattcttgttgcccaggctggagtgcagtggcgtgatctgggctcactgcaacctccgccttccagagattctgctgcctcagcctcccgagtagctgggattacaggtgtctgccactacgcccggctaattttttttgtatttttagtagagacggggtttcaccatgttggccaagctggtcttgaactcttgacctcatgattctcccgccttggcctcccaaagtgctgggattataggcatgagccaccgcacccggccccaaaacaattattattattgggcttataatgcttatttgtactaaactagatttcttgtatcttttaaatttaacttctttatttagtcaacaagtgttcttggatatggcctttttttttttaacagtttgtccttttttcttcttttttttctgcctttttggggttttcttatttttaatttatttttatttcaatagctttagaagtacaaattgcttttggtttcgtggatgaattatatagtggtgaagtctaggatttagtgcacctgtcacctgagtagcttacattgtacccaataggtagtttttcatttcttgccctctcccactctccctgagtcttcaatgtccattgtaccaggagtgcacacagttcacaatttaggttgcacgctccttatgagaatctaatatctgatgatctgaggtggaaccgtttcatcctgaaaccaacccctgagcccctgtccgtggaaaaattgtcttccacgaaaccagtccctggtgccaaaaggttggggaccgctgcattataccactctatatgcttttgcatacccatagcttagctgtcacttataagtgagaccatgctgatatttggttttcaattcctgagttacttcacttagaattattgcctccagttccattcaagttgctgcaaaagatattttcttttttattgctgggtagtatttcatggtgtatatatatatatatatatatatatatgtatgtatatatatatacaccatattttctttatccattcattggttgatggacacttaggttgattccatatctttgcaattgtgaattgtgctgtgataagcatacacatgcaggagtctttttgatacaatgacttcttttcctctttttttctagttttttttttaacttctatcaatgggaagaaaaaagattaatttatgtcatcaaaaattcctaataatattgttgtggggaaaaattattttgtaaggaaattttataaatcatttttaaaagcttttcatgtttaatacagcacataaaacatgttaactatataggcttaataaaacgtactgtaaaatgaggtttactgtagtgtgttatcattatcaatctgtttttttaaaataggttttattgtgtatatttaagttatacaatgttatggggtatataaattgtaaaatggttactgtagtgaagcaaattaacatatccatcatctcaatgtggtgttatagtttctctctttgcatattctcacatgtgggtctgtatgaatgaatatcaattaggctttagaagaccatagcatccgccatgcaagaattctggaagctttagaaactgaaaagcaaaaaattgctaaagaagtacaaattctacagcagaatcggaataatagggataaaacttttacaggtaagtgtgtgctgattttagcaaacattttctaaaattatgcatgttatatgtaatataattactaaaatattagcattagttgcctttacatattcaaaatactttattctagttgttgacttttctggatctaaataaatttgtatgaatggttgtttttgaatattcagcttttagaatatttattatatcaatgctttagactgaatgtttgtgttcccccaaaattaatatattgaattcataacctccaaggcagcagtgttaggaagtggaggtctttggcaggtgagtaagtcatgagggtagagccctcatagatagaattagtgcccctgtgaaagaaattgcagagagtcccctcacctcttccaccaagtgaggacatagcatgaagatggtagtctgcaacccagaacagggccctcaccagaacctgaccgacgctggaaccctgatctcagagttccagcctcctgaactgtgagcaataaattgctgttgtttataagccacccagtctggcaatttgttaatagtactgcaactgagcaaatagtaagccaaatttcaatgtgcagcatgtttttaaaaaatatatcttattctaattcttaatctttgttttatatctgttaatagttgtgcttagtcatggattacgttgttttctttttcacttagacatttttttcttaagagattttttttctagctttactgagatgtaattaacaaataaaaattatgtatatttaagatgtacaacatgatgtttttacatatattgcaaaatgattaccataatcaagctagttaacatatttatcacctcacctagttcttttttttttttttgtcatgaggacacttaggatatactctcttatttcaagtatacaatacagtattattaattataggcaactttctgttcattagacctccagagtgtattcatcctgcataactgaaactttgtaccctttgaccaacatcttcccattcccctatcctgtatttcctggtaaccatcattctactctctgtgcctatgagtttaacatttttagattccacatataagtgagatcatatagtatttatctttctatgtctggcttatttcacttttggtggtgttattagagttttctatatataagatcatgtcgtctataaactaacaattttacttcttccttctcagtttggataccttttatctctttttcttgcccagctggttttgttaggacttccagtactatgttcaatagaagtggtgagagtaggcatccttgtcatgtgcctgatcttaaaggaaaagctttcagctatttgccattgaagatgttaggtatgggcttgtcatatatagcctttattatgttgaggtacattcttctatatctaatttgttgagagtctttatcataaaaggatgttgtagtttgtcaaaggttttttgcacctattgaaatgatcatatgatttttatccttattctgttaatgtggtatatcacatttattgatttgtatatgttaaaccatccttgcatcccagtgataaaccccacttgatcatggtgtatgatccttttaatgtgctgttgaatttggtttgctagtattttgttgaagatttttggatctatgttcatcagggatattggcctgtagttttcttttcttgtagtgtctttgtctggctttagtatcagggtaatgctggccttgcaaaaggaattggaaatgttccctcctcttcagctttttggaagagtttgaaaagggttagcattaattcttctttaattgttcggtagacttcaccagtgaagccattaagtcctgtgagaccttttttttttttttttgaaacagagtcttatgtgttggcaggctggagtatggtggcacgatctcagcttactgcaacctccgcctcccgggttcaagtgattctcctgcctcagcttcccaagtagctgggagtacagtttttgtatttttagtagcgatggggtttcaccatgttggccaggatggtctctacctcctgacctcgtgatccacccacctcagcctcccaaagtgctgggtttacagttgtgagccaccggggcccggcccgactattttttttttttttaaagtctttttgttgttgttgcccaggctggaatgcagtggtgtgatcttggctcactgcagcctctgcctcccaggctcaagcgattctcctgcttcagcttcctgagtagctgggattacaggcatgcaccaccatgcccagctaagttttgtatttttagtagagacagggtttcaccatgttggccaggctggtatcaaacttctgacctcaggtgatctgcctgcctcggcttcccaaagtgctgggattacaggtgtgagccaccatgcctagccaagtcctgggagacttttgattgcactttttttggtacatttctatgtaaaacacagcatatttttaatataaacttttttattatggaaaattttaaacaaactataaaagtagagattgctgcagtaagcctttatatatttatccaacttcaatgattatcaacacatgttcaatcttgttgccgctatcctcaagctcactgcttccctggactagtttgaagcaaatcccagacaccatatcatttaaggtgtacacacttcactgtgtatctctaaattagataaggactctctttttgctctccctctctctctttctctgtcactcttttaagcattgccataactatattaataataatttcttacacatcacatatttactccatattcgtatttcctggattgtttcatcctttttttaaaaaaaaaacttgatttgtttgaatcaggataccaacatcatctacacattgcgtttggtagatgtgccttttaagtctcttttaatctgtaaattcactcttctctttcatctagtaatttgctgaagaaatcagatgatttgtcctgtagagtttttttggattctggattttgctgattgtgtctgcctggtgttacttaacaggctcctctgttccagtattccctagaaagtggtagttagatcttcaggcctatcaaattcaggttcagttttttagcaagaatacttggtaggtatgttgtgtactttctgtaacttctttaaaataacttttaaaatattaatactctttttttttttttctgagacagagtcttgctctgtcacccaggttggagtgcattggagtgcagtagcgcaatctcagctcactgcaacttctgtctcccgctttcaagcaattctcctgcctcagcctcccgagtagctgggactacaggcatccgctaccacgcctgactaatttttgtatttttagtagaaacagtgtttcaccatgatggccaggctagtttcaaactcctgacctcaggtgatccaccggccttggtctcccaaagtgctgggattacagctgtgtgccacttcacccagccaatactctttgtatctattgccaggaggcaatacttttattcttctgagggcctagacagtgccttacaatgattacttgattttttaattcatgtgaatgagtttatccttccaaaaagctatttttagtagattactggttataagtttgtctgaacaatatagaaaatatttatgataaattttttttttttgagacaaagtcttgctctgtcacacaggctggggtgcagagtgccatcatagctgactgcaacctcaaactcctgggctcaagtgatcctcttgtctcaggctctccagtagctaggactacaggtgcatgcttccttgcttggctaatttattttattttctagagatagggtgccactatattgcccaggcaagccttgaaattctggccttcaagtgatcctcctgcctcagcctcccaaaatatggggattatagacatgagctactgtgcccagtcataatcttaaattcaaattaggagctgggtgtggtggctcatgtctgtaatcccagcattttggaaggctgaggcaggtagattgcttaagcccaggagttcaagaccagcctgagcaacatggcaaaacctcctctctacaaaatataagaaagttagctgggtgtggtggcatgcacctgtagttccagctacttggaaggctgagatgggaggatcacttgagcctggggaggtcaaggctgcagtgagccatgcttgagccactgtactatatagcctaggcaacctagtgagaccctgactcaaaaaaaaaaaaaaaaaaaaaaaggaaagtgaaattgtgtactaaattattttccttttttattttaatgtcctgacatatatatatacattttttaaaatttttaggcaaaatacaaaaggacatgtttctacataagtaagactatagaatactcaatacttgaaataatttagaaatgaggaagaaagaaaaaagacattagaaaaaaaatttttttctagatattagaaagtaaagcattgtctttggcttatcttttttatatcaacttccattttcttacatcttcccacaggcaaaaacctcattttataggaaaaatgttttatttcaccaaattactcaaatatcacttatccttctgcaatatagagttaaaaccattcatttaaaatcagtgattttttttttaggaattgttttgcctaatggtatatgttagtgtccatgtatgtattttgaatcttttctgtgtgctttgtattagtgcagacaacttggagctctatgaaactctcaatgatgattcaggaagccaatgctatcagcagcaaattgaaaacatactatgtttttggcaggtgagtaattaattatcctgattttaaatgttttaaacaagttggcctttatatcatttagtttctcttttttttttttttttttctgagacagagtcttgctctgttgcccaggctggagtgcagtggcgcaatctgggctcactgcaacctccacctcccgggttcaagcaattctcctgcctcagcctcctgagtaactgggattactgggtggtgtgcgccaccacacccagctaatttctgtatttttagttagagatggggtttcaccacgttggccaggctggtttcaaactcttgacctagtgatccgcctgacttggcctctcaaagtgctgggattacaggtgtgagccactgcgcccggctatcatttagtttctctaaagtccattctacagctataggaaagagctggtatcagaatccccagaatccccagtgagactttatcctttcagaggtcattctggattaagagagatttcaacaattaacatactagtatatttataaataaaataattttagttgttttaggaatttgctaattttcttttgagttgaaaatgtatcagtatttcattgttcaaaaggaacataccttattagaaatttttgattttaaaaaatttttgttatttttatatgttttatacttatatgattattactataataaaaatacttaactgtggaaagacttaatcagtggatggaatttttagggaaattattctaccccagaaaactcttagtataaatggatgtgtatgtttcaggataagcttttttttgtttatttttctttcagacatgatatatcagataaaagtagttctgacacttctattcgggttcgtaacctgaaactaggaatctcaacattctggagtctggaaaagtttgaatctaaacttgcagcaatgaaagaactttatgaggtttggaatattattaaaatctctataaattttttaaaataaaaaagtataaaagttcaagtacctgcttttggtgaaaaaagtatatatataaaagtgacatattctccatatagaaaatttggaaaataaaaggcaatctatcaattacctaaaccaaccagtattaacaattatatatatttatttttacatttaaatggagttttattggattgttttaatacagttataggtataatagagaaatttaagggtggaatctattgtcataattgtatatttttaaaatttttacatttaagcttaaggaaagaagaaatttgatagacataaatcatattacatcatttgaaatgatcttcctatgcctaatgtacctttttgcatatttacatttctccgttgctgtgctttgagtgcttccaactgcctgctgcctgttatagtcacaactgaaaaatctctgcacatattagtttttaatatcttattttgtcatcttttattttccaaaatgaaactaaacatatgagctttttattacactttgatgctcaccgacaaattgcttgccagaaatattgccattttaccaatgttaccagtttgcattttacaaatatatatatatatatttttttgaaatggaatttcactcttgttgcccaggctggagtgcagtggtgcaatctcagctcactgcaacctccgcctcccgggttcaagcgattctcttgcctcagcctcctgaatagctgggattacaggtgcctgccaccagccccagctaatttttgtatttttttaaaaaagacgagttttcaccacgttggccaggctggtctcgaactcctgacctcgggtgatccacccgccttggcttcccaaagtgctgggattacaggcatgagccaccatgcctgggcttattattactcttttttaatagagacagagtcttgctgtgttgcccaggctggtcttgaactcctggcctcaagcagtcctctcaccttagcctcccaaagtgttgggattacaggcgtgagccattgtgtgcaacctgtactgtaataactagtaaatctagggatttcactgttgtttctttatgggtaaagtatgtgttcatttcctttgaattttctttttgttttttttgagacggaatctcactctgttgcccaggctggagtgcagtggcacaatctcggctcactgcaactccacctcctgagttcacgccattctcctgcctcagccgcctgagtagctgggactacaggtgcccaccaccatgcccggttaattttttgtgtttttagtagagacggggtttcaccatgttagccaggatggtctcgatctccagaccttgtgatccacccgccttggcctcccaaagtgctgggattacaggtgtgagccaccacgcctggctgaattttttgttaaatgaaatgtaggaaattaatatagctataaaagttatttacatattttgataagcctttatatttatcatataccttttttcctgattatatcatctttttgttggtttcattttgttatacaggcatttttaatttggcaaatttgaatccatctattattccagagatcttacttaaacattgtacaacccctgcattttcttttaattaaaaaaaaaaaagttcacatctttgaatcacatagaatttattatggtgttttgtgagaggtatgaatttaaagtttaaagttcatattatctaattatccataaattatccctaaaatagttgcaacatgtattgttgcattgctactatttgtaaaatatactacctttaaataatttgactccatatggaactatatactacttagatcattgtagtaatgaaggtatcatatggaaaaacttagaggatgctgccaaattgtagcctaacacttgaattgtttaatggaaaaatgaaaataaaaacaaaataaaacaaaggaaagcaatgaaaggaatcattatgagataaaagcaataatgaattagaaattaataaatataagctcttgttctttgaaaggataaatgtgattttagaaatgagaagtggcatttaagtaaacataaagagaacatttaaaaagtatgttacctataaaactttatgctaataaatttaacaatttcctacaaataaaagactttttagaaaaagataaattatgaaagttgacttcataggtgaataaccatgcaataatttgaaacgttcatcaacaaactggcctcgaaaaaaaaaaaacaacaaagtgtaggaaaagaaggtgctaatctcagacattcttatgggtaagctcttttaaactgccaaagaacagataaatcttattctgtttaaactattctagaacatagcaatacatagaaagtgtcacagtttatcttatgctagaataactgattaaaaacaaacaaacaaaaaccacaataactgaaaagatagctcagaagagaattaccaaccaatcttcttttttttttttctttttttctttttttgagacggagtctcactccgttgccaggctggagtgcagtggtgcgatttcggctcactgcaacctccgtctcccgggttcaagcgattctcctgcgtcagcggtctcaatctcctgaccttgtgatccactcgcctcggcctcccaaagtgctgggattacaggcgtgagccactgtgcctggcctaccaaccaatcttaatatcaacacagctataaaaatcctaaaggaaatgttagcagggctgggcacggtggctcacgcttttaatctcaacactttgggaggccaaggctggaggatcacttgagcccaggagttcaagaaccgcctgggtaacatgatttttgtttgtttgcttatttgtttgtttgttttgagacagtcttgctctgttgcccaggctggagtgcagtggcacaatcttggctcactgcaaccttcacctcccaggttcaagtgattcttgttccttggctttctgaatatctgggattacaggcatgtgccaccatgcccagctaatttttttttttttttttttgtatttttagtagagtcgggattttaccatgttggccatgctgatctcaaactcctgacctcaggtgatctgcctgcctcagcctctcaaaatgctgagattacagacatgagccaccacacccagccgaccctgtctcttttaccaaaaatctgaaaattagacagatgtggtgttgcgtgcctggagtcccagctgcttggaaggctgcggtgagaggattacctgagtctggaaggtcaaggttgccctataatcccagcactttgggaggctgagatgagaggatcacttgagcccaggagttcgataccagccttctctctacaaaagaaaaaaagagaattcttacaccatgaagaagtagggtttatgtcataaacgtgaagtatattcataatagaaaatccaaaaaggctgaaagcaatcataccaaagcattgacaatgtttatgtgaaaatgatgggtttatgagtggttttaacttttttgtttgtgtttatatgtattaataatttccaaattttctacaattaatatgaattgcttgtatttttagaacaacaaaagtagtatggaggtcatttgattattcttgccttgatatatactttaaaacctagtggttgaattaccctaggtttaacttacctcctactttttttttttttttttttgagacggagtctcgctctgtcgcccaggctggagtgcagtggcgcgatctcggctcactgcaagctccgcctcccgggttcacgccattctcttgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccttacctcctacttttaaccattcattgcagtttttaacttatttttctgtataattgtactatctctgaatcaagttctatgtagcattttgctagaactgtaattgttattacgttaaatatgtaaaatatagactgtaatcctgatcaatatattcgaccaggaagtgactacatcttaactttgtcagattattcttttatgtctctcctgaggattttattgtttatgtttttactattattataaatctcatttattattcctgaattatttaatgatttctattgtttttattaaaagtagatgtcttttaatatcatccctgtcatcgtgtgattgacttttaatttgatcaggaatgattttttagacttatcagataatatataatctgctaattttatggtttaaatgtaacaaaggatttaatcttttttttcttagttgctaaacattttttcaccccaaatttactgaaactatatattatatttttcttagagtaatggtagtaacaggggtgaagatgccttttgtgatcctgaagatgaatgggaacccgacattacagatgcaccagtttcttcactttctagaaggaggtaaagacaattttgttactagttttcttgcactttgtgtgtgcatgtgtgtgtgtgtgtgtgtgtgtaaattgtatatcatatatattatttcctattttaaaagaaccgttgtcatgatagatgtctggacaggaaacccagaactgtaagaggaataatatgttattggtcaaattacagcacttagggcattaaattgtttattagtcagttagaagagaaaccagtttttcagtgttccatcatataagtcttaagagcaacttagagtagcataaattaaattttccgtaaaaatgaacagtatttattacttttaaattattttctctggccaggtgtggtggctcatgcctgtaatcccagcactttgggaggccgaggtgggtggatcacgaggtcaggagatcgagaccatcctggctaacacggtgaaaccccgtctctaccaaaaatacaaaaaattagcccggtgtgggagcaggcacttgtactcccagctactcgggaggcttaggcaggagaatggcatgaacctgggaggcgaaacttgcagtgagctgagatcgctccactgcactccagccgctgcactccagcctgggcgacagagcgagattccgtctcaaaaaaaaaaaaaaaaaaaaaaattaccctttctcaagaacttgacatattctatgatattttcttgtaagttacagaattttaaatgcagtaaagctagtatgaactccacaaaataataaatcatagtgatagacaacttctatatatgacaaatgttgcttgttaactcaaaacataaaagacctccatagtgaataatagatgcttttcaagggaaacctagttctgcttagacctcagatgcttagattatagagaggcaaaatggtattatggaaaggctttggagccaatttagcctcatagtttggtttggtttttaagcaagtatttctttgatgactactgtctgctatgccctgaggaagcaaagatgaatacaaagtatgctctgtcctgaaagaccaggaattgaggaaagtagaggcaggagcagttgataaaaacctgaactgaggctagacagaaggattttaaatgcagtgaagaggaaagtcgagttttatacatactcaggatgcagaatcaataggatgcagagactggttgtgggactgaaggtgtgaagggtgcaaggatgactcctggttttaaattgggtgactgactaggggaaagtcgtgttgcctgagatggagcatttaagaggagtttaattttgaacatgaagaatttgagattctcaggggacatccaggtgtatatttgggtttagaactttggtggatggagctggggattttcaggatgtaagggtcaatagtatttatctgtcagcagaagcatcattgttattaagagcatttattaaatgcttactaagccttatcttacctagtacacaccacaaacctatgaagtagatattgtcattaccctcattttacagatgaagaaactgagatttagagaggttaagtgacttgtccaaagtcacagagctgttacgaggaagagccattactcaaatccaagtttgggtgactccaaagctcctgattttcttaactgctatgccgtatcgcctctccattgtatatgaaagggtagcatccttctgtttaagctaattgttttttgttttcttaaacttcattgccttcagctgcagatcaaaatccatttaggtttctaaatcattttaggcctatagccttgtttttgacttggcttattttaaactcatttatgattttcctcaaagagatgaaactattttatagcaactttcccccattatttctgctttattggtcacatggtaacctctaagctatggtaagaaattgctaatacatagcaagcattatcctgaatgaaatacaaagcatatcttttacacagaaatgagctccttgccgggcgcggtggcgggcgcctgtagtcccagctactcgggaggctgaggcaggagaatggcgtgaacccgggaggcggaggagcttgcagtgagccgagattgcgccactgcaatccggcctgggctaaacagcgggactccgtctcaaaaaaaaaaaaaaaaaaaaaaaagaaatgagctccttgagtgtagggaacgtgtctgtatccccctacaatatagcatagcaaaaaggtcacaaagtctgatatcagcatcctgggttctaatccatgctcagtgtagtcatgtacaagtgacattacatccctaggcttcaattttctcatctataaaatgaagacagtaatatatacctactttacagggatttactattaagattaagtgaggtcctatgtacagagcagctgctgctcctgctgcttctactatgaccaccatgattgacaacatcgggctgatgatggttatgttgcagagttgttacgaggattagagatagtgcatataaagctcctattacggtgggtgggcattcaataaatggcagctctgattattactggatgcttaatatatattgaataagattaaatcttagaatacagagaagctatgatttctgtccagtaccagtaacagatggtaatatcttcaagtgatttgtcttgaggacttgacagagttggcctttggcactgaagtgagctaaatatggtccttaggtgaaattgggtagatagagcttgagatatttaagccaacctagagtaacccaaaaatttaaaccagaccaataaattcatcagagaatgatttatgaatatctttggattttaggattactaggtttgtattatttttattataaacagatttaaactttgtatatttagaattgtaaatcacaatatgaccattaataatgagcattaaacgtttagcctaccggggctgggtgcagtggctcatgcttgtaatcccagcactttgggaggccaaggtgggcggatcacaaggtcaggagattgagaccatcctggctaacacggtgaaaccccgtctctactaaaaatacaaaaattagctgggcgtggtgttgggcgcctgtaatcccagctactcgggaggctgaggcaggagaatggtatgaacccaggaggcagagcttgcagtgagccaagatcgcgccactgcactccagcctgggcgatagagcgagcctccgtctcttaaaaaaaaagacttttagcctcctagatgttggtaatttacatcttattttctgttgacttttaagttaataattagggaatcagcagaaatttaaaatgttaccaaaaatcaaaacatctcaatgttttctaagatttcgaaattggatattttcatttcacagagatttttgggtacttctataatttaaaagtatcatatttttaaaaaatgaattgctcttagtctgagaccttgtatacgaagtttcagccttgtaacaatgtttatgacagaattccaaactctgagaatgcctgcaggtaatggaaacactgacagattcttaattatagaacttctactgggcaatgatatgccacagtcgttctgcaataaaatagactggtttggctgcctttaaattttgatacatactgttgacaattaaaagtaaatttccctctgaggttaagtaaaaactctttgaaaggaatatgacaagcattttacttgggtttaaacgttgtttaactatgatattgttgcaagaataactgttttcctagtttagacttgctgtaataatatactttttttcacccctaagtagaagaactgtaatatttgagaattgatatttcctttcccttttatcagtcctatttctgtgtttttcttgtaggagttcatgggggaaattttatatttgaaacatctaggctactagtgatagaatgctttggcttaataatcttttcgacaaatagtatttttctttgagtggccaactgtaatagagagttctgttaggaaaaatacttcaaaggatccactaaatttagatctagatcactgctctgttagtttcattgacataggaattggagtttgggtttagaaaatttatagatgaacggcaatatggagataggctgctttctccagtagcagaaagggtagcctccatttttaagaagcaaacagaaagaaagaaaataacagcttaggcagccaagcaaactcaaagcagaaattggggcttttttttttttttttctttttgagatggagtcttgctctgtcgcccaggctggagtgcagtggcatgatctccgctcattataagctccccctcccaggtttacgccattcttctgcctcagcctcccgagtagctgggactacagacagctgccaccacgcccggctagaaattggggcatttttataggctgaggaaaaagaggtcagcaaaaagagcaattggagatagaaacatttcttccatttgtaccactgctgcacttcacaggtattatgctttgtacacagtgtagcagatacctacttaaatgtttatttacctaaatcacttccctgtttaaaatctttccttgaaacattgagtacacatggacacaaagaagtgaataatagacactggggcctatttgaggatggtgggtgggaggaaggtgaggattgaaaaactctttaataccatcaggtattatgcctgttacctgtgtgacaaaattatctgtagaccaaacccccacagcatgaaatttacccatgtaacaaacctgcacatgtaccccttgaacctaaaatcaaagttgaaagaaaataaataaatcccaactcggccacttaaaaaaataagataaaatccttccctggataatttgctcaggataaaatctaagctttattgacatgcaaagaccacctcaagctggcccctgtgcacctcccagcttaatcccttgctactctctctcttacatcataggccacagtccttctgaacctcgtttggttcttcgcatgtacactactttcatttatcaggtcttcctgttgcttgtgtctgagacactattccctgcttcccaagcctgccctctgtttggctaagttttacttatccttgagggttactgctccaaggaggcccccctgacttcttgggccaggtcaagttcttttatacaatctaccacaacactctatgccttcatcacattcatcactttactgtaattatttgcctaatttatctcttttgttctggactttaagcctagtgagcccagaaaccatgtttgccacattttaccacaatatccagagcctgcaaatagtagtgcttaatcaatacttatttaattaactatctgcctagaacagtgcctgtaaatagtaaaattcttgctcaattaaccaaatgaatttttcctttgatgaaaatttttaatgaaaaacacacacatgaatgtccattttctttagagaacttataaatattcttaataatattattccatgtggtatagaactgctaatcttatggtttgtcttttttcaggagtaggagtttgatgaagaacagaagaatttctggttgtttacatgacatacaagtccatccaattaagaatttgcattcttcacattcatcaggtatttttttcttcacattttctctatggcgagaaaagcattgagtcctggttctaccattacattttttcttatccgtgtgcaaatcatttcatttcctggaagcttctgattcctctgtaaaatgaggaggttggatcaatgaccccttccgcttcaaaaattctgtgctctgtgatttatttcaaagccttttagtagagtaactaattcaaatgtggaagatgtgtatgttccaaaatgtatgagaatattacttccttacaagtgaaaggaagcaaagtgcagtggattatgtattttattctgtcatttgtgtgaggaggagaaaaaagaagatgtggacatagatgcttgtaaatgaataagatctctctggagaactacaccgaaaccccaaagtgctggttgtacatgggagcttggggatggagacaggacaggaaggaaggcacccttttcactgcatcccctttggtttcttctgaattttgcataatgatctgtgtatcatctatcccaaaattatttcaatttttttaaaaaaggaattattcctctgaataattattttttaccaatatttattataatgttattttaaaatgtaggaggagaggatacactgtaaattttatatgtgtaactacctgtaataattacaatttaagaattactgcctgctaggctgggcacagtagctcacgtctgtaatcctagcactttgggaggctgaggtgggtgaatcacctgaggtcgggagttcaagaccagcctgaacaacatggagaaaccctgtctctactaaaaatacaaaattagctgggtgtggtggcgcatgcctgtcatcccagctactcgagaggctgaggcgggagaatcgcttgaacctgggaggcagaggttgtggtgagctgagatagcaccattgcactccaacctgggcaacaagagtgaaactccatctcaaaaaaaaaaaaaaaaaaaaattactacctgctaacaatagactactatgcagcaataaaaaagaaggaatgactgattcacacaataacctggatgaattccagaaacataatgttgagtgaaagaagccagatccaaaagagtatatatactacatgattccttttatatgaagtttaaggacaggcaaactaaactatggtgacaaaagccagagtaggttagaactgaatagtggttacctctgttgggagttagtaaccgggaagaggaaacctgttgggatgggatggtggaaattttgtatacattgagctaagtggggtttacagatttacacatatataaatcagctgtacacttaagatatatgcactttacagtacacatattatacttagtaaacaaaaattttaaaataattatgtaacaatctatttgataaaagttctaatggaatatgagtagccataaaaggtattatatctcatcttgactttaaattttagaaattagggtttcttttaggaagataattatgatcctactacttatttaatctaaggtagattaaaatatgctgtgggttttttatttatcagcaaaataaaaagatatgtatctgtggtagcaacttatttattcggtattatctgagtaagatattttacaaaaataattttaagggaagtcagagatagaaaaggtctttgcttatttgtggttttcaaagacagtaatggaaacccacgtgtgaacttagtaggaccccgtctgggcagctgtgagtggtggaagggggaccaggcctgggggtgaggggctgtaccccagtgtctagcactttctagctttgggaagttgagcaagtatcttaacttctaaaattcagggccatatattttactgtatttttgcaggtctttctaaaatgtttctgttggattttagaatgcattaatacaattatcttcttaaatagagaatatatagttaactcttctcgatgactctactatagtcattatcatcataatgatattgagtcatcgttaccctactgtagctttgggttttgtagctttttttttttctctttacaaaccaaactcttacctttgttctagttttttaatattcctcatcctatgcctttattctacctccttttagtttgctgcttttaagcacctatgaagtagaccagaaaacttaatcttgtctattaaataagaataattatactcaatatattaggactccaggataaagttatttccagaggctctgaatgagtcaagcttctcatttatttctggtttagacagtgcttagaaaatccatccctcacagatgtgctgtattaactgtagataatcagttggttttagccttttttttttttttttagacggagtctcgctctgtctcccaggctggagtgcagtggcgcaatctcagctgcgcctcccgggttcacgccattctcctgcctcaacctcccgagtagctggggctacaggcgcctgccaccaggcccggctaattttttaaaaatatttttagtagagacggggtttcactgtgttagccaggatggtctcgatctcctgacctcgtgatccacctgcctcagcctcccaaaatgctgggattataggcgtgagccaccgtgcccggccggttttagcctatcttgattgtagtatacctcaaggagaaactattgtaaggtagaagtactgagacattatggtttttttttttttgaggacagagtttcgctctttttgcccaggctggagtgcaatggcgcgatctcggctcactgcaacctcctcccaggttcaagtgattctcctgcctcagcgtcccaggtagctggaattacaggcgcccaccaccatgcctggctgatttttcatttttagtagagacggggtttcaccgtgttggccaggctggtcttgaactcctggcctcaggtgatccacccaccttggcctcccaaagtgctgggattacaggcatgagccactgtgcccggctgagacactacttttaatgtagtttatcattgcctacttttccagtttatgaatccaattatacttctaattttatgtaactgtcattgttttcatcaattacagttctttagggaaaattaatcccaccagacatagtggtacatgcttgttgtcccacctactgtggacgctgaggccaagggattgcttgagcccaggagtttgaggctcagtgtgctatgatcacgcttgtgagtaaccactgcattccagcctgggcaacagagcaagaccctgtctgtctctcttttttttttttgagacagagtcttgttctgttgcccaggctggagtgcagtggtgccatatcggctcactgtaacctccgcctcctggcttcaagcaattctcctgcctcagcctcccgggtagctggaactacaggcgtgtgccaccacgcccagctaatttttttgtatttttaatagagatggggtttcaccacgttagccaggatggtcccgatctcctgacctcgtgatctgcctgcctcggcctcccaaagtgctgggattacaggcatgagccaccgtgcctggcccaaccctgtctcttaaaaaaaaaaaaagaaagaaagaaaagaaaattaattcctaccatagagtaaagaaagagattaacccagtggttacgtgggatatttggattctctattgtctcatagtatagtcagggagctactaaatctatggattgatgcggttgagaggttaattgatccgtgaatggaattgtgttttcactttagcatatagaaatgaggctgaattgaaataagtatagcctactttgaatttattgatcagtgatcctataatatgcttgcaataaaacatttgtttgaaagtattatgcctgaacatttttggaagagcaatagtatacgagtaatatttgcaagcagcagaggggtagtttctgcagaattagcattatggagcaccctggaaatcaacatacacaagtatagcatggaagatatacttacaagtacaacatagcatacgatgttatatatactaatagttttgtttttctaattccacagtgaacacaaaaatgctttgttgttgtaatacatttcagtaatgcagaagtacataaagtaaggatccctttttttaaaaaagaaagtattattcctgaaaacaagcttaaaatggctattttctgttgatgtaggtttaatggacaaatcaagcactatttactcaaattcagcagagtcctttcttcctggaatttgcaaagaattgattggttcttcgttagatttttttggacagagttatgatgaagaaagaactatagcagacagcctaattaatagttttcttaaaatttataatgggctatttgccatttccaaggctcatgaagaacaagatgaagaaagtcaagataactgtaagcaatctcactgcttttgttaactcacataaatgattattttctgcacattgcactttgttttgagtgattatttggcacatctggcatgcatcttttaactgtgttaaatgttttaatgatgatcatatatgagttcttttatttggataatatttcattcagtaatttttcttcttctttcaaagtgttttcttctgatcgagcaatccagtcacttactattcagactgcatgtgcttttgagcagctagtagtgctaatgaaacactggctgagtgatttactgccttgtaccaacatagcaagacttgaggatgagttgagacaagaagttaaaaaactgggaggctacttacagttatttttgcaggtaaattgatttgcttattatcatttgaaggattcatttaataattatttattggctttctactgtctatatcttccccaaaattagctctgtatgattttcaaaagtacattctgttttgaagttctgagactgtggttgtctgtaattgatttgttaaacaaagacttacatggctctctatgtatgagtagttctaagtgatttacaaatattaactcatttaatccttataacaaccccagcagtgggcactgttgttatcaccatcttgtagatgaggaaatggaggcacagggaaaataaatataccatccaatgttacctaactagtaaatgactgagttggatttggacccaggcagtcttgggcccagttcatgctctgccattataccatgctggccctcaataagggatactgggaagagagacagagtctttctctgggtatgggattggatttcaactcagactgaattggccacaattctgctgacatagagacaaggaaataattttgttttcctgcttatcttgtatcagataagattaggtttggctgtaagaagaagtaagatgaaagcttattctctctcacataaaatctagatgtagacacagtggctctgatccacagagtcctcaggatccaggctcctcccattggtcccatccgccatgcccaaagtgtagcccctgatttcatgacccactatggaggagccccatctgagctcagcacagcagggtggaaggagtggtgagaaggatagggcaaagtttgcctttttttttttttttttttgagctggagtctcactcttgtcacccaggttggagtgcagtggcgtgatcttggctcactgcccctctgctcctgggttcaagcgattctcctgcctcagcctctcgagtagctaggattacaggcactcaccaccatgctcggctaatttttgtatttttagtagagatggggtttcaccatgttggccaggctagtctcgaactcctgacctcaggtgatccgcccccctcagcttcccaaagtgctgggattacaggcatgagccactgcgcccggctgaagtttgccttcttttaagggaggtttctggaaatcaccatatgccacatctatttatatatctggctagaattttatcatttgactacatctagctgcaagtatcatgaggaaatgtattttttaaaaaaattctggacacctatgtgccaagccagaaatcaagggatctgtggaagaagtggaaaattgatattggagaatacttagtcatctaccatattaacaaattccttcttaaaaattccttgatatgcaaaaggagcagataagaaattaatggccgagtacagtggctcatgcctataatactaggactttgggaggctgaggcaggaggatcagttaagcctgggactttgagaccagcctgggcaacatagtgaataataacaaatatccaacttgttagatactttgtctctaaaaacataaaaaaaatcagccagctgattttttggtggcatgtacctgtggtcccagctacttgggaggctgaggtgggaggattgcttgagcccaggagttcgaagctacagtgagccatgattgcaccactgcattccagcctggatgacagagtgagaccatgtctcaataataataacaaaaagtaaactatttaaaaaaagaaaatactaagagggttagatttcacttttaaaaaaggataattagaccatgtaataaaatgttatagaacaattgaacaaattttatgttatagtgcccaccgaaagactttccacattctattattgcagtagaatttttgttgtgtcaaatacttcctgaatgggctatttactagctgggatttggaaatctttaactgatctaactagtaaacttgaaatcagatgattgtttttaatgtccgttgttctccctcaggaggattttctaggtctccccaagacttggttaggcacctgtcttatttgcttctctgataaccctaaacttcacccgttatgacttttaatataacatactatttataagcctgtacatctcaatggacagttagctctaagaaggtagaggacagtgggtgtcttttttcacaaggcaccattatgtgatagatgtttggttggatacttgttattgaattaattataaattcatatgggatgaaggatgactttggatataggtaatgaggaaataggatgactaaaacaaggggtggcggggtgggtggactgcaaacaggtgtggatgaaatagtagatgaaggagaatttctgacagcatagaatcatgaaaatgaaaggtaggattggccagagagcaaagctagagagccagaagcgaagggtctgacttaagtttgagcctagaaaaggaagcttgttgaaggatggtcagtgcttagttggctctcagattttagaggcagtactagaatagtgggagaacacacacaaaacaaaaactcactactggcacttgaaaaactgatgtttgaacccatgctaaattagttgtgcgtccttgggcaaactgcttaaatttttgagtctcctgtttctcacaggaaaataaagctggaaatgcctactgggcaggattgctgtgaggatcagatgaattaatgttataagaatgtctctcttagagtaactggtgtgtagtttctttccttcttttcattttctgagaagaacactttgaactgaacttgtgggtttcaactcatagccctgtgggaaatcttatacaaggaatcaaggatggagagaccaggcgacttggaggggaagttagattaagctcaggacagacttgtgttaagctagcaaacctgaatttagtgactacactttctactaagtatggtttgagaatccttttcttgtagcaatacaattagcatattccccaaagcaggccaggagaaatattttgaagagacactacagggggcaggtaacagaaagaagaaaagctcaagagaagcttcctcattccttttttatatgtgtactctgagtgcatgtgggaagtcttttgtttgaaggtgtttggggttttttccatcccttttgcttccccttcctctccctctcgatttctttttccttgagaaaatcatatctttattaactgtcagatggttatcagaacaggaaaagttcagatgcaaaagagccacccttctttttctttcttttggcttttacttattaattctgtcttatatgtagttaattttgtacttacttatgtctcctattagtgtgtaaggtctttgagggtggagactatatcttactcattttatcacctttagcagccacagatgttttctggttctgactgagacatttatgaagtgagatcactatatcaataaatgcagaatttattttctccagatgatttttcttttcttttttttttttttcttctcttttcttttgaaaatcagtgagacagagtctctcgctctgtcacccaggctggagtgcagtggtgcgatctcggctcactgcaatctccacctcccaggttcaagtgattctcctgcctcagcctcctgagcagctgggactacaggcgcccgccaccacgcctggctaatttttgtgtttttagtagagatggggtttcaccatattgaccaggctggcctcaaactcctgaccttgtgatctgcctgcctcggcctccgaaagtgctgagattacaggcatgagccaccgtgtccgggacatttttctttttctttttttttttttttaagatggagtcttactctgtcaccccggctggagtgcagtagcacgatctcagctcactgcaacctctgcctcctgggttcaagcaattctcatgcttcagcctactgagtagctaggatataggcgtgtgccactatgcctgactaatttttgtatttttagtagagatagggttttaccatgttggccaggctgatcttgaactcctgacctcaggcgatccacccgcctcggcctcccaaactgctggaattacaggcgtgagccgctgtgcccggcccttatcttttctttaccacctgttataatctcatgtatctgatacacttgtccatttttatcttacagggatgctgtttggatatttcatcaatgataaaagaggctcaaaagaatgcaatccaaattgtacaacaagctgtaaagtatgtggggcagttagcagttctgaaagggagcaagctacattttctagaaaacggtaacaataaagctgccagtgtccaggtaatttagcaatgttagttcagacagacttcatctgagggaacattagacttttgataatagtacagtactaaacatggcaagttctttttaagttttcaaaatagcttgtacttttagtagttttgcaataagatttaaaactgtttgggccgggtgtggtggcttatgcctgtaatcccagcactttgggaggccgaggcaggtggatcacttgaggtcaggagttcgagatcagcctggccaataggcgaaacacccgtctctactgaaaatacaaaagttagccagtcatggtggcccacgcctgtaatcccagctactcaggaggctgaggcaggagaatcacttgaacccaggagacagaggttgcgttgagctgagattgcgccagtgcactccagcctgggtgacagagtaaggctccatctcaaaaaaaacccaacaaaaccaaacaaccaaaaaacttttaaatatattggattattttgcaaaccttattttacctttcagatccttaatttgatgctagtcatccaccgtggagggttttctcagccaatcaacacatgaaaaaacgttgtaataccagataatttgtatctgcttgctttcactagttatgctattgaaaacattgtattatattagaatgttgctgtgttctggctgggggcggtggctcacacctgtaatcccaacactttgggaggccaaggctggtggatcacctgaggtcagcagttcaagaccagcttggccaacatggcgaaaccccgtctctactaaagatataaaaattagctgagtgtggtggcaggtgcctgtaatcccagctactcaggaggctgagataggagaataacttgaaccaggaaggtggaggttgcagtgagccaagatcgtgctatttcactccagcctgggcaacatgagcgaaactccatttcaaaaaaaaaaaaaagaatgttactgtgttctagcaatatagagccctgcttaaaagatgataaacattctttgcaatatgttatatatgggatactaaattacagatttgctaattttatttctttacagaccacagactgttagttcttattctagctttagttgaacttaataaacttgggatgtattatagtcctaaagtaagcagaaaatataacttaattacttgataatttaaaatatataaaacctaaatttaaataaattaaaatacataaaacctaaattttctagttaatgcttaaattctttttctaggaggaattcatggatgctgtttgtgatggtgtaggcttaggaatgaagattttattagattctggactggaaaaagcaaaagaacttcagcatgaactctttaggcagtgtacaaaaaatgaggtaagatgaataaaagaatattctgtacagtactaaataatatataaagttgattttttcagtcaacaaattagatttctataaattcatatgttttaatttgtttcgagttatttttcactgaagaggctgacatcatgatcttatggtgatattttcccaagttattcttgagtcactgcagcctctattgttaatattttgcttggtcctgttgcagctattttcaagaattcagtctgtaaactcctaagcagagagtggagtgtggtagtgacacctagtgttcgctttctggttgtcattttcttccttagctttgtttagtcttctcctcttctaagaatggaaactattagtaacatttattgattcagtatcttgaactaaatatttttctggggcattcacataagatatttcatatcaagatacagaaccaataagcatttcagtgatttcctaaaatatgtgtcctcccatcctccagctaacattacttagtaccttaggaaagatctgggttttaatattagaagacatgtatttgaaacctggttctatcactttccacttatcatttagcaagtcacttaatgctctgaccctgtcatgtaagcatacctacatcacaggctgtaaactatttactgattaatttcctctgacagttactggactaggtgctttacatgtaacagtggtaaatcttagccatttctataatgggtttgtactttgtcagtaagaaaaagccctatgaatatcatatttcatattcatatcatttttcaaggtaggaatttatattcttcatttcattgaattagagtattttgcctaattacccaactattaagccctgagccaggattttatattctgcctgactccaaaactcaacatgctacataaataagtttttaaaactattgttcatgcattaattttctttattgacaattactgttagtgaagtggggattaggaagatacaaattcaaattcttatgagactgaatttcagagacttgtctgttttagagtcttgtaacaacatattaaaaccatccttggccagggatggtagctcatgcctgtaatcccagcactttggaaggccaaggcaggaagacagcttgagcccagaatatgaaaccagcctgggaatcatagtgagaccttgtctctacaaaaaatacagaaattagccagacatggtggcatgcatctgtagtaccagctactccggaggctgaggcaggagtatcacttgagcccaggagtttgagtctgcagtgagctgtgattgcaccactgcatatcagcctgggcgacagagcaagaccttgtctcaaacaaacaaacaaaaaccacccctgtccattccattgctcttgttggagtcaggtggctggggcagtgctacctggggacatttaggttcctgagatcttagctactaggatgtctcctcatttatgtatatactgattgatctagaaaagtagatcatgtggaggactattggcttctgtccctctgggtggttgtttctgggaaggcatggaataagttagtttttttgttgttgttgtttagaaaaactttggtattaatgtacttctagctcatcttagaatctgaggtgaaactgtgtaagccacagagattctccatccctttgctcatactacagggttatacagatttctctctgcccagaaaaactccatctcagaacaggggaaagacatggaacattaagctgctctcctacttcctatgtagccttgaacaacttacctgagcctcagtcgttccatttttaaatgaggatgatcatacttatttcataaaattgttctgaggatcatatgagatgaagaaacaacgtatacgaaaatgctaaaaatatagtgcctggcaaatcttaagtcattcatcttacttgcacgtgttctctttttctcaacatatgtctgcctctctcactttgtgtttttttgttttaaaaaataaaaacacggctgggcgcggtggctcatgcctgtcatcccagcactttgggaggccaaggtgggcggatcacgagatcaagagatcgagaccatcctggccaacttggtgaaaccccgtgtctactaaaaatacaaaaattagctgagcgtggtggtgcacatctgtagtcccagctactcaggaggctgaggcaggagaatcgcttgaacctgggaggtggatgttgcagtgagccaagatcgtgccactgcactccagcctggcaacagagcaagactctgtctcaaaaataaataaataaataaataaaaaataaaagtaaaaacacattgttactaaatttaggagctcatattgtcactaaatcaagcttgcgctcaaataggcatgaggctgatttcagttccatagtgcaactttgaagaaagggatatattgggctgtcaaaggctcattcagaccaccactgacgtctcaaatttggttttgctcagcagcagcaccatttatcactaaaacacttcaccatatttgcaaagtgataccacttttgcagtctatcactattgcaaagaatttctgctggcaataagtgcagaagggtatagaataaattaatgaaaaatatagatgaaataatatgtgggaatgtgtttagtaagctgttgaagtaggtgcaggtgttagccttggtattgttttgaggaaataagcagcaaaagggccaggcccatcctgtatacaattgaccctatctgcataccctcctttctctcattttctttctatagtatgacaaacctgtactttgttgttcatggtagggttttagtttatctattcttgtaagttaaaactcctttaagaacctatagaagaataaaatatccaaagaaatagaaaatgagctgaaacataaaaggcatggagctacaattttaaagctggagtcaggaaggaaaaataatttggatattcttttggaattttgtttttttttaaaccacatagagcaaatctgaattagggctagggaagctctctgtgagtaaagccaattaaacactgaaaaagaatcccctggcagaaattgagcaggaaagcaccttagggggcagcattggatagaataaaagcaaaggcttagaatttagatgtgggctcccactctagttctcagtcttaggagttaggaaccaaggtctgtttccttacctataaaatgaggtatacaatgggcagcataggactataatggagaatcaaataacaaaacatttgtaaagtttttagagtatagtatttgcttgatatgttacttacccccttccaagggaaatttagaaattttgtatctataaatatttaagtataacacaaaatttgttataacaaatattagagggtgtccatatttaatatagaaatcaatgtgcaatttattttgaaagaaattattaatgaatacaggtgaattagactgattattttcccatgtcacaggtaaatagaaaatacagactaagtatatgatcaatgtgtttaaaaggagagtaattgctatagcttgaaattttttatgtaaataaaataaatgagagagattataaagttgaactcttaaaagtgaaataaacttatttggaaagaagtcaatgtgcaatttatttttgaagaaatttcacatgtatgatttaagtactctcaagctatttaattgcaatcccagaaatagagctccaatctttgggcttctagactagaattttttaaaagtctggtcccatgcaattctatgatttttgtacttctgaataataaagtataataaaatattttaacattctctataggttaccaaagaaatgaaaactaatgccatgggattgattagatctcttgaaaacatctttgctgaatcgaaaattgtaagagaagctttaaattgattttaattttgcttattttttatcatttcacttggttcaaatgtagatatttttatttcagtgtttatccttagccagagacaactcttttgtatatgtctaattgtagcatgtaagatagctctttgtcttttttatgtgtgtcataacttactagttctagtagtggataaaggattgtatagaaatttattaatatgtctgtttcttattgctactggtttaataactgtcagcttttgcttggatgggtcattataggctaaaaaattgtgtttaataatcattgtgctcaaagattttaaaatacagttgaattagatagattattcccatgtcacaggtaaagagaaaaattaagtatatgatcaatgtgttaaaaaggagagtaattgctatggcttgaaaatttttatttaaataaatgagaactattataaagttgagctcttaaaaatgaaataaatgtatcttttaaagtattgaataataaatggcactgttactttattccattctcatgtaataggatgacagactttgaaaattaattgaaaattctgatttcttttgaaaacagtaattactattgtattttggtcttgcttatagaaatagagttaagcactggtgaggaaattaaactctctttcttaaagagaagattctggcaattaaaatcatattgactgagccttactgccattgagcctgttaatgtattattttaaatattaactttatttatacagaaaagtttcagaaggcaagtacaagaagaaaactttgaataccaagatttcaagaggatggttaatcgtgctccagaattcttaaagttaaaacattgcttagagaaagctattgaaattattatttctgcactgaaaggtatgattctccaaatggagtttataatcagaattttatattttaaggaaccttagacatctttcctttttttttttgagatggagtctcgctctgtcactcaggctggagtgcagtggctcgatttcagctcactgcaacctccgactcctgggttcaagcgattctcctgcctcagcctcccaagtagctgggattacaggcatatgccaccatgcctggataatttttgtatttttagtagagatggggtttcaccatgttggccaggctggtctcgaactcctgacctcaaacaattcacccaccttggcctcccaaagtgctgggattacaggcatgagccacagtccccggctgacatctttcctttttatttctaaccttttcattattttagtcattaactgaagcctacccaatgctacttcactgatattagttacccatataggaacttgtatttataattaaattcccacttaatgtatgtatcagtacttctacctaaataattagatcctgaaaaaccaagtgctcatctagcaaataaacactttagttgactaatcttaagtagtttggaattgttttgatagggtcactttgacttaaaagatatctagagtctataaaagtcataaatacctgatgaaaactgaaaaggctaattaacttttccctcctctcttgcatataggatgccatagtgatataaatcttctccagacttgtgttgaaagtattcgcaacttggccagtgatttttacagtgacttcagtgtgccttctacttctgttggcagctatgagagtagagtaactcacattgtccaccaggaactagaatctctagctaagtctctcctcttttgttttgaatctgaagaaagccctgatttgttgaaaccctgggaaacttataatcaaaataccaaagaagaacaccaacaatctaaatcaagcgggattgacggcagtaagaataaaggtgtaccaaagcgtgtctatgagctccatggctcatccccagcagtgagctcagaggaatgcacacccagtaggattcagtgggtgtgaatactgatgtgtaggcacttttatgaccacccatgaaagaaaaagaacacttgctcggtaattttctttatgcaggagagtttaagagaaatcagcacagatatttcaaaaaagtccatgtctttttatctttaaaatatctatttatcaaaggccagacacagtggctcacgcctgtaatcccagcactttgggaggcgggcagatcacaaggtcaggagtttgagaccggcctggccaacatggcgaaaccccgtctctactaaaaatacaaaaatttgctgggcatggtggcgcgtgcctgtaatcccagctactaggggggctgaggcaggaggatcgcttgaacctgagaggcagaggttgcagtgagccaagatcatgccactttactccagtctgagcaacagaacgagacttagtcaaaataaataaataaataaataaataaataaataaataaataaataaaatatatttttatctttaaagtgtttaacattggtatactgtctgtagttggttcattagtcgtttataaagggttattttctcatgagtggaaacctgaacaatcagttacctttgtgcctatgccttctctctcctcagacagctgggatgtttatggtgaaatggcctgtacaagtttaactaagacaacttaacttgcattgttaatcaaaaattcttttctcaaagggttaactggttgccattttgaatagtatgttcaagggtgtagcttcctgtttctttccaaattataagtagctacctaaatatagtataattatatattaataatatggcttgctggcacagtagtttaccctgttatctgtgtttcataatgggggctgtatgaatattatttaaaactaataaaatgttgccagaattatactaaactgttggatgagattaggagatcagaggctggaccttctcttgataatgcttgttttgttaaaggtataatgaaataatttgtatatgatttgatgaagattaaagacccttattttccacagctttaaaaaaaaacctttatttatgatcaagtaataaagataatattctacttgtgggatcttacattacggaaatagtttgacgtttttgacctcaagagtatgtataatttgaagagatactttgtaactatgcttgggtgatattgagcagttcctaaagaataattcatttaaaaaaaaagaagaaaaaaaaagaagaattcatttaaataacctgatcctttcatttgcccttttcgaatttacagatactacttgtacatttggcataactagttgaaattggccattcgtaccatgaataaatctgatagtttccttgttaggaagagattgtaagtaaatacagtcattgcagtcagaacagtattagtgaaccttgtgtggtgttttcaagctctttaaaatggtacaatgtagcacatttgctttcatttctttttttatttttggcatttgaccttgtattctttctgaagctctatatgtgtttttattagtcaataatctggcaagtagcactttgcctgtgcagtttgctggagtgtagatgtacatatgaggatttcccgggaggtgcacttctttgaagaacttcctaaagtacctgtatagtagttttcatcttaatattcagtatttaatcttcagtttgtgctttgtaaactcatgacttaattggtcagaaactttttagtgtctttataaaattttgtatacatatttatactaaacacattgtgatactgtatttgaatgaatggtgaaaaaatatttgctattggaattatgtgcactgacaagaaatgttataaagagaatgcctttaataaatcttttcagcattagaa

SEQ ID NO: 485 - DNA, 21630 bp, Homo sapiens
gaaaaagatggcgccccgcgcccggggggccccttcctgagcgccccggcccctccctccgccgcctccccctcctccccgcggcgcccccgccccgccccgcccccgccgagaccccgaccccggccccacgggcggacactcggccgggcagccgcgggccgagcgcagccgcctccgccaccgatgcgcctggtggccagactccaagtgggaccggcggacacgcagcctcgcggtgagttctgcgctgttgggcggactccccgccacgctctcccctcccggccctcatccctctcttttcgaaatctccctgaactttggcggcccgaacgcctccggggggtgagactcctgcggagcggggctctcgggggtggggaccgggggtgcaggttacctgcggggcagaggggccccacccgggttcccgagccccggggggcatgggtgacaggtcgttcttcctcgcccccgatctttaattttcctatcggggtgggggaaggacagacgggcgtttggcatttcgctcacgtccgaagtcaggctgcggcagggttgggatgggggaggcttggcgtccgagcgactgaggagaggagcgctgaacccgaagggggtgcttctgcaagctttttcccccctcctgaacatcctttttaaaaagccaacggccgccctgggagaggccccggcgcatgaatcatcctcgcttcctgcccccgcccggccccgcgctcccggtgccgcggatttgaactggacgcagacgggaacccgcaaacaggcatttctttgcaaatgggtttgaatcagccaatcacagcccgcgggggcccgctccgggaggacggaggcgggggctgggggggcgccacccgggggcccccgcccggccagggtggaggcgggtgcggcgacccggccggctcctagaggcgcagcgggagaggaagtgtcagtttgtgaacctgcagcggccccggcctggcccctggccgggcgggcggggacctcgcagcgccgggcgagccaggtggcagggagaggacagggattcagaccgcatcccctgcccgggagcctgtgcgctctgcgctggagaaaaaggagatgggagtgggggtggagaaggtcgtggccacgccaccatctggggagccgagacccctgcagtgcctggctcgccccagggccccgcacatacttagcttcacacactccctggcacaatgccgtagacatcatcctgcccagtctcacaggagtacacacacgcaccacacagaaacaggcactggactctctccctgtgaacagatagtcacaacaccaggtgcccagcgccatggccacaaggaggagacccgagtaggcccgcggggaaagagagaggctgtgtgtggctgtagtggagagcatgtggagggacttggagccaggtgagcccagcagaaaggagggggcgttagggacggctttgagcaccagtgagggcagtggggagccccagaaagtttctggaaggaaattggtggccctgcggaagagtctggtggagaggcaggaatgcaggaacggcctgtttagcactgggtgctggtagtaccgttccccaccctaggtgcctagtggaggtaagcacaaggcccaggaaactgttattgggtgaatgaatgaatgaatgaatggcccaagcaaaagatgaggcctgaactgagaccagggcaggaggatggaagctagagctggaaagccagaaatcatggcacttaaaatgggccggctgtggcaactaattgcttggaggagtttgagatgcatgaaggcagtaccacaggcagggagagagaaatcgatgggtgaactgcacgttgaataggatggtgagagacaggcgtggagaggctggcatggggatggatgacttcactgcttggagcaaatgtgtatctgggtgaaagcataagtgggtttaaatgtcccagaattggtttccattaaatcatctcataattgagaacagaaggggggattacaaaagacagatgacccagtctacactagctacaagccacccagttttcctttctaggtgaattttctctggacagatctcaggttagggatggttgcaggggttgggggtaaaaacaaaacccaactgcttgcctggagaagatcctccatccagagcacatggactgtgtttgcttaaggaataaaacctcagcctcctgagacagggagtggttcaggcccgctgggtaggggactttgttctgtgtgggttgagagatccattctctttaaaaggtagtgtggtatgggccatggctctgcctttggcccatcagcctcttctccttgccacacctgtttccctatctgtaagatgtgaataataataatgtctccctcataggatggtcacgaggaatcagtgagataataaccaagtctggcttatagcacagggtacagaaatggtggtttccttccttcccctgatgggctttctgaagcagggaagcaagaagcaaaaaccctgttctttctctcccagtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtaaacccatcctctctggcccctgttctcagactcagaatctctctgctcatgttccagcctggctgtcagaccagggggcagggggattgctggagaattcccttcttgtccctcatgcccaaagctggtggtgggaggggccagagcctggtcttgcaggcaccatccctagggtcaacatcatccaactagttctttagaaaagtgctctgagagcctacaaaacaaaaaagtcaggtttgagaggatcacagaggagcatctgacttgtgcttctgtcctcaacattctgaccaagttgccatccatcggtccctggctgtacgactccaggtgactaggagtacaccctgtccaggaactgccatccttcttccccttctagccctgctttctggaacatacggagacaaaaatgggggaggaagactatgttccaggttggcttttccccagccctttctcacttgctccttcctatctgtaccccaggtcagcagctctaagcaaagctgcctcgtgactttcgaagataattccaaatactgggtcctatggaaggacatacagcatggtgagttttcctaacatttcgggtagcccccaacctccccaggtcttctctcctctgctgccttcatttcttccttctgtccttccatctcttactcctggcatctgcccttgaccatgaaccccaagcccacctgtgatgatgatcaaatctggttgtatattgacttaggaaggtacttaggacatgagtcatccccttgagaattcataccccaggagggaggatgggcaggtggggaaggtagcttagggaggtgctgggagggccaggactgggcctcaggcctgcgtttgcttcctggctgcactacagctgcagctgctcaaagctctgcgtcagtctgggctagaaaagggggcgtgcccaggtattcagaattgtcagctctagatgcaagcacagtgtccctgatttaacatatgaataaaactaatggaagcagccttctccacggggcaaggagttgggaggaatgggagaaaaaccaataaagcagaggtgagccaggcagggtgaagatggacatgcctggatggagctagaccagcttttagggctgaaatgaatctgggttgggtatcatccctgccttcagaaagctgacatctctcccttgcagagatggcaagtcagggccatctttgccaccattctcccttcccatacacacaacagacatcagtagccattgacaacacatgtactttcaacttggagccccaagcagctactgcctgtcaatcagagttggcataagaggagaaacctgtttgccatttatactctaacaggagaagagacatggcccctagcagggtaagaagcagattttagggtcaggtagaccttggaccaagttccagctttgccacttactagctgcatttgcaggagcaagtaatatgacctgagttttagtttcttcatgtgagaggtgatagtgaaagtactggcttcatagggtggttgggaggcttaggtaagctaatccatgtaaaatgcttagctcagtactattggttttagagaagctgttactcaagaatttgttaccagccaggcgcagtggctcatacctgtaatcccagcactttgggaggccaaggtgggtgaatcgcctgacgtcaggagtttgagactggcctgaccaacacagtaaaaccctgtctctactaaaaatacagctacccgggaggctgaggcaggaggttgcagtgagctgagatcacaccactgcactccagcctgggcaacagagcgagactctgtctcaaaaaaaaaaaaaagaaaagaaaaagaaaaaaaaagaatttgttacaataagagatgattccaagaagcctgccaagaagaggctgcagaactcagccagttagtaaagctttcgaattgcccccttctccaagaaattgtggccagtgcagaccgattcctctccaacccctgaaatagtattatataaatatccaaagcaatgaggatctcctctcctggtttacccccttattgaaagcataaggagccagatggagaagaccatgcaccttagctgacctcctgtggaggcccaccacataccaggctccttggaggtacccacagtgatcagctgaagagtggcttgtctcctagccagaactgccccttccgggcagaatggtgaccctctagcatctcctgagatgagagcataaggctgagcaccactgtagttattgatccattgcttcattaacccagtgaggacttactgagatgcactgtgggcaccaccttcctgggagcatgttcaagaataggaggcaacgttcctgcctggccatatattcaacaaacgtcttggaacacctgttacatgccacactctatgaggtcctggggatacagagatgaagaggtaccatttctttttttttttttttttttttttttttttttgagacagagtcttgctctgtcacccaggctggagtgcagtggcttgatctcggctcacagcaacctctgcctcccaggttcaagtgattcttctgcctcagcctcctgagtagctgggactacagccacgtgccaccacgcctagctaatttttgtatttttagtagagagggggtgtcaccctattgggcaggctggtctcgaactcgtgaccttgtgatccgcccgcctcggcctcccaaagtgctgggattacaggcgtgagccactgcgcccggccgaagagatcccatttctacccttacaaaattttcagcatgctggggaaataagacaaacacgtatcaaaatgtgtttaatgtatacatacaaacctttcacacataaaaacatatttattcttcaaccaaaataaaatgcaaagaaaaaaagagatggagaggggacctgtagactaaaagcaattttaaaaacatcagccagtcaccatgtatggactttacttggggactttgattcaaaagaacagacttaaaattgttaaggtatttgtacttaagaaacaattggaaatgagaacattaactgaatttgttaatgatattaagcaattatgttaacttataggtgcagtagaggtgttttaattatgttttttaaaaagagtcttgatctttcacaaatacatactgaaatatttatggaaaaactattgggtatctgggactcaatttaaaataattacaggaaggagaagtaggtgggaatatagtagaaacgagattggccatgagttcataagtgatgagaagatggagtttcattataacttctaggctgggcacagtggctcacgcgtgtaatcccagaactttgagaggccaaggcaggtggatcacttgaggtcaggagttcgagaccatcctggccaacatggcaaaagcctgtctctactaaaaatgtaaaaagtagctgggtgtggtggcatgcacctgcaatctcagctactcgggaggctgaggcaggagaattgcttgaaccagggaggcggaggttgcagtgagacaagatcacaccactgcactccagcctgggtgacagagactccatctcaacaaaacaaacaaacaaattatattatcccataataaagttttaagaaaataacaaccatttaacaaaacaagttaaataaggcgggagaggcagcatgatgtgtcaaaagaacaaagggtttgatgtcaaacagccatgggtttaatccccccctcacctacttactagctaagcaagggacttaacctttcagagcctcaatttccccatctttcgaatggtaatgatgataggcatctcagagtggttggggagattcagtgaggtggcatgtggggcccagcgctaggcctagcagacattagaggctgggcatctggaatgtgagtataaaacttccattcctgtgagctggacccgaccctcgaggccctctctttcagccggtgttccaggagaggagcccaagtgcaacatctgcctagggaagacatcagggccgctgaatgagatcctcatctgcgggaagtgtggcctgggtgagtggagcgagcagggccctgagaaggccccgacctataggtccccacgcactggcccctgacgggtactgctgcagcctgttggggcctcagctggcttcctgtttctcttggcactgcagggtgaaagggggccagttgctgtaagtgagggcttgggaagagatcctggggaaagctgggagggtatgatggtgtatgtaatttggggcccagctagatggagaggatgggtgggaaagatggggctcaggcactgaagtcagaccttcctgtgtcccccccaaccccacaactggccaatgctgtcatttagttcccagcctggacactgacttggccatcttggtgggcaccagcagccaggctcccggcagctggcaggcagagctcctaggacttccctcagccctcccagccctgcctcctttgggccaactggccttgggccacgatgtccttgtgggcgctcaccgccccctcctctgccgtaggttaccaccagcagtgccacatccccatagcgggcagtgctgaccagcccctgctcacaccttggttctgccgacgctgcatcttcgcactggctgtgcgggtgagccttccatcctccccagtccctgcctctcctgcctcctccagtggggcagaccagagactcccatcacagagtctgagctccaagcagaagggccacacctgggctttggagacagatagcgcctctgccactgtccttggccaggatttgtagactccctgagcctcagtttcctcaactgtaaagtggagatgggtttggtgtcgggaataacgggaccaataaatgatgctttactattaaaaaagaaaatccatgtaaatacatgttggtaattgttgcctttattgcgcttattactcttaattctgttatcaacggagttccttctgggatagaggggatgggtttggaattaatgagaaaaagctccttgcttttctgactatattggaatatctgcgggtcccccaagccctggcagcacttccctcaatagacagccgcgtgctgactcgcgtggtccacccggacctggtggttgactggggccctcgtctccccccagaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagagtaaggcagggggtcagggccccccgggcggcagggcaggtctccaagaatcgccagcagggaccgcccatagggagcgagcctggcgtgtcagccaaggcggggaccttgagggcgggcccagtgtgttgcgctgtgggggcggggcctcgaggggcgggcctggagtgtcagccgcgggggtggggcctcgggggcgggactcggggaggggggggtcagccgctgcggaggtggggcctcgaggggtgggcccggaagattggacctgagggcggggcctcggggggcgggcccggaaggttagaccttggggcgaggcctcgggaggcgggcctggcgggttgcgaccgcccaagcagggccccagggaggtgaggcaggtcgagaagcaccctgtggaggggcggggtggggaggagggaatagtaaggcctcgggaacaggacctgaggaggcgaggcctcaaggggcggtccctgaagggaagggctcggggtggggcccgagggggcgggacctcaaggggagaacagaaggccggctccgcgtggcatctagcactgtggagcagggctggagggcagaggtgttaccttggagctttgtaggaaacgaggaagtattgaagagtggttaagagcctgggccggacacagtgcgaatcctcccaggacgtccacgtcctagctctgctccttaccagctgtgcaaccccttagcctcagctctctgaatagtttccccatcatgtggtgattatgagcagagcatgaattacgtaattcacatagaggttctcatagtgcctggcatttggtaaacaaaaaaaatgtgagctgttactggtggtagtggtggtactaatgcatgaaagtcaagataaccttttcacagtcagagtcagtggaaccggctgctggtgagatatgaagatccttttcccgcctggcgcggtggcacacgcctgtagtcccagcttcgtaggaggctgaggtgggaggatcacttgagcttgggagatggaggctgcagtgagctgtgatcatgccactgtactccagcctgggcgacaaagcaggacgaccctgtctccaaaaatagaaaagattcttttccctggagatgtgcaatcaggcaggggtagggggccggggggcggggcatgctatgtcggggccactgtggagggaattcttgtcctggctctgcggcaagagtctttgattcttccttgccgacctgggcctctatgtagccatggcagttgagcttgcttctttgggctgagtgcacgtggcattgtggaaggaaccacagatgtaagagggagggtctctgccctcaggaagttcagccgtcaggaccccctgaagtcctgaatctcagccccaagctccagctgggtaacttgggcaaagcttgaactacttcatctctcaaatgggcttaaccttaacttcaggcccatgagcttccccaagtattgtcagatggagaaatgcttatggaaacctttcctgcattaatgcagtgtttctcaacgcctatgggcagagttgcacaggatgcttgttaaaaatgcatcccagaggcttccccaaagattgaataggtctgcagtggaccaaggaatctgcgttttaacctggagctcacctgacaaggtgtcaatgaagcattgagcattttgctcttcatattccatgaatagttgttggatgaccatgataggccagatacagttgcaggtgagaaaagccagatgtagtcttgcccccgtgcagcttacagaaaccattattctcccgtgaagtctccaaggcaaacgtttccctgtcagcagtgtttgggaagcagcaagtccagaaatggtggcttcattgtggcatggcaaggagagcacagcctctgaagttagggaaaccagaatttgaatcaccatcctccacttgcctgtgagctagggcaagccatttcacctgtgacttatctgtaatatggggacagtgtcccatcttttaccaggtggtgaggtgaaatgagagtatatgtccaactctcaggtcctcccttggcacagcctaagtgctcagtaactgaattctcttccctttctgccagtggagggcaaatttaacttgggaaaggttgccgaagctcatacctgactgggggtgtggtcctggctgaccttggctcctctgtctctccagatggtacctgcggatgctgcaatgttaccggtgcaggcagtggttccacgaggcctgcacccagtgcctcaatgagcccatgatgtttggagaccggtaggtgctaatttggtccaagtgggccttgggcgtggtggggagagggcagggatggcagcaacaactcctgcaggttgactgccaggctccagacaagaggaggtctgtgacaatgtatgcctacctgtttactggaggcagctcaaggtaggggatcccctagctatgcagggccaggaggcaataaagaagtatgctgggccacatccctagttgccattgatttctggagtaccttagataaatgcctgccttccctatgccctagtctcttaagtgtctggggaagaagggatgacacagtccttgcgccagccctgcccagggttgctgtgggagtcactggggaaatggatggcttaatgtggcttctaaccgacggagcaaagctaatggagtccttatggatgtcaaacctgatgttatgcatcttttggttggtgtctcatgtcatttgtgattgcgtgtgtggctgtctcagaggggaagagggtgaccatggcagcccagcctagctcagctcactctctgtgaactcagccacgcttcagggcaagatttgggaaggagattgagggcatgggttagaaggaatatggggtatctcttagtccctgtcctgccctgtccttgacccccagtggccagcagtcctaggagtgagaagattatgggaaggtaggtggggaatgaggagatcaaggggctggactggggtgggggtgtcagagcccctcccaccataggcccccgtctctacccacccacaggttttacctgttcttctgctccgtgtgtaaccagggcccagagtacatcgagaggctgcccctgcgatggtgagagggtggggcttagtccaaccaccgctgctcctcccagcttctcccctccctcctccctcctggaacaattccatttccagctactgggtcccaaccctgcccctgtctctcagcctggacccagaaagctgtgaccctggctgagcaggctgccacctcacctggtcccacctccttgcccccttgcccagggtggatgtggttcacctggccctctataatctgggggtacagagcaagaagaagtactttgactttgaggagattctggcctttgtcaaccaccactgggagctcctgcagcttggcaaggtatgtggggttgtgggatgtcagtggcaggaggcagagaggtttgcccagggccacgcagtgcaggactaggatggaagtctctgaactctcacccttgagttgctgcatccctgagtccaggcctctgatcttgtgtcctttaagggccttcctaatcccagattttggcagtgggcaggttggggcctccccagttcagtggaggggagctgaggccctagatcaagtctggctggaacacagctctctgctgagtgtttgacccactccagatttcctggctaggttgcaacatggagtgggtctgcccactgctgatcctatgctaaatagtgggtcaccaagggccttggaagcctcagatccacggagtgaaattacaaacggagactttcggaatgtcagagttgcagagtgacttgcccgtggtcagcagagctttgaggctgagccagagctggagccagggcctccctaatcactcccacgggggtgctgtgtcttcttttccctaatgacatccttagaatcctctccaccacatacagagtgaggcatcttctctatggactgccccaaatctttctttgatgaaaaggaatttaaaaagaataacctttatgctttgcaaaatatttcatgtaataacatcttcatttacagtatttgataatttttttaaaaaaatagatattataaaaccttaaaagatacgtagagttggtttttagtaacttttttctaattttttttaattgtacatattcgtggtggaaaatctttaaagtaccaaaaagtataaggaagtatactttttaaaaaatccatatcacgccacccagaaatcactagaactaatgcatgggtacatttcctttccgactctcttctatgtatatctttttctgttttatcgtttaaatgatacagtatatacaattttaaataatcttttttttagtatacattatacttttccatattattagaatcttcataaaattttttgtttgtttgtttgtttgagacggagtctccctctgtcgcccaggctggagtgcagtggcgcggtctcagctcactgcaacctcctcccactgggttcaagtgattctcctgcctccgcctcccaagtagctgggattataggcgcccgccaaatttcatggctgcattggtttctaccatagtttacttgtttccttcctgttgggcagtttctttcccatttgtccaccattagaaacaatgccaccatttttttttgtatgtaaagttttgttcctatttcgtgttatatctgcagatatatagattccatgatagattccatggagtagcattactgggtcaagggtatggactttttaaagctctcaatacagttaggtcaggaagtattctctccatttacaaatgggaatgaacttggagaggtgaaaaggcttttctgagatcctggagtgagtcagtggtcctcacctgaaggactcagaagcatcaggagatggaagggagggagtaggggcttgggcctccccatgcgccatatgcctgggtctgatgtcctgctggcctgctctcccacagctcaccagcaccccagtgacagatcgaggaccacatctcctcaacgctctgaacagttataaaagccggtgcgtgcagggaggggagggagtgtggtggggccctctacaggtgagattccttcctacctcatagcctttgctcaggctatgctccctgcctctctgatactccccttctctctgaatcatttccattctccgagatccagggggtaccccacctcctttgcacagccactccaaccaccccagcagcctgccgtattttggtactgggctcagctctgtaggggggctgcacccctgctctctgagggcccctccggctctagacatctaggccttgggggccaggcactgagggatgggtgcatcatctcgggtgggctacatcctcgggtggaagacatccctcagcccctgtcttcccatccagggttctcagcacacacagctggccatgtccctcactacaccacagaggcatgcccagcctcctgaacctggcactcaaggccttttaagaccaggctgtgcccgcgtcctctgccgctgtccctttgctttctgtattctgggtgccagccatcctgagtccttggtttcctacctggcacttttactcatgctctgccctttgtctaggatgtgcctcagtcttttttactcattcgttccatcaacaagtattcattgagttgctgttctatgtcgggcctgtctgggtgctgaggtcatggtggggaataaaataaggtcctcatcgctgaaactcttccagacacctctgggtagaattatccactctctcttccacattctcatggtttagggcccagacaaagctctgctcttcagtacaagaggccacctgccctcccaatggacagtcctctattgggagggcaggtggcctcttgtactaaagagggtagggctgtgtctaagtcacttctgcagcctcagaggagcccagccggtgttgctttcagtctcctggggaaaccagagaacagaatgaagtagattccagtatcttgaccataggagttccactgtaagctggaggagggcttcctgcaggaggtggccttggggctggttgaggcaaacaaaagggagaagagcagcaagaaccacactcatgcaggaggaagcacagggaggaggcaccagccgtgttctcagctgctacctggaaccccgcatcccatgggctttgaggaagtcagcatctgcagagaccatccggattttagctctgggtccaaggaggcagagaggcttgtgtcatgcttgaccccactccccaggaggatggactgacagactccagagcttcttcctcccactgcccacccccaggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctgggtcagtgctcggggacccaggggccagggctgccgccaaactcggtttctctgcttccaagcaagcaaggaggacctgcacccagccagtcccagctgtaggaccctgagagggctagatagtggctgagcgggatcccagatcccagatccccaactcctttcaccaccacagcccccttattacctcgcaaggaggaaaagccagatctgaggacccagccttgctggattaggacttgggcaaggaggtgaaggggaaggcagggtgtgtgaggggtccctctctctcctggctcagctgagccccctcatcctggcactggggggcagggcatctggatgcatgtgcctggggaggcaccttttctttttctgcccactataccttctccacaccttcccacccctactgctcctgaggactctccctcctccccaggcctccctgtgaaggtgcagctgtgttcagagcctgtctccccaactgctgtgacccccgcccctgcggcgcctccctctgggccaccctagggccctcaggctctgacggggccaccttctccctcttctgtctccacagtttgttgcctcacgaattccagcagcagaaaaggcgagtttatagaagaaaaagatcaaagtttttgctggaagatgctattcccagtgttagttccttgttttcttactctccattttcatacgcagggtcagcacatattagggcttcctgtgccgaaaactaagtcccccaggcccagaggactctctcatgtcccttaaagaagccagtccctattacagctaagccaggcactctaagacccctgctttatctccccccaagttctcccaggaatccaaagttggggggcaaaggcaggtaatattcttgtccccactgtccaggtagggacactgagggaagggtggggcagtgactttcctgaggccacacatcaaagtggcagagcccagcctggaaccagggttccagagcactttctttcctccttcagtaaccccaccacctccctgaagccctccctgtgggcagtagtattagcaatgcctcatgtcccagcactttgcggtttagaagcattatttaattttactgcacttcctgacatctgtaagagtgaagcaaggcaggggttattgtccccattttgcagttgaagtaactgaggtccagagacgtgaaggtcgtacagtcagctagagacaaaggcagggctagaactgggatgactttggctccctggtcaggacttggaataaaggtgatggtcttaccctagggagggcccagccctcagcggccctggctggataggaggcagcctgtgtgggaggtggatttgatactcgctgtctgacccttcctctctccttcctgtgtccacagagtgacttcacctcagcctggagcaccaaccaccacctggctagcatatttgacttcacgctggatgaaattcaaagtttaaaaaggtatcagtgagggacctagcacagaggtctgctctggagacagggagggaaccaagcagaaagccaagccctcagttaaaaggatccctgctgtgcaggtctgtctgaaggggctttttgcagtagagctttcagcataacatccctgttcccagagcaccacagccctcccctcttctccagccctccccaccttgccccatggttatccacactcaccatgctgtttgatgcttgctcatctttgctcgtattgctccctctgcctgagataccctttgccttgccctagcccatctgaaaactcaggaccctgcttcttccaggaaggctttactaaccctccccaggctgtgctggacgccctcctttgtagttccatagcaccccatgcttaagtatgtccaagggaggaactgcatcttccatcattttattttccaaattattaaaggtcatttagtattttcctgaggacacagaggagggctttagagtcagacctgaactccagaccctgcttatcagtactagctatgtagttttacctaaatcccttaacctctctgaacctcctcagctcttttcctcaaacaagataatgcaaatgaaagcacttttgacctgtgaagtgttgcacaggtgccttggatcacgctcgagttattgacaccagtgcttacgtcaccgccaggggagggtgctccaggaggtttttttgacttcttggactttgaagggtggctgggtaggaaacagacaggtgtggtggtgggaagctcagctgtgggaagacgggcctccactgggatgaaggatgcatgttaggggaacctgcgggccaggttggcaggaacttgctgggccgggccaccagcaggctcacggtcttgcccctctcagtgccagctcaggccagaccttcttctcagatgtcgactccaccgacgctgccagcacctctggctctgcctccaccagcctctcctatgactccaggtgagcttcctagaggtctggccttcacattttgcaaggaccatcattcctctcagcccctccacctcccacttctgtaatgtgtggctcattctatgtgtctcagtctctggcggggagtacctggccttctgcaattgtgagtctggctctcggaccctctggttctgagtcacggggctttagatgggacctaagtataggcattcagcctcccgtggttccatccctttggaatgcttcacctgctgcagaagcttgtacacacctctcactggacgattccagttctggggttgttggaccagagtttctttcacttttggcctccacgtgccatgagcttgggtgtctctctgcctcttggactacagagttccctgaccttgattcttggctgtctgaatatggtgcctgtcttccggggtctctaagggaaagagccgtttatttagaagcctgacagaagatggcatcctgcagggtggaagatttaggagtggggacagaaatccctgggggcctatctccagtacaactggtctggcaacagctggtcctcagcagtacggggagtggtcgagcacagggctttcctctgcactcaagctgcactgtattttaagatacttgaggcccttgcaaaagtagaattaaaagtataatgcctggccaggcacggtggctcatgcctgtcatcctagcactttgggaggccaaggtgggcagattacctgaggtcagtagttcaagagcagcctggccaacatggtgaaaccccgcctctactaaaaatacaaaaaaaattagctgggtgacagagtaggactccatctcaaaaaaaaaaaaaaaaaaaaaggacaatggtataatgcctgtagaggtctgtcttggagtctgtgtctcttgacatctgtctaggtgtcctctgctgttgcctgttttttctttcttcctgtttgttggttggtttgagacagtctcactctgttgcccaaattagagtgcagtggcatgatctcagctcactgcaacctccgcctgccaggctcaagtgattctcatgcctcagcctccggagtagctgggactacaggcgtgcaccaccatgcctggcctatttcttcctgtttctttggtttcaccagcacttcaggtcttggtttctgtctctaagcatctgaatctgtgccttgtcctgtgtgtctgtgtgtccatttctctaacacccgtgtgtgtgtgtgtgtgtgtgtgtgtgtgtgtgtgtgtgtgtgtgtgatgtctgtcagtctctccatccaggctctagggtacagggtccttcagtccctaacccccagccctatgtgacctatcttgttccaccagtctggtgagaggcaaggtgggataagcagggcctctgcactgcatggcctcaggaggctcagagaatggtgctcttgtgcttttgcagtgccgggatcctagctctaagagcatatgctttggagttggacgttcttacgtttgaatcctggctctgccactccctacctggttttctcctctggaccctcagtttccctcctcgcagggctcttgtgaggatctggtgagataatctatgcccaaggcatagattatctcagggactacataacaggcacctttgagagagcatgggagaagatggataagagaatgctgttcagcgcttttctcttccactttcctggtactgaggggaggactcagggagaggaatttactgtgattgttctacctcattctcatcatcttcctctcccacttctgatacagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcatttggttccctcaaagggaagcccttgccagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgcccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcctgcctggcttcagagagcccagcaaccttctaggcctgctttccagacttctgagatagcctgggatgagcaatcctgttatagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgttaaagtta

SEQ ID NO: 486 - DNA, 92474 bp, Homo sapiens
agggaccaggcttgggaggcgacgaagaggaacgctgggcgcaggaggcccactgcatacgcaggcgcactcggcgatcccggcttttccgcgcgcagttcccgcacaggcatcggggggggcaggggcggggcaggggcggggataaatgcggagggacggtccagctttagctctctgctcgccgccgccgctgtcgccgccacctcctctgatctacgaaagtcatgttacccaacaccgggtaagggggtaggggcggcgcggggagagaccctgtcgggcgaaggacgcgtctcggtggggccgccgcggatcgcccgggctggccggcccggctgtgggaggtcaaggatactgcctgggcacgctctgagctctggtccgcgctgggcactgtgcaccgagaatctgcggtaacgtgtgaaaaggaacacaaacttttgtattacaggatggcagcagtgtagaaaccttttccacgggtaaagggccgagggggagtcaccacgccgcccccagtgccggccctccctgagtttagcaggagtgcgtgcctggccgaatgcgtgtgagttctaggtgaaaggtcgcaggagcagctccagagtttaaagagttttcacttgttcctgacgctcaattctagagtaataatggagtgtttaaaaaatgatttccaaattagaaactaaaccgatcttaaaacatgggtatctttgggggatttttttttcaccttaaaaaattgtgttaaaatacgtacaaaatctgccatcttaaccgttttttaagtgtacacttcagtagtgttaagtagattcatatcgttgtgcagtcaatctccagaacttttttcatctgcaagctgaaactctatccatgaaacaactcctcttccccacctccgctcgtacattggcaaccaccattctactttctggtttatgtaaggtctgggtatcttgagttgagtgacgtgttgtcagattttgtaatttgcctgaaacatgcaggcatatagccaaagacttaaaacagttcaaagagtatagggtaaaaagtgagtctccccatccctaaaatctagttccccagttacttacgtttctatttcgtgcatgtatgaacataatttgtatacatccggatacacacacacacacacacacacacacacataccctttcttaaaaatagcagcagactctattcttggtcttgctacttttagttggtatgtcttgggacattctttctttgttttttttaaagacggggtctcccatgttgcccagactggcctgtagccttgaactcccaggctgatgttcctcccttcttagcctctggagtatttaggattacaggcatgcaccgctgtgcccagggacatacatttttagtacatggcagatcttccgcctcctttttttttcttttgagatggagtctcgctctgtcttccagtctggagtgcagtggcatgatctcggctcactgcagcctccgcctcccgcaattctcctgcctcagcctcccgagtagctgggacttcaggcgcgtgccaccacgccctgttgatttttttgtatttttagtacagacggggtttcaccatgttagccaggatggtctcaatctcatgacctcgtgatccgtctgcctcggcctcccaaagtgctgggattacaggcgtaagccactgcgcctggcccctcctcctttttaatggttgcataatattctgtaacagcttgagtatccattatccaaaatgcttggttccagacgtgttcggatttcagattttcagatttggtttgctcaacctgtatatgaatatacctttgtttatttaacctgttccctattgttggatactagactgtttccagttttttggatactctttttttgcttccataattatacttgtatttatctatttgcacatatataagtgtatatgtaggataaactcctggaagtgaaattgctggatcaaagagtaaatgtggctgggcacagtggctcacgcctgtagtcccagcactttgggaggccgaggcgggcggatcactggaggtcaagagttcgagaccagcctggccaacgtggtgaaactccgtctccactaaaactacaaaattacaaaaattacaaatacaaaaattagctggacctggtagcgggcacctgtaatcccagctactcaggaggctgaggcaggagaaccgcttgaacctggaggcggaggtggcagtgagccgagatcatgccactgccctgccctccaccctgcgagagagagtgagagtctgtctcaaaaagaaaaaagaggaaatgcactttatattttgacagatatttccagatgaccccccagaagggttgcacacccaaaaggataaatgagatcctctaatcccacttgttggctaaccgcaaaatagttaatgatgaaaatctaattagagaaaaaagtgtcacctcattattgttaaaatttgcatttattttatcacaagtgtggatttggatctctttgtgtatttaaaccagggacaatttgatccccagaggacatttggtaatatctcaagacatttttgatagtcacaattgaatggagatgctaatggcatctcgtgagtagagtacagggatgctggtgcacatcctacaattcacaagcattccgtacaacaaagaattatgtagtccaaaaggtcagtagtgcagaggttgagaaaccctggtttaaagccatctatgtatctttatatttgtctggcttaacaaatgaggtttttcgttaatctctgagggctctgtgtattttaaaaatttgtcttttatcacattacaaatattttccacagtttttcatgttgcatctggactttgattatactgtttatttaacatggagaaacatgtttttgtgaagccagagttatcagtctcttaaggcttttgcatttttgagttaaaccaagatctttttttttttttttgagatggagtcttgctctgtaagcctttgagttaaaccgagatctttctttctgtctttcttttttttgagatggaatcttgctctgtatgcctttgagttaaaccgagatctttctttctgtctttctttttttgagatggaatcttgctctgttgcccaggcttgagtgcagtggtgcgatctcgtttcactgcaacctctgcctcccaggtttaagtggttctcctgccttagcctcacaagtagctgggattacaggcgcacaccaccatgccggctaatttttgtaattttagtagagatggagtttcaccatgttggccaggctggtctcaaactcctgacctcaagtaatcctcctgactcggcatcccaacatgctgggattacaggtgtgagccaccgtgcctgggcagatctttttataattagttttcttctgatatttttatggtcttatatttttgtatttttcaaatatatttgtattgtctatattttttatagtcagatttttttatccccctgagatttctttcaggaagtgagttaggaagcccacttgatttttcttcagatggctgctcatttgtcctagcagcattgacctaagagttaatcttttctcttctgctcgaaattctacctctgttgtatattaaattcttgcacatatagcgctctgtttctggactttctgctctgctactttagtctctattcatgtaccagtaccagactgtttacttaattaattaattgagacagggcctcgctctgtcacccaggctggggtgcattggcaccatcatagttcactgcagccttgatctcctggggttaagcagtcctcccagctcatcttcccaattaggtgggactatagacatgcgccataatgcctggctatttttaaaaaatttttttgtagaggagtctcactttgttgcccaggctggtctcaaactcctgggctcaagtgatcctcctgcctcagcccccgaagtgctaggattacagatgtgagccactctacccagcccaaactattttaattgctctagttttacaaaatgttttaatatgtgggaaagctagttcccaccacatttggattatttttcagaattttcctggttatacttgggtatttatttttccaaatgaagtttagaataatttgtatagttttttggaaacagttgttcttccttttactaaaaatttcagtacttttacctgattttggggtaccagagaattttagtaaattaaactgtaagttagctcttcatcagcaagttttagccatctatcaataatactaagaaatttggagccttctttgaagtgctcttgccttctatattctggtactaatgctttggagctggaggacttcttactggcacagatcagggttatgtttgcttttttttctgccaatgccagagactctgagtgaggaagaaaatgccctttctcctactgggaatcaatcaagctatactcaaagcaaagagatatggcttttttttacagcaatagttgggacattttcttgtaaatacttacattaaaaatcactttagcctgtggtcccagctacttgggaagctgaggtgaatcacttgagcccaggaggttgacgctgccatgagctgttgaggctgttgtggtaaactgaggaccagagagaccgatattgggaagacaggaggatgtttatttaaggtactcaccggctcagtggattcacatccaaaaagctgagccttgaacaaaaacagagtttagcttatataggccagcatacaagatcaaaacaaaggcagtaaattttacagtgacaaatcacgtaatccatagcataactgctgacctggcactaacctgtggccttgcatagctagtggcctagcagctgcatcgaaagaaaaacaggaactttgcaaatcttactaaatacaagcattggcaaacatagtcataactaatagtacaagagagacagtaaaggaaattgtttttcgtcttttaaccttgctcaggggtgtctggagttcatttctgcaggctaggtcaccacgacctgtctacagccttgcttgcagtagtgaaaaacttgtgcaagactgtcaaaagaaaaacacaacaacaacaacaacagaaccactttaatattttatgtatactaccttttgtatgaaaaaaggaagggatagtttttcacatacatagagtgttttatatatatatatgtttgcttatgtttgaaaaaagtacaaaaatgataggccagaaattaatgaagctggtcacctataggtaagagatcagacttcttttttaaaagtttttaagttttatttatttatttatttttttgagatggagtcttgctctgtcgcccaggatggagtgcagtggcgcgatctaggctcactgcaacctctgcctcttgggttcaagcgattctcctgcctcagcgtccagagtagctggaattacaggcatgcaccaccacacctggctaattttttttttttttgacagaatcttgcactgtcgcccaggctggagtgcagtggcgcgatctcagctcactgcagcctccacttccagggttcaagcaattctgcttcagcctcccgagtagctgagattacaggcacctgccaccacgcctggccgatttttttttttttgtatttttagtagagatggagtttcaccatgttggtcaggctggtctcaaactcctgaccttgtgatccgcccacctcagcctcccaaagtgctcggattacaggcgtaagccactgtgcctggccaatttttgtattttttagtagagacggggtttcaccatgttggccaggctggtcttgagctgacttcaggtgatctgcccacctcggcctcccaaagagctgggattacaggtgttaggcaccatgcccggccaatttttttaatttaattttttttttttaaatagtaacatggtcttgctatgttgcctaggctggtctcaaacttgggcccaagcaatccacccacctcagcctcccaaagtgttgtgattacaggcatgaaccaccatgcctaggcctcaactaattaaaaaaatatttttttggtaaaggtggggtctcactatgttgcccaggctggtttgtaataatatattttaattctcttttttaaccccacaagtattattttattattattgtactctttctaaacaagatttctgtacttatttaccaatatctttgattttcctattttcttgaatttcagaccttccatctggaaacacttttcttctgactgaagtgtaacctttagtaaataaggtgtaagacaggaagaaaaagtatttggattataatgaaataaataatgctgtcgttatttgccgatgatattatcctgcacagaaaaccaaaataatgtataactgaattattataattaataaaagtttaagaaaattgctatatataaaagtcaacaaataaaaataattttgagcttggcatggtggctcatgcctgtaatcccagcattttgagaggccaaggtgggagaatcgcttgagcccaggagttcaagaccaccctgggcagcacagtaagactctgtctctaccaaaaaaaaataaaaattaaccaagcgtggtgatgcacacccgtgatcctagctattcaggaggcttagtgggaggattagttgagctgggaaggtcaagtctccagtaatctgtgattgtgccattgcacaccagcctgggcgacaaagggagactctctcaaaaaataatagtaagttagatttctacacgagcaaaaatctgcaagaagtatatagtacatgtcaataaaaatgagaagttcaaaatcccagatatggactccactacaggacatatgatgtatattcttcagcaaataaatggcataaagagtggaagggaagctggcagtgattaaaagagaaactcttaaggtataacagccagatgtaatgtgaggtccttattggatcctgatttgatcaggccaaccataagaaaaactgagatagttataaaagtttgaacatagacagatattgagtgatattgagaaattattgttaattttcttgggtataataatgacattggtattttaaaagtttttatctgttagaaaagtaaatactgaagtattcataggtgaaagtatataacctctgggatttggtttcttttcttttttttttttttgaaacagggtctcactctgtggttcaggctggagtgcagtggtgtgaaatcagctcactgcaacctccgtgtcatgggctcaggtgatcctccaacctcagcttcctgagtagctgggactatgggtgcgtaccacatgcctggctaatttttgtattttttagtagagatggggtttctctatgttgcccaggctggtctcaaactccagggctaaagcgttctgcccacctctgcctcccaaagtgctgagattataggcatgagccaccatgcctacctaggatttgttttctgatgattgctttcacaatttagtagttgaataaacatggaagcttattatactcttttctggttttttaaatgtatttgaaaattccataataaaaagagtcttcgtttttgcactgattgtttattggttgcaagggaaggaatagtaactgtgcagtggagaaatatggtaacactatggttagatgataaaaattgacattataaagtgagtacggatggacgttgtatgctgccctatgggatatactgaggaaaatacagtatcacatgttctggttggaaatgcataaccggaatctaatcatgaagaaatatcagttgaatccaaaatgagcattcagccaggggtggtggctcatgcttgtaatcccagcactttgcaagaccaaggcaggagaatcgcttgagcccaagcattcaagaccaggctggccaacatggtgagaccctgtctccacaaaaaataaaaaaattagctgggcttgatgatgtgtgcctgtagtcccagctactcaggaggctgaggtgggagatttgcttgagtccaggaggtcaaggctgcagtgagctgtgattgcaccactgtacttcagcctgggtgacagggcaagagcctgtctcagaaaaaaacaaacaaaaaaaaacccaggcacagtggctcatgcctgtaaccccagcactttgggaggccgaggcgggcagatcacgaggtcaggagttcaagaccagcctgaccaacatggtgaaatcccgtctctactaaaaatagaaaaattagctgggcgttgtggtgcgtgcctgtaatcccagctactcgggaggctgacgcaggagaatcacttgaacgtgggaggcagaggttgtagtgagccgagatcgcgccactgcactccagcctgggagacagagctagactccatctcaaaaaaaaaaaaaaaaaaaatacgccaggtgtggtggcttacacctgtaatcctagcactttgggaacctaggtgggtggatcacaaggtcaggagtccaagaccatggtgaaaccctgtcactgctaaaaatacaaaaaaaaattagccaggtgtggtggtgcatgcctgtaatcccagctactcaggaggctgaggcaggagaattgcttgaacctgggaggtggaggttgcagtgagctgagatagtgccactgcactctaacctgggcgactgagtgtgactccatcttggaaaaaaaaaagtaaggatcattatattttttaaaaaaggagtgcagactgtatttttcaaaaggtcaatatcataaaagacagaagaggctgcaaaaatgttctagattaacggagactaaagagatatgtcaattaaaagcactaccctaaaccgggtcctgtagtggaaggaaaaaatgctctaaagggcattattgagtcaattgacaaaattaaaatactgtgaaagtagatacatgagagaccaagctttgatgtattcagatcactttttttttttttctttttgagacagggtcagtctctgtttcccaggctagagtacagtggtgtaatcatggctcactgcagcctcaacctttgggatcaaacagtcttcctgactgagcctcccgagtagctgggactacaggcacacactgccacacatggctaattttttaattttgtagagacagggtctcactatgttgccctggctggtttcgacttctgggctcaagtgatccccgtcttggtctcccaaattgctgggattataggcatgagccactgcacctggcctcaaatcactcttaagtggtttggagaaaataagatatagagaaggagaaagggagaaggagagaaaatgagcacaaatgctaaatcattggggtaaaatattaacaatacatgaatctgggtgaaggatatgtgaatattttttttgtactattattcttgcaactttaaatttgaattatttacaaataaaaagttggaaaaagttaaaaacaatggagtacctaggaataaagccaacaaaagatgtataatacctttctgtaggaaattatatcataatgaaatacattagaaagacctaaataaatggaattataccatgttcatggattagaacactcactgtcacaaaaatgtcaattctttccactttgaattatagacttaatgtaatttctgtcaaaatctcaactgatttcacttgaccagttagataatgagattctaaaatatatgtgggccgggcgtggtggcttatgcctgtaatcccagcactttgggaagccgaggccggtggatcacttgagctcaggtattccagaccagcctagccaacatggcaaaaccctgtctctactaaaaatacaaaaaatagccagtcatggtggcgcatacctgtagtcccaggtactcaggaggctgaggcaggagaatcacttgaacccaggaggctgaggttgcagtgagccgagatcacgcccctacactccagcctgggcaacagagtgagactctgtctcaaaataaataaataaataaataaataaataaataaagtaaaaaataaaataaaatatatgtggaaaattaaaggtccaaatatagacaagaaactcttgaagaagaataaattggaatcatttgccttatcagttattaagactgataaagctgttttaattaaggcagtgtgatcatgtagattagtggtacagaatagagagtccaaaagcagataatatatatatttatggacattcagtttatgacagagctgatattgaagagcagtgggaaagatgggcatttcagacttggacagttggttatctatgtagggaaaaaatgtattagtcccttacttcagttcatacacaaaaattaattccaggtagattaaagaccaaacttattaatttatctatttagagacagggtctcgctctgtcaccaagctggagtgcagtgacatgatcatggctcactgcagcctcgacctcctgggctcaagcaatccttcacctcagcctcctgagtagttgggactacaggtgcacaccaatacactgggctaatttttttattttttgtagagacagggtctcactatgttgcccaggctagtcttgaactcctgggctcaatcgatcctcccatcacggcctcccaaagtactgggattataggtctgagctaccacacctggcctcaagaccaaactttaaagggtaaaccataaaacttttgaaatacaaattaatccacttacaggaaaaaaagaatttcttaagattcccaaagccctggccataaaagaaaagaattataaattctttaacaaattttctaggctggacgcagtgactcatgtctgtaatcccatcactttgggaggccaaggtgggcagatcacttgaggtcaggagttcaagaccagcctggccaacatggtgaaaccctgtctctactaaaaatacaaaaattagccaggcatggtggcacatgcctgtaatcccaactatttaggaggctgaggcaggagaatcacttgaacccaggagacagaggttgcagtgagccaagatcacgccactacacttcagtctgggtgacagagtaagactccatctcaaaaataataataataataataataattttctataatcccagtgctttgggaggctgaggcaggagaattgcttgaggccagaaattaaagatgagcctgggcgacatagcaagaccctgtccccccccaaaaaataaaaaaattaaattaaccaggcatgttggcatgcacccgtagttccaggtacttgggaggctgagacaggagaattgtgatcccaggaataggaggttatactgagttgtgattcagacactgcacttcagcctgggtgatacagaagacccaatctctaatgataaagaatttctgctaatcaaaagacactataaaaatagtgaaaaagcaagccacaaatgaaaagatactgaaatgtatgtaatttatagacttgtatgagtcaataagaaaaaagttaaccttatttatagaaaaacgggcaaaaccagccaggcttggtggctcatgcctgtaatcccagcactttgggaggcggaggcaggtggatcacctgaggtcaggagttcaagaccagcccaaccaaaatggagaaaccctgtctctactaaaaatacaaaatcagctgggtgtagtggcacacgcctgtaatcccagctacttgggaggctgacgcacgagaatcacttgaacccaggaggtggaggttgcagtgagctgcagcctgggcgacaagagcaaaactctgtctcaaaaaaaaaaaagaaaagaaaagaaaaatgggcaaaaccaattaataggaactttgcaaaagaaggtattgggggaacctgccccaagtatttcaacataggttctttctattttccttaagtgtcggccagctgagaaatagagacagcacaaagagaggaattttacagctgggcctccaggggtgacatcacatatcagtaggactgtgatgcctgcctgagattcagaccagaaagtttttattaagagtttcaaaagagggggaggtgtaagaacagggagtaggtacaaagatcacatgcttcaaagggtgaaaagcaggactactaataagggtctaacaaagatcacatgcttctgagggaacaggacaaagggaaaaagcagaaccactgataagggtctatgttcagtggtgcaggtattgtcttgataaacatcttaaacaacagaaaacaggtttgagagcagagaaccggttgaccacaaatttaccagggcagagtttttcctcaccctagaaagcctgagggcactgcaggagaccagagcgtatctcactccctcactccttatctcaactgcataagacagacattcccagagtggccgttgatagacctgcccccaggaatgcatcccttttccagggtattaatattaatattccttgctaggaaaagaatttagcaatatctctcctacttgcacatccgtttataggctctctgcaagaagaaaaatatggctctttttgcctgaccccacaggcagtcagaccttatggttgtcttcccttgttccctaaaaattgctgttattctattctttttcaaggtgtgctgatttcatattgttcaaacacacgttttacaatcaatttgtacagttaacacaattatcacagtggtcctgaggtgacgtacatcctcagcttacaaagataacagggttaagagattaaagtaaagacaggcataagaaattataaaagtattatttgggaactgataaatgtccatgaaatcttcacaatttatattcctctgccatggttccaactgttccctccattggggggtcccagacttcctgtaacatctctccctttctttttatataaatgagccatggcgatgaaggcttgttcgttctcttggttttgacgcaggattcgttgactggtctggcacgctaaaaagtcgattaaacagagaaacatgattccaaaatttactacagtggagcccccaatagacttaatccaagtcgtggggtttagtccagaaagactttctgccacctgacctaacgcctcagctccaggcacaatggataaataagcttgagaggcttcaaaaattattgtctttaatttagttacgtccaaggataaatgatcttccctacccagcaggtgtcctttgaccatttcccatgactcatcagtctcattgtaggaatatggtgtgatacagaaatcagaagtattccagtcacactgcacttgcatgtgatattcgagactcattagccaatctccaagccaaataacagactgtcttaaatcgttaatttgattagctaatttttgatcaatgccctgttgagaattccacatttgggtggaattggcttgccaatcattaacaaaatgagccacttgaatagattggtgtaacgccactctggcagtggtggccagtgcagtgactgtaattaggcccatgatcacagcgattaaagtgaaaacaaatctcttagatcttttgagaatttgctgtagcacttcattaattaaatgtactgagggggaagattcccaaggtctgggtaaagttactggtatccagattccttcttgagctcgaaccaacattacacttttcctgaagtcaaaacaggagttaacacaagtgcataaatgacaatgtattggacagtttgattgttcatccaaattttgatatttcccactaacagcatgtaaggaggcttaacacaactctgtataggaatagtcaggctggaggtaatcaaagcagaatgtttgaatctacgttgatactgagggagaggagcagcgtggcaatgcctgatgttctccaccataaagaagcaatctgaggtgcccagggatgccgaagaggtagaggggcatacctgggtcgagaagaattatcataatgccaattggagtcccataaagggggatcggcgtcaaaaagaggaagagggttcaaaggggatttatcatggggttcagaatcacagatgtgaggggtggtagtggggacaacagacagaaaagtttccccttcccatactcgcagtccggacatggcaatagccaatttccaaagttctgggtgttctgggctcagaatggggaatatcatacaaagcctcagggctggggtgggcgggtaatgcccttatcttctcattttaagggaaagaacgagctgaactacctatggaaagaaggatggtgatcctcgtcctcccaataagaaataaaataagtagcctccagacatcctcttccgccagaggagcaattgttttttaaatagccctttggtgcccagtctattactaaaccatgtgagtcattttttaatactgctgcatgtgagttaacacaatcttcctaaattaaagttttagatgggccctcaaaatttttaggacatagttttcctatgggtttatattgaaaatatggggtatctcctattactccccctttcatttgtcttaaaggagaaagggagaggccggagaccaaatgtccccattcccctgtggctgatctctccggaaggtaagcagcccagacttgagtttctagatggatacaaccaggtggatgtccgaggcacagaggagggtatttataacccatagtaacattaaatgcagtgccttcttctcctggtcgagtggggcaatggtcatctgtagctccaggcatatatacactatcgttagtatagatttctgcaggagcatccatccaggtgagaggtcgaataagtggaggaaaaggcacataagcccaataagaataattttatgtagcaggtaaatcagtttgaggggaaactggtgagacagaaagtgtaaggaggagaattattaaataaaacctactgtaagcgagatccagtgctggaggaggaagagaagaacagagggatgttattttcaggctaatagaaatggtgagatttttaggttcgtaaggagaaaaagaaaggtaattaggagatgtgggattagttagaggggtctctgttgccatttgggaggactgaaccagacccattttgatttggcctaccagtttctgaggagtcggcacagatctcaccaggtatgagggcagtctctgacgcggacatctcttttctgtggttttcattgtcagtatgcatacgaagtttaagtcttctagtgggcacccagacaggggattgatgatctcctggtgaaacgcaagcataccctcttccccacgttataattgttccaggttcccaggtattggtttgggagtttttccataacactggcttgctttcattgagggagaattttttgcctatgaatagtgttcagcagcattccctgaggaagtactttccattgataatgagctgcaggctcctgattattgatagatggtacagtaaaagcaaattttgacaatctgatttatgtaaagcaatatgaaagaaacagtctttaagatcaataactatgagaggccaattcttaggtattaaaggaggggcaggcatgccaggttggacggctcccataggtttaattacagcattaatggcccttaaagcagttaccatcctccacttccctgatttcttttttactagaaacacaggagaattccagggggaaagaggaggttccacatttccaagttgtaactgttcagaaaccaattgagttaaagcctccagtttttctttagagagcagccactgctcaatccaaacaggtgtttcagatttccctcgtagaggaacaggattaggaggcgtagcagtggccgtcattaaaaaggataacctaaaccagccctgtcttcttttacggtaacttgaagaggtttggtaattccttcatgtcttggactgagaccgagtcctggaacaaaccccatgttttccattatatgttgactgggagcactataagagttatgtggaatattaatttcagccccccattgtgccagcaaatctctaccccaaagattaatggggattggtgtgatatgaggctgaattgtacccttttgaccatcagggctagtgcaaggcaagataaatgtgctctggtgaacttcatcagcttttccaacccctactagtcccattttagtgggatgtttaggccaggaggaaggccatagattagaggaaataatagaaacatcagccctagtatctactaggccctcacacttttttccttgaatgtgtatggtgcaggtgggctgttgtttagaaattacattaatccaataagcggctttttcaccaccagagcccatcccagggccccgtgtcttatctcctttgcttaaaacaatattaggtggtaaaagtaattgagcaattgactcaccagctggaatggaaacaggaaccttggcagacaccataagtttattctcattagaggaatcaaaatgagaccagtatgaaccgtgattcctttagtagtagtggatgtcatacctaacaccaggcccaccgaaccttgaggtaaagggccagaaccttgaggtaaaggccccgtgaggacaattaaagggaaagaattaggtagtaaatttagaggaatggtactacagagattgaccaccccgccccctactgtggaggtagacaagtgtactgagacagaagaagaggctgggacctacctgagttggctgtaggtaagtttgtgtgtgctgggggctgtgttgggaccgcttgaagcagaaatgcaacactggtctgagtctgaggtgtcccatttcatattggggcctgagactggccccgcttccgatttccctggttctgtggcaagggatttccatctatatcagacttagaacggcaagtacttgcccaatgtttgcctttatgacaacaagggcaaacagtagcaggagcatttggctgtgtttgttgagctggcttggctgcttttaagtttttaatggtgcagtttgttcgagtatgaccaagttgaccacagttatagcaggctccaagaaaagaatcagtcgagccggtttgattgccgtccttcatagcccgtgcccacagaatagctttgtgggtccctgatccaatgccttcacaagctttaatatatgcaggcaacacctcgtgatcagctaaattttgtcattggatggcatgcatggccattttacactcatggttcacattcttaaaagctaacatgctaacatacaaaggagaataccttgagcgtgctcatcagagatgaatttttcaacagcatcttgtaatttagccaaaaaatcaggatataattcattgcgaccctgtttaacagtagtaaaagaaacaggagcttgacttggggcacgtaatttatcccaagttctcatacacacctttgttacttgttccatggtgagagcatcaaagcctaattgggaggtagtgtcagagtaattatcggagcctgtgagctgagcctgagtaattggaatgccatcagcccaatttagctgagcctgcagacgggcctcctctcaccaccaggtacggaattgtaaatgctgagatggagttagaacagcttttgccaaaaggtcccagtctaaaggaagcaaaatgacctcagtacaaagagtctgtaataccattttaacatatggagaagtaggaccatactgagtacaagcatccttgaattcttttaaaaaggtaagattgagcggcctaaatcaatgcacttgtaccccttgagcactgggagattccagcacgaccggataagccgacacctctaatccacttgtttcttttttctggcgtaataagtgttgcatggaagtttcaagaacaggcacatgagatggactcggcatagaaatgacaggaaaagtatgtgtagataagggaaactgaggttgaggaggtcggactggtatgagagtatgagaaaggggcattgggggagcagaaaaggcataagcatactggtgattattggctcaatcctgtgcaaccagagtggcaggggcatccacgtgtgaagaagggtacagagaagcaggttgaatggatggcaaagtgaccaaatgagggaccgaaatgacaggagagtgaggggctgtggtggatgagggagggcctgcagaattacaggtaaattgtagtttggttccggagccatcagatggctccggaagcaaaggctgcaaaggtttgaagagggaagagttagtatagatatggtcctgggctgtccaagtcgggtccgtgggagctacaagtaccggctcctcatgaaaagaaataagatcattgggggtgacgttaagccaaagtcaccagagttagatattgagtcctcaatatcgtcaggtaggggaggagttggtgaagggagaggcttgagcagataacgaaggccgaacgggagaggaaacctgaggaagaggtagagggtcaccagacacagaaaactgtggtaactgcagggggttacaggattggtattttaggacagcacttaccaaggcccaatcaccccaaacagtgacgggagcataatttcctgttgggaccagttcctggaattttgcaccaacatgatcccatagtcccacatctaacattcccttttcaggaaaccaaggacagtgttcttccactgccctgaataggatgtccatattttccataggtacctgaactcctccctgttttaacaggagtttaatatagcagagataagcataatgcttagacttcgtgtgacccatagttaccccggacaatacacagacaactcaccaattgtcagggagccgaacaagcgtttctgtgaaccggaccaatgaacgtttctatgcacgtaccaaaaggaatcgggttcccacatgcacttaggaaaaagccacttggcatgccagatattgggggaacctacccctaatatttcaatgtaggttctttctattttctgtgtcagctagctgagaaataaagagagacagtacaaagagaggaattttacagctgggctgccgggggtgacatcacatatcggtaggaccgtgatgcccacctgagtctcagaccagcaaggttttattaaaggtttcaaaaggggagggggtgtaagaacagggagtaggtacaaagatcacatgcttcaaagggcaaaaagcagaactactaataagggtctaacaaagattacagggcaaagggcaaaaacagaaccactgataaggatctatgttcagtggtgcacgtattgtcttgataaacatcttaaacaacagaaaacagggttcgagagcagagaaccagttggaccacaaatttaccagggtggagtttttccccaccctagtaagcctgagggcactgcaggagaccagagcgtatctcactccttatctcaactgcataagacagacgttcccagagtggccgtttatagacctccccccaggaatgcattcctttcccagggtattaatattaatattcctcgctaggaaaagaatttagcaatatctcgcctacttggacatccgtttataggctctctgcaagaagaaaaatatggctctttttgcccgatgccgcaggcagtcagaccttatggttgtcttcccttgttccctaaaaatcactgttattctgttctttttcaaggtgcactgatttcatattgttcaaacacacatgttttacaatcagtttgtacagttaacacaattatcacagtggtcctgaggtgacgtacatcctcagcttacgaagataacaggattaagagattaaagtaaagacaggcataagaaattataaaagtattatttgggaactgataaatatccatgaaattttcacaatttatgttcctcttccgcggctccagctggtccctccgttcggggtccctgacttcccgcaacaagaaggaacacaagcgaccattaacatgggaacaaaaatatattccacctcattagtaactggggaagtgcaaatgaaaatcaccttgggatatcatttcataatactgaattggtgaaaaaactttaaggtcagaaattaccaagtgttggggaggtggtggagctacgggaactcttatactcattcactgctgctggtaaggatattatcctctttgggcagggcatggtggctcacacctgtaatcccaacactttgggaggccgaggtgggcagatcatgaggtcaagagatcaagaccatcctggccaacatggtgaaaccccatctctactaaaaatacaaaaattggctgggcgtggtggcgcatgcctgtagtcccagctacttgggaggctgagtcaggagaatcgcttgaacctgggaggcggaggttgcagtgagccaagatcgtgccactgcactccatcctggtgacagagtgagactccgtctcaaacaaaacaaaacaaacagaaccacaaactggatggcttaaaacaaatggatgctctcactgttctgtaagctagaattctgaaatcaagatgtcagcagggctgtgctgttgtagttctgggtagaatccttccttgcttcttcccagcttctgggggtggccagcaatccttgtgttcagggcttgcagctgcatccctccaggctctctgcctttgtcatcacacattctccatgtggctgtctttacatagtcttccttcttcttagaaggacacctgtccgattggagtaagggcctactccaatatgacttcatgttaactaattacatcttcagcaatcctggttccaactgaggtcaccttctgaagttaggacttccacatgctttttgggggacacaattcaatcaataacagggagataaggccggggttatcttcctgttattgattgataacatcccttgctgttatcttaattttattcttttattcttttttaatgagtttaccaggaagttattttagatgtctccttcttacttagcaagtgagtaagtaaaaagtttaaatgaacttaatttaatgctaataatcccagcactttgggaagccaaggcaggaggatcgcttgagcccagttcaagaccaacctgggtgacatagtgagaccttgtttctacaaaaaattaaaactttttcaggtgtggtagtgcacgcctgtagtcctagctacttgagtggtgaggcagaaagatcacttaagtccagaggcagaggttgcagtgagccacactccagactgggcgacagagcaagaaccgctctcaaaaaaaaaaaaaaaaaaaaaaaaaaagtagcagagagctaatgttttacctaattgggattcaaaattagcattccttgtcatcgaattgatcacaaatactcatctgtaacaatcaatcttagctccagggccacacacagacaggtggtgggtcagatttggcctggggccatagtttgcagactgttgatttagactcagagacctaggtactaggaataatgaaaaaacaagggagtgcataacatttaaggtagttttcgttctgtggggtgggggagggaaggaggatagagttggagaggaatatacaggctggtttctggggtattggtaatattctatttcttgccttgatactactgttcattttaattttgttcattaaacaatacacattgttttacatgctttttatatgtgtgctatatttcatgaaaaataatttcaacctctctgacttctccccacttctccactctccctccttcttaccaaacaaattattccttattttaaaaccgcttcccacttttacctctgatctctttcttctggagtgtaatcctctgggtcgtgcaagagttttatgttcctttattaacaaacctgttaatctatcaccaatctcaggtcatccctttttctttgtcattgtcacttttgctcttctttctccattcttttccttaagcagacttttaaatttgcccttagaaagtaaataagaaagcgggtttcccttgctgttatctttattttattcttttagtttttcttttatgagtttactaggaaattattttaggtgtctccgtttcacttagccactgagtaagcagaaagtttaagtgaacttaatgaaatggggggaggccagggtgggaggatcacataaggccaagagtttgagacctgcctgggtaacataccaagaccctgtctgtacaaacaattttaaaaagtaactgggtatggtggtgtgtgcctgtagtcccagctacttgtgaggctgagatgggaagatcatttaagcccaggagttcaaggctgcagtgagccatgattgcgccactgtactccagcctgggtaacagagctgtcttaaaaaaaaaaaaaagcacgtaggagttcaaggccagcctgagtaagatggtgagaccccatctccatttaaaaaaagcaaaaaacaggctagccgggcgcggtggctcatgcctgtaatcccagcactttgggaggccaaggcgggtggatcacgaggtcaggagttcgagaccagcctggccaacatggtgaaatcacgtctctgctaaaaatacaaaaattagctgggcgtggtggcccacgcctgtagtcccagctacttgggaggctgaagcaggagaattgtttgaggctgaagcaggagaattgcttgaacccgggaggcagaggttgagtgagctgagattgcaccaccgtactccagcctgggcgacagagcgagactgtgtctcaaaagaaaaaaaaacacacacacacacacaaaacacacacacacaaagaatgaaatgggcacagggacccatcagtacatttgaatcagaatatttcagatcaacctgcagcaatttgtgagcgtttgtttatttaacagctcttttgagatgtgattcacgtaccccactatgcagtcatttaaaatacgcaattcattggcttttaatatattcacagagttgtgccaccatcaccacagtcaattttaaaacctttaatcatcctagaaggaaacccctcaaccctccgttgtcagcctccaatccctcccactcccagctctaggtaacctctgatctttctgtctctataggtttgcctattctggacatttcatataaatggcatcatatgtggtccttcatgactggtttcttcctcttagcagaatgtttttggttcatccatgttgtagctcatagcagtactttattgcggaacattatttcattgtatgcgtggctacaccacattctgcttatccgttcatcagctgatggacgtttgagttgtttccaccttggctattatgagcattcattgaacaattatttgcttttaggtaatttattttaagtggtatgtagtcattgtggaaactttgaaaaatattaaagaatataaaggatgtgataaaatttgctcataatcccaccactcaaaaaaaaaaagctttattaacacgttttctgtggggaaaaaaatgcatgtttatataatttgttttataattctttatttctcttgaagatttgctttgcatttgaacagattttgtttgctaaatcacagcaagactggccaactgcagttgtcataaataatttatcagtcattgtgcaatgggagtatagtggagttatctgccatcagatgggcatggggagggtttagagaaaatttcacagaggaggaaacatatattatgaaaatatgcatgaggttctgatacctgtcagtaaataaaacattgggtcttctaataaggtcgtatttgttctgttgtaggaggctggcaggatgtacagtttttatcacaggtgcaagccgtggcattggcaaagctattgcattgaaagcagcaaaggatggagcaaatattgttattgctgcaaagaccgcccagccacatccaaaacttctaggcacaatctatactgctgctgaagaaagtgagtgtgacagtgccatttgataaaatgtctttctagtggtttcaatacatagagaatttgctggagagtttagttaaagctatttgaaagctaccctgaacataattttatctagtgaaagaagtatttatgttgtcaccttggggcagtgcttctgaccgtttttctccaccagcacttttaagcaatgtgagaaactccagttaaaaatcttatttcatggcggggcgtggtgactcacacctgtaatttcacccagctactcgggaggctgaggcaggagaatcacttgaacctgggaggtggaggttgcagtgagccaagatcatgccacagcactccagcttgggtgacagagcgagactccatctcttaaaaaaaaaaaaatcttggttcttgagggcagtggttcttggatgggagggggagtagggaagtggagtagagaggagagaatttgattggtgagtggcatgaactctttgagaaagcgttctgtgttatttattctctgtacaatttgcaagtcatcattttaatacttttagttgacaaataattatcacatacttctatttaaggcatagcgctaggcacagagccaggagagagggcttaaaaattcaagttcagttgacattgctagttttgttaatcatgttcagagcactgtggttatgttagaggaatgcatgtgaagtgtttatgagtgaaatgatgtcagggatttgctttaaaacacaccagcaaaaaataaaacaggggacaggaaagataaacatattaactgacaaaactaacaatcgttgaagataggtgatggattcctgttagtttattacagcatctttacatttttatatagtttagaatatttccacaataaaaagtttttaaaaattactttcaactgggtgaggtggctcaagcctgtaatcccagcactttgggaggccaaggcgggtggatcacttgaggtcaggagtgcgagaccagcctgaccaacatggcaaaaccgtgtctctacaaaaaatagaaaaattagcctggcgtggtggtgcatgcctatagtcccagctacttgggaagctgaggtgggaggatcctttgagcctgggagattgaggctgcagtgagctgtgtttgtgccacttcacccaagcctgggcaagagagtgagaccctgtctgaaaaacaaaaacaaacaaacaaaaaacttcctttttttagctttttaaaaaaattacaaagaaacccccaccaaaccttcgtttttgttttttaatagtgttagcctagctagtctgtcctgctatatggtagagtcactggtggtaagatagagttatttatattgattttctgaaaacagggtacttttttcttttgactgtgatattggaattaaaggtataatatttaaatgctttaacgctttttcattttgtatcctttatataagttgaagcagttggaggaaaggccttgccatgtattgttgatgtgagagatgaacagcagatcagtgctgcagtggagaaagccatcaagaaatttggaggtaataccttcattctgaaaaaattattggatattggtaaaataaaggtataactataatgttaatttaaaaatttgttttgagttttgaattttctgagtctttggagaaatacgtatttgctcacacagaacatgatttaaaaccatctgataaggctgggcgtggtggctcacacctgtaatcccagcactttgggaggccgaggcaggcagatcacttgaggtcaggagtttaagaccagcctggccaacatggtgaaaccccgtctctactaaaaatacaaaaattagctgaacatggtggtggatgcctgtaatcccagctactcaggaggctgaggtggaagaattgcttgaacctgggaggtggaggttgcagtgagctgagattgcaccactgcattccagcctgggtgacagagcaagactctgtctcaaaaagaaaaaaaaaaaaaagaaaaagagtgtggaatgatagactgtggagactgggaagaaagaagggatgcaaggggggtagatgaagagaaattacttaatcggtacaatgtttgctgtttgggtgatggataccctaaaagtcctggacactgcacaatctatgtatgtgagaaaattgcacttgtgccttatatatttgtttttgaaaaaattcttcctttatgtggttaaatttcatcttcttcacaaagtcagttccctcaccatgccaactaatcagaattatatttttctttctctgatttcttttttctttttttttgagactgagtcttgctcttgtcacccaggctggagtgcagtggcgcaatctcggctcactgcaacctctgcctcctgggttcaagcgattctcctgcctcagcctcccgagtagctgggattacaggcgcctgccaccatgcccagctaatttttgtatatttagtagagacaggtttcgccacattggccaggctggtctcgaactcctgacttcatgatccacccaactcagcctcccaaagtgctgggattacaggcgtgagccaccgtgcccggcctctctgatttcttaaaacattcatttgatccttatcttgtactattttagatcttagtatttcttttctccccaattagttcaaaagttcctagaaaaaaggtgttggggattgagctaaggctttcatggtattatagtagggcacctaggcatgtccaaatcctgcctaaaccattaccactctccccgctaatgttctggaggaccatatgtacatgtgagggacaatggccagtggaaaatgagggaatgcttcagtgttagcaaggctgtacttataatcccaatgcagagtgctgtggggtgctggactgaagcacggagctttggctcaagtggagcctcttcccttaaatccaaaatcttacccctagccggcagcctttcccaaagaaatgtgaatgcctgtgtcagaagaggagagaaaatgcaaaatgatgtttgtccaactgatagggcgctaaatgtgaaatgtgccacgctcaaatgcaggatattttatctaaaatgacttcacctagtagtaaaagtggttaactagtgccacttaggatttgatgtaattagtttatccactaatttttggagaggacgtaaggggagaaagctgaagcttttcattctcccatattcattcagttttagttcttttttttttcttctttgaaacagggtctcactctgtcacccagactggtatgtagtggcatgatcgtggctcaccacagctttggcctcctgggctcaggtgatcctccaaccccagcctcccaagaagctgggactataggtgcccaccaccaggcctagctaatttttgtgtttttagtagagatggggtttcaccatgttggccaggctggtctcaaactcctgacctcaagggatccacccacctcaacttctcaaagtgctggggttacaagcatgagccactgtccccagccttgaatttattatttaattttttaaaattgtggtaaaatacacataacataaaatttaccatcctatttttaagtgtacagttcagtgacattgaagtttattatattgttacacaaccatcattaagtacacttcacaaagaataatgaagaccaggtagaaacaaagaaaaaatgtttgacatagtttttgtatttttaccattttcctttaatgttatttcactaagcatataactataagcaaaacttgttggttataggtagaaactagatagaatttgcagaaatagtagttactctaggtttattttttgtgtgtgtgtatgagtcactaaaacaaaattgatccactttgatgatctgcctgggattgaaacagtaggtctttctcttttcccagttctcaagaccagaaaggagcctttccctttaagtgaggggccttgggggaagggagactactatgcttggagggaggacaggcctttgaaacttcatgctagagaggaagaaagactttaaggaatttgatccaaggtttatggagacagggagggacaaccaggaggtaagagaacagttaagagtggaagctacaaaccaccgaagactaagcctccttgtagtttcacatggagctctggcaattggctatatctccactgtgctagtgacaatcatgcaggtgctattttgaaatagctaccagtcttgcattggtagtggttagtcatattatctaaaggaagtatagccatgcattgcttaatgatggggatatgttctgagaaaggcattattaggtgattttatgatcgtatgaacatagagtatacttacacaaacatagatagtctagctgaccacatacctaggctgtatggcatagcctattgcttccaggctgtaaagctgtataacatgttactgtactgactactgtaggcgtttgtaacacaacagtaagtatgtatctgaacaaacttagacagaaaagagataaaataaaaaaacagtattgtaatcttaagggaccatgttgcgtatatgggccattgttgattgaaatgttaggtgtggtacatgactgtatttgtgaatcaactgagggttcaagagagtaaacgctttttttgtgtgtgataaaaagtctttcattaaaatgaaattgattattttgaaaacaggaattgatattctggtaaataatgccagtgccattagtttgaccaatacattggacacacctaccaagagattggatctgatgatgaacgtgaacaccagaggcacctaccttgcgtaagtttgcaagaagagttgttggggaggaagttgcggtgtttctcagggaacttacatagttgtaaacagatttgagccaaattaacagtgtagttcaaaatctagtcaatccttataagggtctaaaagtccttcattcagtcaatagtattttattttattttttatttatttatttttttgagatggagtttcattcttgttgcccaggctggagtgcagtggcacgatctcagctcactgcaacctttgcctcctaggttcaagcgattctcctgcctcagcctcctgagtagctgggattacaggcgcccaccaccatgcccagttgattttttgtatttttagtagagacagggttttaccatgttggccaggctggtctcaaactccttacctcaggtgatccacccaccttggcctcccaaagtgctgggattacaggcatgagccaccatgcccagcccgatagtattttaaatagctttatttggagctccttttctctatgaatttaggaaagactaaagtaggctgagtgcagtggctcacacctgtaatttcagcactttgggtgaggggagtattattggaggccaggagattgagactgagatgcacaagatggcaagacgctgtctctacaaaaaaaagtttttaaaatcaggcaggcatagtggtttgtgtgctactgagactgtggtggtggtctcatctactcaggagactgaggcaagaggatcccttgagcccaggagtttgaggctacaatgagctgtgatcatgccactgcactccagcctgggtaacagagaaagactgtctccaaagaaaaaaaaaaaagactaaagtgtagctcaagcattttctcaaatatttgcatgtgtaaatacttacatgtatactctgtctttcataggacacagtcctttcataggactatttaggattactgaagccagcaatagtctccttcctctgaaaaagacctggcgttaaaaaaaaaaaaagacgtaggttttagttatttaaataacagtaaggtcattctcattatgaatcacactttattgtaaccaataaaaacactaatactttcttgggctttgccggggaaatgtagactatcgaatgaaagaacatagtcttgatctgttctggattcatcagacaacctgtcttattgtccatttatttatctgtttatttaccctctggttctatattttccatgtggatatcaggatacatcaggttagaacttgcttctgtaccttacatgtatcttgttaacacacagaataggtggttaggagcttaggctctggagtaagactgcttggattcaaatcttaacactcacccctcatgactttctattttgtgaccttggacaagtaacttaacttcttgcagattcagtttctttacttttaaaatggcaataatacagtaatatgttatagggttggtcacgagggttaaatgtctaagttattaagttagagtcctgaatttttccctcaggtatgttttgttgggtctgcaaaacttggcccagacagtgttaaaacaaaattgttttcattagttacctacattcaaagttttattagttagggccaggcatggcggctcatgcttgtaatcccagcactttgggaggctgagccaggcgggtcacttgagcccaggagttcgaaaccagcctagacaacatggcaaaaccctgtctctacaaaaaatagaaaaattagctggggatggtggcacacgtgcctgtagtcccagctacttaggaagctgaagtggggggattgtctgaatctgggaggtggacgttgctgtgagctgagatcaccctactgcactccagcctgggtgacagagcgagaccctgtctcaaaaactttattggttgcttatgttgaaaaaattagaagatttatacaaaagtccagatttctagcttttcttgaaatcttagaagatctggccaaatagagaagcattaccacatggcaatagttgctgtagctgagtggcagggttatcaactgcctcatcagatggggccagagctctgttgtcttctggatgctgaggacagactaacaagttatatcattgcatttacactgttgtttttcttatatgaaagaggaaagtgaaatatttctcataaccacatctctctctgaattgggaaaatgagacttatgccaagagggccgtatgttcaagcaaaatgggtgaaagcttacttgtttgtagatgtaaggcatatttctataaattcgatatgtaaggtaggtctctattgaatgaaaccatattgaatccaactgtagtaagaattatggcaaatggctgggcacagtggctcatgcttgtaatcccagcactttgggaggccaatgcaggcagatcacctgaggtcaggagtttaagactagccaggccaacatggtgaaaccctgtctctactaaaaatacaaaaaattagccaggcgtggtggtgtgcacctgttactggactattccggaggctgaggcaggagaatcgcttgaacccaggaggcggaggctgcagtaagccaagatcacaccactgcactccagcttgggcagcagagtgagactctgtctcaaaaagaaaaaaactattatggcaagcatatagattgtgatgaaaaacttgaactagaaagagtttgtgtttattttcaaataaaataggcaatgttgctatgtgatactgtcatggtactagaaaaaattatatgggaataaaaatattttacagctggcaactttgtgaaagaatttcaattgaatgttaagtatttgtttaaacaaatgcttaaaaatataaacctagccaggaatattattgctcaacatgttgaactaaggcttagttaagggcgtgttgtgtgaataagtttaatgatttctggcagtttctattatagatgatgaagccacagatatacatatacaggttgagtatccctggtctgaaaatcccaaatccagaatgctctgagatctgaaactttttgagtgctgactcgacgctcaaaagaaatgctctttggaacattaaggatttcaaatttttggagtagtgatgttgaactggttaagtataatgcagatatttcagaatgaaacctgaaacaattctggtcccaagctaaacttgtaccacacacctaggtatatggcgtcaggagaattttgacgtgattaaaaaggttttagactgggttttcatgacatgaaatgacttccaaggtattgacaaatatcttggcaagtttaaggcagatttatcaaaactagtaatcataactatagacagtgctgtagcagtggtcagtgttaattttagacttattaaaatctaaacaaatgtaggtatatgttttgcaggggtgcagaaattgtttgttcattgtatcattcactaggaattgctccctactaacaaagttaaaaatatacgttttctttccaagagatgatcaatacaagtaaagcattgaattttatgtagatttgtcaaaattagtaatcataactatagacttgaccttttaaactgacattatgactgatgtgtacataaatgtataagtctctttgttttttccttgtgaaattatgtctttggaagcccatttggcaaaaataatttggtctactttcctatattgaggtcatttttcaaaaatgaaagtgatgtcttaacccacatttttagatgtgaaggtgcaattaaaaacaaaacagaccaggtggggtggctcacgcttgtaatctcagcactttgggaggccgaggcaggcggattacttgagcccaggagtttgagatcaacctgggcaacatagtgaaccctgtctctgttttaaaaaaaattacagttaaaattaaaactctcgcacaaagattctattcactattgaaagttcctacctttataaacagccacttaaaaaaaaaacactaaataaaattaaatattgctcccagttaaaagcagattgaaatgccaaatgaaagacctcacactgacttttgggtcaaagaaaagtgtcagatttttggccttctatgaaaagtatgttataaaatgaaaattcataatgaaatatttctattttggccaggtgtggtggctcacgcctgtaatcccagcactttgggaggccaaggcgggcagattacatgaggtcggaagtttgagaccagcccgacgaacatggagaaaccccgtctctactaaaaatactaaattagcaaggtgtggtggcacacgcctgtaatccagctactcgggaggctgaggcaggagagttgcttgaacccaagaggcagaggttgcggtgaaccaagatcacgccattgcactccaagagtgcaacgagagcaacaagtgcgaaattccctctcaaaaaaaaagaaaaaaaagaaaagaaaagaaatatttctattttattttatttttacttccctggtaactcacagaacacatttcttttttaatttgtatttttcaatttaatttattatatactctccagtattacattgtttgtatcatgttaaatgcttttagaagcttagtagtaaggttcagttgtatctctgaacagttgatttttcttattcccagctgtttgaaatgcttgttccctggtgccataaagaaatagcacttgaacataaatttaatttactcagcaaggccgtttttatactttctgcagaaagggtatacttgccagcagttttgccacaagagtacaccgatcaaagcagacagggtcatttataacctgacgcgtccaccctactgctgtgtccggtttccattggctggaacgggacctgacgttctgtatttgtcccggttggctagcaacttagaactttttttaaaaagaggcaaaggcagaggagaacaaaggaaggaggaggtaacttgtggaatgctgagaacggtaaaaacaccttcaaataaggaagaggaacaggctatgacctaatgcttgcttggaccagtatatgcatgccagggcaaatatttaggctaaattgtgggagctaagaacttaaagtacattgatttctttatcatggctagcagatatttaagaatgttagtacgggtctttgaatacattttgcttctaagagaagttactatttattcctaattagacagggaggaaagtctttgaagaggaacctctagtttttacaccaactcactttattcatttactcaaatgccttacaggtctttgagtttgaaaccccaagtaagtaaaataattcatgaaaggtaataaaaacagagtctggcacatagttaggttttcagtaaacgtaactattttattcggctgaaggtatcagtatctaagtgtggtgctaagagttttcaatataatatataagagggcatgctactgtgacagatgcacctgatgtaggattagcaatgttgaggtccaggccagcaaagtgcagatggaaaggtcttgtcccatagatcaaaggaaagcccatgtttagaatgtaaatgaaatgagctctttcctttgagtgtaaaatatggtcttatttactggagtagatttagtttgtttcttcttgatgcttcgagttgcagtttcactgttttaatgaaactcagctgtaatattgtttgccccacctcacctcacctccataaaagtgaagcacctttggaaatgaaaacagtatctaccaaaacccctctagtggtattgattatatttggtaagcttggtaagatgttgctgtttttaacaccagtattgtacatttggtaattaaaaaactgacttgaaagaagaatgaactagttcattcacagctcctggttcagggtaaagaaaaaaaaaagaatggacaagttcagagtcctagaagtcctagaagtcattgaatgtaaacgaaagctaaatttgtagctaaaataaagctataaattaagctataatatattatttagctgctgacattatgtaaaaattaacattttagaaatattgaatctgaatcttaaataaattacctaccttaatgagtgactttttaaaaataaagctatgtattgcacccaaaggcatattttatattggtgaaaattaaatttgggaatgtaatgagagttatattactaaattacagttccaatgtagtagaagtactatgcctattaagatgaaataaatcagcatacataatactaacaacagcgattgtttatttcatgtttagtatatacattgtcctaagtatctcatatatatcatctaattttaatctcttggtcaatcatagaaggtagtgacttttaccaacatttgcagaggagagaactgagcattagaatgctatacaattttcccagggtcacacaatgaaggggcagaagcagaatttgaaccctggtctgtctgacttgaacactcatgttatttaccactgtgctgaccgacaagtatattaactatctctgaaaattacatatgtgtgttagggaggcagaatttgggatggttgtggttgcggataacctcagttgggcttaaggctagtatatcaaggatttgtttttttccatcaagcagatcatgttgccaggccattaagcagaatttcaaaggatgaaaattagttgctttttctgtcttaattctagaaagcaaacaaaagtaccctatgaacaaaacaaacaaacagttccctacagatttctgagcaagttcagttactctgtaggagtagtttaaaatgtatcttggcggagcgtgggtggatcacgaggtcaggagtcgagaccatcctggctaacacggtgaaaccccgtctctactaaaaatacaaaacattagccggacgtggtggcgggcgccttgtagtcccagctactcaggagactgaagcaggagaatggcatgaacccgggaggcggagcttgcagtgagcgattgtgccacttcactccagcctgggcaacagagccagactccgtctcaaaaaaaaaaaaaaagtggattggcccggcatgatggctcacacttgtaatcctagtactttgggaggctgaggcgggtagatcgcttgagtccaggagtttgagacacgcctgcgccacatagcaagaccctgtttctaaaaaaagaaaaaaaaaattacaaaaactatccaggtagctgggcatgctggcacatgcctgtagtcccagctactcaggaggctgaggtgagaggaccacttgagctggggaggcagaggctacaatgagatgtgatcatgccactgcactccagcctggcaacagagagaccctgtcttaaaattaaaaaaaaaaacaaacaaaaaaaaagaagttggctggtcgcagtggttcacacctgtaaacctataatcctggcacttcgggagtctgaggtaggaggagtgcttgagtccaaggggttcaagaccagcctgggcaacaaagctagaccctgtctctaaaaaaaaaaaaaaaagtacagaaattagctgggcatggtggtgctgcacacctgtagttccagctactcggaaaactgaggtgggaggattgcttgagcccaggagcccaggagctcaaggctttagtgaactgtgatcgagtcatgcactccagcctgggcaacagagcaaggccccctctcttaaaaaaaaaagtggagaaattgttagaaagctattaaatttggcttgtattttcttttgctttcagatctaaagcatgtattccttatttgaaaaagagcaaagttgctcatatcctcaatatcagtccaccactgaacctaaatccagtttggttcaaacagcactgtggtaggtggtaggtggtagggtgaggggatggtttgtgcttaatttgttttgaattaaatctgtgtatgtctgatgtaatcacaatctgcacataacattcatcattgaattttctatgccaagtcattaagtggcatttggaaagtagattcttcatcttttatctgtaatttaaaaaattgaggcataattgacattcaataaaatgcacagctcttaatggttcagtttgatgagttttgagaaatgtatataaccaacacccaaatcaagatacagatttttaccatttcagaaagctctttcatttcccaatgagtgtgttttactgtgtgtaatttattcatctataaagttggttaaaaactatctatgagatactttatttttcttagacaggtatgcacctgtagtcctagctacttgaaaggctgaggtgggaggatcgcttgagcccaggagtttgaggctgcagtgagctaggatcatggcactgcactcctgcctgggtgacagagcgagaccctgactctaaaaaaaaaaaaaaaaaacgacaaaaaaaccctattacctttcatagcaaactaatggtttaaggtaaatatgctaagtaacaagatttacatatagatgcctcctttaaaatagttgtatcaaacacttagtttttatttcagcacagttcactaacatttggaaaggcacttggaatgggaacccacagagcaaaactgaaagaagttccactttaattgactaggttaaatacatttgcagcctttttttattattgttttactagcagtagtttccctttaaataaacactttcattcttaaaaaaaaaaaaaagtccaggcatggtggctcatatctgtaatcccagcactttgggaagccgagacaggcagatcacttgaggtcaggagtttgagaccagcctggccaacatagtgaaactccatctctactaaaaatacaaaaattagctgggcatggtggtgcacacctgtaatcccagctactcggaggatgaggcacaagaatcacttgaacctgggaggtggagtttgcagtgagccaagattgcaccactgtgctccagcctgggcaacagagtgaaactgtatctcaaaaaaagaaacatattaagagataataatgtaatttaccctcatagtattaagaaaaatgaaagtttattactgtcacttttattttaatcaaatattaggagggagatatataaaatgatttcatctctgttcacttctataaaacctgttctttacaaaatagtacagtgaaaagttatattttatattattgaaaagaattctcaaaaatatatcagggaggctgggtacggtggctcgtacctgtaatcccagcactttgggaggctaaggcaggtggattgcttgagcccaggagttcaagaccaggctgggcaacgtgcaaaaccctgtctctacaaaaaaattgaaaaattagccaggcttggtggcacacacccatagtcccagctactcgggaggctgaggtgggagggttgcttgagcccaggaggtagaggctgcagtgaatcgtaatcacaccactgcactccagcctgtctcaaaaaaaaaaaaaaagtatgtgtatatatatgtatatatgtatgtgtgtgtatatatgtgtgtattactattttcttcctgatatatatgtgtgcgtgggtgtgttgtatgtatatgcatatatatacacatgtatatgtatatacacacagatatatacacatacatatgtatatacatacatgcacacatatatcaggaagaaaatagtaatagaaaaattggttatttctactcacaagttaatcaaattaatttcttttataattaaattattattttttgtggttctttcagcttataccattgctaagtatggtatgtctatgtatgtgcttggaatggcagaagaatttaaaggtgaaattgcagtcaatgcattatggcctaaaacaggtatgtatttttaaaaacttcatttgttagattttcatgtattgtccttgacacttattattattttttgacagaatctcactcttgtcatccaggctggagtgcagtggtgtgatcttggctcactgcaacctctgcctcctgggttcaagcagttcttgtgcctcagcctcccaagcagctgggactataggtgcacaccaccatgcctggctaatttttgtatttttagtagagacagggtttcaccatgttggccaggctggtctcgaactcctcaagtgatcctcccaccttggcctcccaaagtgctgggattacaagcatgagccaccacgcccggcctgtccttgacactcttgaggtgcatcttgggtatgatagggtgagagtatgtagactgttaatactaacttcaatctgtttgttgggaaacaagttcaactttttattgtacaacataagatccttttcaatcatcttcctgccttggcttagactacatgagtgactcttcagccaatagcctttgtaggaacattgaccaccggaacactttaagaatcttttgaaggccaacaggagaagctgcacttccccaactctttctccatctttgtttctggaaactacctaaattctgcagattctcatacttttgttttctcctcacacattctaacaaatgctttttaacatttttgtattcttactggccttgtctttttcctttagaaaaagctggattatctttcctttcacatgaattcttctgaattcacagagtacctggaaccctgtgagatgacagaagaacctgtgtatgcctgggcttggtgtgcaaatttacagttatgatataacagaagttgatggcttccttgctgggcaataagatatataaaaatgagggaaagccagcaaaaatgagaaaaaaggaaagcctgtctttcttataggttcttaccctctgcttgtatatcagagtagcttaaaggaagaaaaagagacgataacatttcactacacatttttccatgtactagtgggtaatgcccatgaaaaccttaacttctttttatcttaagtgtaaatggtgccgggtgtggttacagatggctcatgccatcccaacactttgggaggccaggatgggcagatcacttgaggccaggagtttgagacaagcctgggtagcatggcaaaaccccgtgtctactaaaaataggataaattagccagttacttgggaggctgaggcatgagaatcacttgaactttggaagcagaggttgcagtgaacccagattggaccactgcactccatcctgggtaacagagcaagaccctgtctcaacaacagcaacaaaatatgtaaatggcaatcacatcgcagaaaagtatgtctaatgataaacagtatgcagagggactgggtgtggtgcctcactcctgtaatcctagcactttgggaggctgagattggatgggaggattacttgaggctaggagtttgaaaccagcctgggcaacatagtgaggcctcttaaaaaaaaaaacacacacaaaaaaaacctagctaggtgtagtggtgcacacctatggccccagctgagatgggaggatcacttaagtccgggggttgaaggctgcagtgagccatggtcatgctgttgcacttcagcctcagcgacagagtgagaccctgtctcaactaacccacttcccctttgtcccgagaatactcttgtctctaattctaatgtaacatcatatacatttctgttacattagggttttcccatttgtcccgagaatactcgtctctaattctaatgtaacatcatatacatttctgttacattagggttagagacaagttctgtttagaaataactcaataacttttatgttttcacattgaaaatcagtcagatttgcttcagcctcaacgtgtgtgtttatgtaaaattaaatgagcgctggtaatttttttttttcctaaacaggaagtgggttaaaaaacaaacaaaaaaagagaatgcatagtgggaaccactttttcatttcactctttaaaaatgtaacaggccagttgcagtggctcgtgcttgtaatcccaacactttgagaagcagaggcaggaggatctcttgagcccaggagttcaagaccagcctaggcaacatagtgagaccccatctctacaaaaaattaagttagctgggcacagtggagcatgcctgtggtcacagcttctcgtgaggctaagattgtaggattgcttgagccctggagattaaggctgtagtgagccgtgatcatgccactgtactctagccttttgagacaggacagagtgagatcctgtctcaaaaaaacaaacaaacaaaaattgaacagaaacttgattatactcacattggaatttaaacagaaaatcaacatggcccctctacgaggaaccaccttaggaatcaatactggtgtttctgctcctagggtagtgctctgcccgtaatagtcactcagatctttgtaaatgcatgatatttttggattcctttggaaagtcttcatattcttcattacatttaaaaaaaaatttttgtagttttttttagtggaaagggggtttagccatgttggccaggctggtcttgaacttcttgcctcaagtgatatatcctcctcggcctcccaaagtgctgggattacaggcatgagccactgcaccggccttattacatttttgaaaacatttctactgatggcaaattggaatctttttcactgaatttgccggcagagggggtttctagatgactactggaattcatgtccctgccgtccctccctttcccctgattggagcagctgctaggacggtgggcaggtgagcctatgaaggaatgagtaagacttgattctgtaagagaaggaacttgagaagcttgtgaaagactgttctctctgagctagaggacagaatggagccaggtgagagaacttgagaaagaacagatactcagaagggctttgaccacggagatctgaggattcaacagggtgactcaacaggcaagataagtatttcctatccttgaggagtggaagtgaggagacctcagagacttcttcaagtcccaaaatagattcagtgactggtatatctgatatgataacttactactgctggcaaagctggcatcatttaaactatcccgggcgacagagtgagactgtctcaaaaaacaaacaaacaaacgaactatataagggtgaacagtgctataaggaaacaaagaaaaattgcagtacagctaagaggacccaatatccagacatggaaaaaataaacagaacaccaacacccagaatagcagttttcagtgaaatcaaactgttaaagaaaaaatatctcaatttaaaaacaaaaatcctgacataagagattgaaatataatatgaaaaatgctctctggaactaaaaatagattgtgtttttaaaatatacatatatatgtatgtaatagttgaagggttggatgttgagtaacacctgggtaagcagcttggatattctagtgcaagaagtatctcagaagagcagaaacaccctgaagtaaatggagagagacttagaagacacatccggggaacttcacatgcaaataccaggagtcccagaaggaggtctggaaagagaacaaatagaggagaaacaataattgaatgaataataggaaacagttcccttgagctgaagaaagaccgatatggatgtaaactaaaaggtttaccaaatttgaggctgaatttatgagggggagaaagacatctgggagaacctcagaatttcaaggataaaaaaatcttccaagccttcaggcagaatatatgttacttacaaaggaaaatgattgcagactcttttatcttcaatgccagaaactagaaggcagtggaataacatctgtacgttgctgatacaaagggactcagccaagatagttacttattgacaagatgaagggaagatatgtggatatgctaccacacttgagaagagtcttgtagaaagggctgttaaccaagcagcaaatctgtcagaacagagagttttcaagataggagtcagaaaaaagaggagagaaaataatggctggcaaataaacctgtagtacatttaatatatggtcaaatgtacatggattatatagaataactgggaatatgaaatacaagtaccaaataacaactccctatattgaagagacaagataagagaaaagtttaataattgtctctagccaaaagcactacactgtcttcaaaacctggaatttggggaagagggaaatgtggaagtcattgaattcttttcttttcttttttttgagacggagtttcgttcttgtcgcccaggctggagagcagtggcataatctcggctcactgcaacctctgcctcctgagtagctgggtttacaggcgtttgccaccatgcccagcaaatttttgtatttttagtagagagggggtttcaccatgttggccaggcaggtcccaaactcctgacctcagggatccacctgcctcggcctcccaaagtgctgggattacaggtgtgagccactgccccaggccagaagtccctgaattctaaaggacttatatgagcatgggaacattagggaagggaacactttctaaccgtctcgttttgaggcagctacaattctagatggtatctttgttgttgtttgttttttgagacagagtctcactctgtcgcccaggctggagtgcagtggcacaattagctcactgcaacctctgcctctgaggctcaagcgattcttgtgcctcagcctcccgaatggctgggattacaggcactcgcccccacgcccagctaatttttatatttttagtagagacagggtttcactatgttggccaggctggtctcgaactcctgacctcagatgatcctcctgccttggcctcccaaagtgctgggattacaagcgtgagccaccacacctggcctagatggtatcttttaaaaaaattagactgggcgcagtggctcacgcctgtaatcccagcactttaggaggctgaggtgggcggatcacgaggtcaggagattgagaccgtcctggctaacatggtgaaaccctgtctctactaaaaatacagaaaaattagccgggcatagtggcgggcgcctgtaatcccagctacttgggaggctgaggcaggagaatggcatgaacctgggaggcagagcttgcagtgagccgagatcgtgccactgcactccagccggggcgacagagcgagattccatctcaaaaaaaaaaaaaaaattatattttctgtttggtgctagggtgtatagaaatgtttttgcatttaaacattataggcagctacctttctaaactttcttgttgagtctaataatttatctagagtctcctggattttctgtgcaggtaataatataatctataataatattccaattcttacatccttggtttcctttttcttgctttactgcactctcctctctcttcctctctagccttcaccagtagttttctcttgacttattgagagcccagcaatgcttttaagaaatgtttattgcttatttatagttttattgtaataagacagccctttagagtatataagtcaccatatagttgatccatgaacaatgtggtgttagggatgctggctcctagcagtgaaaaaaagaaaacatatttccaaaagcagaagactagtcccatccatttttaattaaatatattactagatattttatatttatattttttcaatatattttctaatttgttaaagtatatattaacataaaaactatatacctttattacaaatatactagtaaactgaactctcttattagtactgaagttttctgcagattctcctagtttttttaggtttaaagtcttatcacaaaaagtgacaactgtgtttctgcctttttgttatatgttaaattatttttccatttcttattagattagctaatccttttagaacaatgttgaatagtaacaatgatgggacctatatttgttgtgttcttgtcaataatgggaatgcttttcatcataatatatatgcagtttcttccctttttttaactttagttcttgcatcctttctactacttaatgctgtgttagtattaaatgtgatagttaaagcattaaggtcttacttgatttgctggaaatttttgtgtaatgttcctatctactaagtggacttggtaagttggtaacttattctgaactaccataaaatctccatgtaagtttttaaatgcttattaaaattgaaatattactttttagtcatatctcaaacttggaactattggagaattaagcaataccatattgtttctgcccttagtggtttacaaattttgttagggcaaataaaccatacaaatataatgcaaccagagaagtaatctacctagatactcctcaaatgtgtgaactcttgattgtaaagttcaaatagatttccataatctgttaattatggaaattaattccatctgtatcttttcttctgtgagagcctttgagctttcatattcttggtgtcacattttgtttaattttcttattagcatacttattctgtattccagattctcaattaaccatataatatagttcatgtaaagaaatgatagaactgatttttatttatttattttgagataagatcttgccctgttacccaggctggagtgcagtggcatgatcacagctcactgcagccttgacctcctgggctcaagccatcttcctgcctcaacctcctaaatagctagaaccacaggtgcataccaccatgcccagctagtttttcagtttttgtgtgtatgtgtgtgtggagatggggtcttgccatgttattcaggctggtctcgaactcctgggctcaggaaatccttgcacctcggcctcccaaattgttggcattacaggcgtgagctactgtgccctgctagaagtaattttgataaaatatccaaacatcacattagtatttaaaattattcagtttctctttgcttctttgggtttgtggcaccctggtcacccccatctggctgtgatagcctctgtagtccgtgggctggcagtttgctcttcttttaaggtttctttcctacacaatccccactttctggtaagccttctttttttttttttttttttgagatggagtcttgctctgtcgcccaggctggagtgcagtggcatgatctcagctcactgtaacctctgtctcccgggttcaagcgattctcatgcctcagtctcccaagtagctgggacttcaggcgcctttcactatgcctggctaatttttgtatttttagtagagacagggtttcgccattttggccaggctagtctcaaactcctgacctcaggtgatccacccgccttggtctcccaaagtgctgggattataggcatgagccactgctccttgccctggcaaggtttctatgcagtctgttaggtgtacatcctgcagcttattggtttaaaatgtactagcctgtgatgtggtctctttggggccaactgggagaaagaaaaatcgatagtgcagcagttttgatactgaatattgacaagtgtctttatgaaataaagaaccagtccctcgaaaaaataaaaataattaagtttctgtattgcacatattcttcttagctgtgtgagctgcagtagctgtctgtacctagcttccccttatataaaattaggtattataaataacctctaaagccctttgttgcatatttttcaaacttttaattatgaaaaaagtcaaacatatgtacaaacatgtatacaagtagggagagtagtacatcacgtactattccgcttcagcgatttcaccacatggccaatctagttttaccagccctcacatctccatctccctttaactccacttctaacctcaccagattattattatattattaattaattaattaattgattaattattttttcgaggcagagtctcactctgtcacccaggctggagtgcagtggcacgatctcagcccactgcagcctccacctcccaggtttaagtgattctcctgccccagcctcccgagtagctgggattataggcgcccaccgctgtgcccggctaatttttgtatctttagtagagagggtgttttgccatgttggccaggctggtctcggactcctgacctcaagtgatccacccgcctcggcctcccaaagtgctgggattacaggcctgagccaatgcgcctggccctcgccacattatttttaagcagatctcaatcatagcatcatttcatctgtacatacttcaatatgtatttttaaatgattcggtctctttaaaaagacaaaattattatcatagctaacaaacataccttaatatcatctaatatctagtcagtgttcaaattccctcaagtgtctcataaatgttttctttgcagttggtttatttacatcaggatctaaattgttccatacattgcatttgtttgataagtctcaagtgtttttaatctaaagcagttacactcattttttttcttgccacttatttcttgaaaaaccaggtcgtttatcttataggagttctgtcattccagattttcctgattctcccagtcgtatcatttaacatctttctatatcctgtaaggacccttatattagtatattgtttattcccattcttctttcttctggcattattttatttattcattcatcatccaacaactattgattggacagttatcacgcagcagacatgggtattggggatacttctttggcctttttacctagtgtatgtctaggttggtagaagttaggttttaaaagcatatttaatccagcatttatgcaaagtattattaaagccctggtggtactcttgaactgaactgccgcatatagctgtgtggaacatatccagagttgcttcctatctgctatgtactggataaagggagttccccggctccaagcagtactgaagattctgtggcctgtggtgtagacgatgggaaacaaaggactatgggtgagaatttactgagtactggggcatgctgctgaggtaactcttaggaatatttgacagttgcagccagctttccaatcaccatctttctttttcttctaagtagtccaggaatcagtttggttaaattcctttcttctgcaatttgaccaagactcctttcttccctggtcctcactgtgggaccaaaaccatgttttattgcttctttgtttcctttatgtttctgtagcagacaattcttttaagattttctgaagagtgttgttttttgcagtggggaaaaagatgagagtgaaaaaggcacttcttcaatatttctcaaactatatgtcaagactcgttggtgaggcatgaaatcaatttagtggattgtgaaattgatttagtgagtagcagccagagttgttttgttgttgttttgttttatttctagtggaatcgaatagaaaatattagagtggattgcatggaggaagggtcagtattgtttcataagcttttgtttcatatatgaaaatgttacttattatgggtcacagccaaaaaacttaaaagcttacactttatggtgcctctctttttcaacttctttgccttttctcaccctttctcaattacccttcctcacatcactgttgtcattaaagttgatacagagagttaggaagttaaaaagggaggtctctgaggtaacaaagttctaacatattattttccctctttgtacctcccttatgttacttgtcactttcttttttgatttttgagacagtcttgctctgttgcccaggctggagtgcagtggtgcgatcttggctcactgcaacctctgcctcccaggttcaagcgattctcaggccacagcctcccaagtagctgggatttcaggcgcaggccaccatgcccagctaatttttgtatttttagtagagatggggtttcaccatgttggccaggctaatcttgaactcctgaccttaggagatctgcctgccttagcctccaaaggtgcggggattacaggcatgagccactgtgcccagctgacttctcactttacattcattcattttccaaacattcattcttacatgccaggcacagttctctgcactattcagttgttatgcatttgacagataatttattaactatctactcggtgcaaggcaacatgggtactaagatgaatgtgacacaatccttaccctcaaggagtttaccatttagtgtgggagatttaagagtttgttaccaccatttgtactttgtcctcccctctgccctttcctctacttccctaacctgtaggtctttgggatcctggggtaacaaagtcagaaaaagccttctttgactcttaagaattttaaattttattcatacaataaacattcatcggacacttattttatgccaagctgtgctctgtttgctgaagatacatcagagaacaaaagagatatcaatcgctgtccttatggaacttatagtctaattgggagagatacaatagacaacatgatgaatggcaaagtatatagtatgctaaaggtaatatgctatgaaaaacagaacaaaggaagggggattggagtctcagccattgaggaaggaaggtggcaatttaaaatagagtagaaaggtttggcattaggccaggagtgttggctcctgcttgtaatcccaacactttgggaggtcaaagcaggccgatcgctggagcccaggagttcgagaccagcctgagcaacatggcagaactccatatctacaaaaagtagcagggtgtggtggtgtgcgcctgtcgtcccaactactcagggggctgaggcaggaggatcacctgagccttaggagttcaaggctgcagtgagccgtgatcataccactgcactccagcctgggcaacagagttaaaccctatctcaaaaaaaaaaaaagaaagaaaagagatgtttggcctttctgagagtgccaagtcctaaccgtcagaccaccagggaaggtaggtttggcctttctgagaaggtgacgtttgagcatagactttgacatttgagcataccgttagtcttgggggtaatacagttagccaaaggttatctgagggaaaacatgcaaggcagaggaagcagcagtggataggtcctgtggactagtatggctggcatgatgcaagagcagggagaagaccagtgtcgccagagtgagggaagaggagtagaaaatgagacgatgtccataaggaaatgggggtcagatgttataggcccttgccaagacttggtcttagattactctgggtgaaatgaggagctgtttcaggttttcaagcagagaagggacctgatcaaacctaaatgtttaaaaaacctctctggctgttctgatgagcctagattcttgaggggcaaaggggggaacagttaggaggctattgcaggaactgaggcacagattttggtggctgtgaccaggatgacagcagtaaaggtggtggacagtggccagattctgatatattttcaaggtagaaccaacagtatctgctgatggattgcctttgggatgtgagagaaagagtcaacagtgactccaagatttctggaaaatagcctggtgcggtggctcgcatctgtaatcccagcactttggggaggcccaggtgggtgaatcacctgaggtcaagagttcgagaccagcctggccaacatggtgaaaccccatctgtactaaaaacaaaaaattagcctggcatggtgacgcgtgcctgtagtcccatccactcaggaggctgaggcagaagaattgcttgaacccgggaggtggaggttacagtgagccgagatcacgccagtgcactccagcctgggtgacagagtgagattccaactcaaaaaaaaaaaaaaaaaaaaatttaaaaaaaataaagatttctggcttgagttactagaacagtggagtcgccaggaactgagatggagaaagctgcagatagagcagatggagggcaagcttaggaattgtgtggggtgttgtgtttgaacatccaagtggggacagtcattaggcagcaggcctggtgaatgagggtcaggagagcggtccaggttggagataaaaaaatctgtgggttatcagcatatagaacatataaaaagccacaaaactacatgataccatctaggcagtgagtagaagagaaaggactattgtccatttcaacattgaaaggttgggaagaagaggaagacccacataggagagtaaggtaggaagatgaaaggaagatgaaagaggagatgaaagccgactgaagaaggagcttggggagtgatacagtttggatgttgtctccacccaaatctcatgtcaaaatgtcacccccagtgttggaggtggggtctggtgggaggtgattggatcatgggggcagctttctcctgaacggtttagcaccatcctccttggtactgccctcaccatagtgagtgagttctcatctcgtttttaaaagtgtgtagcacaccacctggctctcttgttcctgcttttgccatgtgacgtgcctgctccctcttcaccttccaccgtgagtacaagctccccaaggcctccccagaagccaagtgatgttggagccatgcttgtacagcatgcagaactgtgagccagttaaacctcttttataaattacccagtctcaggtatttctttcttttttttttttttttttgagacggagtcttgctctgttgcccaggctggactggagtgcagtggtgcgatctcagctcactgcaacctccgcctcccaggttcaagcgattctcctgcctcagcctcttgagtagctgggattacaggcgtgcgccaccacacctggctaatttttttgtattattagtagtgacggggtttcaccatgttgaccagtctggtcttgaactcctgacctcaggtgatccacccacctaggcctcccaaagtgctgggattacaggtgtgagccactgtgccgagcctaggtatttctttatagtaatgcgagaacagactaatacagggagtgatcaattgtgtcagattatgctgatagttcttacaaaatgggactgatcgtcaggtttagtagtctgtacatccccttcacatcacttacaccgtttgtaattattaatttataattatggttgttcagtgtcttctttgctagaatgaaaacttcttgaggatagggacagtgtttgctttgtttgttttattatagtcattgtagacattcaataaatatttgatgagtgagtaaatgagtgaatgaatgtgcaatatgattaccttctgcctagctccaaaatatattctggacaaagcttatataataggcagaatgttctgtatcagggaatatagagggcattatctggtccagcaggaaaaatcagctcattgctgagatctttgctttagcttcaagatattcattttagaaggtttactagacatcttggagccagtgatgttatttggtcctagacttgatgacacactaaatccaatttacagtcatgttccttgtggtgcatggtatgatgaattatgtactggatgttgtgttttgtttttgttttttgagacagaatctctgtcacccaggctggaatgcagtggcgccatctcggctcactgaaacctgtgcctcctgagttcaagtgattatcctgcctcagcctcctgagtagctgggactacaggcatgcaccaccacacctggctaatttttgtatttttttttttagtagagacaggggtttcaccacattggcgagggtgctctagaactcctgacctcaagtgatccacccacctcagcctcccaaagtgctgggattacaggtgtgatccaccgtgcctggcctacagggtgcttttgagacatagtagctcaggataaaggatcagagcagtagattttcaaaagtaggtaaacaattgaaatgagatctcaaggggatgttggaatttttcaaaaaggagaactgggaaagacatttcttggcagagggagcgacgcatgcaaagattgcagtttgggaaaatactttctgtgcggtggaactacaaggttggtgtatgtatgatagggtgtgggcttgttatttcccactgaacttgagcaactcaagttgtacaggttgactggaatgttgggtgagtttgagagtgtggggaagatggatgagatggatggtcttgtctgccaagtttaggagcttgaattttaacctatattcagtggagagccactgaagaatcttagaagcagaggattaataataaactggggaaaataggagcagtgaagtaatatggttgctgatgaggtttaggaagtttaatctggcatctgaatatgggatggcttgtaagactgtagagagaagaggcaggaaagctagctagaatattacattattcatgagtgaggcaatgaaaatggaggagtgaaaatggatttgagagggtgttcaggctcttggctgtttgagaggcctctatttaaaagaaaacactcatctcctcatcttagacgacagcgtagagtgactctctttatgtcagctggaaccagaagtaatctcccaacattattgcctttcaagaaaaaggagatttattgtgcttaacggagtgggtacagtgtaacatacattatcctcaatcagagcagtgtcccggtctcccacttggcttctcagctgcatgttcttctcaacactgacttcattgctcctcctggttttagcacttccaccctgctgaattcagcacatccagagaaaggatcagagggccggcctctagttgtttcacaacatggaatttcaggcttccaactaggtcacctccagaattgtaatttttttctttttataagacctgtttcatggttcttgctgaaatggagggtggggaaggggagagggatgatggctgctattcacaatgcctactcttacctcatgactggtctgggcaagtatggtagaagcaggaaagtccacttttgggtggatttgatttgggcttggggtggggagtctgggaatggcagctactgatttggtaatggctacagagaggaaggcagtagaagtaccacagagcagctgcagacttctgtcacctggactatattacaaatagatttgggaactcagctaaccagggagggtgaggcgacaaggtggcagctcacctccttcctgtctggtgctagaaatcaaaacctgttcactaactaggttaaacagtttataccattttcattgattctgacatgcccatgctttatatttgtacatctctgatctcagtctgtatcttacaatggatgatatatcatagtttaattggcagcttttttctttctttagtggtccctaaggtaatggtgcgctgtataatcagtggtatcattggttcagtggatacacacatgagtgtgtggatatgtttggtggtggctgacaggtgtcaaagaggggaaacaagctctcttcccagagaaggagtcatcacaggcaatgctgatattttaagcctcatacacacttcatatgtttatgtgaaaggaaatctttggtcttaagactgttggtactgtctgttttcaggcagtaatctcttagctgttatcaggagaatcaattggaagctattagatgtctcttcagttatttcttaataagacttaagttttcaggtcgatgttgttgactcttgtgatccatggcttatctgctttcattataaattttgcttattttctttcccagaaatcatcagtgaatttcatttgattgatcctactgttaacctgcttttattgttaccagttttttctaacctattgggttagcttgttggcattgcaaaatctgtgttgagaaatactcaatggcccactccttgagttttgagtgcctagttgtaccttctttgtatctttcctagaaagattgttaaagtaatgataggttggaggaacatttcttattctatagacactcacacacacacacacagcatgtatatacttatacatgacatattttattagacttctaatttagagtttttaaggattcttgtacaattcatgtagtttacatggagactagcagtgtgcatgtatgcatatagtctcaaaatagattatactcaattatgtacagaaaagttctgcagttttcgggagtgagatgataactgaactccaagaactttggttaacaaggttaaccatttagttgcattaaggatgagagcctggctctgaagtcaggctgctgggtgtttgaattttagcttctgtgaccttgggcaagttacttaacttctctgtgcttcactgctcctatttataaaatgggaataacaacaggacctacctcagggttctaagaattaggtaagataatgtatgtaaaataggtaacagcatgcctggcacagggtacacttaatgaatggtaggtgctattttttattttattttattcatttttaatttttctgtttttttgacaaacaaatagggtctcactctgtcacccaggctagaatgcaatggcacagtcatagctcactgcagcctcaaattcctaggctcaagcaatcttcctgcctcagcctccagaatatctgggattataggctctagccacaacattcagctgctattttttttttattattaataaaggatcagttcaagagtgagaccagagctcttgctcttgatctgttggttaaggaaaaaattatttctagggctggacacggtggctcacacctgtaatcccagcactttggaaggccaaggcaggaggacggcttgagcccacgagttggagaccagcctgggaaacatagcaggaccccatttctaccaaaaaaaaaagctggatatggtgggagggtgaggtaggaggatcgtttgagagcccaggagatcaaggctgcagagagccatgatctcaccactgcctttggcctgggtgacagtgtgagaccctatctcaaaaaaaaaaaaaaaaaaaaaaaaattattcctagtaaatgatttttagttatgaagtagaaaagtgtcttctaactcagtgctttcaagaaattccctaaattaattgaacattaaacaaaatagggatgtaagttccatgaaggtagatgccttatgtctgttttgtcaacatctgtgtccttaatatctagaatagcgcctgacttacatatagtaagtgcttaataactatttgttaaatgaatgaaaaagggccaatggctcttaaaagctacagacatttcatcttatagatgaaaatatgtaagttattctagtatgtaataatttaaaattgtattttaacaatatatggaaataagctttaactaaaatactagaaactcacaaacctaagtacatttaaataagttgactttctgtgaacctatgaattatgttggaaagtaaataaataaataaatagacttttcttgtttgatgtaaactaggatatatgtaagaaaattgagatgttactgttgacaatgtgtaattaataatgtactgttaattgtagagtttaaagttacttcacataagagacataattttaaaagtacacctaacatggtaaaaattttatgcaaacattaacagcagttatccctggatagggaaattataattaattaagcaattttttccttttacttctctttcttttctttttttctttttttttttttttttgagacggagtctcgctctgtcacccaggctggagaacagtggagtaatctcagctcattgcaacctctgcctcccaggttcaagcaattctcctacctctgcctcccaagtagctgggactacaggcgctcgccaccatgcttggctaatttttgtatttttagtagagatggggtttcaccatgttgaccaggcttgtcccaaactcctgacctcaagtgatccacccacctcggcctcccacagtgccgggattacaggcgtgagccaccgcacctagctattttctaatattttctacaaaacagtgttgtgtgaatttaaaaaggacccccagaaatccaaccaatatttattgagtgtttttcaaggaacctattcactgactaggtgaaagagtttatactactttcattgattctgagatgcccatgctttatatttgtacatctcagataccagtctgtttcttacaatagatgatatatcataatttaattggcagcttttttgtttccttagtggtccctaaagtaatggtgcactgtataatcagtggtattgttggttcagtgaatacccacaagaatgtgtgcatgtgtttggtggtggctgacaggtgttaaagaggcgaaacaagctctcttcccagagaaggagtcatcacaggcaatgctgatgttttaagcctcatacgcactccatatgtttatgtgaaaggaaatctttggcattaagactgttggtactgtctgttttcaggcagtaatctcttagctgttatcaggagaatcaattggaagctattagaggtctcttcagttattccttaaacaggcatgcaaattcttgagcattctaaatcagaaagttcattgaattttactttgagtcttatggtttggtctgtagtataaggcagtgttgcagggtaaggaacatgtgttttccacccagttctctccgtagaacatttggtaaatcctggggccaggcgtggtggctcatgcctgtaatcccagcactttgggaggctgaggcggacggatcacaaggtcaggagttcgagaccagccaacatggtgaaaccccgtttctattaaaaatacaaaaaaattgccagcagtggtggcgcacgcctgtaatcccagctactcagaaggctgggttcaatcacttgaacccaggaggcagaggttgcggtgagcggagatcacgccattgcaccccagcctgggtgacagtgcaagactgtctcaaaaacaaaaataaaaacaaaaaaacaaaaaaaatttggcaaatcccttaagcaatctggactttgttttcatcagctaagaaatgaaaggattagccttgataattgtgaagggtggtgcttgcttgttacttccatagttttattatttgatttggagttatgagtgtatgtgtgtgtgtgttttctctacagccatacacactgctgctatggatatgctgggaggacctggtatcgaaagccagtgtagaaaagttgatatcattgcagatgcagcatattccattttccaaaagccaaaaagttttactggcaactttgtcattgatgaaaatatcttaaaagaagaaggaatagaaaattttgacgtttatgcaattaaaccaggtaatgcttttatagtttttaaaagtagtgatacgtttttccatattttctgcaatgaacatatctgttttttgtgtgtgtttgtgtgattgtaaaatgaatgtgttcttttaaaagctgtcttcccaatgaaggaagaaaacccataccaacacaacttaaaaaaaaagatgaatgaaaaatagaggtgagttgagggcttttgaagtgatatatatatatatatatataagcacagaaagtcagatcagttactagccacttctaaatctcgaaataagaaatgaaaattattttttaaagttggtcttaaaatcacagagtaaagattttgttcaagaatatgtggtaacagatggtacagtagtgggttatgtatttatttatttatttgagaaagggtctcactctgtcacccaggttggagtgtagtggcgcaatctcagctcactgcaacctctacctcccaggctcaagcaatccttccacctcagcctctagagtagctgggactataggcatgtgccaccacacctggttaatttttgtatttgtagatgtggggtttcaccatgttgcccaggctggtcttgaactcctgagctcaagtgatctgcctgccttggcctcctaaagtgttaggattacaggcgtgagccactgcacctggcacagtaatgaatttttttgtttaaaataatttatgattgtggactctctaaatatttgtctcttaagcgcagtctcttagagtagcttaatgacagatggtgtagatgagtgggcaggctctgtctcatggacagtaaagtgatctgagaagcttctagaaagccctcttgttaagtaactctccctctctgaaattggggatgataatgataataatggatttttaccatatagaatatgatgtattctaatatagccatacataggagttatatttatttgcgctaaagtatattttaaatattattcattaaactgagcttctaaatgacacaaaccacgtttatatttgtatcatccctgctcatctctgcagttcaaactaaagtaaatagcggattatagttttacaaagcactcttatatgcattatctatttagcctgcataacaattctgtacggaaagtaatgcttagtgattaagaacacgaaatttgggagaagacaacccagcttcatattgcagctctgctgctcactgctatgcagctttgagcatgtcacccagtttgtctgtctcagcctcaatttccatattggtaaacttaagagaatgatacatttcatacaagatttttgtaaaggctaaatgtgataatgtataatgtgtttggcacagtgcccagcatatagtacactcagaatatttagtagttaatatttacaagtggaaaaacaggctcagagagattgagcctttgcctaagagcagatggctaataggtggcagaacctgaccagattcaggtcttccgggtcctggtacccaggaatataattattaccttaggttttaaagacacagtgtaattgtgcgcaagttttaaaattttatttaaattaaaaatcctattaagtattgagaacttaaaatgaccagatactatgatattaggatataacaaagatgaattcattcctgccctccagaagtttgcttaaacttctgaaaaagagagagagagaggcaggagaccgaggcaggaggctcatttgagcccagaagtttgagaccagcctgggcaaaacagcaagaccccatgtcaaaaaaaaaaagagagaaaagaaaaagagaacaattgagattgttaacatctcactgtactacagttttgaaggctttgtggcctttaaatcttctagtgtgcacatgtcttggagttatcagtgtaattaaaacagttaacctatttgctaaccacaaccattagctgaaaataagacccagtggaggctgtgtgcagtggctcacacctgtaatcccagcactttgggaggccaaggccagtggatcgcttgagccaaggagttcaagaccatactgggcaacatggcaaaaccccatctctacaaaaaataaaaatgagtgttcaggcacggtggctcacgcccataatcccagcacattgggaggctgaggtgggtggatatcctaggtcaggagtttgagaccagcctgaccaatatggtgaaactctatctctactaaaaatatgaaaagtagccaggcatagtgatgggcacctgtaatcccagctacttgggaggctgaagcaggaggattgcttgaacctgggaggcagagggtgccatgagctgagatcgtgccactgcactcaagcctgggtgacagagcgagactccgtctcaaaaaataaataaataaataaataataaataaataaataaaaattagctggatatggtggcttgcacctgtggtccctgttacttgggaggctgagggaggaggatcacttgagcccaggaggtggaggttgcagtgagccaagatcatatcactgcactccagcctgggtgacagtgagaccctgtgtcaataataataataataacccagtggaataggatggaataggatagcttagtgttcatgatgatggagtgagaggaagagggaaagagagaagagacccaagtgcactaatgctgagaagaaagtccttcttaagaaggggccctctgcttttaggacggcaggtaagaaataagtcctgacaacttcggaagaatgtgggccagaagagcagtgtaggatgagaagggcagaggttcctgggagagcaggtaaaggctttacagaacaggtgatcttttggggattaaatcttgaagataaaatttatcagaggagagaaagataactgaattatgagaaaattaatttaatgaagatcaggtcattcgacagttctcacagaggccttttcttttgcaccagaaagatttttaataaaatagatatgtttattaaacagatgttaaaatcttactatgttgtagttacattaacctaatggtttggggtcaatttttcaggtcatcctttgcaaccagatttcttcttagatgaatacccagaagcagttagcaagaaagtggaatcaactggtaagatctagactatattttatgttagaaaatataaatcctaacttatgtatttcttccaaaatatggaattgatcctataacagtgacatttctgccttctgtttttaaactgttttgtactttaaactaaacaagtaatgtgagatctcagttaattctagtaaagaaggttgttttgttcatctaccagtaagaagttttaataaggctgggcacagtggctcatacctgtaatcccagcactttgggaggctgaggcgaatggatcacttgagtccaggagtttgcgacgagcttgggcaacatggcgaaaccccgtctctacaaaaaaaatacaaaaaaaaaatacgttgggcgtggtggcacgagactgtagtcccagctactcaggaggctgaggtgggaggatcacctgatcccgggaagttgaagtttcagtgagccgtgatcgtgccactgcactctagcctgggtgacagagcaagaccctgtctcaaaaaaaaaaaaaaaaaaaaaaaaaagaagaagttattaatatattctttgcgtttggttaaaaacaagtctgaaaaaacttttttttaggttttatttattttcttttgcactgtctttaggtatttcatgttgatatgttattttgaggaaaagtgtgtcatatatcaaatacatctaacaccatttccacagtttgtgttatgtgactattttatgaaagaaatcaacttcaaaggaggtttgggttttactttgttttgtttctgtaattcataaacaatagtgcccttgaattggtccagagtttacattttagactttgtgttctgacattttgccagtggcttacttgaagaaacactttaatgaatacctgtgggaagaatttctctcatggtttactaataagaatggctgtgcttcttctgggcccttaccttatttttatcttatagatgctatgactctcatcgatttttttttttagaagtctgatagaaaatgtagggatgaatttccttgatacctttagcaaatctgtggcaccttactgcaatgcattttagagccaaaccttatttccagctttcttttatttattctttattatttatcttttctttttccagatttttatggtaatttaaaaaaattacttaggtaataaaaaggacttttttgtattacagacaatttaaaacaatagaaaggaaaatagttactcataatcctactacccagagtattaaaaccaggaaaaacaagactgtcagtctgtttctcaaaaggcctcttacagaatggtggaaaatacctagagagcttatcaaactctagaagagtctggtcttcaagttagttaagtcccaaactccgatttttgcccaacgccctaaggttggatctgtcttttagaagaaggcatgcatgaactgagatcatttaaactccaaattttaaataagaaccacttattgatcatgtatgttctttttgtttattcaacaaatatttactgggcacctcctatgtgccaaacactgtgctaagtactttacatgcattgtcctgtttaataccattaatccccaagacagatactcccctcattttacagctgcaattgcacagccagcaggtggcagaaccaagatttaaactcatatttctctgatttcaaagcccatgtctttaaccagtaaacttaaatggctttcctaacacttgaatacttagtcttttaaattttagcatattcttagtctgggcaacatggtgagaccctgtctctacaaaaaaataaaaaaaattagctggccatggtggcacatgcctgtagtctcagctactcaggagactgaagcaggaggatcccttgagctcaagagtttgaggctgcagtgagctatgattgagctacagcactccagcctgggcaacagagcaagaccctgtctcaaataaatacgtaaattagcacattctttcccctgataatccagtttattaatttataacaaagagttgccatctcataggttaaacatgtaggtgcttgatcagcacattctcttcctttggatataattgtgcatgaaacagaatcatagtcagaaggtcatttcatgaccatggaatcagaacaagggagttagataggtagagtgtaaaatcagtgtttactggcatcaggctttgatagggataactttgcctatagccatctccacataagcaatgctcttacccttaaggttagaagactcaaattcctttggctaacttccctcacctaatgctgcaggagcatttacttctgtagctctctttttttgattctgtgtggttcagtcaatagcaattttacctgaccttttctgtagatatattaatatactcatatagatagtagcctgggctataacttacctctttcagtttatttcttatgtcctctcatagttcagctctttgagaaccatgtgtatcccttgtttccaaagggggagaggttcacctttctattgcaccaacaacttataataacccctgttaccatttcattataccttttccagtattcgtcgtgtgtatgttagctcttatatatgtaattattgtagacaatggacctagttttaaattgatgggttttttttttcttcccatcttaaaagcaatatcaaccaggcatagtggctcacgcctgtagtcccagcactttgggaggctgaggtgggaggatcgcttgagcccaggagttcaagactagtctgggcaacatggcaaaactttgtctctacaaaaagtacaaaaattagctgggtgtgatggtgcatgcctgtagtcccagctacttgggaggctgaagtgggaggatcacttgagttcaggagtttgaggttgtaatgagctatgatcaagccattaaactccagcctgggtgagagagtgagacccctgtctcaaaaaacaaacaaacgaaaatgcaataccattatttcttcattgattccccccacccctactctccactggaacacagggagcccactcagtcttgttttttttttttttttttttgacttccagcttatttttgtttttattttttatttggtttagagactgggtctcaccccgttgcccaagctggagtgcagtggctcgatcatagcccactgcagccctcaaagtcctggactcaaacaatcctctcacctcagcctcaccaatagctgggactagaggtgcatgccaccacgtccagctaatttttaaattttttgtaaagagggggtcttgttatattgcccaggctggtctcaaactcctggcctcaaacaatcatcctgcctcggcctcccaaagtgctgggattacaggcatgagctatggcgctgggcctattttccttcagttacagttttaattgcttctgttgcagttgttctggattctcagaaacacttattcttaccttggctcccctttccctttccctgtagttagcaccatttctcactggttctggctttctcttctgtattctggagaccttgttaagtttgtcctctgtattaaaaaggacagtctgataagatgttctatagcttagtttctgttccatattgtctcaaatggttaatttgctatggtgctcacttcctttttcattttatcctattgtcttttcatcacagccggttatatataactttctgtccctgtttcatatagtttttttttttaaggctttatttatttatttttttgagacagagtctctatcaccctggctggaatgcagtggcatgatcttggctcactgcaacctccaccgcccaggttaaagcaattctccttcctcagcctccctagtagctgggattacatgggtgtgccaccatgcccggctaattttgtatttttagtagagatggggtttcgccacattagccagtctggtctcaaacttctgaccttgggtgatccacccaccttggcctcccaaagtgctgggattacaggcatgagccactgtgcctggccaaagctttatttttttttatagcataaagttttagattcacagcaaaactgagaaggtacagaaatatcatatatcccacacatgcattacttccttccttagcagcatcctctaccagagtggtacatttgttagaattgatgaatctgtattgacacatcataatgatatagttttcgtgtggaagaattcttgtaggtttcatggtaaattagttttagatatttgctcttcagaatagcctccattgcctgtggcacattatttttttcataggcatcaggttattttttttttctgttaattcttcctcatattaggagatatctctagagctagtgtagtcaaaggcaggaatgtgtaggttgcttttggctcccttccctgtctatatggaggaattcctttttctgagctgtagtttcagatgtggcacctgttgggcaaatagctcaggccagtgtgcaaggctgacatgtgaccttcctttacttcctctgtttaaaactactctccaggcctggctcagtggctaatgcctgtaatcccagcactttgggaggctgtggtgggaggattgcccgaggccaggagttcgagatgagcctgggcaatgtagcaatagcaagatcccatttctacaaaaaatttttaacaatagccaggcgtggtggtatgtacctgtggtctcaggtacttgggaggctgaggcgggaggatcacttgagcccaggagttcaagcttgcagcaagctgtgattgtgccattgcactccagcctgggtgacagagggagaccctatctcaaaaacaacatgaaacacaacaaaaacacaaaaactactctctcctggaatgccctgctgccacggttcttcccctccccatccttgtcagccatgccttggggcatgtacttcccaggatgctccactgcaggactcccctactgtctgcttatcttatttgggagctacaagctttggaactggatttgaaagatgaggatgaggaatcacattgagtgtgtcttgaaaagtagcatgtgtaaaacagagagacagcttctgatcttagttggtacaagcccagagtctgatccagcgcgagcctctcttctttgttcgggtgggcagaggtattctttgagatctttcatgagggaaagcacaggagacctgtctttctggggctgactccatgtaccttagagctgctgaacctctcttcctagattcagacaatagattgtgtatcagtctaggtgatattcagtatttccccttttgtgtgtgtgtgcatttttatatttattcagtgtgaagttaggagagcctgtgtcagggactaccagccatatgtcatcttcttttgtgtactggaattctataaatatttctttcccattctggcttacatatttgtagtctgatggctgcacctttaaaatctatcacaggttttttttgtctcctgaagtttttttttctcttgtgcaaactcatcatgtttacgtctcaataatccaggtgataaattatgcagtttatctcttggcaaatgtctttcagggataaactaaagtttttgctgcaatctccttggcacctcatatgtagatgatatatcttgactaatatacaaatcacctgaagtagttacccacaaggaagggaggggttccagcagttatttatgtgacagactcagttctctctggtgtaactgctaaaacgaaacacatgacctgcctttggaaacatgaaggaagcctgtgtcattgctgcccttgctttagcagcctctgcttggtcaacttctggtgagtttcacatctcagcactgtgttcagcttttatgttggctatataaaaaatcaaattgctaaacatagaaggaaatgtggaggaaatatttattactcagtggataaaattgcaggctctggagtcagactgcctggatttaatcttgaattgcatttgtttttattaaacaaattgaaatgctttctggaacaagccaagttaaaaataaaaaggggaaaattaacttttgtatgttctgtatctggtcaccatcatgagttttttgttgttgtttttaaagacatctaatagtttttgagagagcgtgagtactcattgaaagcatagactttggagtaagacagatctgggttcaaatccggtgcccgccacttatatttatcattttgggcatatcacttcagctctctgaaacagttttgtcacctcttactttccttgtgtaattattgtgaggaataagagtgatggtacatcatattgtacatttgatgcaggaagctccctgtaactattggttgctgtagttattattatcttaaattttctacatggtaaaacttcttgtctgcatataataatgtctttcaaggatgatttctggcatatattttaatacactgacttgaacttccaggaggttcattaaaactattttattttaattatccttattttattcttaattttaatgagaaaatcttcagattttaccataagtaaggtgttaacatttgtataagatggacatttttttaatcagagaagttagattggtatctatttttagtgtaataaacttgttacattttaaatatggtaaatgggtactttttctattctttctttcacctctttctttctttcctcctttctttctttccttctttctctctctttttatttttttattgagacggagtcttgctccgttgcccaggctggagtgcagcggcattttcttcttggctcactgcaacgtccgccacctgggttcaagcgattctcctgcctcagcctcctgagtagctaggattacaggcttgccacccagctaatttttttttttatttttttatttttagtagagacagggtttcactgcgttagccaggatggtctcgatctcctgacttcatgatccacccgccttggcctcccaaaagtgctgggattacaggcatgagccaccacacccagcctctctctgtgttcttttctttgaaggtttgaaatacctactaagtcatttgggtcttttctgaagttatttctttcaaaacttttattttattcaattataggctttttaaaaaataaaaacccaaattatccatttgaagtttcaaaacctgtttgagttgacatgtagtatttcacttacacaattttttaaagttttcaaactgttttatctctttcctctgtttttttttttttttttttcttttaagacaaagtctcactctgtctcccaggctggagcgcagtggcacgatctcggctcactgcaacccctgcctcccaggttcaagcaattctcatgcctcagcctcctgagtagctaggattacaggtgcacgccaccatgcccagctaatttttgtatttttagtagagacggggtttcaccatgttggtcaggctggtctcaaactcctgacctcaggtgatccacccaccttggcttcccaaagtgctaggattaccagcatgagccaccacgcccagcctctttcctctgttttaaaaattatttttcttttttcttgattagttgctgattttgtgttatcttattttttctcaaaagcaccagactttaaattttatttcatttttaattctacagcttttctcttttctgattatctttttaataacaactcgagatataacttatatataccaaaaaattcatcattttaggccgggtgcggtggctcatgcctgtaattctagcactttgggaggctgaggcaggcggattgtctgagctccggtgttcaagaccagcctgggcaacatggcgaaattctgtctctactaaaaatacaaaaaattagtcgggtgtggtggtgcacatctgtaatcccagctgcccaggaggtggaggttgcagtgagccaaaatcatgtcactgcactccagacggggtgacagagtggaactcagtttcaaaaaaaaaaaaattcaccatttggaagtgtctagtgatttttagcatcttcccagaattgtgcaaccatctgattccttactttttttacttttggtttattgttttctcctttctgctttctttgaggttgcttttgttcctgttcttacttgttgggctaatactttattgttatttcttttaaaataatgaaataaagtttgtgcatttatccccttaacatagctttggctacatccaatcgattttgttatatactttactcaattttgatagcattttaaattagtctgtatagaaaagcttagtacgggcagggtataggggctcacacctgtaatcataacactatgggagacagaggtgggatgatcacttgaggacatgagttcaagaccggcctgggcaacatagcgagaccccccccccatctctaccaatagaaaaaaattaaaacattaaaaatttaaaaagacaagtttaatacagaagtataaaaaaagcatagaacaggccaggtgccgtggctcatgcctgtaatcccagcattttgggaggctgaggcgagcagatcacctgaggtcgggagttcaagaccagcctggccagcatggtgaaaccctgtctctactaaaaatacaaaattagtcgggtgcagtggtatgtgcctgtaatcccagctattcgggaggctgaggcacaagaatcgcttgaacctgggaggtggaggttgcaatgggctgagatcatgccactgcactccagcctaggtgacagagcaagactgcctcaaaaaaaaaaaaaaaagtatagaacagctcaaagaaaaattttaaagtcacctgtaatccaattataagtacatttatattttggcttatttcctttcaaccacttttttttggcacatataatttaaaatgtatacccagaaataaatattttaccagtaggttcatattgttttttattttcttaagaaagaagctttatatatattatgtttaattgcatagactcccatttaatttaacattacttaattattgtgaatgttttccatgtcttcaaaaacaactttttgaggccgggtgtggtatctcatgtctgtaatcccaatcatgggtggctgaggcgggtggatcgtttgagtctaggagttcgagaccagcctggccaacatggtgaaaccccgtctctataaaaaatacaaaaaattagctgggcgtagtggcacatgcctgtggtcccagctactcaggaagcttgagctcaggaagttgaggctgcagtgaaccttgactgtaccactgcacttcagcctgggtgacagagtaagcccatctcaaaaaacagaccaaaaaaaatagataaatattggaattcatagctcaattttaaaattggcttctaaataataataccttatattaatagtaatgtgtctcattcacttacactggtgtacatttggaaaataactgggaagtggcattgctcaaataagcattgcaaaggttataaagtattaggttattgtcactgaagcatggggaatacctttttcaaattgaactggtgaagacgaactgttggccacatttatgttttcaaattgtagaataaatatgtatgtgtgtatgtatttacatattcagccttatattgtttaattcagtgtctattcaaaaactgtcttatctaaaatagtcttacattctatcccagctcttgctctttttaaagtagaacccatcacttctcgacttaatttcatgtatgtatgcatgtatatgcatttgcatattgtctgtctatactagtcagttttcttttaagtctgcgtctggcttggtgtcatggtaatactgacctcacataattaattagaaagtgttccctcctcttgcattttttttttttggaagagatttgaaggatcggcaggcatataagaatagatactgtgtgattgattccatttatttgaagataaacatgagacaaaactaatatatggtgttagcaattaggaggggttgtggagtgggcttctgggatacctgtaatatcatctttcttgacctaggtggtgatgtttgatctggatacatctgatcactgtttctgaatgtatgttacatgtcaataaaaagcagtgtcatgctaagtgcaaggcagaagtggattgcccccagtgcaggcaataaaggggtacactgtagtaaattttaaaacaataataaaacaggctaaaaaaattctttaaggctttcatctctaatatctgttcgtactttaacttataaaaggaaaatgattttttttatttgtggaaacatcataatgaaaggcaatttatattcagtatactttatgaattaatagcttactttgtactatggagtatctttatgctgtcaattagatttcatgtaataacctttgaggaattgtattagacaagatggctgtgtataatttgagttgagaaacagattcaccttcagcctagagcacagattggccttggagttaatttaattaacgaattgttcttacctgtttctgggggcaactacttagctgcctctatgtgattctagaatgataaataaaggaacagagaggccgggcacggtggctcacgcctgcaatcccagcactttgggaggccaatgtgggtggatcacctgaggtaaggagtttgagaccagcctggccaacatggtgaaaccctgtctctactaaaaattcaaaaattagccgggcacggtggtgggcacctgtagtcccacctactcgggaggctgaagctggagaatcacttgaaccaggagacggaggttgcagtgagccgagatcaagccactgcactccagcctgggtgacaaagcgagactgtctcaaaaataaataaaggaacagagacagtattggggggcagcatcatgatatgggagcaaagcagtcctatgaactgctgtcttctcccctggctgatcatatgttaagttgttatagccagtgggttaagtgaatgcaagttttaaaatgttgcaggtaacctccattcccgtgacctagtgtttccagagagggcagcctgttagtcaggggactaacagtttaacctcccttttcatctagtgggagggataatctgaataagtgagacagggagaagaaactgaggttgtgtgtcagacccttctgagcattctctctttctgagcaggctgtcctcagttttttacatgatctctacttaagagcatttctaacccgtgatgggaggatgcagggtcaatccatgggtgaaaggactaggtgaatagattgaatttagaggtggagtgattagaaagtacacttgggtgttgattcaagctacagtcttcagtttagctccaccagttccacagctgatattttgatttccatctttctgattccaatgtctttttgttctcatttggttttagaactgagagaaattgacaaaggagtgattgattatcatccctcatactccagtagttgtgtttaggtctgtttcttttatttatttttttgagacagggtctccctctgtcaccaaggctggagtgcagtagcgtgatctcggctcactgcagcctctacctcccaggctcaagtgatcctctcacctcagcctcccaagtagctgggactacaggcaccaaccaccacgcccagctaatttttgtattttttgtagagacagggtttctccatgttgcccaggctggtctcgaactcctgggctcaagtgatccacccgccttggcctcccaaagtgctggaattacatgcatgagccgccacgcccagccttggcctcacaaagtactcagattatagaaggtttgtttatgataaatatttatagtttagtagtattttttaacctaatctgaaagtcagccttttatttggagagtataaagatttacatttatagtcataattgatgtgtgtttgactgttattctgtcaatttgatttatgcttttagatgccacttaatgcatttaaagtcattttggtcaaataggtctaattggtggcaagtctgtcctgctgattaattaattctgtgtggggtccttcactgccaagcattaaggtcatttgcttcaataatatcttataggtgctgttccagaattcaaagaagagaaactgcagctgcaaccaaaaccacgttctggagctgtggaagaaacatttagaattgttaaggactctctcagtgatgatgttgttaaagccactcaagcaatctatctgtttgaactctccggtaaggactgcatctggtaatctgaagtttttatgaaacaaaatggggtgtttcctttggaagaaaatcagcgtccaacagtgatcccctggatagttggctgcattcaagacccttactcttgaatgtagacattcaagaacagcaaccataactattgatttgtttttgttgttgttgtgtctttgagatggagtctttgtcacccaggctggagagcaatggcatgatcatggctcacttcggccttgacctcctggactcaagtaatcctctgacctcagcctcccaatgatttttatttctagattaagatcagtgcgtacggacacatgtaaagtaaaattttattacaaatactcccagtgttatataactctggcatatttgagagaaaatcctgcttagaagggcatatggatcatgacaggtagtatgatacagtaatttatcaaccataggcaccttgccatttttatctttgacattaaccaggtcggtctgacggtagtcagctttttttcactttttttatttttaaaaatttataattatttttttgcaatggagtctcgctttgttgcccaggctggagtgcagtggtgggatctgggctcactgcaacctctgcctcctgggttcaagtgattctcctgcctcagcctcccaagtagctgggattaaaggcacccaccaccacacatggctaatttttgtatttttagtagaggtggggttttgccatgttgcccaggctggtctcaaactcctagcctcaagcaatcctcctgcctcagcctcccaaagtgctgagattgcaggtgtgagccattgtgcccagatggtagttagcttttaaaaatctcttaatattgttcttctccatataaaatttacacgttaataatagtgtaagaactagctgccagggatggtggcgtgcagctgtaatcccagctactcaggaggctgaggctggaggatcacttgagcccaggagatcaagactgtagtacactgcgatcgcatctgtgaataaccactgcactccagcctgggcaacatagtgagacccatctcaaacaaataaaagttaagaaacagataaaattcgtgttaaaaaaaaaaaggctacctcagccccattatacacaaaccttttttattcttcgtcctctctgctttatcttagtccatcttgccttcctgttcttacttccttgccatccttggaatccatcatccatggctttagtcactctcttgcttgtgtcctaaacttgctggaccctttgtgcttatgccatcacctgtcaaaagcctagtcctggctgaatcaaactctctggctgctccacagttgtatccaggttgcaaagttttgggggaggaaagctaaaaaaaatcacaccacctgggtggatctgtaccagtagaaattgactattgccccgcttcagctgaggtttaagcaacacttcagaattctgtgtttttgtggtcagcttactgctgcattttccatagtgactatcttaaactttctcagtgttcctgaaatctcccatctctcccttcacctcttccctgccagtgtcagcagataattccacttgctctttgacagaggtaatagaaacctacagacaaaaatgccttcagcttcctgccatcagatatcaaatcaatcatgataggcatcatccttgcctccttccctcttagtagaatggagctcagctctccatcagtgcatctcaagctctaatgtctataccaagtacctgggatcttcctaaaatgcaaaataatgattcagcaggtctggagtggagtctgagattctgcatgtctgacaggtaatgacagtattgcagtccatggatcatacttggaagcaaagttctagatcccattttccctggccttctcaggaattttgtgctgttaattgaaccttgtcctcaatctgttcatcttgcagcctccttcccaatggtattttaatgttctcaattcttttctaactttaaaacagaacccagtgacaataacaaaccacacagcccatcttttttctccttttcagagccagacttattttcatctacaactcattcccctgaacacaccctgctgataccatttgtttccatttcacataattggttttcagcaaggtccttgatgacttccctgtcaccagtgggcctgtgtcattcctcccttgtgaccactctgcagcatttgatactgttgaccacactttccttctggaaatgctccttccccagtccttcattgtaacctccttgctttccttccctgcctgtgatcacaccttgtcagtctcccttgctggctgcttctcctctatccttcccttaagcaatgttcttcaggtcactggctcagcactctcgacactctattcctgacactttctctaggaaaccccaaccattcacgcggcttcaatgaccataggaaccgactgattatgtgtccctgtttctagcttagccagacttcatttgacatttttagttaactgtcacaaagatgcctcagcctgaaaacgtccaaaacaaccattcccaggaaatggtttttttgcaaccacccatgaaatctgctgagtgtctggcttgctgtgtctcttgggcagtgtcgatccacaccctctctctgcatgccttgaaaaattgtggaaatccctgggtggctcgtgcctattatcccagcactttggaaggccgaggtgggcagatcaacagaggtcaagaccagcttggccaacatggcaaaacctcatctctactaaaaaatataaaaattagccgggcttggtggcgcgtgcctgtagtcccagctacttgggaggctgaggcaggagaatcgcttgaaccccggaggcggaggttgcggtgagcccagatcgcatcactgcactccagcttgggcaacagagcgagactctgactcaaaaaaagaaagaaaaaaaaatggaggaaatcaagcgctttctgctcagatccaggcaagtggatgccgtatctgtcaagatcaagaaaaataaagttcacagcagcaggattatactttggttgtcacaaagagaaggcagagaaacaagctgaagcagtctctgccccttggtttgacagtgaaggagctgagatgaaccagacgtgctggtttgagctgtattaaaattttaaacgttgcctgtaatcccagcactctgggaggccaatcacttgagctcaggagttcgagaccaggctgggtaacatagtgagaccctgtctctacaaaaataaaaataaaaaattagctggatctggtgatgtgtgcctataatcccagctacttgggaggctgagatgggaagacagcttaagcccagaaggtcgaggctgcagtgagtgatgatcatgccacttcactctagcctaggcaacagagcaagaccctgtcttaaaaaattaaaaatcaagcaatctgctgttcttcagtagtcttctctcacttaaaaaacaaatccacccaagccaagaactagcagatcattcctatataccctccccaccttttcctcttcatatgcagttacctagtcttatggttctgccttgacattctctctcaaatgtacccacttttctccatgcctctgccatggtcccagtccaggcatgcaccctcaagctcctgaactatcccaacaccatccttactagccctctgcatccttttgatttctctccatttattatctacactgcaggtagggccatacgtaaaccttaccatatcatcttccttccatgacacatcctgtaggatgaagtcatttaatcctttacatgactggctgtgctcagacctagactgcctcacaagctcatccaacacccatctaccttctagtgccactgtttttttttttcagttcctcacacgtgctgcactcttgattctggcttttttgcatgtgctgttcccattgcctgaaatactttccctctaccctgtccatctagctaattcttacttaactttcaaatctcagcttcaactgagctttcctgaccctttttgaaaacttaattttgcatcgcagtaaaaaatacataacattttaaccacttcttcttttttttttttttttcttttgagacggagttttgctcttgttgccccaagctggagtgcaatggcgcgatcttggctcactgcaacctctgcccccaaggttcaaacaattctcttgcctcagcctcccaagtagctgggattataggcactccccaccacacctggctaattttttgtatttttagtagaaacggggtttcaccatgttggccaggctggtcttgaactcctgacctcaggtcatctgcccacccttgcctcccaaagagtcaggattacaggtatgagccaccatgctcggcctattttaaccacttctaagtgtacagcttagtagcattaaatgcattcacattgttttataacaatcatcacctgccgggcacggtatctcatgcctgtaatcccagcactttgggaggccgaggtgggcagatcacgaggtcaggagatcgagaccatcctggctaacatggtgagaccccgtctctactaaaaatacaaaaaattagctgggtgtggtggcgggcacctgtagtcccagctactagggaggctgaggcaggagaatagcatgaacccgggaggcggagcttgcagtgagccgagatcgcgccactgcactccagcctgggcgacagagctagactccatctccaaaaaaaagaaaagaaaaagaaaacaaaaaacaaaaacaaaaacaaaaacaaaacaatcatcaccatctatctccagaactttttcatcattccaagtgaaactctgtacccattaaacagttaactcccattccccatcccccagtccctggaaaccactgttctactttctgtctttatgagttttcttcctctggttatcttgattccttaatgtgctcccacatcaccctctacttcctcttttgtgagtagaaccatggttttctttttattgaagagtcttcagagcctagcagaatacctggacgtgcttaataaatatttgctgaatttgactgatggaggtctggggattttaacttggaaaacagcattttgtaagattattctaattgaagtaattattaaatttaagaagaacagggcttctatgacattgatttctatatgtttatctctctaggtgaagatggtggcacgtggtttcttgatctgaaaagcaagggtgggaatgtcggatatggagagccttctgatcaggcagatgtggtgatgagtatgactactgatgactttgtaaaaatgttttcaggtgagttttccagtttattagtttaccttattgttcagagaaaatttagttctgacattttgctttatcccttcccaaataatcaagacttgtaaatgttggcagcagtggaatcttagttttgggaaggctgttcttactgttgcctccattgccacttctccctcctctcacaagtggaaggtagatgtcagaattattttcttccattactgagaagccagtaatataatgttgggaacagtgagataattcaaagggactcctgggtgggcttcatcatattagctggcctaaggtattatgtttccaataacaccccagtcactagaggcactgaactcagtagcagcagttcgcttattgggagtagggttgtgcttccatcttgccagctgtttcaataggaaacacataccagcccttggccatggcctagtgaccctgctttctggggagtcctaaacccagagaaccttttgtgtgattttctattctgtccatttacctctaactgtgccagaaaattaaggataattttctcttttctactcttagaaaactactccaaatgataagttaattaactcaaattctaaaaaattagaagcagcacttgaaactaagcataacatcctgatctaaagagtctttcatggagtgaattataaatgttattcagactttgttctgttttaatcttttctaagcaggaacatggtgtattctgtgccctctaagtctttctttacagttctaattcaggatgctaattgcctgcattccatctgagtcaatctgtatacggtgtactaatgatcagcatttcttcaacttttccctttttttatagtggtgttaaatgttcatataaaaattagaaaatataggccaggcctggtggctcgcgcctggaatcccaatgctttgggaggccaaggtgggaggatcacttgcgcccaggagtttgagaccagcctgggcaacatggggaaaccctgtctctacagaaaatacaaaaattggttgggtgtgctggtgcgcacctgtagtccccagctactccagttaaggtaggaggattgcctgagcccagaggtgaaggctgcagtaagttgagataacaccaccgcactccagcctgggcggcagaatgaaaccgtctcaaaaaaagagaaagtatacctaagaaaaaagaaaataaaattatttttaccataccactgaaagatgaccataatatacatatgtatgatgctaaaccataaccaaaccaaaatatggtttagcatctatatatgtatattatgctcatcttattatggtttgcataatttggtttagcatcatacatatgtatatttgtatgtgtgtgttagtgtatataaatatacatgtgtgcttataaaaacaggatcataccattactactgtttggcagtctttttcacttaatacattataacatctttcaatgtttatcattggttatccctttaatgaattttttttttttgagacggagttttgctcttgttgcccaggctggagtgcaatggtgttaaccttggttcactgcaacctctgccttccgggttcaagcaattctcctgcctcagcctccagagtcgctgggattacaggtgcccgccaccatgcctggctaattttttgtacttttagtaaagacagggtttcaccatattggccaggctggtctcgaattgctgacctcaggtgatccacccgccttggcctcccaaagtgctggtattacaaatgtgagccaccgcgcccggcccctttaatgatttttaatagtttagtgtttcttcagtgtttcaacaactatttctccatagagcttaaacacagtgctttggacacatttaataaacgctcaatgaatgtttggtgaatcggaatcttataaatatttgttttaacatgaagaccatttaaaataaaaatgtattgtcaacttctaaatggaaataacagtaattatgtatgatttatttattgcatgattgctacaggttaagcaatactcccaacagttctttccaataaaatatgttctccattttatagcagtaagtactgaggctttgaagaattaaataataagcccaaggtcagctgatgaatgagaaaatagagcaaggatttgaatccaagctaactccaaagcttatgctcttcattattatgctagtctgccctccaaaggtgaagaaatcaagtgacttctttctttaatttacatttcacttatgtagcatacagttgaaataataggctttctattggtatctttctttgaatgtggtcttggattcactggatgaggccagtcagttatatgaattatttaaaaaaacaattattcttatcaagtatattttataggtatggtttagatcgggagcaagtgagtttgcttgtgcttcttatgtccttttattcttactgtttatcccatctgctttcctttaaatgggcacaatttagactttatatcctaagaattctctttgatgagaccatagccatttctatgcctaatttatgtagtggatacattataaatacaaaaatttaggccaggcgtggtggttcatttctgtaatcccagcactttgggaggccaaggcaggtggatgacttgaggtcaggagtttgagaccagcctggcctacagggcaaaaccctgtctctaccaaaaatacaaaaattagccgggtgtggtggcacatgcctgtaattccagctcctcaggaggctaaggcataagaatcgcctgaaccttgaagcggaggttgcagtgagctgagatcgagccaccgcactccagcctgggtgactgactgagaccctgtctcaaaaaaaaaaaaaattaaagcaactagtaaccaactaatcagaatctctccttttggccaatagaggccactgtatggtggagcagtatgacagaaataaagtaaattgagcaatattactttacctgaggagggggatgtgtgtgtgtgtgtgtgtgtgtgtgtgtgtgtgtgtgtgtataaaacattgagcttactagctttttaaaaaacttttgttaaaacagtattgttgaggtctaattcacatgcaataaaatttaccatcctaagtataaatgatttttaataaatttatagttacacagccataactacagtccagtctgagaacatttcatcacactaaaaaattctctcatgtctctttgcagtcgatcctatttccattcccaaagccctagccagccaaatactaatttgctctctgtctctataaatttgctatttctggacattttatatatatggaataaaacagtatatagtcttttgcatctagcaccttttacttagcataggcttttgatattcattcatatatatgttgtagctggtatcagtagttcggttcctttttattgctgaatagtattccattgtatggatataccacatgttgtttattcactcaccagctgatggacacttggattgtttcaagtttttggctattatggatattgctgctatgaacattctcatacatgttatcagtatggatatttgttttcatttttcttgggtagatttttaagaatggaattgctaggtcatatggtaagttgatatttaacttttttttttttttttcacttaaaataaaatagagatagggtctcgctttgctgcccaggctggtcttgaacttctgggctaaagcaatcctcctacctcagctttccaaagtcctgggattacaggcgagagccactgtacccagccaatatttaactttttaagaacctaccaaactatttgctacagtgactataccatttttatagtcccatcagcaatgtattaaggttccattttctctacctattcaccaacacttgttgtcttttaaaaacatttttttaaaattgctccttgcagagcagggttaactcataggtagtacacccagagttggcttgttgtcttttttattatagccattctagtgggcatgtagtggtatctcatatgtttatttgtgtatttatttattttttgagacacagtcttgctctcctaggctggagtgcagtggcatgatctcggctcactgcaacctccacctcctgggttcaagcaattctcatgtctcagcctcccaagaagctgggattacaggcatgcactaccacacctaggtaatttttgtatttttactagagacggggtttcaccatgttggccaggctggtctcaaactcctggcctcgagtgatctacccacctcagcctcccaaagtgctgggattataggcatgagccaccgtgcccagcctcgtgtggttttaatttgtattttcttactgataatgatttaaacatattttcatgtgtttgatagctacttatattgggtgaattgtctattcagtctttgctcattttaaaattgagttgtcagccaggcatggtggctcatgcctataatcccaacactttggggggccaaagaaagaggatcacttgaggccaggagtatgagaccagcctgaataacatagtgagaccctgcttctacacacacacagacacacacacagacacacacacacacacacacacacacacacacaagtaaaattgagttgtcttttgaatattgtcagattctttataaattctggatgcatgttctttattggatatgtgatttgcaaatattttctcctagtatgtggtttctctttccattttcttaaaagtatcttctgtattacaaaagttgttttgttttgatcaagtttaatctattattttttcctgttatcattcatgcttttcccactaaatattttcttttttaccgttgtgaaatgaaattattgtcgttagtttatttccaaattgcctgtttctggtatatatagctataactaatttttgtgtattgattttgtatcatttgaattaatcagtgaagccattttgtagctgggattttttgtaggaatattttaaattagtaattcaatttctagttgtatgtcaatagctttttaaaaacagctttattgagatataattcatataccatacagttcacccacttaaagtgtaaaattcatctgttgcttttaaaacattttcgtcatctcaaaaagaaacctcccacccattagcggtcaacctcatatccctctatatccccacctctacccctaaacaaccactaatccactttctgtctctacctatcacctgtcaatgtaatatccctcaatatccccaccagcagccctaagcaacaactaatcaactttctatctctatggttttccctattctgactttcgtatgaactgagtcatgtaatatgtgatcttttgtgactggcttctttcacttaacataatgttttcaagtttcatccttgtagtagcatgtattagtatttcataaccttttaaaaaataaagtgaaattcagataacatgcaattagtcattttatttttattttttgagacagagtctcgcgcagtcaccccagctggagtgcagtggcgtgatctcagcttactgcaacatctgcctcctgggttccagcaattctcttgcctcagtctcctgggtagctgggattacaggagcccactaccacgcctggctaatttttgtatttttagtagagacagaatttcaccatgttggccaggctggtctcgaactcctgacctcaggcaatcctcctgcctcggcctgccaaagtgctgggattacaggcgtgagccaccaggcccggccgcaattactcattttaaagtgtacagttcagtgacatttaatatattcacagtgctgtgcaaccacccctccctggtttcaaaactttttcatcactgcagaggaatacctgtaccatatgtaagtaagcacttctcattctcacctcccctggcaaccactaatctgctttttctctattgatttgcatattctgaatattttaaacaaatggaatcatgcaatatgtgaccttttgcatctgacttattttatttagcataatgtttttgaggttcatccaagctgtagcatgtatcagcacctcatttctttttctggctgaatattattccattatatggatttaccacaattcatttacctattcatcttttgtttctgctgtctggctattatgaataatgcttcgataaacattcatatacaagtttctatgtggctttatgttttcatttctcttggctatctacatgggagtagaattctaggtcataatataattttatgtttaacttctcaaagaattgccaaaaggtttttcatagtggctgcatcatttacattcccaacggcaatgtacaaggatttctatttttccatattcttgcacttaccaacacttcttttttgttattattttgttttttcattattgccaccctagtggatgtgaaatggcatcttattgttttgatttgcatttctctaatgacaaatgatatcatactttttttatgtgcttatggatcaaaggtatttccttggagaaatgtcccttcaagtcctttgccatttcaaaatttggttatttgtcttttattattcagttttaagaaattctggccaggcgcagtggctcacctgtaatcctagcactttgggaggccgaggcgggcagatcacttgaggtcaggacttcgagaccagcctggccaacatggtgaaaccccatctctactaaaaatacaaaaattagctgggcatggtggcaggtgcatgtaatcctatctactcaggaggctgaggcaggagaatcgcttgaacccaggaggcggaggctgcagtgagccaagatcacgccattgcactctagcctgggtgacacagagactgtctcaaaaaaaaaaaaaaatcttcatatattttcagttagttatgtttcatcagatacatgatttacaaatgctttttcacattttttgtaggttgttttttcactttcttgatgatatattttgaagcacatatgtttttagttttgaagttcaacctattttttttgatttttacttccagtgtcatatataagaatcctttgccaaatcaaggttaggaagctttatacctatattttcttctaagagttttgagttttacctcttacatttaggtttatgatccattttaagttaatttttgtagatggtaggagagtccaacttcattcttttgtatgtggatatccagttatcccagcaccatttgttgaatagactgttctttcctgtgttaaatggtcttggcacccttgttgaagatcagttgactatagatacatgggtttagttaaatccatagatgtataggtacagttaattatagaattaccaaataactcacaatttctacttgtaaatatatactcaaaagaattgaaaacaggcactcgaacaaataaatgtacatgcatattcacagcagcgctattcacaataggcaaaagacagaaacaacctaaatgtccattaagggatgcatggataaacaaagtgtggtatatacatataatgaaatagcagtcagccataaaaaggaatgaagtactaatacatgctacaccatgggacattatgctaaatgaaaaaagccagacaccaaagatcacatattgtagaaatccttttatattaaatatctagaataggtgcatccatagacacagagagctgttggtggttgccagagtctggaggcagggggagctgctaatgctgaatccctgagggtttcattttgggatgatgaaaatggttgaaactagatagataccacgtgttgcgtggtggtacacaacattgtacctggacttaaatgccactaaattgtttctcttccttttcttataagggcactaatcccatcattccggctccatcctcatgatttcacctaaaccaaattattttcccaaggccccacttcctgagaccatcacactgagggcaagagcttcaagatatgaagtttgtggggaatgccaacattcagtccatgacactaagcaaagtcttcctgtactcttcccacagcttcttgatgcagttttctacgttgtcaaatgtatcagcttgtgtcagtccactttttccccggagccctttgtcttcatgttataatctagacctgaagctcattaagcctgctacacagctgttgtcctagaaatttaactctctcctgcactgaatctcctgtttcctggatcccatgtcttctttcttcctttacatcttcaatttggtggcacacattgtccagtagtttcatgagaaaggatacattagagataatttttgtgtgtatctgaaactactattattctaccaactctcttgattgtttgtctgggtagagatttccaggttgcaattcattttccctcagaattttgaagccattgctttatcatcttaagattatcgttgagaatttgatgttgttcgtcttaatcttttctatctacccctgtcctttctgaaagtttttgaaatcagagacatatttctctgtggtagtctgatatttcacagtgataaaaggtaaatgtcattttcccagccccttgaaaagttcttatattatttctttgatagttctctcagttttctctcttctgactttctggagaaaaagatcatctgatttaatcactcatttctcctattacacatatatttgtataattcttttcaccttctaggagatcgactcaccttctttttcctacctttctattgcattttaattttgttgactaaaattttactttctaagagctcatcttgttttctgatggtttttcttcctcctcctcaatccaacccatcccctctccttccctggcatcactgcctttccccctttccctttttctcctctctccctctccttcatcccctcttcttctcctctctccttcctgtgctcctcctcttccctctttctccacctgcatcctgttccccatcccttgctgtattattttcttttatctctgagggcagagattgtggaatttttaatttgttctccatttactctactttagttatcttttgtctgagccagcattctgtttcctccaagttgctcttatctgtgttttggttttggttatatttgatgtccattcatctctatgggcaaggctctgcaaagctcattggaagatgtgtgtgagtggggtgggtggaatggtaggcttcactgtagaataacagagcatgatccagttgatttagctgaaggacacccagatgtctgtatctgtgtttttggacgggctgttctgttccttccagaataaagatctttcagtatcctccatgtaaataaaagttaccccttcatttattatttgtaagtattgggattttaacatcacactgtcttaaagtaggacacagctcagtttattcattaaaataaaagagttggacttgatcctttctacctataataactccatgaggctttgctataacctctatttagaataatttaaaggcatttaatagcttaatataatatatatataatatattaactcacacactttctctgcaaagaacctgtgtggggcacaggggtggggagggtggctactaagctactaataaaccaaacacatattgtgccttctagaagatatgtcatctatatcaattagcataatgtaagacagaaaatcataaatgaggctgggccagatggctcacatctgtaatctcagcactctgggaggcaggtggatcacttgagaccagcctgggcaacatggcaaaaccccatctctataaaaaattagccctgcatggtgttgcttgcctgtagtccagctactcaggaggctgaggtgggaggttcagatgagcctgggaagtcaaggctgcagtaagccatgtactccactgtacatgtactccagcctgggagacagagtgagaccttgtctcaaaaaaaaaaaaaaaaaaaaaaaggaaaaaaagtcataaatgaaaggcagacatacctggctttaaattgcagcactgcctcatacaagctgtgtgaccttgagcaagccaaaatcctttttgagtctgtttcctcattaattccactatgtgatagaccccgtactgacactggaataagagtagcagataacaaatgtacttctctccatggagctcatatttattacatgttgttattaggtacaattctattttaatgcttacatttttttataccctggcatttctgtggttaaagtaatgctaacacatattttgtgtccatacactatacttttaatgatcatttcttaagactattttgttcatttacaccatttggttttttgaacttgaaatgtcaaaagtttaatgaactatcgtaagttggaaaattaactaaaatagacagtatttgtttaccagaattcatttgagggccgtgtatcctttagtgtataaaaatctttttggtgtaaaaacatttgctataatcttttgctgattgttgtttttatgctagctcttaataggatattgttaacatctaagtctaggaattgggattcccaagatactgatataaaatgctgtaacagaaatttctatgcttctgaggtttatagaactcaaggagattctttttacaatgcgtgttcttaaagcaatatatccctaagggcactaatggttgcttttccctctctcattttctcattttagggaaactaaaaccaacaatggcattcatgtcagggaaattgaagattaaaggtaacatggccctagcaatcaaattggagaagctaatgaatcagatgaatgccagactgtgaaggaaaatataaaaaaaaagtcgactgctatgctcaaaaagtaaaaaaagctcaacagttaaaatctaatgtttgttttctttcctgttatattataaggatatgcacgtttgttctggaaaagatagaatttgtctctaaaagacttgaaattgtaattaaaatggcaagctaatcaaacataagcttcattaagtgggattctaagacagtctgtgtttttatatttcaagggtttaaccctttgagccttacatctcattcactgtctttctccaagaaaagtattttgggcggacagtcagatcaagcagtaaaattagctctttcaaatcttcttgtcatgtaaaatgaagctagtctgttttaaaatttttagttttggattgtatactaatgaaaatcttaatgatgtttttgatttttatatacttattttaaagaaaatcttatatagtacattttacaaaaattataaaaaatgaattagtactggcgaggactaaatgaaacaataatttttcattttgataactagctttccaggtggacttagccataggaaaatattactaatgtaatttaacaaattgctgcatgtattccatttaaaaatatgtttaaattgtcctaaaacaaaataattttctccctaggagtatgcatttggctacagtgttttgaaacagaaaccttagaataggtcattggtatgggctgaactgtgtatcccccaattcatttgttgaggtcctaactcccatttcttttgaatgtgactgttcggagatgaggcctttaaagaggtgacttaagttcaaaggaggctgttagtctaatccaacatggtgtcctttggacataagagataccagcaatgtgtgcacagaacaaagaccaggagaggacacagtgagaaggcagttatctgcaagcaaagagagaggcttcagaagaaacaaaatcaccagcaccttgatctttgacttctaatctccagaatagtgagaaataaatttctgttgttaagccgtccactgtgggaggccgacgcaggaggattgcttgaggccaggagttcaaggccagcctggacaacatagtaagaccctatctctacccccctaataaattaatttaaaaagccccccaatctgtggtattttattatggcagccctagcaagctaatacagtggtttgagaggctgggagggttgaggggaagataaacttttaaaaagctcttatctttcatttcaatcagttaaaaatacttgctcagtgtaacaattttgcttctcagcttccactctaatattgttgtgccattaagcaatttagctaatcctgacatttcttagattcataatgttaggagcatttaatctgtattttacaagttaggaagcagaggatcagagatgggaaaggactagcccaaggccaacattaacaagccctctaacaaaaactttacaatacatttatgttgaatggaactccaagatctcacctctccatccaggaatggagtccatgtaatcaaagtgaacttaaaaataggacagtttcaacaagtcaggagattcacagcaactgatcaaagggagtccagtcaacgtgagcaagcgtgattatgatgaggaagccccctctgctttaatccacacaaggaacgtaacctgaagtaacctgatgttaaccaatctgctgtgtctactatgctgtttccttgttcctgctagtgctgctttacaaatgcagaccattctatcatacctggcggggcttctgttttattttgtaggctggatgctacccagttcatgaatcgctaataaaagccaattagatctttacataa

SEQ ID NO: 487 - DNA, 23548 bp, Homo sapiens
gtagaagtattgcgccgttggtgattacggaagaaccaggagtttggcgtgaccatggtgagagaagacggtccaagaagggacgttatcaggccactttttgggtggagaaggaggtagtcagaccgtggccaaatttccttcacattatcctagcatattttcattctggtcttagctcttaaacttctccaagcggtgactgttatgctttacagagtggggaagagggtctgggttatttgaggcaagaagggaaggcaatagacaagagaaaagaagagactttaaaagatgccgtgtgtttccaacttttttaattctaaaatttctgtttcaaggggaagcaaaagaaaacaaggaagtatgcgaccatgaagcgaatgcttagtctcagagatcagaggctgtgagtgtctggaatcaactgcccagggatattctaataagagtctagagaggataagtagtaaaaatgtttgttgttattattttgttttttgcttattatcgtgtcttagatttatatagcatgagatagccagtgtttaacagtaatttagctgctgagcgatcacactgggaaaggcgatgggaattaaacatttcttaagtgttcactttttctaccgttatatgctttgtctgccatatcgcatttaaacctcatgtcagttcggtgaagtccgtatagttctctttatgtttttaccattacactactacattcccctggggtggggcgaggggagtgtttcttgttgaaagatggcaaggttagagaccttgtttgtctggcgtttccagtgcctggtactcaaatatttttgtcagagaaaatgggaaaactccaagatatctccattttataagtcttactaatataagaatccaaatcactgtggaagaagaaagtgaagtgaaattccctagtatgaagaggatcaaagcggtgtccctgcttaagtgtagaataagcatagctattaaataaagactgatcttcactgagtttaagagtctcagaaagccgggcgcagtggctcacgcctgtaatcccagcactttgggaggctgaggcgggtggatcacctgaggtgaggagttcaaaaccagcctggccaacacggtgaaaccctgtctccactaaaaatacaaaaaagagtctcagaataagagaatagtcgttaaaaccttcagaattattattctcagcctttagtgtggatgtattgtgtaatttttaggaatgacactccattaataataatttctttctagttaagggttaagttctgtatatgcgtttttacattttagccctttataagaagcatatggggtaatacttttcccccaaaagttaaagcatctgaatcttcagaagataactgtcacccttttacccattgcttggaagtggattgtgatccttgatgtgagagattctgactaaaaaataaatatagtataatcagcttttatttactcattaacaattcttatgcattattggcattactggttaattctgatacttccaggtactgtgctttgcactagagttatttgctcagaaagagtatgctgatattaacatgaggatatcacaaagtaggatttcttcagtagaccaaaaaaaaaaaaaaatggaactttagatttttgagattttaattgctgtggtttttcttctcccttggatttaatttacctttttcttcctagtaaagaaaaggatagattaaaacctaaaaagaaagaaaagaaggatcccagcgcattaaaggaaagagaagtgtgagtaatcaaacgtttgaagttttcctttaaaaccatagacctcttagaaatccaggctttccctgagctggtttgctaacttatttgttagtaagtctagcacaactatgtagatgaaagtcatatcgatgagcatatatcaattctagtggtttgaaggttttgggattttatggagcagtaaaatttcccctaaaatcctggagatattatctaggattattaactttttctttgccagggatcttttaagagacataagtgccattgtttaacacaccagcagttcataaaagagagactgtatcaccaaaaaatatttaaaatatattttcagaataaagatatttatataaagatatgacctttatataaagatataaaggtatttcattccttttaagtaagtacatttaactttatgaaaactttaccacattttccttatttttctaatttttccctggattggtaatggacatattatcacaggtagatactgatccatggcctagcatttggaatcactgtcatattcaacccagacaacttgggctagatgtgatacaggtcctgctgtagtatataatcctaacactagacaaactgttctctatcacattccataacagcagttttagaatcctttaagaatgacaaacgtgttgttgtatcattctaatcacgataactgtattctacctccctgtgcccatggtgattctacttttgctagaggaagagctagattggataattgctttttttgtttgtttgtttttgataattgcttttttaaagttggtgacaaaggttgccaggggagctgagattaagataatgatattactttcttccttgccttcctttttaggatttatttccaatgaacatggacaaaagagtttacagcaaacagtcccaagcagacttcttttttgtttttgttaatactagggtatcaatgtaaatttttctttgttcttgttttctttttccttcagtccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtgagtatcatacttttatgtttccgtgacatttgttcagaataattatatttatacaaatacatgaaaggagggagatggggttcttgttaactgaattgctggccatttaatttacagtggtcaccatagcagtgaccatgtttaatgaattgaagtataatgcaaacttgactggaaaaaattaaactttcacaattcagaaaacacttagaatgcttcgagtatcattatggacatcaattttgaacataggggaattttctgttttagaattctagattttaaaattctagataaatgaaaaatctatttttcagtatctatattcttttatgttaacaaggatatgttctcccttttgccccagtgttgaaacactaaataagacattctgccatttatgatcacagccctagaagttagatagatgatggtcaattcctaagtttattcagtttggtatttattcgtagtacagaggatctgaggtagtttatttacacctaggtatgcaatttaccattaatagatttcccttgtgtatttgtatatcccctcctttaaatgatcttccttcactaccatgaacaggaaaaagaaaagtaaggccatctatgaagcctatcatagtaagatctgtcccatttgtagcgggtttatatttatatatttttcagtcacccggttagaggtacgaatgaaaattagacttaaactttgccatagaggataaattactggaatcaaagggaaaaatttgtacctccctttttaagttttaaaggctactatataatgaacaacagttgcagagtgatagaaatggtaaatgttgtttactgatttattaaaatgagcaagatgagaagatggggttaaggaatgtgtgaaggggtaagaaagcagattctttagatgcccaaaaattaattaagaatggctgcagccgggcgcagtggctcatacctgtaatcccagcactcgcggtggctcacgcctgtaatgccagcactttgggaggccaaagcaggcggatcatgaggtcgagatcgagaccattctggccaacaaggtgaaaccccatatctactaaaaatacaaaaattagctgggcgtggtggcacgtgactgtagtcccagctacttgggaggctgaggcaggagaatcgctggaacctgggaggtggagcttgcagtgagccgagattgtgccactgcactccagcctggcaagagaaactccatctaaaaaaaaaaaagaatggctgcatacatttattagctgcatacgtttattaagatgtgaaggtagccatcagatgagaaaaaaatggagctaatggaataaaatagtcttctctacagatcagaattgattgggtggcaatggtcaggggaccattgttttttcatataggcctttctgtattactttttaaagctatatacataaacttttgaaataaatcttttagaaataatctaaagttgaggtgctaccaggcctctaagaatgaggcttgggtgaccccatatgggggaagacactaaacttggtagtctctttgtatttcccatggtatttctaattgagctgcttctccaggaatgctgtgacctacttatcaatgaaacggatagagggtcaaagcatggccctttgcttccttgatgaattgcttccttgactctatacctccaccagtaatatctagatagtgactgttagagctttaggcaggatagctttagtcttatggctttctttaaatatgtatacttttttttttgagacagggtcttgctttgtcacccaggctggagtgcgttggcgtgatctcagctcactgcgacctccgcctcccaggttcaagcagttcttctgcctcagccaccccagtagctaggacatgccaccacgcctatctaatttttgtatttttcgtagaggcgggtttcaccatattggtcaggctggtctcaaactcctgacctcaggtgatccacccacctcggcctcccgaagtgctgggattgcaggcgtgagccaccgtgcctggccttgcttgcctttatacttaaaggaaggcctttctcttcctcttaccttgaaaaggcctgtttgatctttacatggttcctggtctcttctatttccactttatagtccaacaaggaaggatagtttgcttcccattggctttctcttctgcctatgaatcctgaggctgttactttccctttccttgtagtggttttcctgagcctgcttccctacttcagttgcaagcctttgctcacttcactgctacatggctctgaaattggtcctcttaaagaacacattgccttgtttcatgatctcagtattaaaatatatatatatattgagacaaagtttcactctgtggcccgggctggagtacagtggggtgatctctgctcactgcaacctctgcctcccaggttcaagtgattctcctgcctcagcctcccgagtagctgggattataggtgcatgctgccactcccagctaatttttgtgtaaagtagagacggggtttctctatgttggccaggttggtatcgaactcctgacctcaagcattccgcccactttggcctcccaaagtgctgggattataggcatgagccaccacgcctggccagtattaatatacttctaaaaaattctagcataaaaaaatggaagttgaagcctgggcaacataacgagaccccatgtctacacataatttaaaaattagccagggggccaggtgcggtggttcacacctgtaatcctagtgcttttcaggagttcgagatcagcccggccaacatggtgaaaccccatctctactaaaaatacaaaaattagccaggcgcagcaccatgtgcctgtaatcccagttacctgtgaggctgagggaagagaatctctggaacctgggaggcagaggctacagtgagccgagatcgtgccactgcactccagcctgggtgagagagcgagactctgtctcaaaaaaaaaaaaaaaaaaaaaaagcatgcatcgtggcatgcacctgtggtcctagctacagatgctcaggtgggaggatcacttgagcctgggaggctgaggctacagtgaattgtgattatgccactacactccagcccaggcaacagagcaagaccctgtctttaaaaaaaaaaaaaagaagaagaagaagaaaagaaagttgggctgggcgagatcttcaccccgtagtcccagcagtttgggaggccgaggtgggaggagttctgggcttgagctcaggagttcaagaccagcctgggcaacatggtgtgaccgcatctctacaaaaaaaattttttttaaatcaagctgggcatggtggctcatgcctgtaatcccaacgctttgggaggccaaggtgggtggattgcttgagcccaggagtttgagaccagcctggccaacatggcaaaaccctatctctaccaaaagaaaccacaaaaattagctgagcatggtggagcatgtctatggtcccagctgcttgggaggctgaggtgggaggatcacttaagcctgggaggtcgaggctgcactgagctatgtccatgtcactgccctccagcctgggtgacggaacaagaacctgtctcaaaagggggaaaaaaaggaagttgcttataatgcatttcctcaaaggagcaattataaaaattcataaatctgtgtgagatggagggttacttttatttattaatgaaaatggcctgtaatcccagcactttgggaggccgaagcacgcggactacctgaggtctggagttcaagaccagcatggccaacatggcaaaactctgtctctactaaaaatccaaaaaaaattagccgggcgtggtggcaggtccctataattccagctactcgggaggctgatgcaggaaaatcgcttgaaccccagaggcagaaattgcagtgagccaagatcgtgccattgcaagagcgaaactccgtctcaaaaaaataaaaaaagaaaatggatcctgtattattttttgctttataaaacagatttactgaaatataattgactccctttacaactatacaattcatccctttaaagtgtacagttcagtgacttctagtggattcacagagttgtgcatcatccatcaccatagtcaattttagaacttccattatcccaggaagaaacctggagacccttagccatcaccctgcaaccctcaccattctctctatttctaggcaaccactaatctactttctgtttctataaatttccctattctggacatttcataaaaatagaatcttataatatttggtcctttttcatttaacgtactgttttcaaggatcatttatattacagtttgtatcagtacttcatttctttttattactaaataatattccactgtatggatagatcacattttaatcatttctacttgctttttacattgaactatatattttgaacatttttccatggcatgtatatataaatgggcctcattcttttattttgagtcaaggtcttgctatgtcatccaagctggaatgcagtggtctgagccaatagcttacagcagcctcaacctccaggtctcaagtgatcctgcagccacagcctcccaagtagctgagactactggaaagagccaccatgcctggctattttatttatttatgttttgtagaaacaaggtatcaatcatgttgcccaagtttttggggtttgtttttttttttttttttgagacaggctgtcactctgtcacccaggctggagtgcagtggtgtaatctcagctcactacagcctctgcctcccgggttcaagcaattctcatgcctcagcctcccagtagccgggattgcaggtgtgttccaccacacccacctaattttttttttttttttttgagacagagcctcactctgttacccgggttggagtgcagtggtgcaatatcggctcactgcaacctctgcctccaggcttcaagtgattctcctgcctcagcctcctgagtatctgggactacaggcatgtgccaccacgcccagctaatttttttgtatttttagtagagatgaggtttcaccatgttgaccagactggtcttgaactcctgacctcaggtgacctgcctgccttggcctcccaaagtgctgagattacgggcatgagccaccacacccagccctaatttttatatttttagtagagatggggttttgccatgttggccaggaattcttttttaaagttatgtatggccgggcacggtggctcacgcctataatcccatcattttgggagttcgaggcaggtggattgcttcaggtcaggagttcgaaaccagcctgaccaacatggtgaaaccttgtctttactaaaactacaaaaattagctgggcgtggtggagggcgcctgtaatcccagctacttgggaggctgaggcaggagaatcgcttgaacctgggaggcagagattacgccactgcactccagcctgggcaacaaagtgagacttcaaaaaaaaataaagaatgaataaagttacatactataattgcttctcagccttttggctaagatcaggtgtaaagttacatactattctattgtttaaatacataattttttaaacccagtatcttattaggtattttggttatttccaggttctacccaattaacaagtctgtagtaaatatccttatgaatatgtctccctaagagtgtatttctttaggatacattgtctggaagctgtattatgtatcaagggatttgtgtatttttaataggtattgcaaatttgccctcaaatagttgtaccaatgtatatacctacaaacttagtatgagaatacttgtttcctcaatattgggtattttcttttttttttttttttttgagatggagtttcactcttgtcactcaggctagagtgcaatggcacgatcttggctcattgcaacctccatctgctgggttgaactgatcctcctgcctcagcctcccaagtaactgggattacaggtgcccaacaccatgcccagctattttttttatttttagtagagacgggtttcaccatgttggccaggctggtctcgaactcctgacctcaggtgatccgcctgcctcagcctcccaaagtgctgggattataggcgtgagccactacgcccggccaatattggatattttcatctgtttaatctttgccactcttctaggtgccactcttcccagtctttggcccaatagactccgttcaaatgttggctttaccatttgctatctatttagttaacttctttgtgtctcaggttcctcacctataaaatagggatgatgatttttttttaaactattatatggctttctgtttgatagttgtcaaacagaagtttttaaaatttttatgtgatcagatttacattatctggctaatttcatggtttcttgtggttcacatttaaattttatttcatctgagccaggcacagtggctcacacctgtaatcccagcactttgggagcccaagacaggaggaatgattgatcccaggagttcaagacagcctgggcaacatggcaaagccccatctctacaaaaaaaaaatgtttttttttaattagctgggcatagtggtgcgtacctgtggtcctcgctactcgggaggctgaggtgggagaatcattagaacccaggaggataactagaacccaggagtttgaggctgcagtgagttgagatcgtgccactgcgctccagcctgggcaacagagcaagactctgtctcaaaaaaataataaaaataaataatttttttcccatcaggaacttacattaatataaaaataatgacagagttcagcttagttttttttccccagatatgtttataacagggaatctgcagtttggggttgggacaatcttagtttcttagggttttcttctactctagttcttcttgtatatttcagtgtgctaattctgctgtcattgcaaaagtgtcctgggtctttttaaaactctgagcagggatataattcagagataatttcgttacaagttctgttcttaatgtgaatttttttccctggcaggtatcccatgtataaccgattgtgtaatggctgaaattgagaaattggggcagaagtatcgagtggctctaaggtaggaaggaggtaaactagatctgttctagattggtatactgaagattcatctgtttgttgtttaaagatttcttggccagttagttgtgaaaatcatacaaaactatttatcatttttgggggggttgttttggtctttctctcacacaaaaatcagttccagttagagtgtctaaacttttaatagaaaatacagagaatatcttgtccgggctcggtggcctgtaatcccagcactttgggaggccgaggcaggcagatcacctgaggtcaggagtccgagaccagcctgaccaacatggagaaaccctatctcttctaaaaatacaaaattagccggctgtggtggcaggtgcctgtaatcccagctacttgggaggcttaagcaggagaatcgcttgaacctaggaggcggaggttgcagtgagcctacatcacgccattgcactccagcctgggcaacaagagcaaaactctgtctcaaaaaaaaaaaaaaagagaaaatacagagaatatcttaatgaaattgaatatttgtgtatagcaaaagatatcattaacaaagtaaacagacatacataatcaacaaagggcttattttcaaaatgcataaagaacttcacatctgtaagaaaaacataattcttaaattcacagtgagttgtcatttagtgcccattagattggcaaaaattttttaatgagcttgacaatgccaagaatagttaagaccatgaagcaatgggaattctcatactgaactactaagggtataaattggtcatcactttggagggcaacttgacaatatctggtaaaatccaggttgttcatactcttacaacacagtcttttaacctggagatcacattctacaggtaattaaattggtttaaaggatcacaatgcctggtgggtttggggggttttttgtgttttgttttgttctgtttttgaagcaaggtgttgctctgtcacccaggctggagtgcagtggcacaatcagggctcactgcagcctcgacctcctgggcttaagcagtcctcctgcctcagcaccctcaagtagctgggactacaggcatgcaacacctcacatggccagttttttaaaatttcagtagagatgaggtctcaccatgttgcccaggctagtcttgaactcctgggctcaagtgatcctcccaccttggcctctcaaagtgctgggattataggcatgagccaccacacccaacccccgagtatattttttagtgtaacagaagaaactataggctgggcacggtggctcatgcctgtaatcccaacaccttgggaggctgaggcaagtggattgtttcagcctaggatttccagtccagcctgggcatcatggtgaaaccctgtctccacaaaaagtaaaaaaattaaccaggtgtggtggcatacacctgtagtctcagctattcgggaggctgaggtgggaagattgcttgagcccaggaggcagaggtagcagtgagctgagatggtgccactgcactttagcctgggtgatagagtgagactctgtctcaaaaaaaaaagaaagaaattataaaatattagcatgaatatgtagaaaaaattgggtactgcttcacaaaacttttttcgctgttatatgtgtgtatatgtatatgtggtatatgtgtgcatactgtacgctagataaaatctatctcgtgctatgggttctggtaaaaaaaaaaagaaagaaaaagattgctatagagaagttcagctactattggagtcaagtattggcatcttcttatgtacgtaatagcaaaaaattgcagacagccagaagaaatggcttttcttaagccataaaggatggccaggcatggtggctcatgcctgtaatcccagaactttgggaggccgaggcaggcagatcatttgaggtcaggagtgatcctcaacatggtgaaaccctgtctctactaaaatatgaaaattagccaggcatggtggcgggtgcccatattcccagctactctggaggctgaggcaggagaatcatttgagcccaggaggcggaggtttcagtgagctgaggtcatgccactgtactccagcctgggctacaaagcaagaccctgtctccaaaaaaaaaaaaaaaaaaaaaaaaaaaaactgggtacagaagctcacgtataattcccaacacttcgtgaggccaagtggggaggatcgctggagcccaggagtttgagaccagcctggccaacataatgagaccctggctctacaaaactttaaaaatttgccgggcggccagccaggcgcagtggctcacgcctgtaatcccagcactttgggaggccgaggcgggtggatcacgaggtcaggagatcgagaccatcctggctaacacggtgaaaccctgtctctactaaaaatacaaaaaaattagccaagcgtggtagtgggcgcctggtagtcccagctgctggggaggctgaggcaggagaatagcatgaacccgggaggcggagcttgcagtgagccgagatcgcgccactgcactccagcctgggtgacagagcgagactccatctcaaaaaaaaaaaaaagaaaattagccaggcatggtggcttgtgcctctacggagttcaaggttgcagtgagctatgatcacaccactccactccagccccaaaaacaaagtgagaccttgtctctttaaaaaagaaagaaaagaatagataagctgtggaatgctcatgaataaaatactatacaagagtgaagatgagtgaactagagttatgcgccaatgtggataaatctcaaaaacaatataaactataaaaaaaaaacaacagcagtcaggcactgtggctcactcctgtaatcccagcagtattgggagcccgaagcaggaggattccttgagcccaggagtttgagaccagcctgggcaacatagtgagacccaatgtctatgaaacattttaaaattagccaggcatggtggcatgtacttgtattcccagctacttgggaggctgaggtaggaggattgcttgagccagggaggttcgagatcataccactgcattctagcctgggagacagcgagaccctgtctcaaaaaaaaagaaaaagaacaatgctgagcactgttaacgcacatctgtagttccagttacttgggaggctgaggcagaaggatcacctgagcctaggagtttcaagccagcctggacaacaagacccccatctctttttttttttttttattatactttaagttttagggtacatgtgcacaatgtgcaggttagttacatatgtatacatgtgccatgctggtgcgctgcacccactaactcgtcatctagcattaggtatatctcgcaatgctatccctccctcctccccccaccccacaacaggccccagagtgtgatgttccccttcctgtgtccatgtgttctcattgttcagttcccacctatgagtgagaatatgcggtgtttggttttttgttcttgtgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttactattgtgaataatgccacaataaacatacatgtgcatgtgcctttatagcagcatgatttatagtcctttgggtatatatccagtaatgggatggctgggtcaaatggtatttctagttctagatccctgaggaatcaccacactgacttccacaatggttgaactagtttacagtcctgccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagtagtgtctgttcatgtccttcgcccactttttgatggggttgtttgtttttttcttgtaaatttgtttgagttcattgtagattctgaatattagccctttgtcagatgagtaggttgcgaaaattttctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaaagcctaggttttcttttagggtttttatggttttaggtctaacgtttaagtctttaatccatcttgaattgatttttgtataaagtgtaagaaagggatccagtttcagctttctacatatggctagccagttttcccagcaccatttattaaatagggaatcctttccccattgcttttctcaggtttgtcaaagatcagatagttgtagatatgcggcgttatttctgagggctctgttccgtttcattgatctatatttctgttttggtaccagtaccatgctgttttggttactgtagccttgtagtatagtttgaagtcaggtagtgtgatgcctccagctttgttcttttggcttaggattgacttggcgatgtgggctcttttttggctccatatgaactttaaagtagttttttccaattatgtgaagaaagtcattggtagcttgatggggatggtattgaatctataaattaccttgggcagtatggccattttcacgatattgattcttcctatccatgagcatggaatgttcttccatttgtttgtgtcctcttttatttcattgagcagtggtttgtaattctccttgaagaggtccttcacatcccttgtaagttggattcctaggtattttattctctttgaagcaattgtgaatgggagttcactcatgatttggctctctgtttgtctgttgttggtgtataagaatgcttgtgattttttacattgattttgtatcctgagactttgctgaagttgcttatcagcttaaggagattttgggctgagacaatggggttttctagatatacaatcatgtcgtctgcaaacggacaatttgacttcctcttttcctaattgaataccctttatttccttctcctgcctaattgccctggccagaacttccaacactatgttgaataggagtggtgagagagggcatccctgtcttgtgccagttttcaaagggaatgctgccagtttttgcccattcagtatgatattggctatgggtttgtcatagatagctcttattattttgaaatacgtcccatcaatacctaatttattgagagtttttagcatgaagcgatgttgacttttgccaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggatttgattttcccgtattttattgaggatttttgcatcagtgttcatcaaggatattggtctaaaattctcttttttggttgtgtctctgcccggctttggtatcaggatgatgctggcctcataaaatgagttagggagtattccctctttttctgttgattggaatagtttcagaaggaatggtaccagttcctccttgtacctgtggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtgatgatatcccctttatcattttttattgcgtctatttgattcttctgtctttttttctttattagtcttggtagcggtttatcagttttgttgatcgtttcaaaaaaccagctcctggattcattaattttttgaagggttttttgtgtctctatttccttcagtcctgctctgattttagttatttcttgacttctgctagcttttgaatgcgtttgctcttgtttttctagttcttttaattgtgatgttagggtgtcaattttcgatctttcctgctttctcttgtgggcatttagtgctataaatttccctctacacactgctttgaatgcgtcccagagattctggtatgttgtgtctttgttctcgttggtttcaaagaacatatttatttctgccttcatttcgttatgtacccagtagtcattcaggagcaggttgttcagtttccatgtagttgtgcggttttgagtgagattcttaatcctgagttctagtttgattgcactgtggtctgagagacagtttgttataatttctgttcttttatatttgctgaggagagctttacttccaagtatgtggtcaattttggaataggtgtggtgtggtgctgaaaaaaatgtatattctgttgatttggggtggagagttctgtagatgtctatgaaaaagcaagaacatatgtggagtataccatttatctaaagtctaaaaacatgcaaaccaatactgcattgtttatagatatgtgtatatgctttttttttttttttttttttttaaagacagattctcactctgtcgcccaggctggagtgcagtgatgctatcacagctcactgcagccttgacctctccggctcaagtgatcctcctgctttggcctcccaagtagctgggactacaggtgcataccactatgcatgtctgattattttttttcttttgcatggctaattttaaaaaaaaatttttttggtagagactgggcatggtggttcacgtctgtaatcctggcacttaggaaggctgtggcgggcagatcacctgaggctaggagttcaagaccagtctgaccaatgtggtgaaacctcatctctgctaaaaatacaaaaattagctgggggtggtggcaggcacctataatcccagctactagggatgctgaggcaggagaattgcttgaggctgggaggcagaggctgcaatgagccaagatcatgccactgcatccagcctaggcaacagagcaagactccatctcaaaaaggctgggtgcagtggctaacgcctgtaatcctagcactttgggaggctgaggtaggcagatcatctgaggtcgggagttctagaccagcctggctaacatggtgaaaccccgtctctcctaaaaatacaaaattagctgggcatggtggcgcatgcctgtaatcccagctactcaggaggctgaagcaggagaatcgcttgaacccgggagcagaggttgcagtgagctgggattgtgccaatgcactccagtctgggtgacagaatgagaccccatctccaaaaaaaaaaaaaatttagtagagatagggtctcactatgttgcccagctggtctcaaactcctggcctcaagtgatcttcctgctttggcctcctaaagtgctgggattgtagtcatgatcctccacacccagcctggtaatttttaaaacaataaaaataaagaatgagaggggaaaaaatagaggcaccaagtggaaacactaagtttggctgtcaagagatgcagaaatggggtgttagctggaggggggtataggtaaaaagatttttttgtcttaaggcagagaatatatgacagcatgttagtatgtttctaggaaagagctagtagagaggagacaagtgatttcaggagtaaagagataactgaaagagcatagtcctagactgttgcccacctagtttgtcagcaaccagtccatcctccctctagtgtatcctccccagcacagcctgcttagtttttccaagacagagctttgttcttatcactttgtcccccagaaatctttaatgactcctcattacctgtgtcatcacactcgtcagcctggcattggagactctttctagccccatttcattcttctctccacaaacactctgcccccagccagaaagatgtgtttactcttccccaaataccaagaaaccattttacagttggctggtgtcctatttggtaccctcacattgcttggcacattctttaatcttatttcaccccatgtcatttttttctaaatattcccaacccacattgacctagcgctgaactactgcaatatggaggagtatttgtgttgcacttggtacatatgtgctgtcttgtatttttcttcatttcagtgactcatcatcactgttaatagaaagagcatggctctcagaatcacacagagttggggtttttctttttcaaatatgtatgaaaataatacatgtttgagtgttttatggcaaacaatacaagcatatacatatagtaaaaggtaaaagtctgcctctacattcatactttgtccattctcataccccaagagtgacaactgacaaaggttaatatattttttcagacctttttctgtgcaaatgcaaatctaaataaagagtattggaaagaaggatttgtattttattaattaaatcatattatatatatatatatgcatatgccctgctttgtttattcaacagtttagtgtaggtccttccacattggtacgtacagctctacctcactttttattaataggataagggcaccaaaatgggtttaacttttacctttctaaaggatatttttattttcttcacttactataaactgtgttgagtgatcatccttctgcctatattcttgttcattgtgtttaagacaacttcttaaaagtgaaatggttaggttaaaatgggttttgtttttgaatcctggcttttcccagctgtatagctttgaatgaagtaatttaatctctctaagcctacttcctcatctgtagaatagatatataataactcaaagttttgtaatgattaaatgacccaaagcacactagctgtcagccttcattccctgccccgtgaattgtctttccagttagaggataaagttcaggaggagaacagtgccttaaaatctctgcatagatcatgttacttttattgcattaattaagactcagaaagttatccagctgattgaatgttttctttaatccacctacaggattgccaaggatccaagatttgaacgattaccatgtacacacaaaggaacctatgcagatgactgcttagtacagagagtaactcaggtattatcagttcataactgtttactttgtgcttaaaaaaaaaaaatgtaaactattatctcctgaatgttcatggtcagtaaaacatctaggaatatacattatggttaaattaaaaaaaaattgcatagcattccttcataagaagcataggtgtcttcatttacttgagaaagtggattgaaaatgtacactctaaccataatggaaagagcacaggcttggggaggagacatgggtttcacgtctcagcacctgcatttactggctgtgtgatttgggacatttaactgattctttatctcacaaatctctgtaaaatgattttaagtgagttaatgtagaacccatttatttttgatgtaggaattttgttcctcttcacgatgcctaatccaaaagtgcttcttagttaaatctgagagtctcccaagatgctgtttcacacataccctagaataagtaggtttttaattccttcattaagcaccacaaggacttctgctactgagtgcttttataagggcctctctgctgatgataatcttcatctgctctgctgaccacagagccatccttttagccacttcaccccatggggcgggtgggtggggccagtatttcccacagcacagctgacaccactctgccactttttataaaactcagtaggagagtcagacgtgacagatgtgaagcttcctataaaatagctttcacctgacagctaaatattactgcttttataactgctaggctctagtttcaggccctgaatatcctacttaggcttcctgtttcggggatagcttacctctaacatcagtaggcccagagcacacccaagccccaagatctagggaaaggagggagctatggcctccaaattaaggcactttttatctccatggagttcctcggagcattttcccaaaactaaagaattgtctgccccaagtgtgaaagtccctttcatttatgagcagaaaacagtttgcagcttgtgaaaagttttctaccttctcctcctcaagattctaaatgctgcattcagcccaggcaacttgtttattttatataacaagattaggagctcctagatcatagtaggtactcaacaaattgttatagcctgcccttcgctacttactgtgaaaatgaacgattctcagactggtcagtcgttgtgccattatccagtattcactaagcgtgctcagtgacctcagtgtgaacatcactccatgtctcttacagcataagtgttacattgtggccacagttgaccgggacctgaaaagaagaatccgtaagattcctggagttcctatcatgtacatttctaaccataggtgagaaatttcccttggagaagggaatagaaatatataattgatatcaattgaaaatgaggataagtgataaggttataaaggatttgaaagaaattattgtatcaaatgtttacatagttatatttgaagaaatgagacaaagcaagagcaagagcaaaagagagagataggatttaaggaatgaggcaaacatttaaattgttagagtaagattactggaagaaatagacgtattgttttaaataaaagcagtaatttaaatcaagctaatctttttggccagaaatacctgttttgaaagatttttttttattaacacttcatctgagaaatggaaagcttatttaaaaaaaaaaaaagctgttatccttcttggctattttttgtcagtactcagacttattttccagcttttcagcttgaggagagcacaatgtggtgggaagtctgtggactaagaagttggacttactgatctcagctcctcagttcccctcttgctgactttgtgactttgaaaaaacaatcatattgtattatagtcagcattttgctgtaaatcattcattatgatgttcccctaaattgtttccactgacaaaaaggattcacagtgggggtgagagtattgcagtctataaaggatgggtttttagatgggttctcttcccatctttcttaccggtgttgattttttgtcctgatcagatacaacattgaacggatgccagatgattatggagcccctcgattctaattcttacaagacacagttcctctgcctttcttcgaccaactttctcttgttgccagttcattacacaaaatgtagcgggatttttaaggaatcagagagactgatggagttcagggagatatttattatttaggtgcaccagcccagtcagattaacatccaaaggactgaaccctgaacagagttaagttaccttttaagcattttgtggggccgcgggggttggggggaatctgtgcagggggaagcatattacagaagcaagaaagacagttattcaattaactgagacatgcattacatcatttcttacttttcaaggaaaatcatgttttacgacttgagtttatctgtctagttaccttgcagctgcacagctagagaaacagggtatttacaatgcctgggaaaggaggagagataaggctcactagccacagaaaaacaggcagttaatttttaaaggactccagctctttctctttctcacggggaattggattttcttacatgcaactgaatttctgcttacacatttttaaatttcttttaattgcttttccaatgcaatagcatgaattattattctgttgacctatttgccttactatgagctgagggtagttcaatatgctcactcttttttttttttttcttgagatgaagttttgctctgtcaccaggctggagtgcagtggcgtgatctgggctcactgcaacccctgcctcccatccttcaagtgattctcctgcctcagcctcccgagtagctgggattacaggtacacaccaccatgctcaactaatttttcttttttgggcggggggggtggatatttttagtagagacaaatacttttgtatttttaatacagaaaagtatgcctcggcctcccaaagtgctggaattacagacatgagccactgtgcctggcctgctcactttctgatgctgcttttttgttgtttgtttgtttatttgtttgttttgagacggagtctcgctctgtcaccaggctggagtgcagtggcgcaatctcggctcattgcaacctccgcctcccaggttcaagcgattctcctgcctcagcctgcggagtagctgggactataggtgcgtgccaccacgtccagccactgatgctgttttgccactgatgctgttttgaaattgatattttgtctcataaaaactaggccaggcatggtggctcattcctgtaatcccagcactttgggaggccaaggtgggtggatcacctgaggtcaggagttggagatgagcctggacaacatggcaaaaccccacctctactaaaaatacaaaaaaaattagctgggtatggtgtcacgtgcctgtaatcccagccactggggaggctgaggcaggagaacctcttgaacccaggaggtggaggttgcagtgagctgagattgcgccactgcattccagcctgggtgacagagtgagactgtctcaaaaaaaaaaaaaaattaatgatggtcaaagggtataaaatctcagacaggaagaatatgttttatgctttttttgagttctgttgtacagtgtggtgcctatacttaataatggggtattatacatttcaaaattgatgttctcatcacagaaatgtatttgaagtattgcatatgttaactagcttgatttaactattccatattgtatccacaatttatgatatcactttgtaacccatacatttatacaattataaattgtcaatttacaataaaaaa

SEQ ID NO: 488 - DNA, 16263 bp, Homo sapiens
gtccggccaactctgcagctcggtccagccctgcccttggggagccggggaggggcgggagaggcttttctggagctccttcaaagaagaacttgtacttttctgagaacgacgctcccagaccttggggtgtgcccttgtctggcaaagggcggaggccctggctgtgcctccgcgtgcttccgccgcaggatgccggcgtccgcccgcctggcgggagcggggctgctgctggcctttctccgcgcgctcggctgcgctgggcgggccccaggtatggctgcacgcgcgcgctccttgcttgtcctcgccaaggctttggaacttgctgccaacgtttttgctacgcagtatctttccgtggtagtttttgtggccaatctaattattttgatattataatgttttactcacgtggtaattctagccgtctctacttagggcccaggaatgactcagccaaatgtaatgatgataaagttaactaccagatcgaaaataatcagtataacctggcttcaacagtaaatgatactctatcttgttgacatcaaaagaaagttcatttttcttcttcgcttcagttcatctgtgtaagccgtttggaacaggcagttcgctttttccctgtaactactcaattcatgcacatggaaaataatgtagacagcagtcatcagtgttaatacttcaacatgtcatattacagctgttacccgttacaaggaaattccttggtggaccctccagatcagtcttttttttttttttaattcctcgttttcatccctagttgactctaccgcctctccgtatatgcagctccagacgtttcccactccactcagggtcccgattatcaactcccacagcttccctcagcagaatttaccggctttctttttctctttctctctctctctgtctctctctcttcttcctcctctccctctctcctctgtttctgtctctgtctgtctccctctctcctctctctctctccttccctctcctctatgagaaagaagggcgactttccattgagttccattgagttctcttgaattagtccttttcagtaccctccgggaattgactccatcactttacccctgcatttttgttttgttttgttttctgttttgttggtttttggggttttttaaagttgtttgttttttgttttttgagacggaatctcgccctgttttgttgcccaggctgaagtgcagtggcgcactcttagctcactgccacctctgcctcctgggttcaagtgattctcctgcctcagcctcccgagtagctgagattacaggcgtctgccactacacctggctaattttttgtatttttagtagagacagagtttcaccatgttggccaggctggtcttgaactcctgaccccaggtgatccgcctgtctcagcctcccaaagtgctgggattacaagcatgagccaccgggcctggcctttgtttttgagacagggcctcactctgttgcccaggctgaagtgcagtggcacaatcactgctcactggagcctcaacttccacagctcaagtgatcctcccacctcagcctcccgagtagctgggactacaggtgtgtgccccccacacccagcttacttcttttttttttttctgtagagacagggtctccctttgttacccaggctggtctcaaacccctggagtcaaaagagatcctcccgcctcagtctcacaaagtactgagattatagacgtgagagacggcaccctgtctgcatcttgttaacttcaagttatacctctccataaactctgtctctttggttttaacatatactcaactttcccctgcaaaacaaaccttacttcccttgacctaactttcatattacagtcccattcatttctcctcttctccacaagacttcttaatggaaatctccacatttgctgcccacatatcctcatctccccgtcattgtccagttcattgtggcctgtcttctactttctccactttatttaactacaaagctaccagtgactttccaaagacaaaagcttcattttttcagcctactcatgtgacattactgattatccacccacttagaatgctcttctcagttctcctgtgccctcttggtttcttctttcatgttcttgctccatcttcttccaagtctggcatttatcttttccccatctactccctaaatttaagtgttttctgaagccctcttatttcatatatatgtgtgtgtgtgtgtgtgtgtgtgtgtgtgtgtgtgtgtgtgtgtagttccagacattctcttctttaatgatttcaaccaaatgctgaaatttcaggtttcacctgtgtttaaatgacagccagcttagctttagtctttctcattagttacagactcaaatttcaggactgcccatttgacacctccacaagattgttccttaggaacctcaaattctgtaagacaacataaactctgatcctctcccattctcaaatctgcctctccagtgtgcccttgcatgctcacagcatcagtcttccatgcttccctctttgttgcctcttccttctaactaatcacaagttttattgagttttcttcctttttttctttgagacagtcttgctctgtcatccagatgggggtggagtggcgcgatctcagctcactgcaacctctgcctctcaggttcaagcaatcctcctgccttggcctccctagtagctggaagtacaggtgtgcaccaccacgcccaactaatttctgtatttttagtagagatggggtttcatcagtctcaaactcctgacctcaggtgatccacctgccttagcctcccaaagtgctgggattacaaacgtgagccatcacgcctggcctattgagtttacttctgcaatgtctctcatatatgactcttcctttacatttctgctgccccaggtgagtttttcctcacttctccttgggatggcatagccctcctaacttctgctcttgccttcaatatctgctcttcaaacccatccttcatgctgcaggcaaaataatcagtctaaatatttctccacccccccccagctttattaaaatataattgacaagcaaaaattatatctatatttgcagtgtacaaagtgatgttttgataatgtatgcattgtgcagtgattaaatcaagctaattactaaatgcttctgatcctaccatttccctccccagtagcttcttctttacctatagaataaagttgaaatgcataatttagcatggcatctctacctcccagattaggtccagcctaccttttcagttttgcctccccttaataagccacagagttcaacccagtgagtctcatccctgactgtgtgttaagactacttggaaagcaatatctaggggtgaggcctgaggattaacatttttaaagcttccccaaagatcctgatgcacaagcagggtagcaaacccctggtctagccacaactggctacttgtacttcttcatctccatggtactacattactctaagctccacatactgggagctggtagagcatagcattcatggggattgactctggaaccaaatcccagctccatcacttactggttgtgtgaccttggattaaatgctgtttcctccaagaactctttccctgtcttcccaatcagaattaatttgtttgctcctttgtaatattttctgtccttgttatagcacagggctggttcctgatgagctctcaatggattttcatggaattaaattatcatgccatatattttattgtcattatttgcatgcatttgtgcccctacactaaattaaaaactctttgagggcaaagattttatatcattcatctttgtatatcctagagtgccccattcgtattagacactcagtaagttttgaattctataaactattttttaaatgaattttagagaaagaaataccattagcaagatactctatttagagttattttcaaatattgccaagtacaacattcaatccagcttgttcaccaccaaccccccacctctcagcactaaggttgtatgattctctaggatatggatcctcactctagcggggaactagcagaatgatgaatttccgtgcctactgtcacaaacccatatctcattgtcaagtctgccaacctggcatattcacataaggagtctttacgttatgaagaggtgtaatgtatacagtcaatccacagaggatcaataaacaccacagttttccttcacacacatgaatcataagggtagctggattcaaatgtttacacatcaactctaattttaaccatcttcatccacatcccccttgacaattccctgttcccaaaataaattcgtgtagtttggccatttggcttagattgactgactcaactgtaattctggagccatgagttattttgcttgtgctcttgctttatttgtgtagttagctggttatttgttcaagcattatttgacattttcttagtaaaggagaccggtgagtagcttccagaagcccagaagcagacataacctccattgggacctcctgtgcacttatgccccgtaatcccctattccagattgttatgacccaaactttaaggagaactgaatgaaaaaggacagaaaggttaaatgtatcctactcaacatatttatgatgtttatttttttatttattaatttatttatttgagtcagagtctccctctgttgcccaggctggagtgcagtggggcaatctcggctcactgcagcctccacctcccaggttcaagcgattctcctgcctcagcctcccgagtagctgggattacaggcgcccgccaccatgcccggccaatttttgtatttttggtagaaacggggtttcaccatgttggccaggctgctctcgaactcctgacctcaagtgattcgcccgtgtcggcctcccaaagtgctgagattacaagctatttatgatgtttaatgtgtgctgtttgtctctcacctccagaattaagctcctcaggacagggatcctgttttgttcactgatgtttgcctggtcacctagaacaggtgcctggcacacagtagctgtcagtcagtatttaattgaatgattgaatgtatccccatgtacttcttcgtctatgcctttctcctcatgagaaaatgagaagagggttgcgcttgttgactgagatgcgatgagggctaggtttgtggaggcccagccgagttcctggacagatccccaacccaaagcttttgggttgccggacaaccgcgtcctgaaatcccaccttctgggcgggcccgggccgaggcgccgtctctgattggtcagctggaggtgatgggcatgagcgacagcgaaggagcagctacacactaaacttccgggcgcggaggtttgcgcgccttggtgagccgttggcgtggtggtcccggagtgatcctggcagccggtggggaagacaaggagggtgagccgccaggggcccccagggtgtgcttctcaggtcgattagccctaaaatgttagtagcaggggattctgggagttagtagcagggaattctggtagtgagggagcgggaccgggcatggatgtaaggaggtcatcggtcctcaggttatttccccagaagaggcttcagcgggcagctgcgatccgaagctccctctcccggcgtctggttcttccttcacacacaccttatcacatccactcacgtttccatttccaggaccttgaagtcggggagaggtcgcaatggttaaggatggacaggggtgggtgtggccctttctgactcaggcttgcgggtcctggaataatagcccttcactcttctgctttcctggtttctgacaggtttgagcatggcagaaggaaacaccctgatatcagtggattatgaaatttttgggaaggtgcaaggggtgtttttccgtaagcatactcaggtatgtggcctgcaggctttggggtggtaacctaggttgtgggcataggaacaagggacgtgttcttgacaaatgtgaactagaagccgctggctatttggtagctgcatggcaaagaggtagtttgtagagcaatgagtatgaaaatgctgtgcaatcggtaaaacatggtgtaaatggaagatcaccctgctgttattattagtcagtggtgcctgagcatctagatacacatattaatgagcttctctcttccaagggaaatagagggcttccccagtgctcgccgttgtggcatcatcaaaccaagtcaggtttcttatagaaaggctaacattgattgaagagctggcatttagatgacctgatgtcatgtatataacatatataaatgcttcctctgcagctgctgcactttcttcagacctctttctccaagcttccctcagttctccacttaatttctttctattcttttttggttttgaaagaacatttaccttttccagctgacgtttttcttattaaaaactctttatccattccagaataggtgatgggaacactgaatgtggagcctggtattcttcctagagcaataaaggattatttgaggggatggacaaactgttggcagcctctacctctgctttaatgtggctaatcttccctcaacaggcacacacaaatgcaagctcaatttaccctctgccttctgtaggtattggctattgccttcccagtgtgtcgctaatcccacagataatgagttaggactgcaaaacttcttttttttttttttttttttttgtatttttagtagagacagggtttcaccatcttggccaggctggtcttgaactcctggcctcgtgatccatccgcctcagcctccccaagtgctgggattacaggtgtgagccaccgcacccggccaggactgcagaacttcttaagtgtctcattcctgggactgtggtacttaaaattcaaattctaacctggaaggaatctttgaaacatgaatgtgaattgtcaatacctctttccctttttcttttttttttctgaaggatggtggcacagtcacagcttattgcagccttaacctcccaggctcaaatgatcctccttcctcagcctcccaagtagctgggaccacaggtgcatgccgccacacccagctttttttttttttttctcttttaacagagagctatgttgcccaggctggtctcaaactcccaggctcaagtgatccttctgcctcggcctcccaccagtgtgctgggattacaggcatgagtgaccatacccagccaatacctctttttcttttcttttctttttttttttttttttttttttgagacagagtttcattctttttgcccaggctggagtgcaatggcacgatctcagctcaccgcaacgtccgcctcccgggttcaagcgtttctcctacttcagcttcccaagtagctgagattacaggcatgtgccaccatgccccgctaattttgtatttttagtagagacagggtttttccatgttggtcaggctggtcttgaactcccaacctcaggtgatccgcccaccttggcctcccaaagtgttgggattacaggtgtgagccactgtgcccggccaatacctctttttctaattattcaaaaatcatttcttcccatctgacactcaaataggaaatgactgttgaaaacagaattgctgaaactcacagcaagagctgtgttccagttagctttgctaccagttatgcaggtaagttcctgtaaattaaggtgattgagataacagcttcaaagattagtcaaagttgttgagggaaaagggtcagatagtggtatgcatagcccatctttctctacctgcccctctccccagtttaaagagagaataacagaatgcagaaaaacaaatattgattggaaaactgcatataaaatgacatctattttttcttaattaggcttgtagcttattctttactatttataatcatttaaatatatatgttcatttgaacagttgttttgctgcaatgtttgctgttgatattatctagcctcttatttaaattccttcatttctagagaagtgacaaataataattcagggacttttgaaaacttggaatataatttacatcccataaaacccatcctcctaaagtgtataatttggtgatttttagtatattcacaaaatgttgcactaattccagaacattttcatcatcccaaaaagaaacccctacctaggttagcactcactcctcatcccctgagcccctggcaaccactaacctactttctgtctctatggatttgcctattctagattgttgttgttgttgttgttgttgttgagacagagtctcaactctgcctcattctgtcacccaggctggagtgcagtggcgtgatctcggctcactgcaacctctgcctcctgggttcaagtgattcttctccctcagcatcccaggtagccgggattacaggcatgcaccaccatgcccagttaacttttgtatttttagtagagatggggtttcaccatgttggccaggctgggtcttgaactcctcacctcaggtgatccacctacctcagcctcccaaagtgctgggattacacgcatgagccaccgtgttcagcctattcttgatatttaatataaatggaatcatacaaatgtggcctttttttgtgactggctcctttcacttaacatattgttttcaaggtttatctacactgtagcatgtattagtatcctattcctttttatggctgaataatattccattgtatggatataccacatttcatttatccattcatcaattgatggaaatttgggtttctgatttttggccattatgaatagtagtgctgtgaacacatatgcacatatttttatgtagacaatgttttcagttccattgagtatatacatacctaggagtagattgctgggtcatatggtaactttatgtttagctttttgaggaactgccaaacttttccaaagtagctataccatattatgttctcactggcaatgtgtgagaattccagtttgtccacatccttgccaacaatggttactgtcttttatgttagccatcctagtgggtatgaggtaatatttcattgtggttgtttgtttgtttttcaggtattaatgaatttaaaaggatttaaatcaaggaatgttctccaactacagtggaactaaaccacattaaaaaaataaaaaggataactggaaaatcccaaaatatttggaaaccatatagcacacttacttctaaaattgtggtagaatacatataacatagaaattattgttctaaccatttttaaatgtacaattcagtggtcttaagcacattcacattgttctgtttatctacagaacgcttttcatcttgcaaaactgaaactctgtattcattaaacactaactccccattttctccttcccccatgcccctgacaatcataaatctacattctattaattcaactgctctagttacctcatataagtggaattttacagtatttgtccttttgtggctggcttatttcacttagcataatatcctcagggttcatctgtgttatatcatgaaagtaaaaacaatttcctttctttgtaagacggaataatatcctgttgtatgtgtatactttcagtgtggttttgatttgccttcctaatgactaatgatgttgagcatcttttcatgtgcttattggcatattttatgtctgctttgaagaaatgtccattcaaatatttttgcccatttttagttatttgcctccttattcttgagttgtaagaatatttttattctggatactagtcccttatcagatgtatgatatacaaatatttctcccattctgtgggttgtctttttaatttcttgatagtgtctgtgaagtacaaaagtttttacttttgatgaagtcaaatcaaatttatctgttctttttttgcttgcacttttagtgttatatctaagaaatcttcctaatccaaggtcatgaaggttcatgcctatgttttttgtttgttttgtttttgttttttgtagcaactgggtttccccatgttgcctggctgatcctgacctcaagcaatctgcccacctcagcctcccaaagtgctgggattacaggtgtgagccaccacacccagctgctgtcatgcctatgttttcttttccttttttttttttttttttttttaagacagagtctcgctctgtgcagtggcgcgatctcgatctcggctcactgcaaccttccgcctccagggttcaagcgattctcctgagtagctgagattacaggtgtgctatatcacgcccaactaatttttgcatttttagtagcgacggggtttcaccatgttggtcagactggtctcgaactcctgacctcgtgatccacccgcctcagcctcccaaagtgctgggattacaggcgtgagccaccgcgcccagccgcctatgttttcttcaaaatttcatagtttacactcttagattgaggtctttgatccagtttgagttaatttttatgtgatgtgaggtaggaaatccagctttattcttttgcatatgaatatccagttgtcccagcaccatttgttgaagtgagtattatttcccacattcgtcatagcacccttttcaaaaatcaacataaatgtaaggatttatttctggactctcaatactattccattcatctatatgtctgcctgctgtagttgagatgtttgtccccttcaaatctcatgttgaaatttgatccccagtgttgaaagtgggacataatgggagatgtttgagtaatggggccaggtccctcatgagtagattaatgctcttcctggggggtgggagggtcaatgaagtcttactctattagttccctggagaactggttgttatttttatttattttttttgaaacggagtcttgttcttgtcgcccaggctagagtgcagtgacacaatctcggctcactgcaacctctgcctccagggttcaagcaattctcctgcctcgccctcccaagtggctgggattacaggcacccgccaccacacccagctaatttttgtatttttagtagacacagggtttcaccgtgttggccaggctggtctcaaactcctgacctcaggtgatccgcccgcctcagcctcccaaagtgctgggattacaggtgtgagccaccgtgcccggtgagaactggttgttaaaaagagcctggtaccccacctcttcccacccctgcctcacagtggaaacagcctaaggccctcacctgatgccagtgacagtctcatgcttatacaatctacagaatcatgagtcaaataaacctcttttctttataaattacccagcctcagcaggtagttcttttttttttttttttttttttttgagacagagtcttgctctgttgcctaggctaaagtgcagtagtgcgatctcggctcactgcaacctccacttcctgggttcaagcaattctcctgcctcagcctcctgagtagctgggattacaggcacccaccactgcgcccggctaatttttgtatttttaatagacggcgtttcaccgtcttggccaggctgatctcgaactcctgacctcatgatccccccacctcggcctcccaaagtgctgggattacaggtgtgagctaccacgcctggtcctcaggtagttctttatagcaacacgaaatggtctaagccactatccttatgccagtaccacactgtctcagttactgcagctttgtagtaagttttgaaattgggaagtgtgaatccttcaactttgtttttccttttcaagattatttctagctatcctgggtcccttatgtttccatgtaaattttagtatcaatttttcgatttctgcaaaagcactgggattttgatagagattgagttgaatctgtagatcaattgggtagtaatatcatcttaacaatgttaagtatttcaatacatcagtaagggatgtctttccatttatttagatactctttaatttctttcaagaatgttttgtagatttccatatatgtcgtgcaattcttttgttaaatttattcctagacactctatctttttgatgctattataaatggaattgtttcctaatttcattttcagtttttcattgctagtgtatagaaatacaattgatttttgtatatcaatcttatatcctacaaccttgtgagactgttaattagctctagtgtgtgcctgtgtatgtttcttaggactttttgtatacaagatatgtcatctacaaatagaggtagttctgctttttcctttccaatctgaatgccttttctttctcctgctgtggatagaccctcaagtataatattgagtagagtggtaacagcagacatccttgtcttgttcctgatcttcgtgggaacgtttttaatctttcaccattaagtatgatgttagcagtgggtttttcacagattccctttatcaggttgaggaagtttccttctgttcctagtttgttgagtgttttgatcataaaagaggtattggtttttgtcaaatgcttttttgccatctattgagatgatcatatagcttttgttttattaatatggtgtattaaattgattacttcttgtatattgaaccaaccttgaaagaaatcctagtttgtcatggtatacaattctttttctgtgttgcctgatttggtttgctagtattttgctgatgatttttgcatctctgttcataagagatattggtctatggttttttggttgttttttctcgtgacagctttgtttttgggaggctgaggaaggaggatcatttgagcctgggaggttaaggctgcaataagctgtgactgtgccaccatccttcagaaaaaaaaaagaaaaaggaaaagaggtattgacaattcacattcatgtttcaaagattccttccaggttagaatttgaattttaagtaccacagtcccaggaatgagacacttatttttcatttttattttttagctttagttttagtatgaggataatgctggcttaataaaatgtgttgggaagtgtttcctcttcttttttttaacccttaattcttggtttggatcttcttctattttttggaagagtttgtgaagggttggtaaaggatttttttttaaacatttggtagaatttacccatgaagccatctggtcctgggctttttatctgtgggaagtttttgattacaaattccatctcttggtataggtctattcagactttctatttcttcttgattcagttttggttgtttgtctttctaggtattaggtttgttttcatccaaaaaaatttaatctaattttttggcatataattgttcatagaattcccttttatcctttttatctttgtaaggttggtggtaatgtctccttttatttctgattttagtaatttgaggctttcatccgtttttctttatcagtctagctaaaggttgtcaattttgttgatcctgtcaaagaagcaacttttgttttattgattttctctattcttctgctttccattaatttctgctctaatctttatttccttctttctgctcattttgaattcagtttgctcttctttttctagtatcctaaggtggaaatcttgattattgatttgaagagagtttctttttagattgcaactagaggtggtgattacagtccttgaaatgttgtcagatgattgtttaagcaaaaatatggttatgaggtagaattcactttttggaattttcttaggggagaaaaaccctgttggtgcaatagatattcaaaactgaacatgagtcaataacattatgtcatcattaaaaaaataagaacagagttgagcacacaaatgaaaccagtaggaaacgcccattctcaacactggtcaaattttggagtgttctgttcaactctcaagagttcagataaggccaggtgcagtggctcatgcctgtaatcccagcactttgggaggccgaggcaggcggatcatgaggtcaggagatcgagaccatcctggctaacacagtgaaaccccatctctactaaaaatacaaaaaaattagccgggagtggttgcgggcgcctgtggtcccagctactggggaggctgaggcaggagaatggcataaacctgggaggcggagcttgcagtgagctgagatcacgccactgcactccagtctgggcgacagagcgagactccgtctcaaaaaaaaaaaaaaaaaaaaaaaaagagttcagataaatcacattgcaaatttttaaagatttatttgactgtgacaacctcctgtttaaaactgcacattcttacagctatttaccatataagataactcttaagaactggagatagtcagctcccctgggttaatttgaagcagaagagggcagttgttatactgccctgtcagttggatgcggagtcttactcaaaattcattctcagcattcttcttttatggtatcttctttggcacttagcagcgcatcaggtaggcatcttctatttttcttcattccttaatttcctttgtatccctcaaatggttatttatttggctggagtctgttttgttcattaagcaaacatgtctttgctttgaacatgtctttgatttgatggatacttaaattcctcatcaaacattttgttgctatgcataacgttttctttggccaactccagcaatttcccacattttgacatgcaatcatgttaactcccattttcttttgtaatccaacatcttctatttagataattactttaacaatcaatgacttaatattctaatcataaatttatacaaaaataaaattacctccaaaacattgctacctttcctaaacattcagtcttgccacagtttaataaaaggaaagaacattaaaaaggataagacactgtaatgattagatgctttttataagcctaaaggcattgtgattatttagacagaagagaagaaagtgaagtgaaaacctgatagttatgtagtctcatggtttgctgttgagaggctgaacaccagctgctttccttttctaggaagataataaagtgggctttggctacaacataaagatgttgggttagacagtttcactacagtaagaacaacgggatgagttgcccaggaaattgtgaaatactttctaatgatctttaaagatataatgaacactaattcatctggatttgtttacgtgtggtcctggttaaaggcaaagggaaggatcagataacttcatgttttttccatttaacatacccaatagattcttgattaggggaagggaaaatgagcaagatacagtccagtattctaaaaacaatcagccttaggggatcatttcaaaagcatctgttttggacttaagtctttgatacttaaccaaattgactacacagtgaaaaattctagtgcctgggttttatagggtagaagaaagacatgcagtcaagtggccaatacttcatgtgaagataagcaatgagatccttcttgctgtctttcttttgactgttctgggcaatatcaaattagtttcagtggcttgattctaggccaagattctggcaacagattgtagtcttaccttgttttcttcaatctcactggatctctctctctttttaccccccttaggctgagggtaaaaagctgggattggtaggctgggtccagaacactgaccggggcacagtgcaaggacaattgcaaggtcccatctccaaggtgcgtcatatgcaggaatggcttgaaacaagaggaagtcctaaatcacacatcgacaaagcaaacttcaacaatgaaaaagtcatcttgaagttggattactcagacttccaaattgtaaaataatggcctgaatttaagttttctaagataaactcagtggtttggtttttattattaatagagatagaactattgtgtgttaatattagcattagtcaataagttattttaatgtcagatttttgaatgttattatatattacctgtatgatggaaggattaccactgtacacaaatctaatcaataaaaacgttagaaccttctgcttagagtacttttaaaaaa

SEQ ID NO: 489 - DNA, 321454 bp, Homo sapiens
tcaggtctgaatgctggtgctttttatgccttgtccactcttctgaatcgcatggtgatctggcactacccggtaagggagttccctaagcatgttgggcctcaagatgatatagtttctaagtctgtcttggcaggacctgggatgaccgttaagtcttcattccccccagttctaggtagggtgatatggtggtatgcttatgggatttggagggagatggccctagatctcaaccctagctttggtgttactaaactgtgtgatggcttgacagtgtgacaagctagttagtgtttctgagctctcatttttttttttttctgcaaaagaagcataattgcttcttgcaaggttctttttaggatcagagagtaaataatgacgcttgtgtatgtatacataattatatgtgatacatgtatttattatacagcatagtgcctggcaacactgttggcaaatatatatataaaatatttctgaatttaaatgtttccagaacccacgagggctgggctggatgctgggaatggaatactgagtggcctggagtcaggaatacggagatgcaaccctcttttgaaaggactaggctctcacacttgcagaaggggtagactatatggctaagtgtcctagttttggagttcaaaggcctgagttcagatcctagctttgaacttaacatatgccttgtgaccttgggctagtaggttaatttcattgtgcctgtttcttcatctgcaaaatggagaagactgactcctaaccttatgatggggaatggcgaggagtaaatgagataatgatataaaaccttaggcatggtgcctggcttatagtaagcactcaaaaatatataactattatctttccattcctcttggcattgatagttcaaaaaaacctaagaatggaaattttaacatatatattttaaattccccatctgtgaaatggaattaatgacagataagatagaagagttgctgtgaggtttacattttttaaaaaatttgcctaaaagtagttctaagaacagatttggttcatccttgtcactccagcatccaatatcatgcacacacagtcagggttatattgttgggaggagtagttattctagaattttctcctaggccatcttgtcccgatatgttctgaatattgactctgatggagcttgagttacctgcctttgttccttcaccccatggtgactgtgctctgtcctgggtcttgtcccatcgccgggtgatctttggggttatggtttccccagggggaagaagtgaatgctggaagaattggcctgacgatcgtcattgcaggaatgcttggggctgtgatctcaggaatctggctggataggtccaaaacctacaagtaagtgactcatcctcttggactgagaattggggacctgttttttgaaatgacatattcataagcagtgtgactccaagtcattgtttggagatcctagtggccaagcaggtcattcaagtttgacttctctgagcctcactttcctcatttatcaaatgagggaagctatacccgtcttaagatccccacaggatcttaggaagatgggagctactggacttgaaggcctagcatagtcctcttccccatccccactctctaagtagctttgtgaaagcagcagaggagggagaaatgaaaatgaatggggaaaaaaaatctcagcggtggaaaatttgtggaaaccccaaagagtggagatgaggaggaggtgatttcactctcctgttctcatggcaccttgtggaccccatggggttgaccaaggtactctgagctttctccagtttgcagtgtatattattgtgcaattatttataccttgttggtaaatattataacttactttggacctgaatgcccagtgcatttctaagagcctggagctattttaaaaggttttatcaggctgggcgcagtgactcacatctgtaatcccagcactttgggaggccgaggcaggaggattgcttgagtctaggagctcaaaaccagcctgggcaacatggtgaaaccccatctctacaaaaaatacaaaaattagctaggcatagtggcacacacctgaagtcccagctatttgggaggctgaggtagaaggatcgcttgacccaggaggtggaggttgctgtgaactgggttcacgccactgcactccagcctggctcaagaaaaaaaagaaaagaaaatgttttatcggtgtgcacatgggttaaaaaaaaattaaaaggttttagtgaatgccaggccactacccgccccatggatgccaaatcagcagaagaatctgcatttgtagaaagcagcctgggtgcctccattcagcagctggccttggagaaaatcctctggcgaacagcagcccaacatccttcccttgtgattttccagtgctccccgttcactgggtactcagttagcactggctggcggggcagctgttgggctgtactgtaccggggcagagcagtgtccccggctgctctgtcaaggcctccaaagttcccagtgtctgcaggcaacagacagtggcagacctgttctctgccacacaaacccgcttctgtgaggccctggtcagaccaggtctcattctggctgccctaatcaaaggccaattgagaccatccctagggaggtggcgacgaggagcctggctcggcttaattactgctggcggggcttggctgccatctcatcgctgccatctgttagttgcttgcttcagccagacacaagagcagtgaggactggccatccccaaaccactgaatagcagtgaccctttttccggggcttgctctgcggcaggaggagggagggatgggaatgctggctgggctgggacatgggcagccggatgattcagatgaattagaaaagataatgagaggactgggaagaacactttctcagccctcttcagaacctagatgtcaccagttcctagcatcacgtgatgtctaaatccagtggtcagcacaagatatttttctccctgtgccactacccaggcagagaaaaggcaactcccagtgggatgagagctctgtgatcccatcatttcggagccagtcctcgtcactctaaggctcccagatttgtctagttttgtttggaggttggaaattgggtggtgaggtctgtttatctcagactgggactacaaatagtttttctaaactggtcagtggtttaggatgaagctatggttaaagcttcatcctggtgagcttgtgggatcatcgggcaagactggcgtccatgacgttgctttcagcagagttggtaggaagagtgtgagggaggagcgtgaagggaggaggaagctcctctacccttagcagctgctttgaagcaccaggtgggagcagcatcctttggagactctgaccttgagcttttccaaagatgcaaccacatagtgcatcgttattcccgcatgcagtagcagaagggacacaggtttcaaatccagctttgagttcacatctcagctctgcatttattcagctggtgactttggacaagtaacttgagtggcctgagcttcagtttcttcattggtaaaatgagaaatcatcagatatttcttacaggatttttgtaaaggttgaattgaaataataaatgcatgtgaagtgcttcacagaatctggcactcaagagatggagggtttcgtttgacacaaccgtagcgtgccatttggtgcctccaccatgattctggcttcaggggtgatgtgtaaagaaaagctttaaagattttggccaggtgcggtggctcacgcctgtaatcccagcactttgggaggcggaggcgggcagatcatgaggtcaggagatcgagaccaccctggctaacacagtgaaaccctgtctctactaaacaaactacaaaaaacattagccaggcgtggtggcgggcccctgtagtcccagctgcttgggaggctgaggcaggagaatggtgaacctgggaggcggagcttgcagtgagcagagatcgtgccactgcactccagcctgggtgacagagcaagactccatctcaaaaaaaaaaaaaaaaagaaagaaaagaaaagctttaaagctttcatcatctgagtcctgatgttcatggtaggggggcagagggatgtgcagtgcctatgccctgccttaggtagtgcagggagaagaatgcaggtcgaattgcaggagtcggggctgcatcagagtcctaggtgggcaacatgggaagagaactgctggaggggcacaggagggggtgagactgaaatagaaaccaagacttgctgatggtactcctgaggggatcgacacagggaaatgtaacagggagtgggcgaagatagagaaggtttctcacattggctttggaagtcaagcactcagttcaggctgagagaatattctctcttagttcctgctctctggagtggagtagttcagactcaacagaaaaagctttgctgggccaggcgcagtggctcacacctctaattagaacactttgggaggccaaggcgggcagatcacctgaggtcaggagtttgagaccagcctggccaacatggcgaaaccccatctctactagaaatacaaaaaattagccacgtatggtggcgcatgcctgtaatctcagctacttgggaggctgaggcagaagaatcgcttgaacccgggaggcagaggttgcagtgagctgagatcacgccactgcaccccagcctgtgcgacaagagcgaaactccatctcaaaaaaaggacaaaagaaaaaaaagaaaagaaaaagctttgctgggtctgttggtctgttcaagtagggacaggaagaacttgtaggtgacagagcacattgcccagcattgtcatgggtcttgggataaagcagacaagcagaattggacagcttctggggtagtcctgaatgtcaccgccacctcatcatggctgatgtttgtcctgttttttcttttttctggtgagggatgggagaaggagaaagggctttgcccttcttgtctgtggctaggacatgacaagtcaaggggcagattgatattgttgagtgggttctacagaaagggaacaaagatatcgtaagatggcttcatactttactagtcttacttaccctttgtagcattgatcatgatgtaattaaataatttttttgtgtgatcatcatctgtcagtgtccatcaccctcatggagagaaagttctatgaaagaaaatgtccaagaacaaggccaggccttggctttgtaaggcctgtaatcccagcactttagcaggccaaggcaggtggagcacttgaggtcaggagttcgataccagcctggccaacacggcaaaacaccgtctctatgaaaaatacaaaaattagccaggcgtgatgcgcacaactgtcccagctactcagcaggctgaggcacaagaattgctggagcccaggaggtagaggtttcagcgagctgtgatcacgccactgcactccagcctgggcaacagagcaagacactgtctctgaaaacaaaacaaaactccaagaacatagcagagggcttgacatgcggcagatacttaatagatgcttgtggaataaatgaatgaatgagcctattaaagtcagaagtgtttgattcaatttctttgcctctacttgtagagagacaaccctggtagtctatatcatgacactggtgggcatggtggtgtacacgtttaccttgaacctgggacacctgtgggtagtgttcatcactgctggcacaatggggtaagtttcacctctggctgatttattagaaaataccatgccatggctcccagagcttccagcatcctagaatgcaatattgatgcctttgctgccttctaactgacctcaggagatatggacatggtgcccaggggtctcggtaatacttgtagtacttccaaaggcagcctgggctgtctgttcttttgggatggaatgaagcatgaagcacacccttcgcgacctcttggaggctagaacctgttcagagtctttttcagttttgcctggacaacatgggattgtggaaagtacacagggcttggaaccagagactctgggtcctggtctcagttttgctgctgcctacctgttagaccatgggcacagcacttaaccattctgagcctcaatttcctcatctgtaaagaaagataatagtggcctgccttgtcaagttgttggacagattgagaaagataatagatatgaaagcatcaagaagcattgtgaaaatgtaagaaattaaagttgccgggtgcggtggcttaacgcctgtaatcccagcactttgggagtccaaggcaggcagatcacaaggtcaggagttcaagaccagcctggccaatatggtgataccgcgtctctactaaaaaatacaaaaatcagccaggcatggtggcacacacctgtagtcccagctacttgggaggctgaggcaggagaatcgctggcacctgggaggcggaagttgcagtgagccaagatcgaactactgcactccagcctgggagacagagtgagactccgtctcaaaaaaaaaaaaaaaaaaaggagaaattaaagttggaattttctagacctgttgtatgagaaaacataggaaacaatacctctttcacaggagtctttgttcagctctgcttcccagttattttcctatgggcagtatatgagtgtttgtgtgtgtgtgtgtgtgtgtgtgtgtgtctgtatgtgcatgtgaaagagagaaagagggagagagcatgtgctggcactcagtcctcagctggttcctctctggatggaaataaggaggactctaagctcctccttccaggtcccagagagccacggagatcctgctcaatatccaggaagttcccactcccagcacagggcctgtgtacccaggacatagtctctcagctgaaggttgaacacaccaggcatccttgccccttctgtaaatgctgactggctgtcactgatggcaagatggagaagcagcaagggatcccagaggcctgctgagcacaaggtctccctgtgaacttcttcctggccttcaggggtgcccgtctccttggtatgatcacatagaggatgcccagatcattagagggcctagtatgtcttggtgggaagaaacaaaacagcaaagggagtcctaggggaggaggtgggctccccatccttcttgttctggaagttcttcatccccttgtttctctggtctggtcttcagcttctttatgactggctatctcccactgggatttgagtttgctgtggagctcacgtacccagaatcagaaggcatctcctccggcctcctcaacatatctgcacaggtagagctcgtatttcctgtttgtttcctggctgggaaggcattgcatcatggcagctcagttcttcctcatgagttagttgactgggcccttgtttcctatcttctttatgcctttccaggtatttgggatcatctttaccatctcccagggccagattattgacaactatggaaccaagcctgggaacatcttcctgtgtgtgttccttactcttggagcagccctcactggtgagttggagcctgagggcaagatgaggctcaggttggccatttgggaccctagtgtctcgatggagcaacagatagggagtacgtacgtagggggacagatggaagggtttgttggggaatctgttgggaggcagcacattgttttggtagaatgagcatgggttttggagccagaagactcatgttggaatcccagactgtgacaatgacttccatagctattgaccttggataagtggaccaacctctgggaacctcagtttttaatctgtaaaatgaggattgttgtgatgattagagcaatgtgtgcaaagtccctgatccataagtgaaggccactgtcattgttggcttctgcctgtcagggacggcagtgatcctcgggctctctcaaattggctgatggtgccctcagtcaccagctctcttgactatctgaagtaagtttgggatacctgtgacccttaggaaatgaaggtttcttctctcggatgaacgtgataactgtatttttgtctctcttccttctcaatctatcaaccttagcattcattaaggcagatctccggagacagaaagcaaacaaagaaactcttgagaacgtgagtatatgggagctttgtggggctgagatcggggtccaaggcttttgatgaggatgtggcaacatagatggggcagggagaactcccacagggactggttttgtcatagctgggagaccagttcatcccttacacatggcatcctaagactttcctcagtgggcatctttggcattgcgttcttgctactgctaccctttcttggactcttctcccacttcctgccctctttctggagcccccggcctcatccccagagtgtgtcaccgttgtcacagtctgctgaacagcacccctgactggatcttgagccgagtcctgaggctctggctccactgttttcagcctggggtcagtggctggggaggaaggggaagcctggctccaccactctgtcatggcagtgctggccctaaggctgtgactctcctggcatgtgacaactccttaggcagggccatggggacggagccaaagaattgccagtggggctctgaaaggacaagtcaggaagcaggagctggcgaggtagcagaggagaggaccaggagtatgacctagaacagaaaagtgttttccatctgttctaaccagctgggaaccactttaaacaaaatgttaggtatcaaatctgagtgatgatgaaaggaatttcaaatctgagaaagagcaaaggtaagatatttcttcaaaaattaaaaaaaaacttatagaggtaatacatgctctttgtagaataagtaaaaaatacagaaaagtgtacaaaatttaaaaatcatcctgtaatttcatcatttagagatgagatgccttttttgcattgattgctgcatgtctgtatccacttataatatatacgtggatatatgaatgtgtgtatataaatgcatatttttaaacagaaataaaactgcttttttcacttattgcaagcactttatcaggcaactagtctcttacaacatactttttttttatgagacacagtcttgctccgtcacctaggctggaatgcagtggtacaatctcagctcactgcagcctctgcctcccgggttcgagtgattctcatgccgcagtctcccaagtagctgggattgcaggtgcacgccactatgcctagctaatgtttgtatttttagtagagacggggtttcaccatgttggccagtctggtctcaaactcctgacctcaaatgacccaccaatcttggcctcccaaagtgctgggattacaggagtgagccactgtacctggcctacaacatacttttaatgcctgcatagtgttcctttatacggataagccatgatttatttagcaattttcctgtctgtggacattaaggttgttttgaattgttacaaataatattgtgattaatatgttggaagctgaatctttgtgcatgttctcaagtaccatatttcctggagaaatggaataatggtcatgcccatttcaaagactttggtatgtgttgctaaactgtcctctagaaaggtactttgagtactagcaatttctattgctaggcagtcatatgagcgccaacactgagtatttttcattttgaaaaatcttcgccaattttctaaggcaagagatatctgtaagggatatttttagtgtttgaaggatctgtgttggcagatagatgataatctttaggtctttactatttgtcttttgctattacgttctagagttggcaggcagcagcagaaaagcatgtggaagaaggagcctagaacaggaaattcactggggagacagggaaggcctttcagcaggaatgacattctttaattctgtgtcagggccatagtatggccactgtggagatggatttttcacccacactgtgtacaaggggacataatgatttggtacactggccgggcgcgatggctcatgcctgtaatcccagtactttgggaggccaaggtgggcagatcaggagtttgagaccagcctggccaacatggtgaaatcctatctctactaaaaatacaaaaattagccaggctagtgtcgcacgcttgtaatcccagctactcgggaggtggaggttgcggtaagctgagatcatgccattgcactccagcctgggtgacagagcaagactccatctcgaaaaaaaaaaaaagagagagagagaaatgatttggtacacttgggtaaatatatgtatagcctagtgaaaggtttcagtttggaacgtgacgtattatgtcaagtgacataagatttgctgtgttgactttataacctgtgtttatgttggcagacataggcaaacaaagaaaataaaaatcacctataatcctgcttcccagagataacctagtagcatttccagtgttgtaatctatggacatgcttgcgtatattttgttttctaccctgcttacttagtatagcttgataacatttctacagtgttacattataccacaacctcatgtctactgtgtatttccatctcactcaatatttcagttgttccactatttcattattcttgcagccagctctttgtgtacatggaccaggtttgttaatcaaggttacaattgttggctcagtctcttttgagtgtggggtgctggaaatagcgctgagtaggaataacagccttaggttccaataaatggtgctcacctgtcttgtgtccctggataattcactatgtgtctgtagacctccctggcacctgtggcagcatggtattatggggggtcaaagtcatgctgggactgacaccagcaaggaagccagggccatcacagagcagccctcctctggagccgtgacattacgcaccccatggcagctggtgtaactcagagacctgtggacaaattcattgtcagagtcaggtgaagactgggcacacggcagatctggccagacctgctctttctaatcagtgagatgtatagtttagggaaaaagagatgggacttctgggacagggtaatgattgaccttgactatgaacatcttactggtttgggtttccatttttcttctagcacatagacagtagttgcacttctgtctccactaacttgtttcccatttgtgattgtgatttccaggtgatggctttggaggaggcgggcgtggtgtgtgtgtgtgtgtgtgtgtgtgtgtgtgtgtgtgtgtgtgtcagagagagaggggagactaagtgactgaaataggctgttagtttcctgaatgatggctcctcatggctgaggctgacttgatgccaagtgttagcaagattgagaatgggaaggttggattctacagctgtctccattaccacaaacaggcactgagacactccctggggaagaaagcaccatttgtccacttgacattggcttctgtcttagccctgtgcatgtcctctaggccttgagtagtgttggctgtgtggtgctgcacctgtgcccaaggccttcttgtgaatcagaagaacccttgaggtcacagacaaagtacttcttaaaacagtagacaaaggcccaggttggcagtatgtacctaggggccccacaggataatttccaggccatgttgaattccaaactcacctaaaaagtgtgacttagaagactttcctgtaaatgaatcctgtgccatccctcccctagaaagctaaagccattgagcttacatatgcaattatgcatgctgctttggcatctactgcatgttcattatgatagtattcctcagctgggcgcggtgggtcacgcctgtaatcccagcactttgggaggccaaggtgagtggatcacctgaggtcaggagttcgagaccagcctggccaacatggtgaaaacctgtttgtactaaaaatacaaaaattaactgggcatggtggtgggcacctataatcccagctacttgggaggctgaggcaagagaatcacttgaacctgggaggcggagtttgcagtgagccgagatcgcgccattgcactccagcctaggcagcaaagtgagactccatctcaaaaaaaaaaaaaaaaaaaaaagtattcctcatcctggggctgcctccaagtgggggttgttggaaattccaagggaatcgcagacctggcaccttggacagtgatttgatggttagttgaggtgagttttcagctgtcagaatgtggagggaaaaggggctttgcttctgtttcagtcccgagagtgagcctgaaagagtggcactcggagctggatcatttgtggtggccttggcatcatagaaagcttgcccctttttccctctgatgacctcatgatgttgggtggtgtgtgtttgtgggtgcatttatggcaggggctggttgcttcttttcttgttctctttcttggctctctgggatgctgagtggcccccggctcttgtattccccactgattagtcatggccaggcagctgctccagccagggtggagtgctgtgcctttacccacagcactgcctgtttgttttgctttatagaaactccaagaggaggaggaggagagcaacaccagcaaagtgcccactgctgtgtcagaggatcatctctgagaggaaggtggtgacaactcagggaacacgaacaccccaccttttccttcagcacagctctcaccgccagcacaaagggcttcgctagagatgtttttggagggaatcagtgggactatttgtggcatggatggcctattcctcctagaacccacgtaagagcttggatgatttagttggagaaaattgcacctatcaccaaatgcaaatttgattcccacctccacccccttttaggttatgggagttggtgttgggacagggtggcagagaatattggagtcaatcctagcttggtctcttgccttccctcttttcctccatccatcgtggacaatgcctgcaaaattttcacaggaagaaagcctattcaggatattaacttgaaatttccagtgtcctaagagcctctcatgaagcccagttctaataagtggcaagctgctctgccggggtcatctcctgggtcatcggactgattgctcaagttctgcaggagaggaagcaccattagaacaactccatcagaacagctccaccgggacttgtgggcctaaattttcctggcctaacgggtctgtctccaaaccctctttcctaagagctgagcaaaccaaccataataaacttgacaaaagactttgttgtggccatgacagagataccgactcaggagggctacctacctaggtgtgatcatgctgggggctaccttctgagtatatttgtgaaagcacatatttgggaactctggtagcttgagttgggaatgggaaggttcttttttacagaagtacttccccagggacttctgtgtgtcacagtcacctctgatgcctttatcttgatgttgcattgggaatctcagccatcagcccaagtgcttgttttattccaaggcagggtaatccccgtcaacttactctaacctttgctgaaaactaatcttgattcattctactctgaaaatccaaaggtgcttctgagagataagagggaaggggtagaaggaaaggtgccccttgaaatgggaattgagcctgttagaattaaaagcttatctcacctctgctggggacagtatttgcaccaccaacccctctcctcacctgctttgagcgataatctttatcagatattctaaacttaaagggattccctttaaaccaactcaagctgatctttcctatctagcctgctgtttggctgtactcatgggctttggtaatatctcctaaaaatgaggttttggtaatttttcctatgcattgggcaactgtgatcgtgaccactgtgctgtcttgctccagccactgccctggcctcagcatatcagggcagcctgtgctggctgcaatactgtggtgcttgggccactgcctgagaggagccaggtttgtgtgtgtctgcatgtgtgtgtgtgtgtgtttgtacagattcaagcaatggatgcaaggaacatgctgtatgtaatagaagaaagaagtccacgttttcggcagaagtagtgagtcagtgtggaagagaggtgagggtgtgctttactttttgataaagagaaagatgtttactcataaacccttcaaaaggtattaacaaaatgtttaccaaacctattgctttattttaaaaacataatttgtgttttctatttgtaagatctgacatttcgaggcaataaaaacttctcagaaagtggtctgccttatcattcagtggggcagagatggctcttagaagtccctgcaagactgtcacacattcctgaggctcctgtcttaggtgtggggaagggctgggctggggcgggggagtgtgaggctagagaagcagcaactgtggtcttccacaggagcatctcactgttgccagaccttaccatctgggagggatattttttaaagacaaggctgtaaaggttactgtttgcctacatggagggactgcaactcaacatccagcacgaccctgacctctttccatgctgtgtacgcgctggaatgtgagtgactgctgatgagagagtccactgttgtttctggctctgcctcaaagggtggttgaaatgtttgttctctgattacctcagccatgcatcagcttgctgtggctggggcccatggctcagtcccagcagctgcagtcttgcgttaccatttttcttcctaactggccaacgtcctgttactcatccctccccagttgtgatcaccttgtgcgtgttacttgaatatgctgctactatcatctgtgttctgtacattctttccatagagagttgtactgtgcctgtggtattctagcatcatatttatagcaactcgtagctggggaggaacaatattatgattctattttaaatgatctaggaagggacccaagcctgggctgttaagaaatctaatatccatagtgtctgctaaatactctaactgtacatctctttagatcctttgggtccctgcctttactaatctggaatcacttttttttttttttttttttttgagatggtgtctttttctgtcgccaggctggagtgcaatggcgcaatctcggctcactgcaacctccgccttcctggttcaagcaattctcctgtctcagcctcccaagtagctgggactacaggcacacgccaccatgcccagctaatttttgtacttttagtagagacggggtttcaccatgttggccaggatggtctcgatcttttgacctcatgatctgcccgtgtcagcctcccaaaagtgctgggattacaggcgtgagccaccacacccggccagggcatcacattttcatgacacatgctcagaggacctaaatcatccaatgttttcattcactcctttcataaggtcttcatgtggatctgtgttcaaacattaactgtcatcactgcttttttactgcctcctaacaatatagctgacaagtaaagaaaagatagttcttaccattgagatatttttctagatacagtgttctgggcatatgaggcctggaatttctgcaaccaactttggtaccataaaagaagtcagcctgaggatgccagcacacataggtagtgctgaaagaatcgtaaagaaatggagctggagtcttgatcaaacccttcctgaagctaatcttgtaatttttcagttatatgagccagctatctttattgtttaagctagtttaaggtaggttttgtcctttcacctaaagagacttaactgataagagaattcccaatgtatttaagtgtaaacatcaagcttcttatcacacccttataagccccttgcctccttttctgaccttttctttcacttcctaactcttcaccatgctgtgattacatagttcttattccttgaataagactattctaccttccagttgctgctccctcctttctaacggcctgctccatatcttaagacatttaactcctgggcattcaagtctcagctcaaatcccacctcttagcctggacaacatagtaagaccccatctcttcccacccccaaaaatgttagctggatgtggtggtacacacttgtagtcccagctacttgggaagctgatgcaggaggatcacttgagcccaggaagttgaggctgcagtgaggtgtgattgtgccactgcactccagcctgggtgacagagtgaaaccctgtctctaaaaaacaaaaaaatcccatctcctcagggaggactttctgatgatctaatttaagttacgttccccactgcccaccccacattccttcttgaccaaaataccttgtgtttgttagagttcttatccctatttgaagttctttatttttgtgttggcttgttgattctgttaccttgactataatataaggcccacagggcaggggcattgcctgtgtcgttcatttctctttcccaagtgtccggcatggagaagtactcaacaaatatttgctgaaatagcaatggccttttggatacacacactgtgtatgagggtccagctgggggaggccctctgggtagggtttaagagcaactgtccattccagtgcattctcctcggggtttagttgtcttcttcccatgtcatgcagttgtttcatctatgctgcctagttctatttttttgtctctgctctctcaagaatctgtttcttctttaggaggaaataagaaagggcacttagtgtttagttgtgaacgcagactcttgaaggtgagaaaaaagaagatttgacttcaagaatacaagaggaatgagcaaatgacagtaaggagccggaggcagccaggctgacctgtgtcatgagctgtcctactcactatggtgtattcaatcaggcataaagctgtgattctcctagggctcagaggaggcagccatgctcttgtcttagcagaggtcaaagtacaagaactgatcagagcagagggtttttctatttattacaaaagttgttacacaaatacagctgaccagaaggtctaaaaacagcccagactcttccaaccctcatgcatctgtagatagaaggagagctgtggtcttgctcacacacaggggagcccttcttagaagaactgcctgtcccttggaaggttcagagtcttgggtccagcagcagagaggagcccaacctgcgtggacaaccccttgaggcagcccttggtcacagctgctctgggtgggcagcaggtttaagtttcatagttcacatgttcccaccacacaagtcaaatcaaggcatgaaaataaaagggaaaaaggggaaggctggaaaagggagcctggaagaggttgcaggtaggggaaggagacacagtgggcttccgagaagctggcaatttcttgacttggatggagttacgtagtattcactttaaaattattctttaaattgtacgtacatgttatatacttttcagtatgcatatctttaaattttaaaaattaaaaaaagaggctaaaagtgaataaaagggcagatgatggaatagaaaagaaattaaagaggagagacgacgaaggaagaagatggccaaggtggaaaacgagaaagtcctggaggtgataatgctggcctcagtttctcttcttctgtctggatactggttctacttctagataccggagcccgaccagcatacccaggatggagaaaccttaaatacagaggaaagactagtgactaacatacatacggtacctttcttctctctctctcctgtgtccaccctctgtactagctctagagctggcacagctcctgtaggaggtctagggtggttggatgcttacttgccaccatcaggggtgccaggacgccaatcgtgggagctgcagttccatagacaaacaactcagagaggaaatgccccagggcaaggaggaaggtccagagtgtgatgtgatagagcctataaggaagcagacagaaatgggaaccaaagttactgtttgttcagaacagaggaaaagtatcagacttcatacagacaaataagaacccaggatgtcattaagacttaaaagaaaggacacttgttcctgaggaagagctggttatttgatcacaacgatattctcatctagggcaaaactgaaggtttcaactgctaaactgagaggagaatggttcaggcatccagaatgaacgtccaggtctcagcaaagtggtgaactcagctatagcaaagcagagcctgaatgatgacaatcgcaggcagtgtagacaactttggatccagcacgcttacatattctatttatccaaattggttgactctgcagtctaatcccacctggcaggcatctggccatgcacttgtcggtgtttataagatggatgccacagaacgaacggcctcatggggagtaaggagcaaggacacctctggggcttttagatgctcttgcaatatacgttggttactttgtgccttagcctagaaaagtagtcacattgaggacatggtgacaacctcatgggaaaagaacttatctttcagctttgactataaggtagagaagagacaggctactaggtgactgaccactttgtttgctgatatctttttagtataaaattttttaaaattatgaaatacttcaaacatacaaaaaaattactgaacactataatgaacaccaatgcaaccaacacccagctccctcagatcttaacatcttgacattttgtttcagactcttctaataaaaacttacagagaagagttaaatcatcctgtgtatacttatcctgctctaagtctgttctccctcatccccacaagtaactggtatcttacatttgatttgtatctctcctgtgcatatttttacaccttttttttttttttttttttttttgagacagactcttgctctgtctctcaggctggagtgcagtggcacaatcttggctcactgcaacctccgcctcttgggtcaagtgattctcctgcctcagcctcctggagtagctgggactacaggtgcacaccaccacgcccagctaatttttgtatttttagtagagatggggtttcgccatgttggccaagctggtctcaaactcctgatctcaagtgatctgcccaccttggcctcccaaagtgctgggattacaggcagaagccacccgcgcctggcccattgtggaaacaatatgtatgtgtgttgactttcagtctctagttagggagggaataggatcagaatgcacatcagaagtgcatcgatcaaagtcctaggctagaaaggtctagaaacaggagtcagcgtttgcagctgtcctgtgtggggagaggtgaaagtaaatggtaactgaggtaaagataagtctgggtcaggccgggcacagtggctgaagcctgtaatcccagcaccttggaggccaaggtgggtggatcacgaggtcaggagttcgagaccagcctggccaacatggtgagaacctgtctctactaaaaatacaaaaattagaggggcatggtggtgcgcgcctgtaatcccagctactggggaggctgaggcaggagaatggcttaaacccaggaggcggaggtggaggttgcagggagctgagattgtgccactgtactccagcttgggtgacagagcaagactgtctcagaaaaaaaaaaaaaaagagataagtctgggttgtcttcgctcacttcaaaagcacaacaatcaaaagatatatccctcatactcatcagcaattcttcattgtggtacaggtctttaaaatgattgttcaatcctcccttcctcttagtcaccctgagaggtagaacagatatctattctcattttatggatgaagaggccaaggtgcaaggaaggtgaataatggacttgctactgcaaagctagttaccaacagaactgggcccagaactaaacacactgcttccaaaagtatgtgtcattctaggacaagtaaactgcaggttcaagtttgaaaaaaaattaaaaaaaaaaataaggttgaagagatcaaacggctaatagccctgcttcaaatctcacttgagtcagtctttctttaaactaactgtatctctaatatttagatgtgcaaaatcaggaatgaaaatcatgacctccagggctgctaagaaaagacttaatcaagatcacgtagataaaagctcagcataataagaggggctcaataaatattatcgcctcctgttttccccagatgccaagagcctggataagacagaaaaacattttaatgtgaagttggcattcagatagcctccctcggtgacctgaacaaactgtttccacctagagtgtgatgatgactcccgctgggaagaaagctcgagccccctctagtggccagcactggttatggcttctgattgcctgcaattgttccaccctggtctgtttgagtacccaagacaggtagattcaggagccctagcttctctttcaccctcacctgctgatgctgcatacacatacaacagtttacttgtgggttcctcttttttcatggattgtgatttctgttcattcctgcttcttaaggaggaatgtgagaaaggtatgtgtgggtggctactctaaaaagagcataccactctacttctttagtagaagaagggctgattctttcataaagaagtggaggggcatgatgcaggccactggataatggcctgccagtttgctatgtcagttccaaagaattttcagactttaatgaagacctgttaggtctactatgttttctaggcttggagggaatgtaacctgtgagttttttattattcacattctaagctaatgcattaaaatgattaacagttcccattactcaaggtaacaggtatgcctcgcatctgatttccaacaaaaggatgctaaagctcttccttcccttacatacgtcttgttgtgaatgtcaatggcacagaggcagcgaatcactgatgagagcagcgtccagatcccaaaggtccgagcttggaggccattcactgtgtagcagaaaaaagcaagagtgttcagaaggggagacttgaggttccttccaaactcctcctatttcactggtggttcatgggagatagggagctggacctgacctctctgtggctgggcaggatggaggtcctagtggcaacatgggaactagaaggaatagaaggaattccagaatgagaacttctcagattctcttcaaatgtctacagttggaagggaagttccaagagtggaaacccacaaagagcccagttaggcaaataactcctagatatagtaatttaccccttttgtcctggaagcctagagggtctggatcaggacaggttttggggaacgttgtagagactgatctggaaatgcaagatgcccaggaggccagcagactttcaaggctgatccaggagagaactcagagatactggggaccaatttagatgcccatatatggtctttaagatatgtgagtgcctgggtctcttcctgcatccagatctatgctgttggatgaaccaataccaggttggtttcctgtgtgcatggcagtgggacaaagcactgtttctttggtgtttgctgggggcatcctgctgttggtagctttgttctgacattgctgtattaaatatcttgtcctgaaagtataggtcatattccaccataacagtggttcttgactttgggcatttattacaatcaactgaggtagttttataaaattacaaggcctgggtaccagaccaactatatcgtattctctggaggagggccccaggcataagtattttctagaaactccctgtttgggtaatttaaatgcaaaaccattgagctaaggcatccagtggctcggggatgccaaaacagtgaaagcaaagatacttcctttgctggtctactacctgctgagtaagataaattttaagggacaaaattgacaactgaaaagtctactaatgtttacttgggctttaaggatttttccagcctttggaaaatcagacagctctcccaaattcacaatactgaagaccattagatggtagtgagaaaaaattccatatgccaaccaaatatctagcattagccctggatagctatattctttataaaccaatttgataatgagaagactaaggacgtttctctagttaagagtactcaaccagccctaaccagattaggtatgaggtgaaattctgtgggacactttagagcactgctactttcagaagagtaccatgaaggcccctagatcacaagggagatggcagcctcagcttccgtgctggctgaacacacacacacacacacacacacacacacacacacacacacacataaagttctgctcagctatatgcctttaagtcacatgacctctggacctctttgcctcaactttaaactcaaagggctagaccagatgacctctaaaaatgtgtgaatctatatagggttccatgaccacctgagggcagcatttgaaggtgaaaagatggaattattctgctcactttcccaggttctttactcttattatatttgagctttcttaaaatgagccttagcctacttaatttcattttatactcagacactgcagaaaaacgagctaggtcagagcctgaatctgggttagctataaatgtgacacagaattgtcatctgctgtgaaacagtgctgcagcttaaactaccccacacatcagcgtgatgaagtggaagctgaaatggacactctcagtagagaggctcaggaagccaggaaaggctgccatgggccttcttaagtttcattttgggagaccaacttgaagggattttaaataccttctcagggactatgtcacggaagaccttgaattaataactctccatctgtaacatggaatatgagtcatgtaagccccagaatcatgtaaacctgattctgaagagggctttgagatatatgtaaagcttctttatggctttcttgtcaggcatcacagagtcaccaagtaagtctatttcctcacttgcccttataatgcttttttttttttttttttaaatacatgaattgcccagggcagtgtaaaatcaatgaaaagtattcagagaagcttgggggaaaaagggtcaagtgctcaccacaaagtctattactccagtagctgccaaaggctagctaaggcagcatcagaatcatctgggaagtgttttagcaactggattcctgagctccacccaggttcaataaataggtttggtgagggaaatgggtacctgtgtttgttgacgtttcctaggttactctgatgtacagcctggtttgggaaccacagcatagggccagtcctataagtcctataaaggatgcagaaattctttgatttcttaccaaggtttggcttgccagtgtagagcttttcatagagaaaagtgtggtctcggaagctctgcagcgtgttccccatggctatgatggacaccataaccagccaacttcttaacacattcaggaaacggctcatgactcccctcaaacgtgggagggctttttgccttggaaacaaaggcagaggacatgagacaatgagggccagtctatgttaaccataagcaggaagggaggaagaatgaagcaggccaaaaaaagaaattcagtcacactaatagtggtgaatgaacagtatactttgcaataagtggcacagtacttatccttgtctaagcaatttctccaaaatattaccctaaatcagaactcctttttctgggttggaatcagtcctctatctttacttctataccttcatgttttcatgccattccttcgtaatgcaaatagctcaaaggcgattataactatactcacagacacctgcctggctattgatgacggattcttccaagtgtatggaactttataaatttgagtaggacttatggtgtgaggtcactatttacatccctaggttttctggactctggttctcaggtataccatgctccataaactagaagaacaatctaaaagttaaaaataaactgctgtgtgtcaactccaaataaaatcctaagcccatcacggactgaacagagcccctcttggcctaggggaccccagaaaaatcctaaaactgagctcctggccatgacaagatgggaggtctgacatgccctgttatattcgttgtgttttcaggtttagagacagcaacttaccagcattaaagttaaaatagagatcataagaatgacacaacagattctttgtgcaataagataccaaattataaacaagacctaaggccatgccaggcaagggttaagttacacactcctacatttaaagaataaaagttatattctgccacaaggttttttttttctccagcagctagatgaacactggccttgagataagcaatattaaaacaattgcagctcatccagctcacagaggctgactacctgacccctgttccaccagttgtaactacagctttgattggacaagagactgatttcagtaattttctccagataagaccaccaaccgtggactgctcctggccagtttagcaggatcacacacttgagtgtcttggtgtcctgaaaagactttttgacgtatagagcctaggtgtgatagacttaaatgttaggtctccactccaaagtgaacagggttcatatgtggttacatatgtttgttcaatatgcatgtgtcaggacaaccttcaggaatattcacagctcctcctgtaacctgtcgaatgtgtatgtttagcaaacctgttcagcatgaagctctaccccaaacccttctccttcaaagtaactgtctctggtcttggtgggaggcactcttccctgttgggtggctgtaaccctttgcaagagataaagcctcttttccttttttccaaatttataaattgtgtgtgtttaagttaacgtgtgagtttaggactagtaagaaaattatatagcgaaggaaacagcaatcttggtgttgggttgcaagaaaataataggtttcagtcattgagcacttacaccgtgaactgtgccaagcacctaacatatattaccatttaatctttacaatgaggtaagcaggcactattaatatttccatcttacagatgagggttggaacagagaggttaaacaagtttcttaaggtcacacagcaaagttggcagagctgagataagaatcatggtctgctggactgctgcagtgctacctcattgtttgagactattttaatgaagttcccattttttgagaaagaaaagcataccatatccacttttgtcttcaagttgtatggaaaatacaattagattacatactttttgttttttaatttattatttatttatttatttttttgagacagggtcttgctctgtcacacaggctggaatgcagtggcatagtcatggctcattgcagccttgaaatcaaaggcttaagtgatcctcctacctcaacctctccacttgggctcaactgatccactcaccttggcctcgcctcccaaatgctgggattacaggtgtgagctacagcacccagcctttttttttttttttttaaggcttagttcaactcttgttgagtagtaatttcagttagtctgatttaaataaaaccaaaatagataaataatctaataatggaatgactttttcccatcctcattattattttcttggtccacggtttatctgttgtcaggttaacctcttgggcctgaagtggtaataaactaacaggctttctttgtcactttggcaatacaagtttcggtattgttctctgctacccagtgggacagatattaaagtcagcaatggcccaagacagtgtgaaacaccgccgcccccccccgccaactccccgccccaaacaagcaataaagagatctagagaaggaagggtgaattgatgagcccttcagggagagctggatcacaaaggtggtctctgtcgaagatcagagagactgagggtctactggacatcacaggccattatcatttgggccaagatccacccatcctctttattttctcactctctctcaagaggagactcctccggggtttagaaaagctgcatggatgcacctctccacttttctgcacaagtatgccttccatttcacagaagtgttatctgttagaaatcccaacagatagctgatgaggacagagcctgagcacttctgaattgctctgccaatttctcaacctaatttccctaaagcttaagggcctcttagagtgtatacaacatctatttccaaattttgtcctggccctggcccagcccagccaagcccagcccagcataggtgtgctgttaaaacttaatcaggagaaagggattcttatcctggccctaccacttagtagctgtgtgaccctgggtaagtcatttacacttttcagtctcggtttcctcatctgcaaaatggagatagaaatatcaacccgaagggctattgtaagaattatatgacaaaaagtgaaggctctttgtacagtgctaggctcatagtggctgctcattcgctcatccattccttcgttccttgaattcaccaagccttctccatcttcctagctcccccttgtcatcgcctctcgaaaccttttccccccaaaaggttgccttccagttatcttccttccatcccacctccatttttccagactctccggatcctctcaatcagaagcaacacagacacctacatccctcttctcccccatattctccttacctggcgaccgggcccccagcacagcagtggcagcagcagccgctgccgcaaacaagctcccccaggacagctccagcccggagtccacctgagccatttgtccccgccccctccctcagccctgctccaggattgggccgtttccgtcagtactctctctgattggctgtcccggtttcgcccgagcaggagatggggagtgaacccctttactgccaatcagcggttgccgctgcctaagcctctccccaggtacgccgctcacgccgtaagccctcctgttggacctagcggaactccgggtttggagtcaacctcttaggggcggagaaaaaaacagcggaaaaaaaaaaaaaaaagaagactcccttcagctgagggcagggctctgcgcccgcgctgcgcggcggtgacgacattcgcccgcgtccgcagctgagcgttatgagcgcctgcgcagtggctccgagcgggcggttgcttgttggttgttgtagtaaccggggaagcagccgtcggcggctgccctgagccttcctggggaaggaggagggaggtaggcgcagagcgcggtccacgcctgctcgccccgaaccatgggaagatgagacaggtaaacgcctgcgcccgcgcgcttccctaccctagggaggagcattcccgggtccgggctggcgcctgcagcaggacttcccgctcagagcccgggagtagctgttggcttccgggcgcgccgcgttgaatcgcggctgcggggtcgtcccgtccttcccggggggagcatctgcggacctacgtgggattggggtgagctgggggtggggctgagaagcagattcctttcgggagaggagtctccttaggtgagtatctctactcttcttccgatagacctgtttctccccgctctgcaggcagcctaggagaggttggcatcccttcccgtttggaggttttgtttgtttaaacttaaagggcttcccagcattttgggaaagatcaagaaatcccgttgagaatcccctgaagaaagccattgaagttgttagacattgcctattgcgccgaagatctttgatcattatcggggtctgttttttttttgtcttatttacagtctcatcgtatttatgaatgcatggaaaagttaagaaggattgacagcaagtaattatcgctgagtaatttgggattatggtcatttaaacatgtttcttttatttgtagttcctatttcttcttctgacacacacaacgaacatgtacttttttactttagaaaaaatattttaagttagaaatgcagtgttggaaatttcctaatttcatcgtctatttgagagtcgtaccaaactttgtgatttttaggaagaataatttttaagagtggaagggcattcctcccctcccccacctatttatatggacctttgattcaagagaatatattcatctttcggttcattgttgaatttattttactggaaacatgatggcatcttgtcagcgtgcttgtcatagagtctaaataaatgttggcaggggttttttgttgtttttttttttttgagacggagttcactcttgttgcccaggctggagtgcaatggcgcgatcttggctcaccgcaacctccgcctcccgggttcaagcgattctcctccctcagcctcccgagtagctgggattacaggcatgagccagcacacccggctaattttttgtattttttttttttttttttagtaaagacggggtttctccatgttagtcaggctggtctcgaactcccgacctcaggtgatccgcccgccttggcctcccaaagtactgggattacaggcgtgagccaccctgcccggcctgcaagggtcttaaaccttgagtttttatttatttatttttaacccaggccaggtttgtctagcaaggaatatatgttttagggaatcagtcacctgcctcaaactgagtgaaagtgaggagtctatccttttggtgcatattcgatttagtaaataatgagaaactcaaacttagtaacagctcttcaaatatatagagcacagactgtatgtttgaaaaaaatcttgatttttgtggcatattgaggcacatattgaggcacattccatatgttatggaaagtaaacttctagaggttgagcactgtttaggaatatagtcattttcattacttagattatcagcaataaccaataaatagacaactgcattgtgtttcaggtcaattgatccaatcaagttgatttcttgcaggaatctgtgccatccaaattgcttgatccagtgaatctgctaggaaaggtctctgaggcccccgtctgctgactgcatgacaaaccctaaaggaaatgccaatcgtgatggcccgggacctggaggaaacagcatcatcctcagaggatgaggaggtcataagtcaagagtaagtaatagcaagcctgctttcaacctgtgctttgtactctttcacttatatactcttatatactgttttactatatactcttctcttttacttatgtactcttttatctagtgtcattccttggggattatctaactctggttttagcttctatccataatgtcatttaaggtcttgttactcagtccctatcagctatgagaaatgagataaggctctctttctgggcccataagtgaacatcagctctagatgttgtaaaatgcaagtagtagctcttggtgaactcttgctcagaactcccaacagaagattttgaaatgtttaagtattgaagaaaagcatgtccaaactctacaacattagttacgtttgctaattttctcaaaagcctttacaatgataaaatggtggtaatatagagaggtcaggtaacttaccatagtaactctgaggcaggatattagagttctatagcctgtgttgtgtccattgacccacactgctttcctgagttcttttagttaagagtccaatttcatgattactggatcatcacaataagaatgaataatagctaggtgtgttggcttatgcctgtaatcccagcactttgggtagccgaggtgagcggatcacctgaggtcaggagttcaagaccagcctggccaacatggtgaaaccccatctctactaaaaaaacagaaattagctgggcgtgatggtgggtatctgtaatctcagctactcgggaggctgagacaggagaatggcttgaacctgggaggtggaggttgcagtgagctgagatctcaccattgcactccagcccgggcaacaagagcaaacctccatctcaaaaaaaaaaaaaagaatgataatgataaatatagctactacagatgacgataaaggctttatctcatctatatcttatatctttttaaatctgaaggtgttattattttcacttttttaaactcagtcttatcaggaaatttcctcagtgacccatagagagtaagtgatgcattgagatttggacttagcttttctggattttgatcactttgctcttttgcctcctttaattattgcttgacacagagtaaagagagaatctggtttaaaggtaaaattcatttttaagattctccctgagtccttttggatatgtgtgtgctatgtaacctgaaaaatagagataatatctcccaggctattttgtaggggtctggttagactcaaatagcataatgtatgtgaaattactttgtaagtgctatacaaatgtaaggcattatttttactggttttaatattgaatttatggtgggcttcttgtaagatacaagattacttgtaatttgaaaaaaattgttgaagcattaagaaagctttgaggaaacgtttcttatcactgttaggtcatagaaactaatagagatttgaaagtatatttgggtcattcttgttcaggataattaaatggataattccctctggttactttcccttcttctgactttttgctttcggtgtgctgcctcttacccatttcataaaacttttaacttctgctgcaagtatcagtctttccctttttaaaggttgttcttttactccattactgtctctcttattagtgggtttacagattgggcctgacaaatgttagattgaactatatgaaactgccattttggtaggtcagaaacagtcaaatactgacgattgcagatagtttgacctaatattatagtaggtacttagtaaattcttgctgactgaataacgaaatgaaggaataaatgaaggctttatactttacattaccttagatcagagttgttaacttttttatgccatggattccttaccagaataatgtttttaaggcttaaaataaaatacatattattacaaagagtactaattacattcaaatgcagttattaaaacacatttgtaacatagtaatatgtgctgttttactaatacattaaataataagatcatttcaaatctgggaaagttaaattttgttttctaaagacaacaacatgaagactgtttttgtttagtttgtgtaagatcagtacactgggagggtggcctttgattaacaatcataggtcgggggtactgggaagcagcatagatgtctgggtcaccagtgtgaggtgtcatcatttagtgactgaatgattattaggaggagagttgcccaattgttgtccaacctcatcacactagcatttagatagaaagaccatgatcacatgtgatctaggggtgagtcttaaactactataacttagaagtagtgacaaatgtaatacctgtaattggccaggtgcagtggctcacgcctgtaatcccagcactttgggaggccgaggtgggcagatcacttgcagtcaggagtttgagaccagcctggccaatatggtgaaaccctgtctctactaaaatacaaaaattagccgggtgtggttgtgggtaatcccagctactcgggaggctgaggcaggtgaatcgcttgaacctggaaggcagaggttgcagtgagccgagattgtgccactgtgctccagcctgggagacagagtgagactccgtctcaaacaaaacaaaacaaaaaaactgctgtaattttagataacgtcaaaggcacagataatgctaatattactatggttcgttgcctatattcataattaagaaatactgaatttctagtaaaagttagtgaaaataaaggtgtaattttccctctgctcccatccaaatttatggaccacttcctccttttagactcctactgttgatttttaactgttaatcttgtttcatcagcttatgtcttgtctatcagacacttattttttacattaggaagcttaaatcaatcttgttcacacctgaagcagcaggcttacattttaaaagttgatttagaagtttgaaggccataaatcatcggaagatgttgacttgatccaaagatgtatatccatggacatctgttagatctgctcagatccctaggctgtgttaaagtattaattccttgcaatcgtggacttcaggaatagaaactatccaggcagtcttgttttgcatggtattatttcaaatagaaaatgtaaagaggctgtttttctatattttgcttggggatcccaaatacaactctgtatgtagatatagaagctttcgtagaagaacgtgatgtaagatttctttggtcactgaaaaaatgtcaactttaattgctattgtaaaaggctggctttatatcagttaaaaagattattaacaatcaattataaagtgggtgctataggagttcagagaaggaagtatcgtaatgggctgaaggagctggggaaggctgcctgaaggtggtgagactttaggtaggccttggagagtgggcttagataaacagaagtggggaaggcatttctaataggggtagtggtatgaagacagcctagaagcaagaatgcaaaagctgcttacagctccatctttgagttatgtaggctgggtcccaggagtgaatgatgtctatttctcatgaaattattcccggaaaaccaaaatgtttttaggctttcaataaagtgaatcataaaactgatctgcttcggtaattattcaaatcctttgtttttcatgcctataaaagtggattttaatatgtaccagtttctgatgtgaatgagaatataaagtcccaattttcagtttcctaatcattctgaattttttccttttagcatcacttggtgggaatatgtttttcatgacaacttcgcatattccttaagtgctttttttttttagctgaccttactgtttactctctcttttatctttccatgggttggaaatgaaaagatttctctgttagagacttggctttctacagatagtacagttagggcctgggctcttctcagctgtgtatctgttgattgtgctccccttgtcaggcattttaaaattggagcagcaatccattgtttataaatgctaaggcatagtggtgccagctggtagctagtgctagattgacagagaactttggatagtttccagagttcctgtctgagactttgtagtttaggctgcctgtttttttctgtacttgctgatttagaaatatagtggaaaaattaaggttggaagagatcataggaatcacctggcttcatgcccacattttacaggtgttaaagatgaagaagcaagcaagccacaaaaaaatccttcctgctaaaaaaggtaccctatcagcaccgtttctcacaagtgggtactgtcaccaagtcaaagaacaagaacaataagcatccacatgccatttctagaaaacggggaataaactaggtatgctgttctttgctttcttcactagaaagcagttggcagcttgtcccaagtctaaagactgcctcactcctaagattgggagccttacagactgtgcattcagagtgtggatctttttatgtttttttttttttttttttttttttattgagacggagtcttgctctgttgccaggctggagtgtagtggcacgatcttggttcactgcaacctccgcctcccaggttcaactgattcttctgcctcagcctcccgagtagctgggactacaggtgcgggccaccacacccagctaatttttgtatttttagtagagacggggtttcaccatgttggccaggatggtctcgatctcttgacctcgtgatctgtctgcctcggcctcccaaagtgctgggattacaggcgtgagccaccgtgtccggcccgagtgtggatctttttaaagttggattgggaggggctgacttggccctgagatttgtggtatgacctttgttaagggatgtggttatgtgagtttttaagagtcgagtgaatcttggccaagtggattgtattgcatttaaggaattatcagtttaagttcccaaataattgaattcaaggtatccaatatatacaactttgctgaaatgcgattagggaggcaaacagtagaaagaatacagatgttaggttcaaatacctcatcccttacttaaccagctatatgaccttaggcaggttacttaacctttctgagacagttttcctgcagttcatagtatgggcagggggattaagtgagatatgagagctcttagtttaaatcctggcacatagtagggactcagttcatttaattttatttctcttcctacctccctgccctaatgagggtgaaggtttttctgatctgtgagtaaatattcatcagcctaaaattaagctgagatttcctgaggatagggaaagagaataaagtcagaggtctttttctcccctgtggttttatactggaggaaaatatatattgttccatttagcatgggcttcctttaaaatatgtgattttaattgggatacttgtattaatttagagttcctagttcagagtcttaggatgcatcatcaaattggcttgaaaatggactatagcgtgtaaaaggagtatgtaaattattgtgaactcatcagttaggattctttatgtgtgcaaaggattacaacataatccaaatggtcctaagtaataaagagaatactttcactcatattcaggcatatcttgattctgaaaatcccactttatctcttcagtcaacctcctgctgactttctccttcaccaacagctacaggctcttctttcaaggtcacaaaatggttgttgcccttccagacttctcattctcatcctataccatcaagaggaagacaggctatcatctgtagccattatagaagagaaagaaaccattgctttctcacagagtccagaacatgtctccttaaacttatgggctccaattggtttatgtgcctatctctgaaccactaattatactggatgatgaagtatcttgattggctgaaaccaatcaaggcccatccctgaaccagggatagagttaattttaaacacacagctaagaatgggagatgtgatttcccacaggatatttgggatttgtattccagaaggaaggggaaacttgctaagcaacaaaccatagtaatctgcatcagcagttagttcaggttttgagctgtaaattaatgaaggcttttttgtcgttatagggatcatccatgcatcatgtggactggaggctgcaggagaattccagttttggtattccatgccgacgctattcttacaaaggacaacaatattagagtaattggaggtgcgtataacctctcccacagaggacggagctgggcatggcccagacgtccttgtcttaaagaagttgatatgacatatatatagggaaagggccttggccatgagaaaaatcaattgagttgttatacttcaaacattataatttcttaaattgttttctgcttatgtttttcctctgattttttttcaagaatattgtgtacatgtgttttttttttaattgtggtaaaatacacctaacaaaatttaccattttaaccattttagagtgtacaagtcgttgttgtttagtacattcacaatgttgtgcagccgtcaccactgtttagttccagaacattttcatcatctccaaagtacagccaatacccattaagcagatatccccagcccccataccaccagtccctggcaaccactcatctattttctgtttttatagattcccatattctggatgttttatataaatggagtcatgtgatatgtgaccttttttggcaggcttcttttcacttagcataatgtttttgaggttcatccatgttggagtatatatcagtcctttattcctttttatagctgaataacattccattgtatatgctaatgaatgcattccaatgatacaccacattttgtttatccagtcatcagttgatgtacattttttttgtttccacctttttttttaattttgtttttaaaatttatttattttttagatacaggatctcactgtgttgcctatgttggtctcaaactcctggccttaagcaatcctgccttggttacatgcataatccactgtgtctggcctttttccaccttttgtctgttgtgaattgtgctgctatgaatgttcacggaaaagtcgtttggacacttaatcttcagttctttggggtatacctaggaatggaattgctaggccatatggtaattctgtgtttaacttattccgtgtcaaactgttttccatagcagctgtaccgttttacattcccgtcaacaacgtataggggttccagtttctccacatcctcactaacatttgatattttctgtttcttagatcatagccataccagtgaatgtgatgtggtatctggctgtggttttgatttgcatttccctaatgagtaatttgaatatctttttatgtactttttggccatttgtgtattttctttggagaaaggcctattcaagtcctttgtacattttaaaaattgggttttctttattgttgttgaattataagagttttatatgttatggatattagacaagatatatgatttacaaatattcttactctgtgaattgtctttcattttcttgttagtgttctttcatgagcaaaagttttttgttttgatgacatccagtttatctaatttttcttttgttgcttatattctttgtgtcatatctaagaaaccattgcctaacccaaggtcatgatccctgtgcttttttctaagagttttatggtttaagctcttatatttagggctcaatagtctttgatccattttgagttaaatttttcatgtagggttatgtaagggttcaccttcattcttttgcatttggatatccagttgtctcagcaaaattagttgaagagactattcttttccccactggatggtcttggcactattgttgaaaatcagtagaccataggtgtatgggtttacttatggacttttaatatttcattgaactatacatttatccttatggtagtaacatactcttgattaccgtacctttgtattaagttttgaaattgcggattgtaagtcctctaatatagttctttttcaagatctctggccattcagggtcccttgcaattccatatgaatgttaggatcagcttttcccctttcttcaaaaatggctgttgggatgttgatagggagtgcattgaatctataaatcacttcttagagtgttgccatcttaatgatgttttctatgaacatggaatgtctttccaattttttgggcttctttaatttctttcatcatggttttatagttttctgtgtacaagtcttgtacccccttggttaaatttattcctaaatattttattctttttgatgttattgtaaatagaattgttttctcaatttcatttttgggttattcactgctagtgtatagaaatacacctgagttctgtatattgatcttgtatcctgaaaccttgctgcactcatttattagctctaatagtttttgtgtttaggtttgtctgcatgtaatatgttatctgcaaatagagagaattttagttctttctctccaacgtggatgccttttatttctttttcttccctaattgttctggctagaatttctagtacaatgctgaatagaaagagggtgtctttgtcttgtttttgatcataggaagaaagctttctgttttctgtcattgcgtatgatactagctgtgggttttcataaatgtcctttgtcatgttgagaaagtttgcttctattcctagtttgttgtgtgtttttatcatgaaaaggtgttagtcaaatgctttttccacatcaactgaaatgatatttcccccttcagcctgttaacgtggtacattacattgactgactttttgtgtcttgaacctcccttatattcctgagataaatcccactttgtcagagtgtaattgctagtattttattttattttgttttattttatttttttgcgacggagtctcgctctgtcacccaggctggagtgcagtggcacaatctcagctcactgcaacctcctcctcctgagttcaagcaattctctgcctcagcctcccgagtagctgggattataggcgtccaccaccatgcccggctaatttttgtatttttagtaaagatggggtttcaccatgttggcaggctggttttgaactcctgacctcatgatccacccgcctcggcctcccaaagtgctgggattataggcatgagccaccacgcccggcctaattgctagtattttgttgaacattttttgtctgtatttataagggatattgatttatagttttcttctgatgcctttgtctggctttggtatcagggtaatgctggcctcatagaatgggttcccttcaacctctgcttgctgtaggtctattcatattttctatttcttcttgagtcagttttggtagtttatgtgtttctaggtatttgtccattttatttagcttatctaacttgtttgcatacaactgttcatagtattcttttacaatccttttcatttctgtaaggtctgtaataatgtccccactttcacttctgattttagttatttcagtcttttctcttttttccttagtttagctagaggtttgtcaatttcgttgatcatttttattttattctttttgagtgacaaagtctcactctgtcacccatgctggagtgcagtggtgtaatcctagctcactgcagcctcagacttctgggctcaagtgatcctcctgccccagcctcctgagtagcttggtctgtgggtgtacaccaccatggctagctaattaaaaaaaaaaaagctttttgtagagatgggggggtctcactatgtttcccaggctggtcttgaactcctggcctcaagcagtcctcccagctcagtctcctaaagtgttgggattataggaatgagaatttgcacctggctttgttgataattttaaagacccaattttaaaattccaacttttgctttctcttgttttctgcattgtttgtattttatcaatttcacttatctctgctcctcttggattttaagcagtgctctgagccctggtgttagtctgtagccatcttcaaaggttataacactgtggatcaggactgtcttgtggtatggtggaaagagtgtacacttgggttctcagccattggttcaaatcccagctttggtatttcttagctgtgagtcttgggcaagtgacttagactcttttaaccggtttcattattagtaaaatcttaaccagtttcattattagtaaaatcattagtaaaatggagagaatatgatattgtgaggattacatgagctcatttaatgtccgacacatagtaggcgctcaaaacttgtgctgcttattttactgattgaataagatctactctacttgtaaatgacttttgtcttgtcccttaataagtcaggagttcagaggactgttagcattgcttctgggatttgaatcctccttcctccccaaggatccttgtgttctagtcacctcagcaagttgccaagttaccatttaaagggaagtggttcattcatgttctctgaagcctgagtaactgaagaccccttgctgagaaactccctctaaatatgatttgagccaaaatgttaaaggtggataaaaacaaatattccccccaaacatacttcttttggtctgcttgtcacataaagtaatcgatgtattctatggcaataggcggacccttcttttttagaatacctaacatttattggaaaataatatccatcaatgtcatctatttaagcaattactatttttttaggatccataagtctttttctttacacattcctgtgattaaagaaaaagccaccaaacttttctcaaattctgtgtttttgagttttctgtatctttcccagttccttgtggcttaataattttcttcaccttccttaatgaaaagaacaatttgaatgacttttggtagttgctgcctcagttttctgtattgttaaatactctcaatctgcaacttttctttttggctctcttaaatagctgacacagatctgttcagatcataagcctgtggttaaatccccctgagaagtgtatctggggcaatagttaccttctgttgatctcatcgtgttagatgccaaattggttttttctctttatgacatgtttcattgaattcactattaatatttttggtacaatatgatttctcgtgttttatttgtgaaatattccaggaatgtggcttttcttcattataaccttgtttttttcccaaattgtatgtactttaaatgtgtaaatgggattgtattttagagacaacataggtattttcagcttaaagtaaacttctagaatgaagcatttttctgtaatttgtccctgaatgtgtttatttagtaagtttgtatttgtatatactagcaatagatgtatgatgcaagctatatatgtgatttgaaattttctagtaggaaattatttttaaaagtaaaaggaaacaggtaggtgaaattaattttaataatatattttatttaacccaatatattccagaatattatcatttccacatttactcaatataaaaaaaccattaatattttatatctagtatatattttaacataacagagcatctcaatttgcaaaattttcattggaaatattcggtctatatttagattttataacttttatagtttaaaaagtaaattcatatactcaattgtttcttcccctccccacaggcaaattgtttaaaataggatttccagtaactgaatcaagtattcattcttaaatttaaattaactaaagttaaataaggacatttcaagtgcttattagtcacacacattcgacagcacaaatatcctaatcctaattctaggtaacctaattttctgatactagggcacagctacactatgttgccattaaaggagttatttttgtgttctacaagtcaaaaatgtcagctttatctttatcctatttcccatgctatttttgtttaaaccctttaaggcgtttcattgctctctaggtacttctctgtgttgacagttagattattggtttgttttcatttgctctgctgtggtctgtcctggaacttgctaggggtcctagcacttcaagttgcctctaggggcacatgtgagtggttggagaagaggaaattctgtggtctcttctatggtggaattgatgtgatgcatgttaagaggcttagaaataggatatttggcagtttgctagtagtcaaggaggaccatgctctgcctcatgtttttatacagaagaaaacatgggatgaggtggttctttcttaggcagttgggcagcttcagtttacagttgcaatcttccatttgactcttgtcatgggagagaaagcctaggcatattagtcagagttcttgttacgggagagaaagcccaggtacatattagtcagggtgttccagagaaatagaaccaataggatacaaggagacagggagggggaagggaggaatgaatgttgttataaggttattggtttatgtaattatgtaagctaaaaagtcccattatctaccatttgcaagttggagaccctgggaagttggtggtccagtttgaaagcctgtgagccagagagccagtggtatagattccactctgagtctgaattcctgagaaccaggagtgtcgagggcagagaaggtctgtgtcccatctcaaccagtcaggcagagagagagcaaaaccaatcacccttttgttctattcttgccctcaatggattaaatgattcccacccacatttgggagggtaatctgctttattcattccctatatttaaatgctcatctcttctggagacatcctcacagacacctataaatgacatttaaccaggtatctgggcatcctgtggcccagtcaagttgacacataaaaataaccatcattaccaggtttcttaagagaagcctagaaatctatatttttatatgaatttttccaattttcaatggcttagcaactaatttagttttattttgaagcatcgtgagtgacagaccacatctgcaggctaggtctggttcttgggtcactaatttgtaacctctagtctaaaatatactacccaccagccttattgcacacagagggctaccggacacagagtatatatgaactaaaaatctccagcagtgatgtttgcattctgtcattccacccttctttttttgcactactcttttggaacatgttcagtgtatctgagttgggttatagttaggtgatatggattagaagtggcttgtcactgcttactatttatgtattgtaagaatcagatttgccactgagtgtggtggcagttgtatttttcttttatattaggaggagtaggagaaataatattgatagcattttacttttttttttttttttttctgaaacagggtcttgctctgtcacccacgctgaagtgcagtggcatgattacaactcactactacagccttgacctcctgggctcaagcaactctcttgcctcagcctcctgagtagcttggactagagacatgtaccaccatgtctggctaatttttaaatttttgtagagacagggtctcctatgttgctcaggctggactcaaatttctggcctcaagcagccctcccatctcggccttccaaagtgctgggattacaggcatgagccaccacacctggcccattttaattttttaatttgctatataaaatgtataattatgtacagtgcatatactaatgacttttattatttttttactatataaaaataatttatactgtgtagaataattgtttcatagctttacatgtattaactgatttagtgcttacagctactctatgcagtaactactgttattatcaactccattttacaggtgaggaaattgatcatagagaaattaaacaatttattgaaggctacagggaggaagtggtagaatcagggtttgaaccctagtttgattctagagattctctttctctctctctctctttttttttttttttttttttttgagacagggtctcaccctgtcactcaggctggagtgcagtggcctgatcatgactcactgcagccttagcctttcaaggctcaggtgatcctcctgcctcagcctcccaggtagctgggactacaggcgcacagcaccatgcctggctaaattttgtatttttagtagagatggggtttcaccatgtttcccaggctggtttctctctctctctttttttaagagacagggtcttgctctgccacctgggctggagtgcaatggtgtgatcatagctcactgtaactttgaactcttgggctcaagcagtcctcttacctcagcctcctgagtagctaagactacaggcgcccacccgtacacttggctaattaaaaaaaaaaattttttttttttttgttagtgacgaggtctcgctatgttgccctggccgatcttgaactgctggtctcaagcagccctccagctccagcctcccatcgtactgggattacaggcatgagccaccatgcccagacttgttattattcccccttgtctcttattccccatgtaactgttctctattttctcacacaccttactgatcacctcccctgtggctgggcagtgaggggcaagcactgcagaacatgcacagaattgggttcagtccttatttctagcagtcactgtgtagctgatgatgctttgacttttcatgtgcaaaaatgttagtgatcatggttatcataatgaaaggaccagatattttttcatttttgtacacattttatttagaaaaattaaaaaccttcagacaagttacaaaaatagtacaatgaacgcatatagtctttccctggaatcacccattacttacattttgccatatttgcttctctctttctgaaccatttgagaattagtaaaatattgcatgccctaatacattattcagcttgtgactcctgagaataagggcatattctatataagcacaataatgtgtcactggcaaaatactgttatctaatccatagatctaatctatgcagatttccccattgttccaatttagtcttctatagtggttttttgtttttctattcaggatccaatcaaatattacattttgttgtcatatttccttagtctactgtacagccatttcctagactttttttttgtcttccatgacattgacatttttaaatattctagactgcttgttttacagatatccttaaatttgattgttatccatgtttgatggttcctacatgtttagattcagatttttaaaaatctgcaggaatattgcttagtgaaactgtatccccagtgtataacatttgggagtatgtgatgctattattttgcagtattggtgatggcacatttgatcatttggttaagactgtgttcaccagatggcttcattttaaaggtgccttttccctttgttataagcattctctggtaagatattttgagatgtatgcgtgtcctattccctaatagcctctccccattggtatctactgattcttgtttgaatcacttactcttatagtttttgtaaaatggtgatttttcatttctgtctttccttctacatttattagctggattctctgtaaataatagctttctcttgtgtggtaggcagaataatggtcccttaaagatgtctaccttctaatttccagaatctgtgaatatgttatcttacatggcataggatgaattaaggtttagatggaattaaagttgctaatcaactggccttaagataaggagattatcctggactatccaagtgggcccaatgtaatcacaagagttttttaaagtgggagaaggaggtagaagaggccagagtgttgtgatgtgaaaaagactacatgcaaccatggttgacttcaaagatagaggaaggggaccataagccataagccaaggaatggaaaagggaaggaaacaaatcctacccagagcccacagaaaggaacacagctctgccaattccttggttttagcctggtgagacctgtgttcgacttctgatgtacagagctgtaagacaataaatttgccttacaacaacaaatgtgttgtaatttgtcacagcagcaaaagaaaaccaatattccctctcgactccttgtaagtgtggatacatggattcttttataagtacattataatctatctctatcactattcatttttgcattcaaattgtcttaaacttggccctcaagagcccttttaagctcttagtgacatgtccctaatcagtttttgagtatttcccttttttgacattgcaagatattctaagcctattttgtgattcccacacatgattctgcagtgtttcttatgatgatactgcaaagacaaagtaatagtgactgatcactgggataacactgttacttggctttgaaagtttgcccacaagaatgaaaaggacgaagtgattgacattttaaatgttaatcctcctgtgtctgctttgcatggtgttcctgccagtgctgagtaagtagcagcagagatttatgaatatcttcacataaacttgaaagagaaattgttgtctttgactacagaggctgaatattgttctagagtctgtccatgagtgtctgtatcattcagaattgttcaattcagaaactgttcaatatgaagtcctctaaaaaaattcttcagcagaattcttagctaactttttcagttagtagtggtgcatagaaagagattgaattcagtggtccagagtaaatacattgaaatctcacatggtttcagactttccgctcccatagtggtcacaagcacaaacgcttacttggccctggcaggaaatgtgattgagtgaggcaggctggatcctgagctgaactgaagagtgtggcctgtcctgaatggggcaggtgcagttctccagctgattcttgccattggagagaagaaagcccaggtttccaggtttttttaagagacgtctagaaatctagagttgtatacgaattctttccatttcagaagctaagcaatgaattcaatttcatttttagagcaccatgagaaacaaaccaaccatgtctgcaggctggatttcatccttgggctaccagtttctaacctctggtctaagatgtactggtaatcagcattataggatacagagggctatctagagcagggattttttttttttttttttttttttgagatgaagtcttgctcttgtcccccaggctggagtgcagtggcatgatctcggcgctcactgcaacatccacctcccgggttcaagtgattctcctgcctcagcctcccgagtaggtgggattacaggtgcgtaccaccacacccagctaattttttgtatttttaagtagagatggggtttcacaatgttggccaggctggtctcgaattcctgacctcaggtgatccgcccaccttggcctcccaaagtgctggagttacaggcgtgagccaccatgcccagcctagagcaggggtttttaacctttttggtacaatagatccctttggcagtctggagaagcccatgggcctcttcgcagaagagtgttttaaaatagatttttaaaaagtacgtaattacaaaggaaatacattgtattgaaatatagtaatcagaatattttttaagaaattgtgacatgtgcttttttattagtgtattaaataacaatctagtgaaggtctattaactactataatctttaaatactatgagaataattgatattttgagatatactgtaaaataatattaaaaatatctgatgtctgttagtggcagggtcacagataatgttaatactgcctgttttgttacttaaaatcttaattgaagccattgttaaatttcaactagaaactagtgaaaaccaaggtgtaatttttcccccatctatgtctaatgacctccaaagagtctcattttaagaactcatggtccaaaatacgttcaacttatttataatcattttaatggtagcatgtaatgttattgagtataattaagccaccatgttacagtttatttttgtttttacagttaactttctagttactgaacttgattctgtttttctttagaacgttatcatttgtcttataagattgtacgaacggacagtcgcctagtacgcagcattctgacagcccatggatttcatgaagtaagtttatttttaatacctcacctgatctgctcataagctgaaaatcccagccacctaactgactttaccagttaacagggccagctccaggaagtacatgggaccaatgcttagtggtggtccagaactcagattgaattttggagtggctttaccagtttctgcttgcaatacatggaaaacgtttccagatgattttagaaaaaaattttttcttgctacgttcttgggcttgggctaggggcaccgttgcccataaggaattgtctgacacccaattaaggttctttgattgcaggcaactgaacagactttgcttaacttgaaatggcaggtggatcccaaggtcaggagatcgagaccatcctggccaacatggtgaaaccccgtctctactaaaaatacaaaaattggctgggtgtggtggtgtgcaactgtagtcccagctactcaggagcccgaggcaggagaatcgcttgaacttgggaggtggaggttgtagtgagccgagatcacaccactgcactccagcctgggtgacagagtgagactccgtctcaaaaaaaaaaaaaaaaacaaacccaaaagggatttgtcagaatgatgtgcagaggggactagcagaatcagagaaaaagctgaaaaggcaggcctttggaaggagagagaccaggacaagccccaaggatataggaacaggagtcttcagcacagccagggaaggtccccgagtgaaggtcagatggggagaggcctgcatggctggcaccgaggaggaacaggagtgttcaggatcattttctcaaggcactgccatgggcgtgactggactccattcattgtccttttgtctttccttgctcaaaaatcacattctggagatagaatgattggcctagcttgggtttggatccactccttgcaggaggggatgggtgggtgattgacaggttcttgaaaaccatggagtaagtcattctccaaagaaagttggaagattggaatgtaaacatcaaaaaggacaggcaaaaaggctgaacagacacttccactatagacactttgtgacagttgataaaagtctggttcctagcttgagatttgtaagagacattttgaggaagtttttttttttttttaattttttatttttagagatggagtctcactgagttacccaggcaggagaacagtggcatgatcatagttcactgtaggcttgaactcctgggctcaagtgattctcctgcctcagcctcccaagtagttggtactacaggtgcatggcaccactcctggctaattaaaaaaaaaattttttttatagagacagggtcttaatatgttgctaggatagtctcaaactcctgagctcaagcgctcctcccgcctcggcctcccaaagtgctgagattacaggcatgagccaccgcacttgtccgtgagggaagttctgataccagtttgtatcctgtcttgttgctgttttatttctggcacttaacatggcgccttattgttgaattaatggacaaaagaattttaatggatgaatgggtgaattctaagtcggtttgctactataaggtttatctctgatcagcacttcatactcagtttctgcaaggataaggaaagcctgagaaagaaatgcaagaatattaagagacatcatgggtttctatagaagggttaatttattttagtttctgcatcggggatttgcccaaccctcccattccttgaacttgttctgtgatacactgcttttgtctcactaggctcacgtactaattgggccaccccggtgagtacactgtggatgaaaaaatcactgtggctttttctgccattgcttttcctggagaaggggtatctctgatgtttttttgccttcttgtctttctgtctgccctcaggttcacccaagcagcactgactataacctaatgtggacaggatcccacctgaagcccttcttactgcgcaccctctctgaagcacaaaaagttaatcactttcccaggtaatgctctttgtagctgctttgcttcatttaaaggtacatgacattggggcatgtagccagcaaaggtaattagtgtccttaaagaagaggaagatgaaaatgaagaagaagaaggacttttttttttttttttgagatgagtatcgctctgtcacccaggctggagtgcagtggcatgatcttggctcactgcaacctctgcctcctgagttcaagcaattctcctgcctcagcctacccagtagctgggaatacaagcttgcaccaccatgcccggctaatttttgtatctttgggagagacgaggtttcgccatgtaggccaggctggtctcaaactcctgacctcaattgatctgcctgccttggcctcccaaagtgctgggattacagacatgagccaccacgcccggccagaagaagaaatttttctggtacggaacagcactctgcaaatcaaactgttgtgttcatatccctgagcatgaatgaacactttctaagggctatatagacatggatggttttaaaggagatagtttctggttctctttcctaaagttgagctgcttgggagtacctcatgaggatgggtttgcctttcttacttccccttcacagttactgttttttcacttttattaaagaatggctcacctagaatcttagtctggtatattgtccttaggtgtagaaattttcagggttccaaagaaaggtagaaaaaaattagtgtctaatttaattctagtaatagcataacaaatcctttttgcatgatggtagtttctatttctttgtttttaaaataattgaaggatgatataatctagctattagctgatcattaaacataattttgatgacagatcattttataattttttgatgtgtaattaggaaggagttcacagagttgagcgtcattggtgtttggatgaattgtatactacaatacttgcaatgataatcagtcatgtatatataaacagttatagccttacggtcacagggaattaaaaatatatgccaattcctatgtataattttgctgtacagaaggtatgatatgatgtaaaagacaagtattaaatacgttaggctaacctgttgtttgtgggaaatgaaagaattaaaaacaagagtgactgggggatagtgtctgtgtggcagtctgagggaggcttttctggcatgctgggaatgttctatacagaacttgagtggtggctacacagttgtgttcactttgtaaaaattcattatgccctgccgtgttctttgtatacttttctgtacatacgttaacttcattaaaaagcatattttaaaaagtgaaaattttactgacagagcttttcctttaataacattttaaaaatgaggtattgaatcttgatgttgtttaggttcccttcaatatacttaaaagtgtggtgttggctaggtgcagcggctcatgtctgtgatcccagcactttgggaggccaaggcagacagatcgcttgagccccaggagttggagaccaccctgggcaacatggcaaaaccccggctctaaaaaaaacaaaaaatttagctgggcatggtggcatgtgcctagcaacttgcgatgctgaggtgggaggatcacctgagtttggggtggtcagggcttcagtgagctatgattgtgccactgcactccagcctgggtaacacagagagactctgtctcaaaaaaaaaaaaaaaaaaagggtggtgttatgattttgtcttaatgtaatatttaccattcatcatattctttggaacaatttaaatttatgatgaaaaatcttacatgctagcttaaacatgcaagaggatatatagtttccccaaattattctaggatgtaccaagcaaagaagtttgaaaaccactgatgtggggcatctgtaggagagtgcattctttttcttagcctctggttcagtgtttgtaattccctaatgataagaattacctagggtacttttgcaaaatatgcattctcaggtcccattgcagattcatggaagttaccatctctagagaaggtgtatatttgagcactttcctagttaccttacctttccaggtaaatatgtacctagaaagctatatatttaaaaagcattgaggtaatttgtaacagggaagtttggaaattactgttgtagattacatcagcagttagtgtgggtcctggaccatctgtatcagaatcttctggggtacttgtttaaaatgcagaatcctgggcttcatcccagaattttgagaggtgagacccaggaacatgcattttttaggaagttctctaggtgattcttacatacactaaaaattgagtacctctgctctggatttcagaagagggccgtagataagaaagaaatgtttgtggtacctagatttgccaaagcagtttctgaactcatagaaagaaatttgaactgtggaacaggttgagtaagtttttaatgattaccacaaaggttcttagttggttttgaaggagtggaacaaatcatagatcaatgagtccagtcgaggctaaccaaggtgcctttttggagtactgtacacaagaatgtacccctgatataatagtaattattaccctggttttaaggtgctaattgccccgattttctttataactttgcctcttctatatccatctctcaatgatgtagttaagttctcaacggggttcctaacctgggtctttactgtaataggatcattatactctaaaattaaggcctgtcttgggtcccatctggaagggtcatttcaggcccgtggtgctagtgatgataagagttccacatagttacatgagaggttgggcagttattgctatggcaatacatttataaacgtggattagataaccatgtgtttgattttcctggacagtcctttttaaaaatatgctaaatgcttttccccctaaaaccaaattaagataacatctcagaaattctgatgttttagtagctaatctttctcaatttacattctacttagaattaactcagaattttttttttgccatgctatgtttctcagaaggtcacatctgtagatacctgtggtataaaaacttccagaatgctttggtttgggagcttgcttttagttggagtactggtgtttttttcactatctgagtaatccagatgattttatgctattagagaatcatgattccattaaagtaaaacacacaggggtcctaaaatattttataatgatttataatagtgaatagcacagactctgttgaaggttttgaagctagaatttctttcacaggttcggtttttataacctgaaattttgggtatatttatcaacagtcaaacttttttgttgttgtttacttatatttgaaatctgttttagaatagatttttatacctgtgaatcaatttttaaaaacccatttgaaataagggtcatagacctaaaaataaaacataaactgtaaaacttatagaagaaaacatagacaagatctttgcaaccttgtgttagacaaaggattcctagatgcaacaatagaagcacagtcataaaaggaaaaaattgataaatttgacctttttggtttttttgtggggggacagtttcgctctgtcacccagtctggagtacagtggtgtgatcttggttcactgcaacctctgcctcctgggttcaagcgattctcctgcctcagcctcccgagtagctgggactacaggcatgcactacggctggctgattttttttgtagttttagtagagacggggtttcatcgtgttggtcaggctggtctcgaactcctgacctcaaatgatccacctgcctcagcctcccaaagtgctgggattacaggcgtgagccaccatgcctcacctaaatttgaccttttaaaaattaaaaatatctgctctttgaaagacactgttaagaaaatgaaaaaacaagctatggactggagaaaatatttgcaaaacacataactgataaagaatttgtgtccagaatatataacaaactcttaaaactcaaccataaggaaacaaacaactttatttttcaaagtgggtaaaatatctgaatggatgcctcaccaaagaagatacagggatggcaaataaaagaggctcgtgaaaagatgctcaatagcattagtaattaatggaatacaaattaaaactatacaaagtatcagtatacccgttagaatggctaaaaacaaaagccagaaaacaccaagtgtgggccaggatgcatggcaactggaacacttttgctggcgggaatgcagagtggtatagccactctggataactgtgatcttgtgaaatatgtagttagtcttcctcgtgtttcctgacatataactccttggctccttggaatctccagagtgagaagtgtccttttatatactaatgacttaactggtgcctggcagtccctaggtagcttccggatggggattggttacaagaaaagaccaaggcatgattagagggttataacttccagcccacccctcagcctccaggaagggaagaggggctgaaagttaaattagtcaccagtgtccaatcaattatgcctgtgtaatgaagcttccataaaaacccaaaaggactgggtttggagagcttctgggtaacagaatacatggagattcttggccagtagtgtgcctggagatcgcatagaggttctgtgcctcctttctcatacctcgccctgtgcatgtcttcctctatatcctttgtaatatcctttttaataaaccagtaaacataaatgtttctctgagttctgtgagctgctctaacaaattaattgatcccaaggagggagtcgtagggatgcctatttatagccaggtggttagaagcacaggtaaaacaacttggggcttgctattggcattggaagtgggaggcagtcttgtgggactgagccttcaacttatgggaactgacactatctcgaggtaggtagggtcaaatttgagttgaattagaggacacccactgcaagattgcttgctttgtgtgtggggaaacacacatttggtgtctaaagtgttgagtgattatgttgaattgagagtagagagtaggaaaaacactttggtttttcctcaatatctcagaatatagcaggagaaacggagcttgttttcctcagaataaccatttggcagttcattataaagtttaacatatgtggtgattgtaaaatgtgtccataaattctttgacattgttttcaaaaggtttaacttaatttttctgttcttgagtgttgactggatttagtgacttgcctctaactagtggaatatgacagaagtgattatcgcttctgagactagattgtaaaagacattacagcttcttgctcactttcttggatcacttgatctgggagaaaccagttgtcacgtcatgaaggcacttggccttatgaaaaagttcatgtggggaggaactgaggcctcctgccagcaggcagccccatgtgagtgatgagccatctggaagttgggttttccatcctctcttgagcctgatgactgcagtgctggccagtatcttgactgtaacctcataaaggaccttgggacagaaccacctagctctctcactcccacattcctggccccagaaactatgaggtcataaatatatactgttattttaagctgctgtgttttagggtaatttgttgtacagcaataaataactaaaacaacttactgaacaaccaagcagtcccacttctagagaaataaaaacttacgtttacagtaaaacttacaaaaacgtacattcatataaaaatctatatggaaatgctttatagcaactttattcataatctccaaaaattaaacaatccaaatgccttcaactggtgaatggataaccatggtacatctatacagtggattactactgagcaagaaaagggacagaatactgatacatgcaacaatgatacatttcaaatgagttgtgctcagtgaaagaagctagtctcaaaaggatacacactgtctgattccacttatttgactttctggaaaaggcaaaattataaggacagaaaacaaatgaatgttttcccaggggctggaggtgattgggagggtccactacagggggacttgaggtaactttttgggatgttgaaactgttgtttatcttgattgtggtggtggttacataattgtatgtgtttgtccaaactcatagaattacacattaaaaagggcaaattttactgtatggagattttatcttaatgaaaaaatctgaccaaaaaacccatttgataaaaatgattaataagccttttggattaacagcgatatgtttaggatacaatactatcttcactaaccggtctaggactgtgaactgtaactctttagaatgtgataacacaggaaaattctgagtcatagtttactgaatggaaatacttttttgatttttcaggtcttatgaacttacccggaaggaccgactgtacaaaaacattattcgaatgcagcatacacatggattcaaggcttttcacatcctcccccagaccttcctcctgccagctgagtacgcggaattttgtagtaagtgcttgacagagaatgccccagtccccagcaactgaacctggggaatatttaccccaaaagcctcctcaaggtgtcaaccaatcagggctttccaaatccttagacaactgtgactctttagtaaaacagttgcagaggtaactttaaaaactatttttattctgatatgttcagtaaacttgtcagtatcatttatgtaagggcacactggcatcatataagcatgcccctgtcttatgtattttttgcttgaatgtcccttctctccattgatgacttagtgcctatgtaagtattatttttttttttttaagagacagagcctccctctgtagcccagaaccacagtggcacgatcatggctcactgcaccctctgcttcatgggctcaagtgatccttcctcctcaacctcccaagtagctgggaatacaggcatgcaccattaggctcagctaattttttaattttttgtagagatgggatctcgctctgttgcctgggctggtcttgaacacctgggctcaaaggatcctccactcttggcttcgcaaaattctgagatgacaggcatgatccaccacacccggcctgtaaggatactttatattcctgcatgtgaattatacatgcttccttttcggtatccctttttcgcttgccatttaagaacattctttcagccttgatttcttgtcttctgtaatttatgttctttgagggtagagatatcgcatatctttggatgttagggtttggagctacaagttagtcacattctctcccctttgagttcagactaataaaaaaaaatacacgtaggagccaaataggcacctaagtgtcagctgtatggctggtaaagtgacacagaaacacatggcctggatccagatctaaaatgggcttcttatttattttgcatcattgtgaacttacccacccaggccaggcagaggcgctgggctggtttcaggctttcctccacaggggcagagcctgactcagtaggcttaatgcacagaagagacatgagtacagatgagatgtgaggcaggtctcttgtgaaagtccaaattacggtggtaatagctaacatttactgaatgtttactttctagtaggcacctctactctggtagtattttagatgaggcgactaaggtacagtttggttaagaaactttccatgagttatgcagcttgcaaatggtagagttagggttcaaactggcagtttggcttcagaggccatgctcttcgtctctgtgcttcattgctaatggcactgggcagcgtgcatgcaatgaccattccccagtagcatcggtgtgagagaagtcacttctcccatgaggaacatcaggtgagacacacagagaggacagttttcctcccaagaagtccaagaaagatactatttctgttttatggatagacgaagtagcatggggagaagagagagttatctctagacttcctgacttttgattcttttaacatgttaggcttgccagtctctctgggtcacctagtgggttgttcatcttttggcagaggagaccagcagttcatcaggaatgcctgcttcaccatttatctaatagcgtttgttgctctatctggggccattggttggcaattcattgtttgcccacagatggctctgcagtgggtcacatagagcactaattaaatgaatcaacttcagaacttcagtgcactcaaagctgcaaatttgtagtcaagaaattttttgctatgtgactttagccaagttactccaacttctgtgtgccttaatgtccgcatctataaaatgggagtattgctggtgctgaccttataaagttgtcaagatatttaagtaggttagtatgtggaaatcacttgggatagtgcctgataggggtggcttgataaatgtttaatactatttcctatttcaggctatgtttgtattagtaatagttatgtttaactactcactatattaatactactatgtttttactatgttttactattttatttttgtatgttttgtttaactactaactaaagttgtagttatgttattaataactactattaattagtattagttaaacaatactaattaatattattatgttctggccctccagtgcttaattgagtgtgggcaataggaaatttttttggaaggaaagggacaccataaacagactggcctttagaaaaataactatgtgaaatgagtcggtggaagcagagagaagaaactggtggtctctttgaaggttactgcagtgaagtggataaaatggataggtatgagtagaaagggtgcaagaacaaacattactgcctgtgtatggggagcgaggcaggggtcaaagaggaatcctaaggtttgagtctgagtagctaggaagaccattgggtttttaaccagggaatgtaaccaggaaggcaaaggaggagctgttaaaggggtagaggaatgttacattttggacagggtatggatttggatgtcgatggggcatccaggtagtgtgttttgcaggtggcagttgtaagagcaggtttgagttctggccagagatgtagattctggaagctgcagtatggagatgggtgtgattactaagggagagaaaaaaagcagcagcaccgcagagaatcagagaggaaagggagattgaagaggaacaagggaatgaggtctcagaggaggcaggagagggttaaatcaagaaccccagtagaagggtgagcatttgaaagagaagtgggcatgtgtctcctgaaagaggagaaggaagaaggctaagttgatgacccagataacattttagatggagaggaaagcaggtaaataggtttatgttacaaattcctagccttcttagtgaacaggttgatgaggtcttatgccaggagtgaaggggcctagggatgggtgggtgtctaaaaaggcagaaagggattggaatagcctctgcagggcctttgaaagagaactgataaggattggacatgaggattgcctaaaaacactagagacaccagccaaggtgatctcatgaaggtatagctttttgttctaataagagacaacctgtaaagatatagcctagagactaatcactgtctccagagatgtgaaagcctaggtactccccaaactgttctcagtaatttgagtgtagtggttggaatacatggcacactggtctatctaggctcctgccatcactgccagttacagtatttagtagaatagaattagaggtctgtgaccctgaagaccgtgactaaggatctgttgccaactccagccattcccctcaaggggacagctttctaagcagaaggaagaaagaagcaacaaagaagaagatggggtggtaccagtatcagaaaagcaaaactttccccagaattgggctctatggccatctctagttgtaagggagattgagaagtgattctaacatgtgaattttcatgtccgccaactaattacagatgactagatttcaaagcaatgggtaaatttgtagaattacgattttagaattataagagatcttagtaaatcaggctaaattttacaaatctcattttaaagataagactaggtgatttaagcaaattacctctagagtcatatacttgaaaagccagaattacaactcagatctttctactccaggttcattgctgtttctgttagaccaagcctgctgccactgtaggaactggaaagcacttgaaagaactggggagcctgttttagtacatcttcatcctgaagcagagagtcctgagcaagactgcccggcctttgcctctgatttttcttgcttcctacccacacatttagaacctgtaaaagagaacaatccttgttctgaaaatatcacaaatcaaggagaaaagcctagcatgaaagacagtctttgatatttagaatttcaagaacattcaggattttaatcatagtgaagcaccagaagaagcattaacttctttttttttgagacagtcttactctatcgcccaggctggagtgcaatggtgtgatctcggctcactgcaacctctgcctcctgggttcaagcaattcttctgcctcaacctcctgagtagctgggattacagatgtgcaccatgcctagctaatttttgtgtttttagtagagatggggtttcaccatgttggccaggctagtctcgaactcctgacctcaggtgatccgcccacctcggcctcccaaattgctgggattacaggcataagccactgcgcccagccagatgttgtgggaagtcagggaccctgagcggagggactggctgaagccatggcagagtaacataaattgtgaagatttcatggatgtttattagttccccaaattaatacttttataatttcttacgcctatctttactgcagtctctgaacataaattgtgaagattttatggacatttatcacttccctaatcaatactcttgtgatttcctatgtctgtctttactttaatctcttaatcccgtcatcttcataagctgaggacgtatgtcgcctcaggaccctgtgataattgcgttaactgcacaaattgttcgtaaagcatgtgtttaaacaatatgaaatctgggcaccttgaaaaaagaacaggataacagtgatgttcatggaacaagggagataaccattaggtctgactgcctgagagctgggtggaacagagccatatttctcttcttacaaaagcgaataggagaaatattgctgaattctttttctcagcaaggaacagccctgagaaagagaatgcattcctaggggaaggtccctaaaatggccactctaggaatgtctgtcttagacggttgaagataagggataaaataagccctggtctcccgtcgcgctcccaggcctattaggatgaggaaattcctgcctagtaaattttagtcagactggttgtctgctctcaaccctgtctcctgataagatgttatcaatgacaatgcgtgcccagtgggacatgaaacttcattagcaattttagttttgcctggtcctgtgatctcactctgcccccatttgccttgtgatattttattgccttgggaagcatgtgatctctgtgacccacaccctattcgtacactccctcccctttaaaaatcactaataaaaacttgctggttttgcggctcagggggcatcatggaacctgccaacatgtgatgtctcccctggacaccagctttaaaatttctctcttttgtactctttccctttatttctcagaccggccaacacttagggaaatagaaaagaacctatgttgaaatattgggggtggttcccccgatagccagaagcattaacttctgataagcctagttcacaaagtagagggtactgtctccagatggctttgaccccttcccttccctgccctcccctcccctcccctccccgacttccctctcccacttccctcccctaccttcctcccgctacctttcccccttccctcccctctccttccttcccttcccctcccctcccctccctccccagggtcttgttctctcacccaggctgtggtaatcatagctccccataacctcgaattcctaggctcatgtaatctgcccacctcagccttagaagcagctaggactacagccacacaccaccatgcctggctaatttttttattttccatagagacagtctcagtaggttggccagcctggtcttgaactcctggcctcaagggatcctcctgccccagtctcccaaagcgctgggattacaggtgtgagtgagcctattaataactagcctggtcgtttccttagacatttctgtagaaccttgtacttcctttttataactctcattgcctgtaattacttgttcaatgtctgttttttcggctagtctaatcttcatgatggaaaagactgtattttttaatactgtgcgccccacacctagcaaactgatggacacagattagatacttagaggtattaaatgagtgacatttggaaagttttgttattttttgttttgttttgatattaatagcctcttgctcaggcattctgttcagtctgctcagtatctggggaaaatggcaaagtgaaaaaaatatataaactgaatacacatacatatattcagtggcctcactttatggaaatttaattttttgtcatatataactataaatatgtcttctatagcaggacttataaattatattttttgaaaggtaatatattcccatggtacaaaagaaattccaaaacagtcatcagtgaaaagactcttttctcctcttgttcctcagtcatcccattttcctccccagagatgatcagtgttactagttttttacataccctctagagatattctttgcatttactagcaaataacgtgtgtatatgaacagatgggcgtatataacatacattgccctgcactttgtttttttcatttaacaggctatcttcaagatcattccatatcagttcattaataatattcttgttttgtgtgtctgcttaatattccattgtgtagattagatgtctgcaaactatatcccttgagtgaaattggtcttctgccagtttttgtgtgtcccacaagctaagaaccatttttaaatggttggaaagaaatcaaaagaagaataaaattttgtggcatgtagaaatcatatgaaattcagtgttcatacataaaattttatgtaaacagccacacccctttgcttacatattgtttatggctactttcaagctacaattgcagagttaggtactgccacagaaactgcatggcctgcaaagcctaaaatatttattctctggctttttacaaaaatagtttgccgacccttcatacagatgcattgtagtgtatttaattaatattttgctgttataacacagcattgaaaatcttatatatgcaatattttacacatgtgtgagtagaactagaggatatagttctagaggtagaattgctcacagagttttaaattctgtgcggcacattaaattttttctaattctgttaattctgcatcaagggaaaaggcagaggaagatgggggagagtggacaaaagatctctttctttcctcctgctgaaatggtttgtggcattgacaaagtcaagtttgtgtgggaggctttgaagagactggctcatgtcagagggagaggaaagaaaaggagacaagtagttgctggcaagtcatctgggaaaaggagctgagcctagagagctccttctgaagacctgcctggtataggcccaaatgcagggtggagggaagtgtgcaaaacttcaggactccagtatctgaaagtcttgttctgatactggagccctagaaaaggacttgcctcttaataggtccaaccagaagaacagaaactatagggaactttcttaggtttatgctgttgtattctagataaactgggactgatatcttggcgcacagcaacctaggcaatttggaaaaaggaagtctttgtgagatctgctcagaaacatttgcatttgcttgatttatttccccacactattccttccctttctctcttccttcattgaagaaaaataccaaaaacaaaaaattctctcaatttttacctttcatcccatctctgctttgaaacagtactgactgctgccacctgacgtatttcatcaaaagtggaagaggcacagctgggaccagtgctctctctccagtctgggatgtgagaatcagcagcactgagagctctagcctgcttctctcccctgacttctgacactccctaagtggaagacagagctgcttttcctcagaccacttgcaagcctctgggaggcttagtgtcagttgtctgctttctcttttcacgatccaaagggatataaagtgtaaagctgaacctgggaaaggaacaggacaaatggcaccttttaatcacttgtaaatgattgtccttcctctccactggcacattgcttgatttacagtgaatttttttttataagctcgaaatatttaaggaaagtagctgtattataagaactagattttggcttacattgacactgtttgcctaaggtcctttagttaacagatgtaagcatttcaaagattcatgatgattctttgtgacagtaatagactaacatccagatatttgccttattttgttttcatcttttcattcaagaaagaggggaggccgggcatggtggcttatacctgtaattccggcgctttgggaggctgaggtgggaggattgcttgaggccaggagttgaagactagcctgggcaacatagagaaaccctgtctctacaaaaagttaaaaacaattagctgggcatggtggcccatgcctgtagtcccatcaactcagaaggctgaggtgggaggactgtttgagccccagaggttgagggtgcaataagctatggaagcaccactgcactccagcctggtcaacagagcaaagaccctgccttaaaaaaaaaaaaaagaaaaggaaagaggcgaaatggtggaagaaattactatgggagtgattttgctgtcctcttttctcctccctccttccctcgctctatttttatttttaaggcaagtccaaaaatacaggtaattttagttactgcccaacacttagaaatttgtaagatttttgggttccctgagtagataaccctttttgaaagttgatataataaactcaagttcattctttttctttgtttcctctgttttttatctcccaatattttgagcagattcatattcgaaggaccggggaccttggatagtaaaaccagtggcatcttcaagggggcggggcgtctacctgatcaacaatgtaagtatgcagcagatggcaaacctctctcctcacttgttctttcctccttcaccctttgtattggttactaatatagttccatttcattaagagcaggtgtgctcttcttaaatctgcattcagaagtgagttaagcgtaggtataacttgacttgtttgccttactggcaggaatcttctgcaccagcagttactccatggctaaaaagacacttgatcagattttaggggagggcaacctgttgtgtcagcagaaaagaggtaccttttctgcttttagcatattgtgatgttaattcctacacaccaagtattaattgatagcgtatgtgtttagcatctgttgtgagcagaactgtgggttctgttctcaaggttatcaaacaagtgaaccttaatttggtatggtatcctcgctactgctgctgcttctcctttctcctccttccttcctctttcctttcctctttctgcccttcttcgtctcatttctcctcttttttcaaaagccagcaatatcttgattctttgcaaaattctcattaaaagttgtcttaaattgaatacatacacatggtaaataaaatccctactggtctcactccctggacttacaatagtagttagtaacttttgttgatttatatttctttcattgacattacattgtatttgttaattcccagtttggcatttattgcatttacatcatgtcccaccctcccttgcacatttgtttgattagtttttatgtttatgttttaaacaataatagaatctcttcagtaactatgattcagtttctttattttatctataagttgagtaaaacatttaaactcagtggaaaccaactcttggacttctaaagggggaaatattaggataggtagctgggcagacatgagccgggcatgagagggcccccgctaccaccaaggagtgtcaggtgatcatcaggtgatggtcaggcagttgttaaactggtctctctaaaataataattggtagcagcagatgccagggaaaggcaggcacctgaagctggtgatcagccatttcccagtaagatctcaggagttgggcgagtaggctcaagcatgtgccctaagaagcaaaatgatggagtttaactggtatatgaccttcctctaggaacactcgactggtaaggcaaaaacacttcaaatgagcacgtgcacagctgcagccaacacactgtgtatgaggcccctctcaagtgctggcaggccactgcacatgcagacagcttaccccatggaaaaatcaagggaggagagatgcaaaaccccggaagcatgccaacatataaaaccccaagtctaaggtgaaacaggcacttgggtctctcaagttgtcggcttggccctcttccacgtgtactttacttcctttcatttctgctctaaaacttttcaataaatgttcactcctgctctaaaacttgccttggtctctcactctgccttatgccctcagacaaattctttcctgcaaggaggcaataagtgagttgctgcagacccacccatatggatttgctgctgccgctgacagactttgggattctgaaatttaaccaggatttaggcctggaccagttttttattcttcctcctggatatttggcaggcattttcagtctggaaactggtgtttttctttaaggaaagttatcttcttatttgtctccgcttttagaactcttttttgaggcattctagatctttccttcatgttaacttttctcgcatttttaattcttttcccatcttctagatcacaggttgaggtttatccatttattattcatttatctactgtatttttatattgggtatcataggttgatttccagaaactcatattctgatttgctttatttttatttacaaataacaaccttttgttgcataatggatgcagtttgcctgcctttccttctgaggataccaatggaaatttttgtaaagttctcttctgtcctttaattttattgggattgtcttttcccctgctattggattttctcagctttgatgatccttacatgttggaccatatttatgaacaaaagactagactgaatgaaactggccgctggtctgggtttctactgtggttgtgtaggactcttttcctaatatcttctccctggaagaggctgactgtgaattttgtgtaagggcaaaacatgttgactctcaggctttactttaggtggacatggtgagaagcactccccttccaccttgccaaaataaagtgggccatattgtgaatgcagaggaggattttggtgatctccctcttgggcagagctacctttcttttcctttttgtgtgtactggtgataaggtagcctcaagttctactcttctctatcagatttctgcacccacacgtctcctggcctcactgttccaaatgctgtttgttaattatctgattctaattccttggctgatccctgagcttcatgtttgttgagtacaagcttggaaatttgcaggagcctccttgggaaggtcactcttatctcttttggacttttctggcttcttttactttttcctagctttgatatcatttcattcttttgaaaatattctttctgtccttccactggaactctggaagggcaggggtaggtagatgtgttgtatgtgggaccagaaccctatcttaaattccccacttgtcttttcacattgagctgtttgccatatgtgtagaaactaactttctgagggatctttcacattggaaagtccttaaattcagtctggactcaaaacagtaccgtaaacaatgatggccagacccttcatgccaaagaaatataggatctggttttgatagagcaactgctacagccccaggcattggctgcaacttctgttacctggcctaggccactctggaggccttttaccctgagtctcctgtgacataaggccatggtcatatgccttggctctgtctcctcttgtctctgctctgacgttggtgttgaaggcccctctccaacagcttttccttcagctctgtgccaggagctccagtgttgtttgaatctcatagacggcactagtttgggtttaggttttagctgccaaatggaattgctattgaaagtcagctatggtacaagtttgctttttattttcttagatatgagtcaaaaagaataggatctattcccagctcatctgggacttttttcttttggaatgcttttttgccctagtgatttgttattttaaagctagcatcataaaggatagaaaagttaaactttccttggtggagccgagaaccctgcgccctaactcttccctggatgccgaatctcagtggggtgacatgtcttagagaatgtgtttggcaggctatgtaagagtctttttctccctcccacctctccctgggctgaatcctttgagaccccctgcatagatcaaagtacttggcaggaccttttgccttccccctccctctttgtgaagctttggaatgagtctgattcttttaggtatttagtggaagtgccagacagaagcctgggaggatgccaggaggcatgaggggagctggcaacatgcggacataatgggaaaatactcctgttttaccccaaaactggaattttaccaccttttacccagacctgcaaaccatgttgttaatactcttctctctccttacacaaaaggcataaccatcccctcttttccatgcctggatcctttcccatggaatatgtgacccattagccaactggatgaagtaactctttccaaggctgctgcctgctttccttttagatttaagcaggagggtgaggagagggaatgctgaggcagagggtctgggagcagaactaatgtgagtgagtgagggatttaggcagtggggatggagttggtgtgagggccaaatgaaaatatcttcccctctcttcccactggagtgagagggccacttactaaaacttccctatagtagtcataaccttttggaaactctctgcaaatagcaacttttaccattacgagaacgagataaaggatagcaaaagcatcacttttatgtaacactgaaaagagaagtgtggaccacagatggaaacatctcggttggctaacgtggtctcataaggatgtgctctttagaaatacagcataaaggaacaaagctgtgtttgctccactccttcagtaaccatgactaaatgccatattttcccaatttagtatattcaaagcaaggaggggaaagaatgggtgttttctgattaaggtatgaatttgattatggaagtcaagtttactcattcttgtctcacacatgatccatgggaaatacagtattgatacattctctgagactttcacatgttaggagagtgttaggtcactctagtccctcctatattcgtgaatataattctgtactctcttgtttctgtttgtttatgtgtttttatcttaggttccctttgtttttctcattgctcaacaagtatttcaggagtgcctactgtgttgtcactccttaaaagcttttgagaaattctcctaattattatgtatctccaattttcataatagtaccactcagtactctgagtagaatggcatgcagcaggtagtgatgaatgctgttgagctgtgggactttgtaattagaaccacatatattctgttaagtttgcagtaataataactaatgtttattgagcctaccactgtcctttctaaacataatctcacttaatccatatatgaaccctatgaggtagttattatttccttaataagtggtagagtcaaggttgtaactcaggtccagatgattccagcatagacactcttaaccactatatcattctcctttacaatgacttaacagataccatgagctttaaccttaaggtccatttagaaagatacctttccagccaggcgcagtggctcatgcctgtaatcccagcactttgggaggctgaggcgggcatatcacttgaggccaggagtttgagaccagcctgggcaacatggtgaaaccccatctctactaaaaatacaaaaattagctgggtatggtggtacgtgtctgtaatcccaactactggggaggctgaggcagggcagttgcttgaacctaggaagtggaggttgcagtgagctgaaataacaccattggactccagcctgggcgaagaaatgagatgctgtcttagaaaagaaagatgtgtttccaactttcccaacaattcagattcctacttcagcattctttgggaggcagtttgagctttgaattggaataatttgaaatgagttaactggggattgatgaaaggaaacaggcttgaagatatcaaaaagtttttcttagttgctcttcagtctgtaacgctgtgcaaagaaactatatccaaacctttcttttcttctgggagtctacagtttaattcccaatgcggatagaagtgagggataaagacaatagaacacatagtaaagttacctaaatattgtaagggtttatgttacgtgtaactcaaaggataaatgtgtatggtgagcaagggaggagaggaaatgggcatgggcgttagatgtgtcatggaatgatgaccactatcagcatattctctgctgtggagaaaagttgggtgagtagatatttattgtagcctataggttctactcagtaggaagagagctgtgattgtttgattttacgtttacaacatagcctgcagctgtatagtgattgcatcaattctcattgagcagattcaaaatggagatagtacttacgagaagctgatcaagaaatgtaagggagtcaggaaatggtatggatgatgaagttcattagggatgaatcagtaatgatgtcattgtgttcctatgatgcgtagagatgggttgtgaaagctgtgttctgactttgagatagcagcagtgggaactgagagaggactctcattctgacttcagagctgctcatactggttgtgtataatgttataggtcacaaaattatcatatgaaaaacagtagtagtattgagggtaggaaatgcattgttataaagacaaacttttgaatttgggggacaattaaatttgagagcagaatattgggaagaggtaagaataaagcctaaaagcgaagcctgtgaggaagactccctggattccgttgctgctctattgcttattagctccgtgactttgagcaggtccctaacccactctgattcttttttaatctataaaatgtggatggtgatatacctgcctcatggggttgggtgaggattaaatgaaataatcctgtgaacagacttagaacagcacttggcacatccacgtgtttagtacatttgttaaattttgtgtctgcaaatgttgatggttatttctgttgcctttactgtagctattatcaacctaattattatcactaccacttcccttttggagcccttttgtcctacatggattgtggtgacttccagctttatctaatcacatgtgaaggtttttttttttctcccagatattttaatcttgctgtttccttaatctagaatccacaataatttcctgcttcccaccatgctaaatataaactccctttgccaggggttcaaatccctttgtcagtagggtacctccctcctcattgtttaaccatgtctttcataatttcccagttcagtcttttagccccaggtctgtgaatcggcccaccctcctttctactgggcttggtgcgtgccatcttccgatgatgggctcctttcttctccaccatgtgcttcccagccttcactcatttctgcatctactcttctgggacaagtcttccctgactggtcccacctgattggtctgcactttaactttgtaacctggcatcttgtatttatagaaatgctgctttgtgttcttttaaattctatattttgctgttcctctacctaaatattaaacttttcagggatagggatttactgaatcttaaatctgccaggcagagattatatgtgttatgttcatcatggtatccccagtgccatatgcagtgtccacagtacttttctatttattgtataaacaactgtttttcattgaagaaatcttttaaagaccttattcactctttgcatacagttgcttagcaaatacccttaagtgaatcaattaaacacctatctcattttacagagaaaatgctaggatccattgtggatctgtaagttctccaaacatgttaatgaaagccttcatttaagaatagtagtagtatttttaaatttccattatacttcagggagaaagcaagttttcatttatttttaaagtggctcttattttcttggcaggtaactatttaatatcatgtatatacatctttaaggctattaggcttatttatttatttatttatttatttattatttattatgtgagaggtactgtgtaaatttatttttcctgcatcgtaattggatgcctatagtgttatagaagtgatattatatggccaactgaatatatgggtaccttggaggaaactttaaccagaattttagttttccaccttaccatttctttaaaggttaagaactttgctcccttattgtaaattaggattcctgtgtatttctattctttcattctttctctttactcaatagccaaaccagatctccctggaagagaacattttggtctcccgttacattaacaaccccctgctcatagatggtgagttgtgattaggcccttgaccaaattgggccagatttttgctcaactttttaagcttttcatagccttctctagtaagtctttattatactgttgtgaaattcttgacatgtgtggctccagaaaggcagcaggttccttacctatctcacgggatttatctgaaggtgaaatgagacaatataagagaaagtgctttataggttatatagtagtatatgtatgaaaattgtgcagtaattaatatatatgaaaatgacacacatatgcattatatatacattacagttatattaatgtatatatacattatacggtttttattatgtactatatacataatatgtatacggtacaattatatagtataattattagttatcctccgaagtcaaggtgtgtgagcagtgtgtgtttcatgtggagtgtaggaatgttctttctttcatgtttcttggtttcgttgtttattctgtaacaggaaacaaatgaacttagtttttttttgtgaatacaaactttttttttttagatttcaagtttgacgtgcgcctctatgtgctcgtgacttcctatgatcctcttgtcatctatctctatgaagaaggattggctaggtaagaagctgtttgggggtgaaggggttgggtgggtatattaagggtgggtatattaagagtggatccattaacaagtttattaaatcagatcatgctatttttacttgtcattactgcttacagatgcaatccacctcctcaactgctgtgctctataacatcaaagccagtatgcctaaaaagaacttcagaaattaggcttatttgtctgtagtctcactgcatgtccacacataaggtgtgtaaacatcttccccagcactgatccaggatcatatggtattttcctgcagtgacaattgttatgaagctcctaggatattaagataatttgctgttattcttcaggatagatgtagaaagaaaaataaaatcctacctgtatttgcctattatatgccaggcatttattttcatcctcgcaacaaccttttagttgatgcatttttgcagttgaggaaacagatttagaggtgggagaagtggaatggggatttgacctcatggatctgactccagagctcagggctcagacaatttcatgccctctcatatttggaaggtattaattgagggtttttttttttttccttaacatgcaagttactttacagtggttgtacatacattgttctctttttgttaaggtgcttttttttgtttgtttttgagatggcgtgatctcggctcactgcaagctctgcctccaggttcacgccattctcctgcctcagcctcctgagtagctgggacaacaggtgccccccaccatgcctggctaatgttttgtatttttagtagagacgaggtttcactgtgttagccaggatggtctcgatctcctgacctcgtgatccgcctgcctcagcctcccaaagtgctgggattacaggtgtgagccaccacacctggcctgttgaggtgctttctaagttttaaggtaatgtgacttacaagattaagttcaagttgttatattttgaagttttgtttcctctagccacagaattttacaggtaattgtttttgtaaaccctttaaattgtttaaaataagtatgtaactactatgctgtgttcttccccccaacaaaactaaatttttgtattagccaactagtttgccctgaagttctttttatgcgtagtgcctttgatatagagcaggggtgtccaatcttttggcttccctgggccacattggaagaagaattgtcttgggccatacctaaaatacactaacaatagctgatgagcttaaaaaaaattgcaaaaaactcataatattttgagaaactttataaatttgtgttgggccacattcaaagctgtcctgggctgtatgcagcctgtgggcctcaggttggacaagcttgttataaagcatagcagtttaggaggtgatttgcatctgtgagtggtcacgacaagctaaaaaagcctggtctgtgtatgtttctgtattttagaaaatgcaattggaagatgggaaataccatggataaaagaaggctacctatttatgtacaggtgctttgacagatattattgtactctgacaactattattttagaatggtcttttaatgattttagagacttagtttttttcacatgtatcctatgacttgaaatcagtgagagcagactaaccaaacctcgctggtggagctctgtgttccgttcgcctctaggtggcagtcacagcatttataagtcctgtcatattcttaactgagattttgagtttgagccctgggaacattggagactaccaaaactccctagttctggcctcttccttgaaaattgagaaagggaagaactgaaacatctcgcagttattagataaagggctggaccaggcatctgaacatgagctgactactagctctaatcaggtttttataggaaagaaattgtcgataatatttgtagacacacgtgctctcacgttttgaagtatcactatacaaaattaggtataaaagcctattcctggccaggcgtggtggctcacacctgtaatcctagcactttgggaggccgagacgggaggattgcctgaggccaggagttcaagaccagtttgggcaacattgtgagaccccatctcattaaaaaaaaaaaaaaaaaaaaaaaaaaagaccaagaaaaagcctattccctatattatttaaaacaaaatgatggtaaaatacagtcctgacttctcagatatgcaaggttctgaggattttcagctttataatttgagacttctgagctttctctcttttgtgttatgagtttcatcattctccttcctctgctcatcctcaccttcacttctctcctgtgtcaagttttagaaactgattatgtcctgccaaaaattggactttgggaatagagaaaagagatggaggttgtgcttcactgtttctcaaggacatcatagcaatatgttttgcttaatattccaaagatattttcacctacaatattaacagccctctctatgggtaaaatttggcataattttaagacctttctggttcagagcacaacatgagaacaacagtaccaatgtttattatagaatttactacaaatatgcaagtgctttggctactggttgtgtgttggaagtcagaatctactgaattaagtataacccttttgcttccagcagaaacaaaaaaatttatacacacacacacacacacacacacacacacacacacacaatggatgttttttcacagaataattagaaaaacagcttttaaaaaactcagaccaagtagaaccagaaagccacatgaattttcagggctttggttaggtttacctgaaagtgtaggtgaatataaaagctttatcaaagctttacaaaagcataacgcatggcaatatgatgcactgtttgcgggagtcctgcgagggcacattgttccgtgcagtaatttcaatgtgcctaagttcttgtgtcttcactaattatgtatcttgacattcacttgctttgttgtaaccctcagagtctgttcaactatgtcgatagtctgtagcatctccagatctgcagcttttagttatcttgggccacatgtaatttatgtagacataactgaagatcatcagtttgggatgagattattgggttacgttgaggctcaacaagaaaaaccataatctttcctaaagagacggaacaggaggcaaatacaattcatttccttctttagaaatgaattcccttacaccctatcacttctgttttggacctcaaattaatactaggcgacagaaagattaaattcatttcacaagacagttttgtgatataagttattttgtgtaaaattttttaacacaaaattaaattcgtgaaaaccctagtttctgtatagatgagtgttttcagttgtccttattgttttattaacataagaagtgggagagctctcactgttttctcatgtgtgggtatagtattgaagaagtgttgcaattgtccccctggtatttgggtgcagctttttgtgattcccacagtagccctcagaggtcccctgtgcttttgaattttacttgcgtgttgctgttttgcaccaccaggggacactcagtttccacagaggggtgctatgctctaccaaaatggtgcagattctttttcctgtcaggggtggactccaaaaagattttgtcctggattttacagctttaggtggatccagtattgggtttagatgagttgacagagccctttctgagatgaagctaatagccagattttcactgaaacaggaaaaataaaaatttcaaaaaaattaaaacaaaatggagttaaaaactaaatatgttgccagagacccaaagataggcagctctagcaacttggggggcatgcaagtatccatccagggagctgagttccacccatgcggcggaggtgggaagagaggattctgggaaggtcccggttggaatggccttttttctgcctcagccatattattcagtggaaattcagaaaagaccccaaaacatttgtagtgcctttccctttctccccacccccagttccttcttcagtagccttccttgctaattaacactggctctgcagggatatttaccttttctctgctggattcctgtggttttgaaagaattcaggtacttgctggttgccaaggaattcagattacctcacaggctgcacactgtccagaatctgccacagcagcaagtaggggggaagagacaccaacaagggggagaaaaccctttccagtgctcattgtcaccctccctggcaggcccttgctgtttgtgaagtttgagtcatttctggctctaaagacaagggatcaggctggtaatcccctcccagacggctctgtagggcgctgcctagtcactgcagcgctttggcagtctcccggctgcagctggttgacagcagatcagagagctcttgggcctcttgttctcttccataagatttttctgggtcaggccaggatgaaacccagtggctcctggcaaggctgcctgaggtgctgtctcttcattgtccaggcctctctgactcaaaatgcctacacctgttgaaggataactcatgtgccacagcgaggtcgaggctggccttctcttttcttggtacatttgtagtgaatgtttgtcagaaaatataactaccaaagaggatgttaagcttctacatctagaatgcctgtgactctgaccataagaagatattggtatcaaaaaaaagtttttaagaaaacagcaggacaaaaaaaaaaaaaaagaacatgtggggtcatattcttagaagaacaaactggtttttgaataggggaagagagtttaaaagatcccactaactctctgctttccttcttgttttggttccatattggtaaagatcttggagcaagcaactccagtgcagtttcagttaatgtttgccaagtccctaccatatgccaaacattgaaatcttttctccacacagacattcagacttttagacaaattatcttgattctcttgatcaaattatcttgatcactatcttgattctcagtgagaaacattagaaagcgaaaaggaaatgtaacttgtgatttaaaaatttattgtcaaaataaagatattgtccaaaacaattcatatttgttttcattgtggttaaaaaggggggagggggcggcaaatagttctatattcatcaataggctgcaaaatagtacctagggtttcaaatttaacaaagaaagtaggaactctcccaccttttgttagcttaaaggtcaaagccttaaaggtctgtcgtgagaactttcctaaatcttgatctcattaagagggagatacaagactgactccatcgtgtaaattttggtctacattaggataagtgtggtcatgtagtcatgtgctttataacaatgggcaaggaaggaccacatatactatggtatcccataagattgtaatggagctgaaaaatttctgtcgcctagtgacattgtaacatcataacacaatgtattactttttctatgtttagatacacaaatacttaccattgtgttccagttgcctacagtattcagtatagtacaatgctgtacaggtttgtagcctacaagcaagaagctgtattatctatcctaggtgtgtagtaggctataccatccaggtttgtgtaaatacgctctatgatgttcacacaacgatgaaattggcctatcaatgcatttctcagagcatatccccattgttaagtgacgaatggttgtatgtgcaaacttggtcctggggtacctagtaaatagtgctcttttaggttattgttaatagagaaatggtgttgaaacttcagacctagagaagatgaaatttgataatatgtgatggtctaaatcaaaggtcactaacataaatgctcacaagtacattcactgaaggaagagtggagactggagaatggagagtacatgtctcatctaaaggcatttactatttagtgccagcagctgatactggtattgccagatctggtttgttaagtgaggcttgaacatgtagatttttactgtgaaacaaagcacttttttacacttttaattttgaaaccgttttgaacttatagagttgtcagagctgtaagaattatatgaaaaattaccttttaccctatgtctagagatctcattccaattctgccaattgtcctaagattttttttttttttaattacaaaaggatccaatcaaggatcacatgttgtatttagccgtcgggtctccgtagtctccttcagtctgaaacagttccttagtctttctttgactttcatgatctcagcatttttgaagattacaggccagtcattttgtggattgtccctcagtttgggcttgtctgatattttctcatgaagagacctaggtaatgcatttggggccagaataccacaaaagtgatactaattcttgtcattgcattatatgtgatggcacatgctagtcatttagtggtgtttgaccatttgctttaggtcatctgctagattcctccactgtaaaattatttggtcttaccctttgtaattagtaagtattttataaggagatactttaaatcatgtaaaatttcattcttcatctcatttctcatttttaagaaaaatctattgatttttcttgccttaatgaattattgctgtaatagttgccaaatgatgattttttaattccatcataacttttatttcttggcatttttctgtgaggaagagctttatcttctcgtttatttattcatctatttatttataccaatgcagactcaagcgttcctgttttatttaatgggttataattctttactatcatgatttattttgatgctcaaattgtcccagatttggccagtgggagacctctcaagctggctttgtgtccttttgacatgtctttatcattctttgagcacaagatgtttcaggctcatcttgttctttctctattctatccctggaatcaaccatttctccaaggagcactggttgctttttcttggagtataatatttagaaatcaatatctgggtgctagatacgctcattgttttggggcatttctgctttcagaccctggccatgagcagagttaggaaattatgtatttatgtacatatacacttgtacatctgtatttctatatctgtctctaatgtattgttgaaaaatagaagtttatactagtacgcacaattctagttcaaaactacagagttccttcttgttttttgcttttcatattttaaaatctcttttccaacagcaggaaatctggctcgcagtatctttaacatatttatttatttgctcaattcctttgtatgtggccagtttcctgaccccactgggccactgtcccattcagatgccgtttttatatggatttatacccttatttggtggcctccctgcttagaaaacctccttgtgcttctggctgacttcccaccctactcaccatcttccttttttttttttttttttttttgtaactcaccatcttcctcatgtgggccctggctacccctgggctgcaagaaggaaggtctgatttttatatgttgttcaggtaattaaagtttaaaagaaaaaacaaagcttttgtaggttaatcagaacttgaccagtaggtcacattcaagactaatgtgacctgtggtctagacaataaaaaagaaaatagtggtcagatgatgatgatggcttatttactatggattttagtgagagctataagctcttactggggtaggaggaaagatgaacatgcacaccttttctctccatagtgtatgttccccactagactgagggagatatggagtggagcactttcacccttcaggggaacttttcctttaagcttttttgtttcactttaatttttgctgcttctgcttcatacactcagtttagaattccacgctttgatattagaaatcttatccttgctggggttcagaataaaatgctccagtgaaaaggaagattaggaagaagaaacatgattttttttttttttagatgtgcagccctcttgaaaaaaagaatataggaatgacaaatgtgttggtacccgattccagctcaccacagacttttgtcaggcttttcatgttgaccaagttagatcaagtacttgtagtaactacaagagatgaaaagcctctttttctgaagcagaagctttcccctccttctaattcattgttctttgaggggagaggatgacaggagggatgtcaccttgaggtaatgtctggctgaggcaggcagccagcacggggcccctttgcatctcacaagaattcagagaatgacagtctgcaacttgcttggacaatctattagaggaagattgggatgcataggcaagggttactcaccagggcactggggtgtgacatggctagaagttaagtgataactactggaagttggaagtttctagaaaatctggggtccttctcaagcacagacataataatgctcatcaaactcttgtcttttagcctagtcatcattttctctttgtccacatcctttttcctagcctcatgtttgtttattttagttttttgggtttggggttttttttcttttcactattctttctttggctcttgtatatttctggtacagggaattagggagtggagatagtgggtggatgagaagaaacagagaagaggaaagttttttaatgctgacctttaatgtggtgaaaattcatgttgacttcatagtctgagtaagcatatgtaaataatttgtaagtcatatgaaaataaacttgtggccttcttttttttttcacacacttggatatgcctcttgggaaaaccactctagtgaagggtgatatggttacagtggtatgtaaacaggggttgatatctaccataaccattcgccttgagtgtccttttgttgatactgagcatccttttgttgatattgagcatcactggaaagttctctctttccctggttacttccttcagaggcacatgtattttatactttggtcttcttttgacaacagtccgggatatcaaattgctaccctgttttcagtgggctccatgtttaattcctcttttgccttcatttcaaattcaggactaagtctcttgcactgtgcccatatttatgccgttttgctttgtctgctgttaatgctgtcattatcattctttttaaatgagtattatggatcagttctattctttctatggatgtcagctctaagcctacatatagctgtgctgtcattttttctttttgcttattttttttttcattgaatgctatagtaccaggcactgtgtgggcactcagtcggtgtttctgttgcctaggctggagtgtagtggtgcgatcacagctcactgcagcctctgtctcctgggctcaagcagtcttctcaccttggcctcccaagtagctgggactacaggtgcacactaccacgcctgcttaattttttaattttttgtagagatagggtcttgcagtgttgcctaggctggtctcaaactcctgggctcaagcaatcctcctgcctcggcctcccaaagtgttgagattagaggcatgagccaccatgcccagccagttgttatttctggaccagctaatgctgcatctttcacagtatcctacacacaatttcccaggttgtaaatagctatattttcaattttcattcttcctattggtgtaatgttctatataagagaagcaatgtcttgttgtgattaagtccatgggttttggagttggtgtgatcttgaacaagttatttaatagaccacatttagttttcacatctgtttttcaacttggatacgatattatctacttcatagggttgctttaaggattgaattaagtatgacattataaaacacttagaatgggagttagcacttagtaggcacttggtatttgttaggtaatgatattaccctcctttattattatctcattgatcctcagttccagcctgtatttccttgaaactctgttcctggcatttaacctgtttcccttctatcaggtttgcaactgtgcgatatgatcaaggagccaagaacattcggaaccagttcatgcatctgacaaactacagtgtcaacaagaaaagtggagattacgtcaggtactggctgtgtctgagccagaagtcagaggtgtcagtctcagatgtgggtgttgtagaggtggaaaggtaacatgtggcactggaggacaactttacattaatgtccatgtaccatttatggaaatctgtcagtcatataacagtgttgaggcatatctcctgctgcttctccattgcctccccggttaacggtgtcacctttctctaccaaaatgtgccttcacaagtttttcttcctcactgccttccctcacttgacttaggaatgggaatttaataggcatatggaacgttttagaagttaagaaatgaggtcatttcagcacttggcaaacatatcaaaagcttaaaaaatgtctgtaccctttgaccccatggttccatttctaggaacttaaccttaaggaataaaagatgtacacacaggatcagtgataagaatgttcattaccatgtattcgtaggtggaaaaagcaggttatcagatagcacatgcaacttaactttcttgcttgaatatgagatatctaaagctgcttatttttgctgaggggggaggaaaaaaagaccagaagtagtaccgaagtgttaatttagcttaactatagtgggtaggattgtgagtgggtgatttttattttcttctttgtgccattatgtattttctaaatttttctaaaataaatacttgtatgatcaagaaaaagaaaaggaaaaaatcaaagaaagaaagaaatgaggccatctcagaaaaggattcagtggaagggagtactagcccagctgtgtggaaatattctttttgctctgttttctttcatgccgatatttttgccagaaagtggaaaagtggaaaagagacccaaatagttactttctactcagactaaaaataggttcctagcaggtccaaggaaagaaagaaaggaatctggaagtgatagaatagttgctgaagctatataggtttcagcaaatatcctgtgagcagcatttgcattgactgaagagatcatacctccactgtgaaagatgagcaaaggcacaattggtggagagtgggatggtggtagggagtgaggggacagctgcaaaacacaggttccagattgcggggctcttccaacattcgtgggaggctgtgccattggccactccgctgccatagcaatagtatacctcctcactcttactgtcactccagtgcactctcccttcagtgttacctcaaaaaaatcaggaaaagccatatctactgccaaagaggagggaacctgcttcagatgccaaagcaattctgtgtggggttatttcattagcatgctgcaccagaataactcactcacccattccaactcagttctggtctgaaaatggcatcagaggttgttttgtggactcaggtgacattcacctcaaaggttaattgtcttttaacttgttgtaaccattcttaaatttgtttgccttctttcacacattgctttcactctttcttgatgcataattgtttggttaagaaagaatttgccgccttcttccccaccctcttgaaaaaggcaaactgtatgcattttcatttccattgaagaaattggtatgaaaggatatatgacaaaaaggaccaagaaaaaatgagtaactggaagtcagcaaagtgaattaaaaaaaaaactttttaaaaagacaagaaggctatttgcaaagagtcttgttattatagccaagcctagttacatatgtgactttgatttattaatttgttttagttgtgacgatccagaagtggaggattatggaaacaaatggagcatgagtgctatgcttaggtacctgaaacaagaaggcagagatacaaccggtgagtactgggcctttttccttcttgacttctcttctttggataactttatcattgtctcttgccaggaatcattctctgttgctttgatagtgttgctgagacgggatgattgtccttggtgttactttttcctgcagttgacaagctggggaacaggttttccattaccctcaaaatcccttttcttgtttcgggtctgaaagacataactttttccttttaatccttagtgaatttacccttcttgaatgttgaactgctgactaaaatatggtcagctttttatataacaaattgcctgtctccatattggccccaagtttcgagttttctaagttaatctctctcattcatgttgctgagttggagaatgggcactgtttgagcacagggcttcaaatcaaaatggacacaattgctgagccttgagcagaacgggaaactgtgtgccaaaaaagacttttcatttcacaagggaaagggtcataggggaagtgtgagaagggaagtgaggctcctattccattatgtgtctgtcttttgtcataagaggccacctgagggtatcccttggcacctacattcttgactgtattgatctgttcacagatatgcctgcctctatagcacccattcagaagtctgccatatagaggcttttttgaatgagcacacatgcttttatagttatattgttatctggaatccagttcataatccatgtattttgatattgagtctgaaatttaaaaatttttgtttgcagcattgatggcccatgtagaagacctgatcattaagactataatctctgctgaactagctattgctactgcctgtaaaacctttgttcctcatcgcagcagttgttttggtaaggagactcaagaagcttaacatgttttgtgaagaggatcttgggaagttggacgggattttagggtagagaggcttagtgattctatagcagtaagaggtatgtgatggactcttctttctaagctcatgtagcatatgaagagcctactaagaggccaatagtgagcttggtcagaagtcccctgaggagtaactagctttctgtgtgggaagcagggattggaacgaacgtgttggtctttctgtcagagtgcagtcagaaaaagtctgcaacggactgtacaggaatccagctctaacaaatatattccagagctccttggcagccaggctgggaacagttccaagaagctctggctggtaccagtatgtgctttctcccattttccgatgactcctcctttttgtttgagtcttctttctagtgtgttcctccccctcctctctttctcccattcctcttccactttcttttctctttctctttctcttcctcttctcctccccttccactccacccccaactccttgactgcacagagaaggaataagcagttcacaactacagaatcaggaaatgttacctactgaccccctagctataatggtagcactgagggtgcctatggacattgcttcctatgtggaaatgaatgggtttgtgattgcccatgtgaatgtgtttaaagtcacataggcttttggcagtgttaggctttgttagtaaaatacactagggtctttgatggggaggatgattaaagtgtggtgtggagtaatacaggtagtaaggatatgagagtcgtgctttggttagaaggcagagtaacagggaaataaagaatatgggttttagagcctaacagccttagtttgtaaccatgtatatccatatctagttttgtgattttcagcaagttactctaatcctgtttcctcaactataaaatggcagtaatggtggtgtctacctcctgagaataccatgaagatcaaatgagatgatgcacgcaaagcacttgacacaatgtctggcccttacgttgtactcaataaaaattatttgttatttttgtaattagacatcataattcctgatctctttaacagattatcgttaacaggctatatttgagggtcagtaaacaaagggaattgttgagattgaatagaagatggtagataaatcaggacctaaaattatatgggaaaagaagaggttgtaatatattttttaaaatacatatctgatcatgtcttctgaaatccttaaatggttccttaggcttaaattgtataatagaaacttgatatgacctgaaaggcttctaaggtaactcaggtaactcttctagaattccatttcccctcatataccttataatccagctgtactatagtatacttctaagcactctgtgcttttgtgccactgtatgagttctgctgtttggcctaaaaactctccttctgtctctgccttgcatgctcccatttcttttctaagatttagttctccacattgcctcctccctcatgctgttcttttttttttgagacaaggtcttgctctgttgcccagggtggagtacagtggcatgatcaccgttcactgcagcctccacctcctgggcccaagtgatcctcccaccttagcctctcgagtagttgggactataggcatgtgtcatcatgcctggctaattgtttaaaaaactttttgtagaaatgtgacctcactatgcattatgcttttctgtgcttgtttgatcattctcttttcctatcacatcatgatgttttgtttatacatacactcagccgtgtctgagtttattttcttgaattcataacagccagtgtgtcctttcttcccatttcaccctatttctgccaaaccagagctttcaacatttctcttgtcccctttttaaatttttttttttagttttgtattagagacagggtctcactgttgtctaggctagagtgcaatggcgcaatcgtatttagctcactgcagccttgaactcatggtaccaagtgatcctcctgccttggcttccccaaatactgggcttacaggcatgagctaccatgtaagccctcgcttgctacctctgcacctgttttaccgtgtgtctgaaatacctttcttgtgttactttacctaataaattacagacatttttcaagacaaagtcaagtgtcacttctttggtgatgtttttttctaatgctcccagagttagcctgctctgcccttatacccccagcactctgtttgtaactctacaatagtatctgtatgttgtctggtagtcatgtgtatatttgtctcctgtagccgactggaaactccttgaggacagtaagaatatctccgtcagttttgcccccaccatgcatggcagcacttttttttaaattgagacagtatctcactacgttacccagtctggccttgaactcctgggcccaaaggatccacctgcctcagcctcccgagtagctaggactataggtgtgtgccaccatacccagttgcatgtcagcgtcttttgctcttagagaatgttcaggaaatgtttcttgaatgaatgattggcacttgctttaattgctttttggtggcctgacagtagacttcccaatggatctggtttggtaatggcctagaactcttagaattattgcagactgtttgaagatggggatgaggggttgggactaggagcgtaactccaacttccaaaacctcattagatttaaataataaataaaggtttatttttctacatctacttggctcttatatgagggtaaatttctgatatcccttgctgtaaaaatctttgttctaaataattataaaaccttttctgaatgtttccttttgtttgtttgtttgtttgttttataacttgattgccttttggaagcttgggagcttcattattgaacttattggcaatagaatgttccgacgtggaagaagctgtgactttctctgactcagtgaaataccccttaagtccatttcatcagccatgggtctcctttcttcctccctacttgtgttcagttttaataaactgagtgcatctggagttttttaagttgttgactatcttcttggcttttgtggttctaattccacttcctgtcagccctgggattttgtgtgcttcattaacctcatcccatcagatatgattttgtatacgtgtgtatatttgtatgagtctctgcctcccactgactcctaacttcccctggggtttaagtcacaaggaataagctagttgtttttttttttttccatttattttagagtaaacaggaattgaaagcttcccagaagattttggctcaaacagagcattggtgcttttaggggaaaccaacagaccagacatggggttcgctatattcttttggtggttgttcctgtccttccatcttatggatctctgccaggggcattcccttactatctcagtgtttgtatcctatgatttctttcccatcctaccacctgtaatgttcaactatgtttccaggtatcttcaatatcccatcctatttatttatacatttaatttttcttcagttcctgctgtgggcaagtcataggttagcctttcggcagtgtattaccatcaagtttgttcctctcaaaccaaattttatgtaggatgagatacagatatagatatatatatacctccattgcactattagtgtttaaatgtagacttgagaacctatacaaactacccgaaactttgtcatttaatgctttttcctagatttgcacatctggcaaggaccttagagaataattagttcagatatagaaattgaaaccctgagaaatgaactctatgttccaggttctagagttagtgagtgaaataactcaggtcaaaatgactcagcttgtatctatggggcttcagaagatgggttttggcaatcagataatcttgatcataagacttttgatttatagaattttttatgcctccctcaataagacagattttttacaatctaatttttactgccttccaagatcgtgaaaatatggtaccatgtgaaataatatgcttaaacagcaatcctttaaatatgcttaggaaattggcattgtgagatacaactggctatgagaatagcttttggatcagttgaagaaaaacagccaaaaacaacaggatgttcgctgctctttaaagatgttgctgctgacagtgggtttatctctgtgtattagcatggctgaagtcatgggttgtgacccaggcctgggatcatggggacaagttgtggagccacttgtagaactgatcagcctggacttgttctgatcagagcccagtgacgtgtttgctccgcaccagccatgcccagtacacctctgtgttgacgatacctggtttggttttctgttgctgccattcttgaccatttcacagggtaacctgaggttcttatagggaggatgtccataaataattgttggaggaatgaaagcaggcagtgtacattctccaacaatgtaaactacttggccacccacagaaaaataatgagagtcatcaatctcttcactttttgagataatctccttttttggtttatcatatgctcctgtttagatgggaaaggaagtttactacagaagaaacttatgtaggaagtatctactgtttatcaagcaaacattggttatttcctttaatttggtttcactggttatttctttttagtcttcgacaattttggttggtattatctgtgttttatagacatggaaaaaagattcagaaaggttaaataagttgtcctaggtcatgcagctaataaatggcaaagccaaatttgggagccagttctctctggctctttctccacccacataaagacatgtccttatgagtccggccacttttggcatgccccatatcctggattctccctctgctctcccgtaactagatactcaggaaaaatgatatcatcctttctagcagatcaggcctgaaaaggacactccttttgctctagttaagcatacccagtcctaaatactcctttcaaatctacctttacatctggtaaccagatagcatattgatttcttggactagttaaccaattggctgtgggcattttcttttcattttcttgtgggtctgcttttttccaaaattctccttctggaccccatataaagacttcctctttagctttttcaatttgaatccaaagccaaggtaaaaagaatttccttcatacaatagcatttcagtgacagtgagttctggctaatgtcagcactttccattgcctcagggaccacagcttcagctgggactttatttctggggagagttagtggattgatccaaaattagtggtgtgacatgtttagtaatctattaggccttggatggattattattttcttgagaaaatctttatttcctcctctctccctaaactaacttttatcaggttttttcttaatacagctttaatatgtaaagtttcctaagaatctctcttattttctttatgattggtggctttattataaatatttcaagtgttgtgatcagggttattttgtaggaagtggctgccaattattttgtctttctcaaaaactatgcattgtttttcacttaaaatatatttttttcattcagtatttctgaagtatttcctatgtgctagttatggtgcaggctacttgtaatacaacaatgaatgaaacatggaccctgccctcaagtgatagggaggagcagacatgaaatgataaatgacattacaagtagtataagtgactcaggtgctctaggaatatataagatttactagctgtgcctaggggatccacagaaagccatttttaacagcaagaatgtagtatgcaacatacagtgtcatgacaggatgtgatattttttgaaatggtaagaagtatgactaaatatagcgtgcatagaatgggggaatagaagatagggttatggaggtggatttgggccagaatataaagaattgacaagtttaaattcatcttgtagctaacagacagccactggaagtttttgagcaggggagcgataggattattattatttttctttaacttttatcataatttaatccaaagcttaggatgacagaattacaataaagggaatacagtacaatattactagcaatgactgacttaaaatcttctaggaaccaagctgacattagtttctgttgttggaccaattcactgcctacctctatgtgactgctaagtttgtttttctaagaaaagtataattctcatggccttgaagaatggactacaattgagagaggcaagtgctagggaaatgactaaggtggtaagaggtgtgcagtgataatatatacttaccatatgacccagtagtcccactcataggtattttcccagaagaaccgaaaccatatgtttatacgaatatctgtatacaaatgtttatagcagctttattaataattgccaaaaattggaaacaatccaaatgtccatcaactgttgaatgggtaaataaattgtggtatgtccatataatggaatactactcagctagagaaaggaacgaactatattattggtatgtataacaacatagataaatctcaaaagcacaatgctaagtgaaagaagccagtttcaagaaactacatattacattaatttcatttatttgactttctggaaaaggcaggaagcagacaaaaatgagatcagtggttgctgagggtgggagtgcgactggagaggggcacaagggaatgtttgttaaaattgtcctatgtcttgtggtggtgttagacaactgcatatatttgtcaaaactcaccaaaatgtatactttaaaagggtgaatttattgtatgtaaattagactttgataaatctgcctgaaaacaaaaagcaatgatagatggatgaacctcagaaacatggtagatgaaagaaaccagactcaaaagagtatataccatatgattccatttatgtgaaattctagaataagcaaaactaatctgtgatgaaagaaataagactagtcgttgtcagggatgggggaaagggcaggatacttactaggaagcagcacaaggagtccttttggggtgatggaaacattctatgtgggctgacaggcatgtgggttacatggatatgtccaattatcaagacttgtcaagttgtacacttagatctaactatttcatcatatgtaaattatacctcaaaagggaatagagaagattaaagagattaaagaggaagaaactggctgggcacagtggctcacgcctgtaatcccagcactttgggaggccaaggagggtggatcacttgaggtcaggagtttgagaccagcctggccaacatggtaaaaccccatctctactaaaaatacaaaagttagccaggcatggtggcaggtgcctgtaatcctagctacttgggaggctgaggcaggagaattgcttgaacctgggaggtggagattgcagcgagccgatattacaccattgcactctagcctgggagacaagagcaaaactccatctcagaaaaaaaaaaaaaaaagagagaaaaagagactaaagagaaagattaaagacaagaaagagagatagagatttggtgatatcttgtatttgggaggtggtaagagagtgtttctagtttggagcctggtggatggggttaccattctccaagatgaagaataatagcaaaccaaacagttttggggaaagaaaacaagggctattttgttgagtgttgaatacctgtggaatatcctagtgaagatgtccaaaaggcaatttgaattatggatttggtgtccaggagacacttggctaaagatgtgatttgaatattatcatcatcatcatcatcgtcatattaattgtggccatgagaatacctgagattgcctaaggagaaaactagaattgagaaggaaggagacctgagagtgtcaccctgagcaaacctaccattgaatatctgggtagaagagaaggaaggaaaggaggagtggaaaggggagaatcagaagagagcagtgtcctagaacccaagggagaagaaagctccagtaagtcaggggtggtcatcagtttcagatgtttgggcttagcaataaggtagtctttggtgatcatattgagaacagtcagttattagagagggagcagaagcaaattcttagggctgggaataaataggtattaagaagttcagacgttaagtgtagattgctttttcaaggaaccctattaaagaggtaggaagctaagtttgctttggtttggctaggggctgaaggaaatatttcttactaaggaaaattgtcctggggaaatgttccataaggcatgcaatagtcctttgaaaacacttgctcttctgtcatgataaagacaacacagaaagaggagctctcagaactggaaaagcccagctagcttgcacccattcatgacaggaaagttggtgtatctcattgtggatactgagtttttaaaattctcgttactgctgccaaaacactcaatattaaaagatgaggaagttgattatgctcagcacaacctactctttaccttttaaaatcttcaatgcccatagaaaataccaaataccaatagtaagtttaaaaggttctttaaggactctagttgcctgccaaggacccaaattatttttcttaagctgaattgattgtgttcaaagaggaaaacctgatacagaagcaatctttccaccccattccccccaccaatgccagcctttgaggtgagctgggttttgcactatgttataatgctgtcacataccaatatatatttcttctccaactcttaaatgatagtaggtccaagcctggtatgtgtacagatgtagttagattcaaggctggatttttttagtttgggcaccctctctgtagaggttgtttagcagtaacaagatttattcatccaaatgaaaattaatttagctttgtgaaggatgttttctctctaggtcattttcccccctcatatttcccagaatattggttctcagcctgtcaactgagattcttggaatttgcctctggtttggggaaatggttaagtaaacctgtagctgcttaatgcaagatacttaaatagtgggtttcattgattgttaatctgatttgaatttgtcttcatttgtagctgattctgtaaacctgatcaatatgtgcatcaattactattttcaccctgttcttcttacttttaataatattaccactttatgaaacagttgaatcctgtgcttcagcttttaaacaatgaagagaatattctttttcgtcaatcaaatgttgtattctctcttgcttataaaatgtttatgtagacttgtagattttgcaagtagatttttccttttaaatgccttatttagtgctatatcacagatgattttttctcaggttaaaggggcaatattctaaaagattactgaagattagatcagctattgagaagaatgtattagctgttaaaagctatgaattcattgcgaaaagaagagatgaaagagcttccttttctttacgttttaatgtataggcaatgtataaattttgtatagttacttgaaggtgatcccatctcaaactcttgtatagtttgtgatgatttttgcaaattaaatggaatcccatataattactatggaagccaactcattcatggaaaattttccctagaggatttagaatatgaatgtctgagttcatactgccatatatctgtaaatagcatccagatattgacagtgattaataaagaggctaaaggaaaccaaatgatgccaaagaaatctcagagagagaaatgatttccccaagttccacagtgtagaatcatggggacaactaaggtctctagattcccattctaggattctttttttttttcacccaggctggagtgcagtggtgcggtctcagctcatttcaacctccaccttccagtttcaagcgattctcctgcctcagcctcctgagtagctgggattacaggtgcctgccaccacgcccagctaatttttgtatttttagtagagacggggtttcaccatgttggccagggtggtctcaaactcctgacctcgtgatctgcctgcctcggcctcccaaagtgctgggattacaggcatgagccaccatacccggcctcattctaggattcttaatacatcatgtaacttcagactccctgtgttctagaagagagttttggcggccatctttttagagtctatttttttgttttctgagagtattgagaaatttaaaaatccttcttgaagcaaggaaatttgtatcagaattaatttctggaaaatacctcgttgtgttctgtgggtgtgagctctggtctgtgacctctgatcaaacagtaaggaaggtagtgtggtagtgtttacttctagagaaaaaatataagcagtttttttgagggtcacaggatgggatgtttaggagtgatgttttatatatatatagatatagctataaatatacacatacatacacacacacacacacacacacacacacacacacacacacacacacacaggactgtacattaccgtgatttttgtagaggaagtctcagtaataataagaagggtttcaaagttaacctctcatccctgaacttgttaaatgaaaccaggcattctgggaagaacacttgcttctgggtcttgctttctctttgcaacagttgggaaggtagagaaagagaatcaatacagaatccataaacttgatctctggctcctacccttcttaaataatattagtagtgcaaagataccttgtcacacctgtgctctgctaccactgatttctctttccttgtctgtcttttggttcatgttgggctagagtgttttattttctgtcttcaaagggaaattgaaactgtaggagaggggaaagaataaatacatttatatgtcttcttgacctaagttgcaaaagcaatatcttggtttaagaaaatgtgatggaaggattctagagaaatgccttcaggagatgtttctgttttcaaagttggcagggagggattggggaagggaaattcagagaaggcctacagcagtgttggtgttggttgtgcttgtttcattcctttccccgcctcttttttttttttttttttacgcccataagcacagcagaatcgtgcttgttaactattctagagtcaggtcgctttctatgtaggatttaggaacatcaatagacactgcatgataaaaacagtggaattttatagcattgttttcttattcctagaacttgattaatttctcttgaacttgaaagattcttgaaagattctctgcttctacttccacttgctacttacactcagtgagtttctaggcctgggagttaatgagattgagtcttctagatctttgtgtagttgtgacatggaaaatgatcttgtgtattgtgttgtgttgtatttctagaactctatggctttgacgtgctcatagattctactctgaagccatggttgttggaagtgaatctctctccttctttggcctggtaagtcagttccatcaactaaaaaaggacaaatcttcaagtagtacttaaagcacttttttttttttgatcatttctcttggcactagaagactgtttttttcctagttattaggtggagataaccagactttcttaaatcagctggtttatggcataatatcaaagtgcatatgacaaccatggatctctgtcttcctagtcaatttacaattatatcattcctgtttattaggtttctaagggatgattcttgcattcagttttatccctgtagtttttttaatagtaggtcttctattaagggtaaagaaatacataaggtatttccttcattaccgaaagttttacaggttcaaatccacatacactataaaggtataaacctggatctagggccatgtggataatatgtggtccttttaccctgtctcatgtttaaagtcatccaagtttaaagtcaaaaacttcaaacaacttaaaaatcttttttttactaacctattgtttagaagaaaagaaacatatttttcaataccagggaaaattcttattatatttgcagctacagccagaatttctgttcgctgtacacttctctaaactgagaactctagagatttatgccaaagaccacccagctgctgagtttttaaggatgagagatattggcaaaatgccaaggaatcaaataaagacagattgactacttttggagtgggagtttggcttaacctccatagtaaggtgtagagctagatattacagatgcttcagatgttatgcaactttcgtcaagtcagccttttgcaggttgcccagtaaagtatattatactatactttaaaagtgagaaatccccagaacgaggcactgagtatagcggccagagcagtttggttcatggaggaacacctcagcactgaagccaccgtggccgtcactgccgcagggaggcctcttgcttttggtcgatgttgtttttgttttcatgtgggttcccgcccatctggtgagattttggtataacttgtatttttttttttctttttttgccgtatttgcaagcctgcaagcctaagaaatttgttttagagcagacaataaagactttaaaaagtaccagtgtggccagagttgcttctcttgcgtgtgaatgtgacttgactgttgcagcagcaaaaagtaatttgaatggtggtggacatactcataaaagagcatactgaaaatctgaacctctaaaatccacagttttaatgaagtggtattcttgacttgtgcaaattttgaattgcacaagaccttctggtataaagaaaattgcatgttagagaatcaatggatggtgctgcgtttgcattacagaggacgaatttaacaccaggatttcatttctcatatttttgcccaggatttttcccccaccgcccccgtggattttatgggctttatgtgttgctcttcattgacatttggaaactttgctatattgggacccatcagagggcggctattctgttaacctacacacttatcaattgctcttttctttctctgttctgttagtgatgcgcctctggacctaaagattaaagccagtatgatttcagatatgttcactgttgtaggtgagtagtagtattttctgaactggactcacataaaaattaaccggagcgtccattttatcagactccataggttttgccaactggcaggtcctaagccatgctgaatggtttgtactaaaaaattatattttcagggaaatgtttatatgtttctacgacacttggctccatcctgtcctgaggctgaaccacaactaaggctgagacctgaggcacaggaattaggagctgaggaagagaattagcaaagatctggagaaagtgtatttttctccaagctgggaaagtaaaacccactgaagaagccttgttgcaaaggagactggctatatttctgctagacagtctctactggtctcaacgtgatcccttctgtagtagttataaccaaagcagcccaaagaagaaatctcattttaagtagataagccaaaactttgaagtggagatgcgcagtcaggtgggtattttgtgggcttgttggtttttttttaggtactataaaaagacataataaaatatatttgaaatgaactagtacctgatgtaccagcgaatgctataaaacttagctactctattctccctggatgggaatctgcttctttttaggaagtaagtgaaattagctgaagtccaatttccaaagccatagataatctacaaagccaattttgaaagttgccaatagaccaccttctgcagttccagaagtagatcatgtaacaggatgagactgttcacttgcttttgtaaaaataactttattttccagtcatcatccaggtagccactttaaagtaacttgtttttattaacaactgtgtgttttaaaatggtaatttgcggttactcttaagttcttcaaaaatctacatctctttctcactcagaatcacatttcagctacccaaccagcaaggttaattcatctggagatttcccttttcttctctctagttatggtggttcagagttcagagggtgtgtgtgggagagttgtgcattatgctcctgaggatagatctctgtgatatttatgacagtgaaactgagtttgtgtatctaaagaaaaggtgcagccagacctgctaatttcttagaaaatggcaggttttaatgttgcccattccccattcaggatttgtgtgccaagatcctgcccagcgggcatcaactcggccaatttatcccacctttgagtcttccaggcgaaaccctttccagaaacctcaggtaagccaattccacagcagggagcctgaaggaggcttactgggaagtggcggctgatgtaactgtgggagcagaagcactgtgggtatgaggtcacttagagcaggagaatttggggatcactctagacaggaggcagttatattcagctgtggctaatagcttatgctttcaacattttccaagaaacttactccctgttttttgttttgtcttttctcttggctttttttcattatcttccttctttctgtttttaaaaatcacgttttttccgcctcagattgatatgctcagaaacaaggcacagaaaaggagcctattaattcttagtcattactgcattctttctgatcttcagactagctttgtaaagaagatgctttgttgaaatagtatcttctctacaagtaattctcctcaaaggaccctccatgatcatgagttattgattgaggctaaatgagataaaagcccaaagaaacttatacttgtctaaaatatcatttgatcaagcattgcttcggtctttgtgtactctgcatttttgttccagttaaaccaatcagctgatccttctatttactcattccatcatcttgtcagtccctgtctgttttgaccctgctaattttccacttttgtttcttggcctttaacatttcttcttatttaaaaaaaaatccactttgctcttctcttcccatctggtttgattgctttgcctgctcagacattttggaagtcttttcttattaaatccatcgtcacctttacttttcattttaacatttatttacttgttctatattacattgttttgcattcattgatttgttgcttttaaattgttctgtactctcctgccagattgtaggctctttgaaggcataagcagctttttcttcctactccccattttctctttccttttcttctctccttttatccctgccccaactccactttaaccctttactcctcacttttttcctcccttcttccactcccattcctgctcttgttccttttgcttgctagtctcatttggagtagtgctattttctgtttgcgaaatccatatactattatttattcagataattttttattagaacagggttttcaaactcaaatgcttagagggcctgcaggcaggtaatataaatgagtaaatagaggcaggcataaaacagccaagagtgatatgactgaggtaaactggagagtgcatacctcatctgaaagggatggctgttttactaatgtgctctagctaattactatcaggcataagtgtgggccaggtgttatgagatcttgctattgtcaagagaaatcagaaatcttacttttaagtattggcagccacttcattagaaacaatactttgcaggccaagcataacatgtctttgagctagattcagtctatgcctatctatgaccccgtgctgcagaattattccctaattaatgttgggatgtggaacagggtgtactgtattttaaaggctattatcttggattaaatataaaatcagttaccagggttgtacttgatcagtgcatcatcagagatcaaagggttttctttaatttttagtaagaaaaagtagaggattaacctaggtgtactagaaaaacttaatttaggcagtcacattcctttgcaaattgtttcctgcagtatctgtggcaagaaccacagaattatgtataaaggatcatgaacatttctgtgcagctttaacacagtttctgccaagtttcacttctagaggtagctgtattgccagtcttaaatgaattggtcccttttcttagtttgcctgtcagctttattggcaactctttgcaaactctagaaaatctgttcaatgcttgttttgccaactggtaggtaatggcatgattacatccataagcagcctacaggacacttacataaaggctaaaggaactgtagattggtcatgtgtactgtgtgaaaccagtttgtcaggtggactagttgacttcaggatcttcagtatctggcagtaggattgtgccctcagtggtgagaagttgaagctggaatatatatggcataggagaaagcagtgtgaaagaaaataaatgttctaaccttccaaccacaaagtgtagggctcttgcttttggtttctgcttggagattattttttccttttttatatcatagatctaggagatggaaaatgtaggcatattaggagaagataagggtttattccatttttctgtcttttatagcgtccagtatctgcacagtttcagtcgtcaaaggccaagcaggtaagttctagatcttttggagacttcttcaaattttattttcattctccaaatggaaagttttttagctttagtttttcatggtacatatttttatgtacctatttttttgcgcagtttaataacaaagtgaatgaaaatgaatgcatagaagtctttttggttataggatataagagtagaggatgcaggaacttagggatcctcttttcctgatagtgattatactgagatggagacagttgaatttaaatgaggaacaggggcttgaaggcatatctatcactttgaccaaaataatccaggaaggaaattttccagttcacaaatgaacttcaattttttttttcagacatcttatgaaacatactgttgtctatagcttaatattggaaatgttttcacattgggtgtagggttgtatttgagttccttaacaggtgacatttcaaatatgtagtgatctgcagtttataaatcttagaagctctgccacaatagtgtctcagatgctacctttgaaatacaaacatctttctttctgaatgatcagcatttgctttcttactgtttttgttagcagtatttgagattaaccattgctttcttctgcacagatttaaaaaattctttttgaagtaataggctagcagtgggggtcctgtgcctgctatttgatgctttagtatgagggatatagatattctcatatataaacgtgtcactgcaactgttgtttagcaaaaagctccagtatatttattttggcgtttgtactctctgatgcaatttctggtaagcttgaatgcttgacatgtaacttttcttagctactgtttctgataaagtgatttatatggtttatgtgaatccaagaaatgaaaaataacttactggatgccttgtctaatatttagtaactgattaatgtggctctgtagtatgagttttggtgcttagttggtggaattcgaaactctataatatgtagtattttatatttagtaaatacctaagtatgctagttgctcccatggcagaaaacaaaacaaaataatgctgttgacttcaaagagcttatattctaaatatacctggaactaatgtactgaaaggagtacgttaggaaaggggtactctttcatagcctgtggcatttgactgtaaagaagtgtctttgataggtaattctaatttatttttacttacttatttgagacagcgtgtcactccatcacccaggctggagtgcagtgacgcgatcacagctcactacagcctggacttcctgggctcaggtgatcctcccaccttggcctcctgattagctgggactacaggtgcacaccaccatgcctggctaattttttgtatttttggtagagatgagggttttgacctgttacccaggttggtctggaactcctgagctcaagcgatctgcctgcctcggccctcccaaagtgctgggattgcaggcatgagccaccatgcccggcctttgatatgtaattctaatcttaatttctcattatcaattttaattccattacatctagttgcattgcttgaattaccgtaggttgtaataggcttgttggagagcaagacctctctttagtagtaatgtatctgaatacttgcttacgtgacataaagcctttctggctttattcagccagctttatacatgttgaattctttgacttttattgtactttgcaatgttctattttgtcattgtctttctgttaacgaagcactcttaacttcacagtattttcattggagctaagtaaaaaaaaaaatttctttgttctgaccagttagactgtgtcaagctttctttttctgttgctgtcagattgtgaattctcttagtcctttgccctttttctgccttttcctttttaaaccattatctctatatttctcctttctctttaatgtctatggttcaaattttccactcaccagaaattgtatggcatggtactgtggaaagaatatggacttttacagtccgatagacctggattcaaatttgagctctgccaaaaactagcaattagacctttgggcaagttctcttacctctctgaggctcaattcccacatctgtcatatggggataataatatatacatgaagttacagtgaggaagaaatgataaaatggaggtaaaatattcaggataagtgctagacatgtagtttacactaagaagatttactccccttcacacttttgagtcttttgattttcccattgtcaagatctcttgttattttgatattcacctgtttgtagtcatgtttttcacatttgccatcatccacaaatgctattttgtttttccttccagatgttaatgaagattctaaataatgcttagttaatacccattccagaaatcactttctaacttgattcactgctatttatcttgcagttacactgttttcagtgtttgttgatgtgttatattctggcactaacccctaactggaaatataatttagaataaaaattttgtgaaattttctcaaatgcttctctaaaatccaaagacatttaatatattgctatagttccccttttaaaaatcttgtcctaaaaatgaaacttttaaagcatgttttaaaataaagcattcttcatactattcttcataagcccattatcctctaagttattagggattttttccttttaatatttgttccattattttactagggattcgagttaggtttaccaggcagtaaccaccaggagcatacttcttacatttttgaagattagtacctcatttggtttttttctaaactggtacctcctcagttcttcatgatttttcaaacataattataagtggtttgggtaagttttgtttgtttttaaagccaatttccttaataacaggatgcatgtctctcagacctgctggcttacatttattccaaatttctagatgctgttacacaagcctacttgctttctcccctccacctgccaatttcaaagtataccctgattatcagtatgtttaaaccttctcttagaagccatttttttggtccatttccattcagatttattgataatgtggtcttttccatttgttttctttcatttgatagcattcattttacttttaaacttgattttacctgttgttttttagatggtaaaatgtatcacatataaattgagctatttctagttcctttgcttttaatgaagaattccaaactttgtaaaactgcattgggagatttttattctttgcatgtgttctctgtcaagcaaattttgtttttgcccctcaattatgacatagtcttaggatatcttgccatttttccccattccacattttgttaagttcttctcatcattggtacttgccagctttttaaaggctgagagtcattttctgattcaacatctgtttcttactactttgattgagtggagactggtggttccttgtctcaataatttcacactttcagccagttgttccttagcaatgatggttagatatgtaaggtttcttctctgggaagatttctgaatcgtaagttgtactattgataaattcatctttatccttggtgcatgttgcatggcagaattcttgacagtaatttgacagtttataatttatctgagcactggatatctaaatcatgtatcttttagccagaggcaatggttctcctctctaagttcagaggaccttacttccttagtgcattcagtcaactcatgggaatatgtggatttattatatctaccacccagagaatgtagttgatgtgcccaaaggcaaagctgcagaatgacttgcgtttggactgttttgcccttgtttttgatagtcttggtggcctttcaaatcagtctgattcctttttttttttttttaactttgctttgtttttaatctccaagtgtgtctccttgacactcataagcatttattttctttttttctgtccatcttatcctttcttcttcccttctctctttctctaccttttctttcacctgtgtctataactcaggtcacagaattagagacctttctcagagctcttaaataccccaactagaagcacagacctgaattcctacatgcctctacccgaccccaaacattcacaaataatgtacacagtagctagacctagaattgtaggctgtaacaaaggagtggttgtgaatgtatatgggagacaagtctttgaaagtgattggcagagaagttttaagagttttggggtgctaattcattggttacagaaaccacattaggttagtaggagaaggttgccacatcattatctcaatttctagaagccaggaatattaaaaaaaccattaaaaacaatacccaggaattggaagttctcattagatgtcattcaatagtgatttgacccctgttcttttaaatacagccatgcattccttaatctgtttaatagttaataactttttctttaagtacttttaattgacctttgatatagcttttagtttatcaaccttctaagtaacattctttctgttcttaaatgcttaataaagatacctatttttattatatcatttaaatgaatgtttgtttcttactctctctttacgtaatttgagatttgaggctgtttcttactctctctttacgtaatttgagatttgaggcccttaaatagtgtcatgtaagaaagctacttaactgtagaggactgactgccagtggctttattgttttgttttgttttgttttgtttttgagacagagttttgctcttgtcacccaggctggagtgcaatggggcaatcttggctcagtgcaacttccgcttccagggtccaagcgattctcttgcctcagcctctcacgtagctgagaccacaggcatgtgccaccaagcccagctaattttgtattttgaatagagacaaggtttcaccatgttggccatggttggtctcgaactcctgacctcaggtgatccacccgccttggcctcccaaagtgctgggattacaggtgtgagccaccacaccaggctttgccagtggctttatgatcagagacatgctgtgatgggtgaactaggtaagtattttttggcaaacaataagtagtgtgtgatcatgagaaaagtcatcaaactatccatttaatatttttgactttttccaaattatacattaaataagtgttcacactttttaaagatttataaacaatggttatattatttatatttgtttccttcctaaatctttcaactttcccctataaaccctctcattttaacatctactgtttaatttattcccagagattgaggaagtaaaaatatttcccaaaatccttctgcaaagtttacttctagccatgattgatgtcagcactttcacgtatttgtttgttcaaccaatatttcttgattgacttcatgccaagtacagtgtattgttctggatgttgaagataccacagtaaaagcccctgcacttcacatgttgcttacatctgttgatttcatcgttttcttgatatagatatccatcatggagttgccaatcagaaaatttagcttttataactcccatgctagctttggagattggttagttggtctctcttgtgtccaaagataaaaccatccatggttggttatttgtgtacatgaatatattagtctgttcaggctgtcataacaaaatgccataggctgggtggcttaaacaacagaaatttatttctcacagtctgaaggctgagaagtccgaggtgccggcaagataggcttcattctaagtcttttttctgttggcttataggtctccattttgttgtatgctcacatgacctcttctttgtacacatactagctggggtctgggggagagagagtgagatcaaactctctggcatcgctcttttttttttttttttttttttttgagacggagttttgctctgttgcccaggctggagtgcagtggcgtgatctcagctcactgcatgctccgcctcctgggttcacgccattctcctgcctcagcctcccgagtagctgggactacaggtgcccgccaccacgcccagctaattttttgtatttttagtagagatggggtttcaccgtgttagccaggatggtctcaatctcctgaccttgtgatctgcccaccttggcctcccaaagtgctgggattacaggcatgagccaccgtgcccagccaccatctcttcttataaggacactaatcccattacaccagggccccactctcatgacttcatctgactttaattaccttccaaaagtcccatctccaaatgctgtcacattggaggttaggacttcaacatgagaatttttgagagaaaccaacattcagtccataacaacgggtgttgctaaaaaggccaaaagttagttaccacaatgcctttgaatagatattctacaaatagagagagagaaataatacctcgtgacaatggggctgctgctctctggttgaagttacttctaagaatcaagaggacaatttgcacccatgtgggtgaattctttcttactttttgtacttggcagatttgtcttatttttgtctgtcacttcatctatttcaataatagtgtattattatgcttttatactgacttccttttttaccttcctatttctccactcgcataaaatcaaaatcacttaaaacttgtgttttcagatgacctccctcatcatcatgtagaagctgaaatagccaagatcctcttctgggatcagtgatggacagggcccatttggctgccttcttggagtacccagggtagtcacgtttgtgccaggcctcttgaagtccagcaaccacagtgatagccttttggccacagctcttttctgtgttactgatgtctctcatctcaatatttccccctcaaattgtaaaacatttcacagcccaactttttcatttgtgatataatagattgttccttggttttgtgtcttatgtctcaattctcttaattgttcatctcctgtgctaaaaatatacccactgaaataaatacacatttatttttctattgagggcatcttcagatttttccatatccttgaaatattggatgtgctctaaaaccaaggtttgggttaaatactagcttagaaagtcacgtggacctcattctttctttcttctcttttctctctcaacccatagtgttcttttactgttctgttttctcctcttgcctttgagtttattagctttcgtctgttttccagggttccaggctgagattaattacagaaagtgggctatgaatttgagcttataaatctttagaaaaataatgatgttgagggaatgaacagagggtaatgaggagtaatgaaaacttaaaaaattttttttactattttcattttcttctccttagcgttgccgtccactctctgccagtgatgcggaaatgaaaaacctcgtgggctcagcccgggagaaagggccagggaagttgggtggttctgtgcttggtctgtcaatggaggaggtaaagataagttcattttaggcttttgtgggttaacacagggtttagtgaaaattagtgagtgattgataatattcatgacaaactcatgtcttacattgaaaagagaaagattcaagattggagaaatgttttctcagggaagaacattttaaatggaattaatttctcccttcatgctactttcatattcttgggtcataactatcttcctttgtcctatagccacatggactccggttttcaaaataggtactcattttatcttatttttcatctagatcaaagttttacgaagggtgaaggaggagaatgatcggcgaggtggatttattcgcatatttcctacatctgagacatgggaaatatatgggtgaggtgactaccttttttttttattctttacctgaggtccatagaattagattaattgtgatacactgtcatcactgctccccccgatgatgcttttcttattttgtttatttataatatgataaatattatccaacccgagaactagattattgacagtaatttaatatacctgtgtattatttctcccttttaatcctctgcctccctcctaactagcttcctatcccagggttagggactgtcctaaactttgtgtttatcattaccttgatttgaaaaaaaaaattgtttatctatatgtgtatctaagcaatatattgttttattgagatctagtttatatgcagtaaaatgcatctattttaaatgtacagtttgaagatgatttttggcaacaataggcaccagtttaaccactgctactgccacaatgaagatataaaatatttccatcaccctcgtagccctctttatccccttttatattcaatcctccacatgaccctgggcttcagacattatgacctgccttctgacattacagtttttctacagttccacataaatggaatcatacagtatgtactcttttgtatctggactcttttgttcagcgtagtgtttttcatattcatatgtgttggtttatgaagaatagttcattattattattatatactatgtcattgtttgaatataccagaatttgttgaatataccagaatataccactcatcttttgtagacatttgggttgtgttcagttatggtctcttttgaagaaagccgctgtgaccattcatgtacaattcccagcacctttaaaatgtcttttcgtcattttcaggcttgcgtttttctgatgagaagcatacagcaattattgtctttgttcttctatgcataatgtctttttttcccagcttgcttttaggattatctctttataactgatttcctcttttcttttcttttttttttttttttggagacagtgtctcactttgttgcccagactggaatgcagtggcacaatcttggcttactgcaaccttggcttcctgggctccacttcaagctatcctgccacctcagcctgccaggtagctaggactacaggtacatgccactgtgcatgactcatttttgtatttttttgtagagatggggtctccccatgttgcccaagctgatcttgaactcctgggctcaagtgatccatctgccttggcctcccaaagtgctgagattataggcgtgagacaccgtgcttggtcacagctgattttcagcagtttgattatgatgtgccttggtgtcattttcttcatgtttcttgtgctcgggattcattgagcttcttcatctatgggcttatagttttattcaaatttggaaaccttttggcctttatttcttcaaatatttttttctaattttctcctttcctgtcttcttttgggactctggttacatgttaacttagtttatattttaccacaaatctggctgtgctcatgttttttcagactttttttttcttgctttccttaatttgggatggttttgtatttctgtgtgtctctaaggtcattcatcattttgtctgcagtgcctagtcctctattaattctacccagtgaaattttcatttcagatattttatttttcatcagtttttgtgtgtcctttttctctttttcattatgttcatgatttcctttacatttttgtttacatgttataatatttgtaataaatgttttaaaatacctttttctgttatctgtcattttggggtctgtttctattgactggttttcctcatgtttatgggtcacatttttgtttcttcacatgtacagtaatttttttaattgaatgctagacattgcagatgttatattgttgagtgtttggattttattgccttctttaaacccttttgaatttttttttttttggtcaggcacttaagttacttgtagatcagcttatctttttcaggcttatttttaagcattgttatggtttgtttatagtagctttttgtctagatccaggttagttcctccactaaagagtcttttgaggtgtctgttaaattacctccacgttcaatgagatcttttcattctgtctggtgggaactcaatttgcaacctcatgtgagctctgggaattattcagcttacaccttaccttctccttaatttgttctttatcctgatagttgcactttgctcagccttgtggactttcaccctatacctaagcagatttgtattcacccaaacattcaaggggtccctcatgatgatttttgaatatcttcttctgcacaacttcttctccaggacattgctctgaaaattctagctactccctagaaattagatttctcttgtctcttttcagagacagttgggctctatttgcatttcctctctgtctgtgtagtctggaaattgcctttaggcagaaatgtagggcagttgtacttcgtgtatttccctctgtcagagatcacagtcctgtgctgccagttgtttaatgtctgaaaacagttatttcaaataacttgtaaacttttctagctgtttatggtaggagagcgtgtcctgtaacagttatcctctcatgtatagaagcagaattctattgttttgtttgaatcacttttaaactttttcttaaaaaaaaaaaaaaaaaagacatgttctatgtatttttgcttttttcattcagcattttgtaattcaggttcatgttacatatagttacagtacagttttttcaatgcttttgtatttactgtgtgtttatattgctgttaatttttctgttctcctgttgttaagtatttgacttctttctggtcttttgctgttaaggacagctgtggtgcagatattcttgtatgtgtctgctgggcatgtatctaggagtggaattactgggccttaaaatatgtgagccagtaaatggcctggtgccactcatttcagatccgttgctgaagtttttgtataggctcagtgccttaagacatgtgaatgttaagctttaaaaggtaatgctttaggaaaaaagataaagctaaattgttttccaaagtggctatgtaaactatcagcaatgcataagagagtctgttgatctgtatcttctccaattgcagtactgtcagacttcttaatttttgtcaatctaatgggagtaaaatatcttattttggtcttgatttgcatttctgtgatttctagtaaggttgacactctttgtacttgtttataggcaacacactttcttcctctggtgactgcattttgacctagttgggatgttcgtggttctaagtatagaggtagaacttagagaaataaaagaaaaagccatttttaaaaatttgcctgcttgttttgaaaacctagctgttcatagagaaatcgtccttttatcttttaaaatatgctattcatgtagttataccttatgaagacctaggagttcaacagaaaaatattacatgggttttcttgaaaattatatatatatgtatatcttttgaaatgttttttaaagaatttgaatttttgcatttcctagaaagtgtatcttttaattaatgaaagggggaccatttacttttgagtatttcaagatataggaccttactttgagtatctttttctatggaatcaattacaaataatcttgaggtctcttaaggaagtccaacaatgatacctttctttactaggttggttttgaactagttgagaaataaaacaaggactaaaatagatagaaaccaaaatactgtattttttactgataaagtctaggttgggggaattgattgtaactgtctacaagcaaatgcacttcctgttgagcttcagaattggacggacttatattcctattgtaagcaaggttggtctgagccatgtatggggagtgctgaccctataggagcagtagaggatatgtatttcctaagtggggattagctcccaggagaaaaaagagaggtgctcagtgcatcattttctgtttatttttcctaaattaccaatcacattggtaagttactctaactctcttggtgcgttctgagaaaagaggctcaattaatattaattgaactgcctttacatagaatgtgggaggtatgtttatctactaacaaatatgctattttattagtacacatatattatcaacaaatgtctacattatgcttggttctttggtgtataaaataaatattaggtgggctccctgtcagttgagagttaacagtatgtttatggaaaattatttacacatataataagaatagctttattactttattcctaataataatcttaataataagaatagctcatatttgtatagctttttgtaattttaatgtactttgtatacttcattgtttcactcacattttaatgacagggattctaaggctcagtaaaacaatgtgacttgtccgtaaccacacagtgagacttgggtcagatattctgatctagatctacttttttcctgctgcatcatacagctttcctagaacaaaaagtttgctctgtaggcacaggttatgagaggtccttaggcatacagtaaagacacgttagggcatatcagggaaggctttgtacagcagggtggacttgacctgctttttgaagggtgtagtacagtagaaaactgcttatcagcagaggattatcagcggaggataccttccaagagcccctgtggatgcctgaaactgtggacagtaccaaacagttgacccttaagcaacatggatttgaagtaaaattatacatggattctcttctacctctgccaccccgagacagcaactagatcttcttcctcctccttatgattttcttaatacattttattttctctagcttactttattgtaagaatacagtatgtaatacatataacatgcaaaatacgtgttaatccactttttgtgttattgataaggcttctggtaaacagtaggctattagtaattaacttttttggggaagcaaaagttatatgcggatttttgactctgtggcagggccagtgcccctaaaccccacattgttcaagggtcaactatatatactatgttttttactatatatgtacccatgataaagttaaatttattaattaggcacagtaagatattaatagtaactaataataaaatagagcagttaaaacaatattctgtaatacaagttatgtgaatgtggcctctcaaatatcttattgttctgtacttacccttccttttgtgatgatatgagatggtacagtgagatgagatgaagtgaggtgaacgccataggcattgtgacgtggtgttaggctactgttgaccttttgtattcctgaatgtgtgtaaccatcccttatttgcagtaaatggcttggtgtcactcatttcagatcccttgctgaagtctttgtatgggctcagtgctttctggtgtgacacactgctgtcacttgctcacgtcttccaccccaaaatgtaatgtcttttccacctgagcacttatcatgcactgtggccatcacttttgcaatctgaggtgtgacagcaaaactagcatgaatttctttcttcttcacgatgtcatggatagaaaatttgttcttattttagcagctccagcatgtgatttctttttccttaagtcaagaacttttaccgtttcaccgaaaggaagcactttacagttctctttggcatatgcagattgccagcctcactactcttatcttttggggccattattaagtagaataaggattctttgaacacaaacactgctaagtgattcatgggcctggagtgtctacagtgcagagacgctggacaaagggatgatccacattcctggtgggaaagagcagaatgcatgagatttcatcacgctcctcaggacagtgcataatttaaaatttatgaattatctctggaattttccatgtaatattttcagtctttcgttcactgtgggtaactgaaacatgagggaggaccactgtatagatgtagaggagatatggggagaagataaccagtcagaggcaaaagatcagtgggaggtgagagagtgttactggaaagggatcccgatccagaccccaagagagggttcttggatcttatacaagaaagaattctggtgagtccataaggtaaagtgaaagcaagtttattaacaaagtaaaggaataaaagaatggctgctccataggcagagcagccccgagggccgctggttgcccctttttatggttatttcttgattgtatgctaaacaatcaagaaataaggtggattatccatgcctctcctttttagaccatgtagggtaacttcttgacattgccatggcatttgtaaactgtcgtggtgctggtgggagtgtagcagtgaggacaaccattgttcctctcactgccatcttggttttggtgggttttagccagcttctgtactgcgacctgttttatcagcaaggtctttatgacctgtatcttgtacagacctcctgtctcatcctgtgacttagaattcctaaccatctgggaatgcagcccagtaggcctcagcctcattttacccagcccctgttcaagatggagttgctctggttcaaatgcctctgacaagaggattctaaggagacttggctgactgtactgcaggatccgtgttgggcaactgtgtggagaaagtgtgaatgaattgatgttacagatgatccaacttttgaaagtttggaagagaaagtatttgccttaagcagtagacatcgaggagccactgaaagctcttaatttgggaataacatgattgaaacagtctcttatctacattttcaggccctttatgcatctcctattcccagtttcatttgacctatatataaatttttgttaatttttcttttatctttcagtcttattttctgaatttagtatattacctattattaatccaagaaatgctggtttttctttctgttttctacattaaatcctctttttccatattctttttattctatttgtttctattctagtatcttacgatttaaatttgagcaactgtcttttcctttgccactttagaaacagtatgtttcattaaaaacagtatataagtacccctgttatttctgtgcttgattcatggttgtatttctacattttcctcttgaactagcttaagaaataaccagtttctttctttgcttttcaggtcctacctcgagcataagacctcaatgaactatatgctggcaacacgcctcttccaggacaggtagagatttgctaaactttaaatttaggactagatcacaagattaacagaaagtacatgtcaaagaaggaaacagaccttataaaagtctttatgtaaaatctctgctagaaaaaaaagtcctgtagaaagcatgctatcatgactcatttttccagaatttatcatgaactctcagcactttgtaacatttccaaaagacaaaaatttaactataaagatctttgagcaattttaacagatgccttaaactttattcttctttaaggaaggcctttacttagtgccattatattttagatgcagttttaatagacacgattatctgtttttctagacctgaagatactagaattatcagattggaaaaagtggaggggaggtaattcgtaaaataaatacactgaaacttttataagaaatgacaactgataatctcagtacaagggaaaatggaaatgatggaaaacagacattggaatttaaatagcacagcaatcagggctgcttagtcccacatacttttgtagcccctgaaacataactgcattgcagtacagttcattaattgattatcaaaataaggcaccctagttatttagagaaacctatattattttgaggatatatgtacgtttttgaaggattcttaaaatagatacccatgttttaaccatctgcaatttcatgatctactatcaggaaatacatgggatttgcaatttgtctctgtaaatttgtggtaattacgattgattaatcacattgtgtagattctaaagaaagagatctttggatttacgtagaagacagaatctcatttctttatatgtataaaacctgtgggtttttcctcccctctatgaaaacttttacaaggtttcttttatctttagagtttagatactttgccaggatgtgttctgatacgtcatttttcattattttggttatgcagtgagtgcggcctttcagtctttcagctgtgggaagtatttcccttatcctttcttttctctccttgtggaattcctgttagataaattttggctataacctccatatttctttactgtttttaaacttttggttttgcttcttagccttaaattcttggagatttcttggattttgtcttccaaaactaaattaatcttcaaccatatctatattgttatttatttcccacacaggataggggtgtttaattaagttttttattttggcaagtgtgtttttaatatacaagaactatttttgcttttcgattagttttagtatttcatggatgtaatgtcttttcagatctctattttagattgtttaaagttcctttctgttttttgcattattttaattcttctggattagttgtatttattcatcttattctttctagttttaacttctatatatctgcaaatgtatggtgatctttgtccagtcatatttagaagtaatgaactgtttgcttaagacaggtagtttgcttcacaggttatataggtctgtttctgaactgacatggacactgcacttgaggctggatctttctatacttgaatttcccaggaaggggaaggagggcagagtaggcattctggggaccactgcattagccaaaatgaggaagtatctgcctaggagtagcaaaaaataaacaatttgaggtataataatatgtgtgcctctttgttaacatattaaatagtaagagctagcagcagatctaatacctaccgtaatttcaaacagtgataaatattgacagtatttcaaaatagttgtaagaattctaaaataatatgaagaaagatgcattatttcttttggtaatgaagtcacattaatccactactgtggatagtttcctacatttatatggaggaaatgctaaatttcagttagaggatgtaagtttttttctatccaagtttgtatattgcctgcattctttcttgaggccccagttaacagctcctgcttatgaagcattctaaaaactttgattaaaaaaaacataatttggccaggcgcggtggctcacgcctgtaatcccagcactttgggaggctgaggtgggcagatcacctgaggtcgggagttcgagaccagcctgacccacatggagaaaccccatctctactaaaaatacaaaattagccaggcttggtggcgcatgcctataatcccagctacttgggaaggctgaggcaggagaatcgcttgaacctgggaggtggaggttgctctgagctaagatcgcaccattgcattccagcctgggcaaccagagcaaaactctgtctccaaaaataataataataataataataataataataattttccctgtttagctaagaaaaaccctcatggtctacccatgcttacctttttagcctaattgtcactttttcacaccaactgatggccatttctacttgctcttttatacatccatattcttacaaactccccttcttttggaatggccttcaatccatccctaaattcttctagctttgtccttcctcctctatcctagattagaaagaggtactcccagcccttcttttatccctcagtctaatttagattcccagattgtataattgcctgtttactaatttgtgctttccaggttggctcttaagagtagatactttgttatgttcatctttgtcagtatcaagaacctaccacatggtaggcacacacacggaaacatgcattgaaaaaaatgagattgtgtttgtagcaagtcctagtatcttccaataaatctgttctctcatcagtctaaattgatattttccttcttgcagatccaattaattttgttattattaggaccattttcaaactaattctctactcatttcttttaggttaattttgactaccttccttaccttcttgactcctccccgacctacccactctgttctggcaaacagtatcttacatactgtcttatactatggcagttgctttaaccctggcttatgtcctggccacccccccaccgccccccacccccacccagagtgaagtattggtacttactaaaagctgcccaggtaattataatgtaaagtcatgattgcaaattactggagaaaaccattatctgggtgaaaaacttaaaatcattttgagactttctgatgattacctgacaatatcaggacattaacatggatagaaaacatgggaaaggaaagacaaaacatcttggtgaagacttaccttttcactggatttttctttgcatatcatctacattgcatttgtctctttacaaaaaaaaatcaaaacatgttatgtgactctatataatatttttgaagtgacaattttagaatggagaacagattaatgaggcagggtttaagaggtatgggtagttataaaagggcaacataggggatcttcatggtgatataatcattgagtatcttttctgtggtggatacatgaacctacacaggcagtaaaaatgtactgaattaaatacacacgtacataaatgagtacaagtaaaactggggacttttttttttttttgagacagtgtctcactctgttgcccaggctggagtgcagtggcgcaatctcggctcactgcaacctcctccttctgggttcaagtgattctcctgcctcagcctcccgagcagctgggattatgggcccatgacaccacacctggctaatttttgtattttgtagtagagatgggtttcgccatgttggccaagctgatcgcgaactcttggcctcaagtaatccacctacctcgacctcccaaagtgctagaattacaggcatgagccactgcctagccagaaattttttaagagtgttaaatgaaaggaaattgaatgagagtgttttaaaagaaaaacaaaagcctattttaacatgaatagcactcaatttctgtggttagagcccagtcttagtttagagacaatggagagtatcttttttcaatagaggttttgttgttgttgttgttgttgttttgttttttttgagaggagtctcgctctgttgcccagagtggagtgcagtggcatgatcttggctcactgcaacctccgcctcccaggttcaagcaattctcctgcctcagcctcccaagtagctgggattacaggtgcacgccaccacgcctggctgattttctgtattttagtagagacagggtttcaccgtattgcccaggctggtcttgacctcctgagctcaggcaatccccctgcttcggccagccaaagtgctaggattacagctgtgagccaatgcgcccgtccttttaatagagatttttttttaattgtggaaaatatatttctgatgagcatcccttttgaaccccatgagaattgagcttggtttcttttcctaaaacagttcagtgaaagtagaaagagcactacagtttgagacctaagccagaggctcagatgtaagccctttaagctccggccatggcaggtcaaaaaattattttatcctgctcctttctataaatggagcgaattaacaaccttcttcacatggtggttgtgatgaataagcagtttgctttgtaaatagataagcaagtacaaataattattataatttttctctataatttgtccttttttgttttttattgatgtccctccagctcacagcactctactcttttatgagaatgttctcaatttatctgtctgcttttctgcaaagatgccctccttggcctaatgtcatgttgaatttctgtattaaaaatttctggagtgcatgtgtgtgtgaacttaagagagactacctgaatagcattctctaacccggttgtcctttctgcttctgtaggggaaacccaagaagaagcttattgacaggaagaacacggtaattgacttttaaaagttgagaaatgctttccatgtgcataatgtgtgaccatgcacagactaagcataataccttatataaccatttttagtttggttcagcttgaatagtaacataaaaattttttctattgaaaaagtgttttgtcgccactttttacaagctaagtttgagatttacttcactataactacaggtatactattctaactgaagatggtattctcgtttagctgtgtgagagagagtattaatgagattttgaaactactgtcatgttagattcaagtacagagtttgtgttttggccttgacatacctgaggcacacagctctgtgcctcatggtacagaagagaacctgtttctagtttgccacagaactgaaagtatacaaaacacctgtggactttcatttaggcagagagccctttaaagcataaatctaatttttctttaaagaaggaatacattatgattgccatttagttaagggaaaactgagataaatcaagtttgtagcttgtttccaaatagaaagtcacacttggtgtataagttttctccagttttgagtcaagaaatatgcttcctataacatactgctgttaacttggaaattgagaaaaaagaaaaaaatcttaaacattaagaataaatgaagagcactgagttctgttgttcattttttggcactcattttatattgccatcaatagggattttgggccctgtagaggtgtaagcagatgcaagctggcatatgatagaccatatgctggagcatgaaacaagtcctaatatatttaaaaggattaaaatgatacagagtatgttctttggccccagtagaattgaatatcaataacaatagaaaatcttcacatatttgggaattaaacatttctaaataatccatgggtaaaagaagaaatcatgaggaaaattagaaaatactttgaactgaatgatactaaaaatatgtcaagatatgtacgctacagctaaagtagtgctttgggggaaattataagtttaaatgcttaccttggaaaattgaggactgagatcactgttctaatgtttgttttaagaaactgaaaaaagtagagtaactccaaagtaagtggaagaaaggaaaggcagaaatcaaataaaaaacaaacagtaaagaatgttaacaaaatccaaagtgtgttcattgataaggtagcataattgataaacccttaggtagactgatctagaataaagagaaaggacactaattaccaatatcatcagatagaaaagagaggatttcactatagattcaacagacataaagtggatgctaaggtgcggaaaaaggatattaaggcaatattattagcaactttattccattactttgacagcttagttgaaatgacaattctttgtggtggtgggaaagttgggggcaacacccaaactgataccagctgaagtagaaattttgaaaagccctgtatctgttgagaaaattgaaattgtcctgaaaaactttcctatagagaaaactccaggctcactggtttcactattgaattctgtcaagcatttgaggaataataacaccaatcttatacagattcttttaagaatataggaagggacacttcccagttcatcttacgatgccagcatgactatgattccaaaacctgacaaagacattaaaatagaagaagaagagaaaattacaggctaatatccttcatgaacatagacacaaaatttcttaatactagcaaatctaatctgccattataaaaaggataatacatatgactgagattttccccagtattgcaaggttggcttaacatttgaaaattagtcattgaaattcaccatattaattacaggggaaaaactagattatcatttcattagatatcccaaaaaagcaactgatgaaattcagcacatatttatgagaaaaactcagcaaatcagaaatagaaggaaacttcattgataaaggccttatatgaaaaacctcttgctatcatcatattcagtaaaatattgaaggctttttccatatgatttgtaatagggcaagatgtccactcataccacttttattcacgttgtacattagtatagtaaagcaaggcagtgaaaaaagaaatgcacacagattggaaaggaggaagtaaaatgtctatttttggatgacacgatcaggttagtagaaaatcctaaggcatctgtaactacaagaacacagaagtgaacttagcaaggtcttaggatacaagatcgacatactaaaatcgattgtatcttaatgtactagtagtaaataattggaaaatgaaattttaaattatatttacaacagcatttgaaaatatgaaatacttaggaataaatttaacaaaacatgttcaatacctatacagtaaaaactattaaatattactgaaagaaattaaagaagacctaaataaatggagagatatgccatatttgttgattagaagaattcatatagttaaaatagccattttcctcaaattgatataaagatccagtgcaatttcaatcattattctggtagatttttttaaaaggaacagaccaacatttaaaaatttatattcaaatacaaaggactcagaatatccaaagtaatcttgaaaaagacttaacgtacttgacctaaatactgtaattctacagtattcaagatattggcaaactgatcacattgaaacagaataggaagcccagaaatagacccacatttatatggtcaaagtaatccaatggtgaaaggaaattattttttaaaaatgaggatggaacaactgaatatcgtatttttaaaaatgaaccccaaccgctgtttcccatagaaattagagatgattcatagatacaaaaatgattactataaaacttattgaagaaaacataatatctttgtgactttgggcttggcagtgtttttagacatgacacagaaagcaataaaaaacaaataatgttatattttctcaagattaaaaacttcattataagatactgttaggaaaatgatttggcaagccactgactgagtggaaatatgcatcaaacatatctgtcaaaggattgatatctaggaactatcaagaactcctacaactcaataataaaaagaccatcaacccaattacaaaaggataaaatatttgaacagacacttcaaaaggaagatatatgagtagccaatatgcttatgaaaatgtgcttaacaacattagttatcagggaattacaaagtaaaaccacgttataccactgaacatctagcagaatggcagatattatactgacaatactaaatggtggtaaggatgtggaactaacagaactgtgataaattgtcgttgacagtgtaaactggtacaagcactttaggaagagactggcagtttgttagaaatatacaaatttcactttgagatctacacagaagaaataaacataatcacaaaacagcttgtacaaataggttcatagtagctttattcataatgctccaaaacaggaaacaacctaagtgtccaacaacagagcagataactgtgggttattcagacagtgacctactgctcagaaataaaatgggatgaatactgacacacacaagagtgaatctcaaaagcatgctgagtgaaagaagccttatacaaaacagttcatactgtatggtttcatttttatgaaattctggaacaggcaaaagtaatacatgatgaaaaatttacaacagtgattgcctttaggacgttagggaaggattgactggataggagtgggaaggggcatgagaacttctgagttgatactaatattaagagtttaggttatatagctctaggcatttgtcagaacgcattaagtggacatttaatatttggatatgtcactgtatgtaacttttagcttacccaacacagttctataaaacaattattgaactctagatagtaatgatatgcatgttgaaatgtttatgagcaaaatgtactgatgtctctaactttgaattgctttaaaaattagatagactgatggatgaaggatatatgattggatatatacgtgacgaaacaaaatatagtaaaatgttaattgtagaaactaggtggtaagtaggtatatggttgttcactgtacaattctttaaacttttgtttaaatatttaaaaaaaaaatgttgggggctgggcgtggtggctcacacctgtaatcccagcactttgggaggccgaggcgggtggatcacgaggtcaggagattgagaccatcctggctaatacggtgaaaccccatctctactaaaaatacaaaaaattagccaggcgtggtggcacatgcctgtagtctcagctacctgggaggctgaggcaggagaattgcttgaacccaggaggcagaggttgcagtgaatcgagatggcgccactgcactccagcctgggtgacagagcaagactccgtctcaaaataaataaataaataaatagttggaaaaagtaaatgaaaaagatgtagctaaaagatatccaacttatttttaggaaattcaattgtttgttaattaaccaatatttatggcaagtcagctgtgtgctggacagtctcataagcatctaggatacagtgatacaagacaaacatggtccttgccctcatagaactattattctggcttatcagattcatattttacccagcattccctatcctctatcccttgtactatttaggatttatctgtttatccagggtctcttggttcttagttgttattttaaaatatctttagagaaagagatttgtagtagcttctccatatctgtgagcttttagcgttcatgttttcagaagtttattttttgagtttttgttgataaaaagaaatctttttttcctaaagaatggagttcttgacaatgtagacggtataatgtagacaatataaactcttgtttatataatgaacagtggttcgtgaacgtaaacactgggctttaacttattagggtgttgaattaacttccactcatttaattaggatgatctcaaacattagattgtctccaatcacattaagtttttaagagacacgtcattggagagagagtttgtgtgtttatgagataatgatgtcggtgttaagctatgcccatgtttgtccatatagttatcaaatttgaccaagtttaaaaaaaaatacaaaattgaccaagttagccagacattattgaataaatggtttaaatgattttatctttctatcagatttgttttattttctttattattgaattggctaaaagtttatttctatagctctctctctgtgtgtgtgtgtgtgtgtgtgtgtgtgtgtactctttgggactctgataaaatacattggaaccatttttaaagttcattgatttgcttcccatttctgctcccagtgccaggaccttcctgtttttggctctttgtcttactctggagagaaggcctccaaaagacttaccatccattccatccacccagaaatccctatcagaaaggtcctaaatagaccaaatgacacagcctttttattatactcagagactgaaaactcccagaggagttaggatgatttcttgacctcaaagggaacacactttgagttctagagagttcagagccaaccaattagatattgcgtttgagcgtagagagttggctacatgctttcagtcactgatatagatactgcttttctgacctggtgacccagagccctctctttggtgacttggttatggctgcctctcttgtattttgctcagtccttgtctagactgggcctcatatcagtcactgcctgatttgtgatttgtgttactttaatgcctaatgtagctggtgccagccccctttccacatcccatttctcattcttgacttgatgtatttagccttgtcctatctctgctgccttcccttgtctgtgcctctgactgtaactccagacctgtacttaacgcctgtaaagtccctgccaccttgctccaccttctcctgtatataatcaggatcttaaaggagggtgggtgccttggcatttcctcatgttgggatgcttgagacttggtgagtccctagggcttggtgacttttcactaagacacttctatgcgtctcagtcaactcggtgctccctcacgtattcacagatcatcagcctttgttcccctcatctgaacctctgctaaatccatattgtttagattttatatacattcaaaagaatatttataaaatgctgagtaagttataatgggtagaaatgaaacaaacaccatttgccaccactcaacttaagaattaagatattgtcgtttttaaggtataaagtattttaaggtataaggtgttgggtggcactttataatccctgcagtaaagtaataatcagtatcactgaacacttaaaggtcttaaacattgtctttagctgcatatttttttagaacatttaataaattcaaatgggtcactagtgaggttttaacgtagattctagtgttcctctttatctgtcaaacttttagaattcacttgagttaccatgtccagtatgtcagcattatggaattctgggaagcttagccttggaatgaaggagagaactttctgaaggccatagctaccatgttgcttttcccctagaatgactgctgatggagcgccagaattgaagatagagagtctgaattcaaaggccaagctgcatgctgcactttacgagaggaagctcctgtctctggaggtgcgaaaacgtagacgacggagtagcagattgagggcaatgaggccaaaatacccaggtacctgctggtgagctttcaccaaactcccttatctggatcctgccagactgagttaaccagctgcttactcagtatttcatgagtcagaatcttcctgatcacatacaccttttttatatagttttttctctgaaacttaatttcaacaaagtcttaagtttttaaaccttccactctataatatttgtattgaagactatctgaaacacatacattttggcctttgctcttatgtcagcatcatacaaatacctgatactctagaaataatattagcctgagtttaatggaatcctgagcattactgttcaggttttttataattaggtaagttcagttcattctttaacattgctgaatggcataagtattttagataaagtggaatttctttctctcctagcttctacaatgttgtaggtctgtttataattgactgatatactgatttcctttttttctctccttccctcctgtgaacgtctgtgtcaggcagtgtgttagtcactgaggttttgctggtaaataaaaaagatatggtctctgtcctcatagaacttacaaggcgatagagaaggataatgaataaacataggatagaaagatattcccctgttctttatacctccgtgaagggtgctttttaaaaaatctctaatacactgtagaaattactaagccaagggttttttgtttttttatttttattttttgccttaagttgtgagagagtgatgatgagagtatgatgaaaaatgtatactttaatgaagattattaataggttttagaatatgtaacattaggccaggcatggtgcctcatgcctgtaatcccagcactttaggaggccaaggtgggcgaatcgcttgagcccaggagttcgagaccagcccaggcaatctggcaaaatcctgtctctacaaaaaatacaaaaattagctgggtatggtaacatgtgcctatagtcccagctacttggaaggctgaggttggaggactacttgaccccaggatgtcgagctgtaatgagccgagatcctgccactgccctccagcctgggcaacagagcgagaccctgaatcaaaaaatgataataaatgaaaacaaaaataaataaaagaatatatgagattagagagtgacatgtgggtgctattaattctgtgccttgtttgtggtttggtttagaaatgggcttttactaaaaagagaaaaggaaggtattgggagagaggaacatttaatccttttttcagcaacattagtgattcttcgtatttagtgattacccaaccagctgaaatgaatgttaaaactgagacagagagtgaagaggaggaagaagtcgcattagataatgaagatgaagaacaggaggcttcccaggaggagtctgcaggatttcttagagaaaatcaagccaaatatacaccctcattgacagctttggtagaaaatacacccaaagaaaattccatgaaagttcgtgaatggaataataaaggtggacactgctgcaaacttgagactcaggagctagagcctaaatttaacctgatgcagattcttcaagataatggcaatcttaggtatgtatcttttataattatattagtaaaactgataacagctaacttgtactgtgtaccagctactattttagtggttttacagtcatttttcatttaatatttacagaagtcctatgaaataatgactgtgattagatactgttattattaaggaaactgagccttagagaggttaggtaacttgtctaaggtagagctatgatacaaacccgggtctcattggttgggcatttgtgtcagtcactgagtataaggtaactgggacaaggagctcaagcagctcgtcgtttagtatcagagacagagagctcaggccatggccccactatgaacaaagtggtcttaggacacagaaaaagagtgattggtctggcttgggagggctagaaaggcattatggatgagggaaaatttgaatcaggccttgacagatgagtagggtttcaggagctttgggaagtgatggttaaatgtgggagtgctaggtagaggcaataaagacgtagaggtggccaagctcagtgtctcacacctataattgcagcactttgggaggccgaggtggtcggatcacctaaggtcaggagttcgagaccagcctgaccaacatggagaaaccctgtctctactaaaaatacaaaattagctgggtgtggtggtgcatgcctgtaagcccagctactcgggaggatgaagcaggagaattgcttgaacctggaaggtggagtttgcagtgagccaagattgtgccattgcactccagcctgggcaacaagagtgaaactccatcttaaaaaaaaaaaaaaaaagacatagaggtgtgataatacagtcattcattaagtccctcagtgagtttttattgagcacctgccctatgccagttgtgctaggccatatcacattactgtggggaccaagataggcctggagtttacagtctagtggggaagaatgacagttaacaaagaaacaaggtcatttcaggtcgtgagaaatgctgtcaggacaataagatggtgtaatgttagaatgtaattgggcagagttacttaattgcagtgatctggcatgaagaggtaacctttgaggtaagtcctgaatgatgaggagtcagtcgtgtgaatagtaggaggcagaatactcccagcagaatagcaagtacaaaagcccagacatcgtaatgagcttggtgtgtttacaaaatacagactagaggaattatataaggagaagagcatggtaagaaatgagactaaaaaattggatgttgttagattgtgaagggccgtaagaggagcctaagctttattttctagatgacttttaagcagataaatgatacggtgagatcttgttttagaaagtaaatcgtgcttgcattgtgggatagtgaaactaaaggcaggggggtgagttagggactgttagaattgtccagagccaggaagatgaaggccttgatcagagtaatggctttaggagtggagagaatgggatggacttagtaaaatttgcaaagtaaaattgatgagactaagtttttcacatttggaaacttggtggtgcctttggtcaatataaggaacataggagttggtttcatgttaaaaacaatgagtttgatttaagatgtagtaaggaagaagggttctgggctaaagtccaatagacaggtggacagctttgttgatcaaggttgaacaggattgtatagttggtaggtaaagtcttgcgaatggataagattgttcacaaatttatttggttcagcaaggataaaaaaagaattgagccctggggaataccactgttcaatgggtaagtcagtaaaaaggtcaagatgtagcagttagagcaatagacataagatcaggaaggagtagtatggtaaaagctgcagaatgagcatttcaggtctgtagagcctcaaacagccctagttaggatgaatagtgaaaagagacttctggatttgtgacctagggccaactgagtaggtggaagaccagttgtgagtggagaaaataagaaagcaagtgtgaactaactgtctaagggtttggcaatgaaaggaaggtaagaatgcatcagggagacagccagctaaaagaaacggattttttttttttcttttgagaagaggttctggaggttgtttatagactaaggggaaggatttgaggataagaggattagaaatgcagaaatggacatattggtagagaagagtactaaaggaaggtgggaagaggccagaggagggagtatctcttcctatcagtcagaaagaaagtgctatgggatgaatgaagttgacagaagtttaagagcaaggaagtttagccgtttatgcatgatagtctttatttctaaattagaggccagttcttatactgaaaggctggagggtgacattggagtagcaggggatagagttaaggtttggaacagtgtcatggagaataagaatagttctgtcagtggagaatagaatatgctaaactcagtcagaagacctgagctctggctgttttagtgctaccaactggccgtgtggtcatagacaagtcaaagagcttctataggcctcagtttccttttctgtcaatccaagatgtggagttagacaagtgttttttcaaacttcttcctagagggaaagaagatttcactgaattgaaaatagagcatttgaaaaccactggactgtattctaaggtcctttccagcaataacattctgcttagttgttgtagaaataaattatttcttcatgaatcttgtggctctcgctttgaatgagtaaactgttaaaattgcaggctgcgttagtgtcaatcagtggttttcagactgtgttccctaaagctgctcattgttcggtgaagtgtctcagaggctacttaggggtttggggaaagtccacgcacagccagggttcaaaactctaaggatcgcgtcattgttgcatatcttatatactgagcatctgcataaccttttgttttttaaaataggtttctttggtttttattctttctggtttttattctttcatcttttggggggtttgttgcaagtgactagctgaacaatgtgtccaataccttagagacagtctcagaattaacattcgtgacgtttatggaaatggaaacctcaatatttgttcatttgctttgcaacagtgattcacaacaaaacaatgattgaagtctcaacttatgagcaataatccccttatttaaaagatcttcaagttttagtataaagggatgaatccgtggaattggatattctgctacatttgaaggtgtctgaaacatgctatttcttgctcattatattgtaggtgaatttattgacccaaactgaggatcttttaaatttattttgacttgagaataatttgttgtggagacaaagcttataggattgattcagggtaaagtgatatatgctctctgggtaaacaagagtataattattgtctttgaggaacagttgaaaatgtacatttatggccaggcgtgcaggctcatgcctgtaatcccagcactttgggaggctgaggtgggtggatcacctgaggtcaggagtttgagaccaacctgatcaacatggtgaaactctatctctattaaaatacaaaaattagctgggcatagtagtgagcacctgtaatcttagctacttgggaggctgaggcaggagaatcgcttgaacctgggaggcagaggttgcagtgaaccaagatcacaccactgcactccagcctgggtgacaagagcaaaactctgtctcgaaaaaaaaaaaaaaaaaaagaaaatataagtgtattatttcaaaaccatattatgctcccataaaaaccatccctgctagtaacaaagatgtagccttattcttagttcatgttctgaagctcttatgtattaaactctcaaaagcaaatcttctccccagcctgactcccttgccctccaattctccaacatacacatggaagctagactggagccctcttaagatgtgcagcttactttagccaaatcctacctcctaaccttgtgaaaacagtcagtagaaagcattcagtgattgcatttgtggggattgtaaacaaagtttgtgttgggccctaatcttcgctgatataattttggctacagtatcagaaggccgatcagctgaagtaaccaaaatctggcctgaaagaaaacagatctgccatgaacagcagctgaggtgaaaatcatcagtgtctctctggtacttctgtcttccaaactatagcttgatcagatttccttatttccagcctaggccaccaggcagaaaatagctgcgttctttaatgatgttgctaaggtgcttttcacaagacttgaggatttctttcgcccactgaacatctgggcttgtcctgcctggcccatcagttcatctgtgccaaactctgttggacctccctcatttgctctgggctccagccattccatcttgtagttgagaacagtgtggccttaaatttggtcttaagagtccctttataggatttatctatttcctgctttggacacttttatatactagaaatattaattgccattgcaaaatccacacttttgcttttgtactaactgataagttcttatggacctccaaatgtaaaaaacattttctcattaatacagtggtttttgtgaagattgagtacttctcctgtctgttcccccaagaaagttgttaaaaagttcaaagagggtcaagcacagtgactcaggcctatatgtaatcccagcactttgggaggccaaggcaggcggatcacttgaggccaggagttcgagaccagcctggccaacatggtgaaaccccgtctctactaaaaatacaaaaattagctgggtgtgatggtgtgcacctgtaagtccagctagttgggtggctgaggcacaagaatcacgtgaatccagcaggatggaggttgcggtgagctgagattccaccactacactgcagcctgggtgacagaatgagaccttgtctcaaaaaaaaaatttcaaagagaaggagtaagaaatctaattttctattcttctttttttcccttatgctaataatgagaaaataaataggattctccatctctgattcttttaataggaaatttaaaaagaaaaaccttcatgtactgcttagaaggaatccttattcacaggctgtaagatgggtttcatatttcttagccatcataatagaagcatcctcaaaggccacttggagagaagcaagtacacattttgtagttttacacttctgtcacataacggtatgttgttttggatttctatagcaaaatgcaggcccgaatagcattctctgcctatctccagcatgttcaaattcgcctgatgaaagacagtggcggtcagacgttcagtgccagttgggctgccaaagaggatgaacagatggtaaggcttttcttactgaaacctttttactttccctttttctttcttctttctgtatttttttttttttttcctattagggtaaagtgcgatatttttctggtgaaaggattattatgtaagaaggtttttagatttcttataaatctatacttacaagatttatatatacttatttcttatacttcaatgtgaagcaaatctttgacctggagctatgttcattacaccatgtagtgaaggcatcaatgtatttcattttgaattggaaattgatttctcattggacgtgaagccctgtgcaaagccctttaaaagaataacaatttacagtcttttctcaagcaacctcacattattaactctgaggtaggcattatcatccctgttttacagaagagcaaacaaagacctcgagaagccaaggttccacaggttatacgtgatgaaaccagaacttaaactcagatgtactttacttgctcctccattgctttcatgcattgtaaagcatttattttctgtcctgaggagtcaaattagctctttgaaagtcatcaccttatcataggccctgtcagaatataccatcctccaagttggtattttttactttactagttgtaacctcttaagattcttagattgctagaatcaaacttgtataatcatttttactgtatatcagtcatttgaacattcctgggattcagtattctaggacagttttgtgtgtgtgaatcagaatgatggggagctttaagctgtttggtaaggtcagagtttatggaagaagccacagcccttccatattcttttttttttttttttgagacagagtcttgctctgtcgcccaggctggagtgcagtggtgcgatctcagctcactgcaacctccgcttcctgggttcaagctattctcctgccttagcctcccaagtagctgtgattacaggcacccaccaccaagcctagctaattttgtattttaagtagtgacggggtttttccatgttggtcaagctggtctcaagctcctgatctcaggtgatccaccctccttggcctcccaaagtgctgggattataggtatgagccagcgcgcctggccccatattctttttaataacagggatttgtcaccaaaaggagaggggcctttaagtctgagaaagctgcattctttgttccactcagtggtgaccttattgtaatttttagtcctccacatacaaaaggcaagtctttatgccaggcttattgtaaaaacatgttggttatcccagaaaacaacttatgaatttaaagtagccaatggaacccagagataaaaccttgtgtgttgtgaataatccttcaaccatcagtggaaaatgttagctctgctctttccaagtggaaaattgaaactgcctttttgagagtcagtttgtctgctccactgtgaaaaaaataatgttttaatataacagcttaaaccaccctatagtaaagacagcagagtagaactatgaaattcaaccctctggttatgaggctgtttcacttatgctggagtaaattggcaccaaaggacaatgaaccaaaatcaaattcaagaagaaaaaaaatagttcaaaaaagaataaccactgcggatgctggcttggaattcacacagtatttctttggggctttctacaagaatattgaggatcatcactacaaaacttaataccagttctgtgaattctttcttgaaaatatatctaggctgggtgcggtggctcatgcctgtaatcccagcgctttgggaggctgaggcgggtggatcagttgaggtcaggagttcgaaaccagcctggccaacatggtgaaaccccgtctctactaaaatacaaaaaaattagctgggtgtggtagtgcgcacctatagtcccagctacttgggaggctgaggcaggagaattgcttgaacctggcaggcggaggttgcagtgagctgagatcacaccactgcacttcaggctgggtgacagagcaagataccgtctcaaaaaaaaaaaaaaatacatatatatatatatatatatagagagagagagagagagagagagagagaaagagagagagagagagagagagagagagagagagagagagagcgagagtacaagccttaccccattccctgatgattgtagcagtggtcttgcttttgaggaaggtagatgtagagttggcctctgtgttccagcttaggttagagattccttatctcataactcacagaaggcacatcaacagaacgtccccagatttatcatctgaaggcagttttattgtggtttttggacaacaacatctttaaggctcttggccttataaaatctctctttgaagcatttatgatttcatcagtaatctgattggtatctgttcagatttcaaaatcctttgcccccatcttctgtgagatgtattctttctttaccttaataactttccactgtgccctccttgacaacccccaactctaaaagctcccttattcttggggaagaaaaaaagctattacctttcaaactactgtgatagttctttctttgccttaatcacgacacttttaaagtcattagtttctactcttcacgtatatttttcattacccatgcattttcttaatgtcttcttgtactctctttattgaaactgttttcttgaaattatccctcagtggtcagatccaaggccttgtctttgtagtgggcctttccagctccagcctcttggaagcatttgacatggaaccctttcttcagttggcctccatggcactattttctcttaattttctttttttttcttttttgaaatggaatcttgctttgtcgcctaggttggagtgccgtggcatgatcttggctcggtgcaacctccacctcctgggttcaagtgattctcatacctcagcctcccaagtagcggagattacaggtgtgtgccaccacgtcaggctaatttttgtatttttcgtagaaatgcagttttactgtgttggccaggctgatctcgaactcttgacctcaagtgatctgcccacctcagcttcccaaattgctaggattgtaggtgtgagccaccatgcccagcctattttctcctggttttctgtgtttctggtgtttctaactttttttttttttttcctgatacttcatcatcttttctatctctaaatatgaatatttctgtattctctgtcttctcacctttgatactttcatctgcttccacagttttagttcctactacctgtctttgaatgctaccttccctaaatagtgctatttgtgtatgtactgtggtacttttacaactgctactttattacatagttatttacatacatacttgatttaaattttctgattgccagctgattgagggaagggaataagtttctttcatttttgttttgtctttctgtatgcttcttatacctaacctttttgttctgggtcttgtttgttgaaatgtgtaatatatgtcttcttccatctctgttatataatgccttcatagcttgtcttctgttgcttagcaccatccctcctttttttttctcccacgactctttaatttataggagctggttgttcgtttcctcaagcgagcatcaaataacctccagcattcactgaggatggtattacccagtcgacgattggcacttctggaacgcagaagaatcctggcccaccagctgggtgactttatcattgtatacaacaaggtaagtctttttctgttagtcttgtgctttggattgccatacactgtcagaaacagactagatagaagcctctgtccaactggatggagacactcttcttctgttctctggcatcaccatcccttatgtattactgttaggggaagcaggaccccacaccttaactcagctggtctgaaaaactatttattacttctgaaggcccagtggccatagttaattcttaattcttatcaaaaggcatattccttttgagcactgagatgaatcctaggctgtgtgagtctgcacggttgttagtgcctgtagaaagtggcaaattgaccattggagaacaaatttgagctgtggattgaatgtaatgacatattctttcttgaacgagttatactttcatctttaaaacattttatacattacagaattttacagtcaagcccaagaaatatactatttaattagaatattttgcaaagcattctatatcccgggatctcagaatgcattaaaaatatcattttgggtgtttgggtttgggaggtttggtcagtttgcagaaggaaaagctgatagaaatttaaatggcttttctaaagttgcatggaattgttggtagaatatcagtgcaccaaactcatagccacaatttactccagatctgttgagaattttgttatgtcttatataagtgaagaatttattcagtatggaagctggtataagagtaccttccaagatctgtctttcctctcctaattggaacaaaatactgtgtctctgttgtcatattgttaaagctacaagggtgatcatagatattactaagctactataaaaacctctttaatcaatgggctgtgtaagtagaaagtaaaaacatgattaaaatttacattcattctgcaacttttacttgggaatttcaaaatgttttacaaaatcatggccaaaagtaatatgtcaaatttataggtggcaaaagtacatacaagaattaaatgtctttactataaggacagattaactcaaggctattgaaactacatgatgaagtgcatatttattaggagtcagttttatcttgttgtttttctgtggggtttgggcactgggtaggaaacagaacaaatggctgaaaagaaatcaaagaagaaagttgaggaagaagaggaagatggggtgaatatggaaaactttcaggagttcatcagacaagcaaggtagtagacattcttgattgataaaagctgtcttattccatcttccataatgctcattgagtacccagcattcctttgtttctgatacatggatgtgaatgaaatcactcttaaagccgggcacagtggcacacccctttagttctagttacttgggagcctgaggcaggaggattgcttgagcccaggaattcgaggccagcttgggcaacatagtgagaccctgtctctaaatgatgaaaaaagaaatcattctcagaaggagaaaagattgtatgggtttggcctctccatatcttagccaattatgttgctattttcatggcttcagttatcaaaacattactgctgggtagcagggctgtagttctcgacagccttcacagtgcacatctcttgaagtcacatgagagctctttggaaagttgaaattagaggcatctcatatttactgggtctgaatttgtccctgacctactcatggagtagaaatgaccacattttgcctacattgagtaggctgaggaatttgcaatttctccactctgtgagggttacacctaatttatataaaatagaacaagttcttcatgcttagggttagcctttagaaatggaaaatctcgatattcatctctctatcttgataaaagtcagccaggccattttgtccatttatgttggcttacaaaggaagagataacaaaggcacttaattttaaatcttgtaaaacttacactggaggatttttttctaaatagagagatgtgcaaaaccattaaaataaaataggataaaaaaacagtaagccccattacttaggcttcaactgtcaaagtcacaaatagggagaaaatcagtagaaaatctaccctatgttgattggtgaagttaaatgaggtaggggtaggagcttatcaatcaccagcataatataatctttgtttaatacccttttcagacctcactatcatgcgctttacagcaaacaaatatatcattttgtaggagtccataattgtatggtgttatttgttgacatttttgagtcttaagtaatatgattgataaaacaggtatagtaacagcttctctcatcaacgttataaaaacagaaaaggattaaaaaaaaaaaacaaaaaacagattgtgtccagaaaatagctctactttttaaagctaaaagataattttcaggtttatcctaaggatcttcaaaatccctaaaatatatattttaaaaaacccagcctttaaaagaacactatttcccaagcaagtctaactggacactaaaaatgaattataacatattgttaactaattatatagatgtggagataaaatgcattggaacataattacttctgattggggattaggtgttgattgttgggaaataatgtggtgacgtcagttcttcttttattaagtttggtttgagtacatggatacttttcagggctggtaaattcaaatacttgctggagtcagacaggaaaacataaattatgaagtgggcaaaggataagacagatataaagcagcttgtattttgaccaaccgtaacctttgcctttcagtattctgtgaagggccaaataaaacacactgacaggcaaaggtttgcaccctcagctgtagatctttgatagtcacttgagagacttatcttgtggcatttggctactttgaagactttagggtttacgctgagattcataaaggtggtttctaggttctggttagagtgtgttttctgaagatgggatataggttctctgtgataatgcaggcattcttcacttaatagccactttcctagaacgtagccaagcttcaagaaaaagaaaaagaaaagaaaaaggccattgagaagctgctacagatgttaaagtccatgtgtgatatgttcaatagaagaatccactagcctctcatctgtttccttatactttctattttgtggctgttcataaagagcatataatttcagtaatttgaagtgatttagagatgatatactttagtctcgtgcattatatagatggttagggaattctatggttattggtggatttccttatttctgacataggcaatgaaaatgacaagtggctctttaagtgaaggtacttcaattatctagaagtgagctgaacaaactgtaaaggtccagataataaacatttcagactctgtgggctacatatgggtggtggtggtggtggttgttgtcttgttattgttgttttgcatattctttaaaaatattttaaaaaatttttggctgggggccataaaaacaagtcgctggtcaggtttagcccacagtgtgtagttgtttgccgcctgttctagaatgtggctgtccaatagaactttttgtgggtgactactgaacacttgaagtgtggctagtttacggaaaagaatctttaatttaatttgaatttaaatagtcacatatgactgagtagtcgctaccatattagacagtgtagatctagaaaattcactgcgggatgaataaagccttatgctttaaattttttagattgctttcatttatattttattttaaccacctattaatagggaattttcagcttgtgcttttcatttttcccttttccagcttgctctgttttcataataaaatctggtggaaagattttccagaatagcttcctgtctgaccatactttttctcctcatttcagtgaggctgaactggaggaggtgttgactttttatacccaaaagaacaagtctgctagtgtcttcctggggactcactctaaaatttctaagaacaacaacaattattctgatagtggggcaaaaggtggtaagtatactggttaatgaacgaaaaataagaagaacaagtgaagaaatgagaaatgcaaaggagaatgaggaataatgtgttggctaagcactaatagtccccaaggtaatgagactttgcagcttggggagggagtggagaatgggggacagtactttttgtcctaaaagcagaagaagggcatggtctgattttttttcaagataattaacagcagagagattttcaagaaaagctaataatagctgatatttagtgaacacttatctttctgtctgctggacatggtcttattttttacttcccaaaaccatatagagtgggcactactacagaacctctttacagatgagaaaataagctaaaagagactgagtaacttgcccaaggttattctttatcgtgcagggacaaggaatttgatacatagcctgcctgactcaaagtttgtgctcttaatatattcttctgtctctcttaatgattatttctgactcttgtcaagtttgttactttctctaacttaacatcattggcattttgggcaggagaattctttgtcgtgtggggctgttccatacctggtgggaagtctaatatacttggttccaagcctgacatgccattagcttccgccagccattgtgataatccagaatgcccctacatgtttctaaaacttcttactgctgggggattccatggttggggattttggaattgaatatggatgtggctgtctagctcacgtcaccatgataaaaaaaaatagcagtgacattctgttacaaacaaagctctgtgctttaaatgtaaaattaacttaaaacctagatggaagcctaaggcataggtaatcaacctactgatgttgtcagtgtgctaagtactagattcaaagatggagacttcttccctgctcttaagttatgataatctaatatggaaatagccaggaagattggtcatttaaaatgtggaatgaattttcccaaagaaacagtgttaatcttttaaaaactgatttggttcataggccaatccacataagcctgtttaactcatggtatgattgaattattgtattactggaagtcctgaatccagcccttttctttgagtttttctaacttcattcacctgttcattcattctttctatacttttttttacttagcacctattatgtgttaggcattttcatggttgctagggatacaatgaccaggactgtcacagtctttaactttataaagtttattgtctggtaggtaaaagtcaggtgagtgaatagaataagaaagctggcagaagctctgaaaaactcctataagagttttggctaagggagacaaaggaattcttgtaataaggttggaatagagaaaagcgtgctaatttggggaggtaggggcctagatggacattcatctagtaacttctcccctggcagtaatgtggaagccctaacagcatgtggtggcgacatcttttatactgataggtcattcaaaattctagggtttgtgttttaaggactacctttacataagatccatacctgtgtaaacttgttaaggataactggccggcgggggcagtaggaagacgtcaatcaaggaaacaacattatgacatttgatagtatagtatctggagtcatttcaaacatgaacaaacaagtgtgtgacagtgttaccactgctattggcgatggaggggagaaaattcgtatgtctttattctttcactctgaaagatgatctataaaatggcctttcttaagtttttgtatgattctagcccttgacaaagattttggaatatttttatatatgattagctctggctattctgtttcaaaattctgtagtggaaaaaattagttattaatgtcaaaattgattagagtgatactattattgaatatactgatcaacctatctccagtaaaactgaagagtttaggccgggcatggtggctcacgcctgtaatcccagcactttgggaagctgaggcaggtggatcacctgaggtcagaagttcaagaccagcctggtcaacatggtgaaagcctgtctctactaaatatacaaaaattagccgggtgtggtggcaggcacctgtaaatcccaagtactcaggaggctgaggcaggagaatcgcttgaactgggaggcagaggttgcagtgagccaagatcgcgcaattgcgctccagcctaggcagcaacaagagtgaaactttgttcaaaaaaaaaaaaaaaaaaaaaaagctgaggagtttaagatacagagccatcgtagtatccaggtattatgccaagaaatagtgggaccgctcttgctgtctcggggtagcttcgctgctccatatatattgtaacttcttggctccaggggctaccaccaaccagcgtgatctcttagaaccctcagtctgaattcctggcataaatctgactgcccttattattattattatttttccagataagccctagcttgttggctgtccgtggatggctgccctgggtttaggtaccgttcgccagttcagttaactgtagctgggattgggaatagctgggaatcatttaattggttgcctactccttagggctgtgggtgtcttcatctttggaaaagtgtgatgagacgtgccatgtttcccagcattgattagcagttgtgttatatttttgggaataaaattatgtatagaacagcggacttgcaattgattataagagagtccaagctcattatttcttatttcagatcaccctgagactataatggaagaagtgaaaataaagccacctaaacagcaacagacgacagaaattcattctgataaattatctcgtgagtgatttcaaacctacctagatttgctgctctctgataatttcctaaaagaaggaaatagtcatcagatattaaatatttctaaagcatggaacattaccccaaagaaatatttttctttttccttttcccttagaattttctcttatctattgataagctattttccttccaaagactttttcgttttcttaagtttagaaattctaagtgcattctttgttcctagaagggtgaaaagaagggggagaggaattagctgttgctagtggagacttcatcttgatgtcctaacatgtgtaagacatgcctgctctgtttcatagaggtagtcccaactccagcttttagaaaggaataaaagtaaattcctatttctgttgccaggttgtttctggtaggcaaaaatcattaagtttatgatgaacactcattaaagtctgtatttttcatgatttctgtttcatgccaagattattgtgatgtttatgttttaaaaatatttgttttatagagattgtatgtttgtttttcctataatgatgtcttgttttgttttgtttttaataggatttaccacttcagcagaaaaagaggcaaaattagtttatagcaattcctcctctggtcctactgctactctgcagaaaattcccaacacccatttgtcatctgttacaacctctgacctctctccagggccttgccaccattcttctttatctcaaattccttcagctatccccagcatgcctcaccagccaacaattttactgaacacagtctctgccagtgcttctccctgcctacatcccggggcacagaacatcccaagccctactggcctgccacgctgtcgatcaggaagtcacaccattggtcccttttcttccttccaaagtgctgcacacatctatagccagaaactgtctcgtccctcttcagcaaaggcaggtgagtgagagaacgaaagacagtccacaatgtgagctcctccccagccccaataaagaaaggatgtcatctcttccctttgcctttttttaaattttgaaatggaaatggacacacactgcattgttctgacgtgactaaagaagacttttgcattgcatccagtagcatgccttcattgacacaaagggaaacaggacttcttttaggtactggagataaagagatgaatctgacaaggcttctgttcactaggagcctacagcctagtcaagagatttcctgtcacagataaccatctatgagtgtgctatatgcattctctgtgcttcaaatagttattcccaacatcagacaagttagtttttaggcaagaatgacctgaataaataaccaaagaattcttagaataggttatatcattttaactgaaatagacctatagtgtcaagtttgtcctccattttttaataacagctttattgagatataatttacattctatcaaattcacccttttaaaatgtacaattcagtaattcagtggttatatatatatctatcttcacagacttgtacattcgacaccagtatctaattttagaacattttcatcatctccaaaagaaaccccatacctgttagcagccacggtctgtttcttcctcccccaagcccctggcaaccactgatctacttctctgtttttacagatttgtctattctggacatttttatataagtaaaatcatataataggtagtcttttgtgaatggctgctttctattctggacattgtatataagtaaaatcataataggtggtcttttgtgaatggctgctttcacttagcataatgtttttcaggttcatccacgttgtagtaggaacttcattccctttatggctgaataatattccattgtatggatataccacaatttgtttagccattagttgaggggcatttgatttgtttataccttttggccattatgaataatgctgctatgaacatttgtttgtaagttttcgtgtggacatatgtttttatttctcttgagtgtatagctagagtggaattgttggttcatatgataactttttgtatttcctctttttgaggaacttctaaactgttttccaaagtcgctgtgcccttttactaacagcaatgtttgagggttccagtttctccctgtccttgccaaaactatgagttgtctctgtttttgattttcacatcctaatgggtatgaaatagtatctcttttttgtggttatgatttgcatttccctaatggctaatgatgttgaatatcttttcatttgcttattggatttttgtatatcttctttggaggaatgtctatttaaattatttgccctttttaaaattcatatgttttcctttttattgttgaatgtaaatgttctttatatactctagataaaaaccctttgtcagataggatttataaatattttttccctacttgatggttatcttttcactttcttgaagcacaaaagttttagattttaatgatgtccagtttatctgttttttttctattgtcacttgtgcttttggtatcatgtctggaatactgttgcctaatcaagtgtcacagagatttcctcctttttttttttttttttttttttgagacggattgttgctgtgccgccaggctggagtgcagtggcacgatctcggcccactgcatcttccacctccaggttcaagcgattctcttgcctcagcctcccgagtagttgggactacaggcacatgccaccatgctcagctaatttttgtagttttagtagaggtggggtttcaccatgttggccaggatggtctcgatctcttgaccttgtgatccacccaccttggcctccccaaagtgctgggattacaggcgtgagccactgcgcccggcccctcctatgttttatagtttagactcttacatttaggtcttttgtccattttcagttaattgtcctgcatggtatgatgtaggggtctaacttcattcttctgcatgtggatattcagttaaatcagcatcatttgtggaaaagagtattgtttccccatgggattgtcttggcactcttctcaaaaatcaattaattataaatgtaaaagtttatttttaaggcctcagttttattccattgatctatatgtctgaccttatgccaatatcacattgtcttgattgctacagcattatagtaagttttgaaatcaccaaggatgattgttccaacttcactcttctttttcaagattgtttaggctgttctggatcccttgcattttcatatgaattttaggatcagcttgtcaatttcctcaagaaaaggcagatgggattttgataggattattatctgtggatcagtttggggactatcttaacatcagtcaagatttaaacactagtaatagctatgttaaggtgagttacagctaagacatgttttataaatagccagtctatatttcttaatacctgttttcaaatgaaatggatattttaatatgcagcttgagtcagagatattaaatggtccactttaataagtcataaatatgaatatatacatatgtatatatctgctaattctgggtgatcttgttcttgtgatttaattttctaaaatcggtaataataatgatcaataatgttctagtttgaactattttttccccatgtaagaaattcagtaagatgaatgtcttcagtggcctgtgttatcataaaaactttttcaaaaccctcccttttgatcctttccaagagaatgatagtgaacaaaagaagttggtgagttcataaatattttctgatatctattgtgatttcttttttgactcttggattatttataaatatattgtttaattttcaggtagttgggattctttatttttgtaattggtttttagcttatttccactgtggtcagagaacataatctgaatggattaaacagtagtagatgacaatatgcggacaaaaatatataattgacaacagcctgtaattgattggagttaaatttttctgtggtaattgagtgattttggaataggagtaagattttatttaactctatagactttttaaagttaaatatacagcatcaaatttcaaaggtcatcactaaaagaataaaagtataaattctaatggggagaagaaaaatgaattgtggataaaaaacatgcagaaacttaggtgtatgcaagcaagaagcatagaaaaagcaagataaatagaaatttaaaacatagtaaattggccgggcacagcgtcttatgcctataatcccagcactttcggaggccgagttaggcagatcgcttgaggttaggagttcaagaccagcctggccaacatggtaaaacccaatctctactgaaaatacaaaaattagccaggcatggtggcgctggcctgtagtcccagctactcaggaggttgaggcaagagaattgcttgaacccgggaggcagaggttgaagtgagccaagatcacaccactgcactccagcctgggcacagagcaagactccatctcaaacaacaaaacaaaacaaaaaacattgtaaatcaagtccaaatatatcaagaagcaaataaacataaataggttaaacttgacagatttttaaagtttaaaaaaatccaactatatgctgtttaccagaggcacacctaagtttcaggacacagaacgtttaaaagtaaaaaattgaaaaaagaaatacgagatgagtactaaccagaagaaagttggtatggttgcattaatatatgctgaaataggcttgaagatataaaactttcttacagataaagagtaactacataatgacaaaaggttcagttcagtcaaaagttaaacaattctaaaagtgtctgcacctcataaaatagcctccaaatatgtaacacaaaaatggaaacaaccacatgaagaatgtataaatccactatcttagtgggtgatttccacatacttctattaattattaatacactaaacagatttttaaaatgcagaaaggataaagaggatttgaacaagatgataagattatttattgataatatataggaccgtgtacccaataattagacaaaacgcctcaagcgtacatgatatatttataaaaatctgtcataccctacatcataaacaagagaacaaattgcagagacttggtatcacacagccacattctttgtccacattgcaattaagttgaaagtcagtaacaaaaagatatagaagaaacccccatgtatttcaaaatttaagagtcaaagaagaaatcctgatggaagtaaattattaagttttagaactgaatgataatgaaaaagctgtatgtccaaataagtagagagcaatgcaagtcagtatttgaagggaaatttactggcttaaataattatagttggtgtgcacctgtagtccaagctccctaggaggctgaggtgggaggattgcttgagcgcaggagttcgagaccagtctgggcaacatagcgagatcccatctctaaaaataaataaataaataagtaaataagtaaataaaaacttatatttgaaaagaagacaggctggaaattaatgtgctaaatgtctggctttagacattataaaaacaacagtatcataaatctaaataaaggataaagaaatataaagataagagcaataattatagaattcaaaaataaggcacagtagagggtggcaaagccaaaagtgattttttgaaaagcctaataaaatggacaaacctctgatgacacctatcaagaaaaaagagaagacatggataaataatataaggagtagaaaagcagacatagaaaatataaatacacccaaaatgacaaaaataatgtaatcttaactttattccaataaaattgaaagcttacataaaatggaccaaactcatacaaactataacttatgtaaaaatgactcaagaagatgaagaaagtctgaatagtcctataagtattttaaaaagtgatacagtagttgaaagtcttaaagaaaacataaggcctagatttatgggtaagttctaatctttcaaaaggtagataatttcaatatatttttaaaaaaactcttctggagtgtggaaaaagagaattttcctcaacttattctgtatggctagttttatcttaataatacaaacagttaaggacagtattaaaaaggaaaattacagactggctttatttattaacacaaatgcaaaaatttgaatcaaaataaaagccaatcaactctagcaacatctaaaagaggtagtacaccatgagcaagtttattcaaggaatgtaagaggggtttaacattagtaaacctataaatatcatttgccatgtaaatataataaagaaaaaaccatattcttcatcatggtacatgcagaaaaagaattcgataaaattctgcactcattcatgatgataactctcagctcattaggaagagaaggagattctcttaaaaaaagggtatttgccaaaaacctgcaagagctatcagcctaaatacggaaatgttgaaagcattctctttaacattgagaacaagtaaggatgcccattaacattccttctgtccagtgttttactggagatcagaaccaacatagtaagataagaaaaagaaattataagcataaggatcatcccttcttagccttttggctaagatcaagtataagcataaggatcaaaaaagaggaaacaaaattgtgtaattgcagataatatattgtctacatagaaaacaaagtaattacagatacattttagaaatagttattttagcataagatcaatatttaaaaattaattgctttcaaaattacttgccagaagtgacagaaaacaattttttgattgtagcaaaatataaataacataaaatttaacattgaactattttaaattcagtggcattcagtacagtcacacttttgcagccatcaccaccaataaaaatgtttttaaaaatatcactaataatagcataaaaactgtgttacctaggaatacatttagaaaggaaaggaagttttataagactacattgaaagacacagatattagacattaacaaaaatttaaataaatggataaatataccacgtacatgcataggaagactcaatatcatcaaagtttccattttcatcacattgatctctgtattcaatacggttccaatcaaaatctcaacaagtgtgtcattggattttttaagcctattctaaaatgataatagaaaggcaaagagccaagaatagtgagaacctactgaagaagaaaaataaggtggaggagcaccttattaatataaaggtctgatacttaagacagtgtggtattggcaaatgtgtagacagattgaccagtggaacagaatagaaagttagaaacagtcacacaagaagatggaaatttcatgtatgacagagatggcattgtagatcagaagaaagggagagatgtctcaataaatgcttctggggtaattgttatccccacagagaaagatgaaattagatccctgcctcacaccatgtataaaatcaatttcagttgtaaaacttccatactgaaataaaataataaaataaaggagaccatcattaagaacttgtggtatggagcaaaagtaaaaacaaaaacacaaatcgtgtaagtcaataagaaaaagatagcccaatagaaaaatgataccagaaaagaggtagcatgttcaacatcatcattaatcaggtacatgaagactacaatgggaagaattaagacacttgacaatactaagtgttgaagaggctatggatcaacaggaattttctttctttttttcttttttttttttaatttgagacagggtctcactctgtcacccaggctggagtttagtggtgcaatcatggctcactgcagccttgacctcccagggcttaagcaatcctcacacctcagcctcctgagtaactgggactacaggcccatgtccccacacccagctaagtttttgtagagaagagatctcactttgttgcctaatctggtctcgaacttctgtgctaaagtggccctcctgcctcagcctcccaaagtgctgggattacaggtgtgagccaccattcccggcccaggaacttttttattttgtttgttggagtgtaaaaaaataccattttggggccgggtgcggtggctcacgcttgtaatcccagcactttgggaggccaaggcagacggatcacgaggtcaggagatcaagaccatcctggctaacacggtgaaaccccatctctactaaaaaaaaaaaaaaaaaagaaaaattacccgggcctggtggcgggtgcctgtagtcccagctactcgggaggctgaggcgggagattggcgtgaacctgggaggcggagcttgcagtgagccaagatcgcgccactgcgcttcagcctgggtgacagagcaagactctgtctcaaaaaaaaaaaaaaaaaaataccactttggtattactacataaacttgaaaatttacatactttgtgacccaacaattccactcctgggcatatacaagaggagcttttctatacgtgtgccagcagatgtatgcaagggtgtttatggctgcgttgtttataatggcaatatgcttgaaataaccacaatacccattgataggggaatagaaatataagttgtggtgtatttataaaatggaatgccagacagcaaggaaaatgaatgactttcagctgtatttatctaggattaatcttggaagagtagagttgaataacagagcaagtcccaggaaatatctatattaggataccatttttgtagatctcaaaaacgagcaaaattatctggtattttgtttgtatatgcatatacacacaaatatatttgataaaacttttttttttaaaagaatgtttgataaggggagattaggaatggggaggaacaaccacataggttagtacatattgttgataatgtaattcctgggttgggtagtgagttcacaggtgttcattacagtatgcatataactacatatacagctattataaatattttgtatgtactaaataatatagtaaacgtgaaaaagttacagattcagaaaatcagttgtatatgcagaatgatcattgttatattagcattaattttaaaaagacaggaaataggttatattatttctacttttctgagtttaaagattttttttgaagagatgtgacttttacaatcaggaaaaatgtgaatttttattttattttatttttagagacaggttctctttctgtcacacaggctggagtgcagtggcatgatcatagctcactgtaaccttgaactcctgggcttaagcaatcctcctgcctcagcctcccaagtagctgggactataagcatgagccactgtgctcagctgaatcttgattttatattaaataatttctttttgccagaatttcagtgcttaaataatagaatgctctgatattacagttgaaagaagaaaatttaaatctgaaagggaaatcagtcatttgaaaatatacacacactggggcctatcatggggtggggggaggggggagggatagcattaggagatatacctaatgtaaatgacgagttaatgggtgcagcacaccaacatggcacatgtatacatatgtaacaaacctgcacgttgtgcacatgtaccctagaacttaaagtataataataataaaaaagaaaacatgttttgactaaaaatataaaaaaaaaaagaaaatataagattattgttatttttctgagtatactcgattttgtttttatccctgtttcccttttgagctttctaagtattatggatgatttgacagtggatgccacagactgttgacaagtacagttacataacaagaaaaacaagaattataatgagtttcaaatatgtattttttattcagtaagattagcaaattataggattggtattccccactacatataatgaaaattcttctttgtgaagctttcattataagcaaaaacatattaataaataatgcatgtggcagtttggtaataggaagagtttctaggttatggtaaccatttatttttgtgatcatttgaagatagtttatttctcctatattattaaagatccttagggttcagtaaagtatctgttgacctgagatttctgtcattatcctaatttttttcaggcctttttttcctaaatgagtgaaaacttttctccgttttagcaggatcgtgctatctaaacaagcatcattcaggaatagccaaaacacaaaaagagggagaagatgcttctttatatagcaaacggtacaaccaaagtatggttacagctgaacttcagcggctagctgagaagcaggcagcgagacagtattctccatccagccacatcaacctcctcacccaacaggtacggatggtctggggtgtccaagagctctttggacctgaggatagaattaatgacagggtactttgtctttccctgtctttactattcccatatactgatgcctcttgaatgagtattattaatagttggtttcaagctaaattatcaagtttttcctcttcaaatttaaagaaaataactttctgttacaggcattgtgaagtaagtctgctactggatatgatgtacctatttcatggataaacagacttgaatgttcatctgtaaatataattttaaaggatctttaaaaataagttcttttctttggtaaaattttccagtgagttctagtcttataaatctttttaccagaattttataacattaccctttaaaaaaatttttttctatactgcctcttatttcatgatctcaggatgttttatgggtaactgattaatttcatatttcattatacccttatccaatataatatcattctccccattttacagatgggggaacctgaggctgaaataagtgatgtgatcaaggtcattcaacaagctgggtggatagaaataaataacaggatattgtccttatgctatatagatattaacaatcttgcaacacagtgaaggtagatgacactttcaagagctttgtgaattctctttgtccttcttgctggttatccctatggtgtttaattgaaggaaaagccatatctcttattccttaatgttaaatggcatcaaagtcctccaaaggaattatcataatttaactccacagttatattttgctatgttgctgatgtgccaaattccttaattggtagtaactctgtagtgataatcaagtctcgaaaaaagtgaagctgaaaattactttaagtacatgctaaaagtaggcaacacactgctccctggtggtaccctacttatctgtataaaatttaggaccaaaactaaagctaagcctctcatggaattagttttacttcagcctcatcccagcgtgtgaagcagtaattattttctttctcaaatccttagttgtttgaagggagtaaataagaaggcctaatgtgaaataggaagcaaagaatattataagaacaatgttgattcttggagggagttgggtagttagattttagtgatagaattatgggaagagggaataggatactaagatatgatgggaaggaattttcaaattaaataagtggctatgagacgggaaaggccagtgctctgctacacttttatcattgggtcactaactagattatatgtttccggtttataaatgggcagctagaagcaccaagacattgagattttgtgattgtagtaaaaaaaaaaaaaaaatacccaaaatagccaatattagtgcttacctatctagctcctatcgttcactagactgcaaagcctacaaagtgaaaagatcctaatcctgtaggaatccaaggtgactgtatcctgattgggaagtcatcccccttcagttcatttttttcgtctataaagaacttcagtgccagcgaattaaaagtccattagactatggtttgtagggatctgaacttgccattagatgtcagtgttaacttttagagtcttggtaatagggtggtcagtactgagggaggtgctgtaggatgtaataagcaggatggagtagtggagaaagagctagattagccatccagagacttgccactgactcctgtgtgatcttgagcagttcactccattgttattctgacactgactcctgtatgatctttggcagttcatgccactgttctgtcactgattagctatgtgatcttggacagttcactctactcttctgacactgactagctgtgtgatcttgggcagttcaccccactgttctcctgccactgactcctgtgtgatattgggcagttaattccattgttctgacactgactagctgtgtgatcttggacagttcattctactcttctgacactgactagctgtgtgatcttggacagttcactctactgttctcctgccactgactagctgtgtgatcttgagcagttcactcaacttctcttaacctcagggtcttcactgattgatgaggaaaatacaacagggtcatgaggatattatgcaaaacctctaaatgcaatatatgtggaaaatattgttatttcagccataaaaggctttcaatagtaaatggcttctaatttggttagaaacaagtttttagataaagtgtactttttagtagtttttcaaaaattattgtgggtacataggtgtatatatttatggggtacatacgattttttttatttcagtaggtttttgggggaacaggtggtgtttggttacatggataagctctctagtggtgatttccaagattttggtgcacctatcacccaagtagtgtacactgtacccaatgtgcagtcttttattcttcaccctccttccacccttccccccaagtccccaaagtccattatataatccttgtacctttgtgtcctcatagcttagctcctacttataagtgagaacatatgatgtctggttttccattcctgagttacttcacttagaataatggtctccagctccctccaggttgctgcgaataccattattttgttcctttttatggatgagtagtagtccatggtgtatatatatacacaccacattttctttatctactcattgattgatagacatttgggctggttccatatttttgcaattgcaaattgtgttgctataaatatgcatgtgcaagtatctttttcatataatgacttcttttcctctgggtagatacccagtagtgggattactggatcaaatggtagatctacttttagttctttaaggaatctccatagtgttttccataatggttgtactagtttacattcccaccaacagtgtaaaagtgttcccttttcacctcttccatgccaacatctattattttttgactttttaattatagccattcttgcaggagtaaggtagtattgcattgtggttttgatttgcatttccctgataataagtgatgttgagcattttctcatatgtttgttggatatttgtatatcttcttttgagaattgtctattcatgtccttagcctttttgatggaattatttttttcttgctgatttgtttgagttccttgtagattctggctattagtcctttgttggatgcatagtttgtgaagattttctcccactgtgtgggttgtctgtttccttgctgattatttcttttgcctgcagaagctttttagtttaattaaattctatctatttatctttgtttttgttgcatttgcttttggggtcttggccatgaagtctttgcctaagccagtgtctagaagggtttttctgatgttatcttctagaatttttatggtttcaggtcttagatttaagtctttcatctatcttgagttgatttttgtgtaaggtgagagatgaggatccagtttcattcttctacatgtggcttgccagttatgctagcaccatttgttgaatagggtgtcctttccccaggttatgttttttgtttgctttgtcaaagatcagttggctgttaagtatttgactttatttctgggttttctattctgttctattggtctatgtgcctatttttataccagtaccatgctgttttggtaactatatccttttagtatagtttgaatttgggtaatgtgatgcctctagatttgttctttttgcttagttgtgttttggctatgcaggctcttttttggttccatatgaatttcaggattgttttttctagttctgtgaagaatgatgatggtattaaattgcactgaatttgtagattgcttttggcagtgtggtcattttcacaatattgattctacccatccatgagcatgggatgtgtttccatttgtttgtgtcatctgtgattcctttcagcagtgttttgtagttttccttgtagaggtctttcacgtccttggttaggtatatccgtaagtattttattttattttttgcagctgttgtaaaaggggttaaattcttgatgtgattctcagcttggcggcagttggtgtatagcagtgctactgatttgtgtacattgattttgtatcctgaaactttactgaatttatttattagatctaggagctttttgggtgaacctttatggttttctaggtatatgatcatattggcaaacagcaacagtttgacttcctctttaatgatttgaatgcccttatttctcttgtctgattgctttggctaggacttccagaactatgttgaatagaagtggtgaaatgggcattcttgtcttgttccagttttcaaggggaatatattcaacttttctacttttggtataatgttggttgtgggtttgtcatagatggcttttattaccttaaggtatgtccattttatgccaattttgttgagggttttaatcatgaagagatgctggattttgtcagatgctttttctgtgtctgttgagattaccatgtgatttttgtctttgattctgtttatgtggtatatcacatttattgacttgcgtatgttaaaccatgcccgcatccctggtatgaaactcacttgatgaaggtggattatctttttgatatgctgttggattaggttagtggcagaaactgcaattacttgtgtaacaacctagaattttgttggggatttttgcatctgtattcatcagagatattggtctgtagttttctttttttgttaatgtcctttcctgggtttggtattagggtgttactggctttatagaattatttagggaggattctctttttctctgtcttttggaatagtttcaataagattcgtctaattcttcttgaatgcctgatggaattcagctgtgaatccatctggtcctggacttctttttattggcaatttttaaattgccatttcaatattgctgcttgctgttatctgttcagagtttttatttattcctggtttaatctagaagggttgtatatttccaggaatttatccgtctcctctaggttttctagtttgtgcacgtaaaggtgttcatagtagccttgagttatcttttgtatttctgtggtgttggttgtactatctcttgcttcccttctaattgagtttatttggatcttctctcttcttttcttcttctcttctaatcttgctagtggtctgtcaattttgtttatttatttttttttcaaagaaccagatttttgtttcatttatcttttgtattgggtttttttgtttgtatcaattttatttagttatgctctgatctttgttatttcttttcttctgctggatttcagtttggtttgttcttgtttctctagttctctgagatgtgaccttagattgtctatttgagctctttcaggctttttgatgtaggcatttaaagctatgaactttcgtcttagcaccgcttttgctgtatcccagagattttgataggttgtgtcactgttatcattcagctcaaggaatttttacatttccatattgatttcattgttgacccaatgaccattcaggagcagactatttaatttccatgtacttgcatggtgttgagggttccttttggagttgatttccagttttattacattgtggtctgagagaatacttgatataattttgattttcttaagtttgttgagactcgttttgtggcctatcttgtggtctatcttggagaatatttcatgtgctgatgaatagaatgtgtattctgcagttgctgggtagaatgttctgtaaatatccgttaactccatttgttctagggtatggtttatgtctgttgtctctttgttgactttctgtgttgatgacctgcctagtgctgtcagtggagtattgaagtttcccactattattgtgttgttgtctatctcatttcttaggtctagtagtaattgttttatgaatttgggagctccagtgttaggcgcatatgtatttaggattgtgatattttcctattggactagtccttttatcattacgtaatgtccctctttgtctctttaaactgttattgctttgaatctttaaagtttgctttgtctgatgtaagaatagctacttctgctcacttccgttatccatttgcatggaatatcttttttcactcccttaccttaagtttatgtgagtttatgtgttagatgagtttcctgaacttatatgttagttgagtttcttgaagacagcagattttgtatcttttaaggggaacatttaggccatttacattcaacattattattgagatgtgaggcactattctgttcatcatgctagttgttgcctgaatacctggtgatttttgcattgtgttattgttttataggccctgtaggatttgtgctttatggaggttctattttggtgtatttcgaggttttgtctcaagatttagaactttctttagcagtttgtgtagtgctggcttggtagtggctaattctctcagcatttgtttgtctgaaaaagactatctttccttcatttatgaagcttcgtttcactggatacaagattgttggctgataattgttttgtttaaggaggctaaacataggaccccactcccttctagcttttagggtttctgctgagaaatctggtgttaatctaataggttttcctttataggttacctcatgcttttgcctatagctcttaagagtctttcctttgtcttgactttagataacctgatgactatgtgtctaagtgattatctttttgcgatgaatttcccaggtgttctttgagcttctcctgtttggatgtctcgatctttggcaaggccagggaagttctcctcgattattcccccaaataagttttccaaacttttagatttctcttcttcctcgggaacaccagttattcttaggtttggtcgtttaacataatcccaaacttcttggaggctttgttcatttttggggatgcctttttctttgtctttgttggattgggttaatcaaaagccttgtcttcgagctctgaagttctttcttctacttttttgattctattgttgaaactttccagtgtattttgcatctctttaagtgtgtcttttatttccaggagttatgattgttttttatcgatgctctctatttccctggagattttttggtccatgtcctgtattattattatttttttagtttctttaaattggtttccacctttccctggtgcctccttaaataggtaaataatcgaccttttgagttctttttctggcaacttagaaatttcttctttggatccgttgctagtgagctagtgtgatcttttgggagtgttaaagaaccttgccttgtcatattaccagaattgtttttccggttccttctcatctgggtagtctgtatcagagggtctgggttgaagggctgctgttcagattcttttgtcccactggttggttccttgatgtggtgttctcttcttcccctagtagggatggggcttcctgagagccaaactgcagtgattgttactgcccttctgggtctagccccccagcagagctgctgggctctgggctggtactggcaagtttctgtgaagagtcctgtgatgtgatccatcttcaggtctctcagccatggataccagcacctgatctggtggaggtagcaggggagtgagctctgtggactctgtgagggtcctttgttgtagttttgttcagtgagctggttttcttgagcgctggttgtgctagtggttttttgacctccagccaggaggtggcgctttcaagagagcatcagctgatacaagcttgccctaaggtcgccttggttaagtatttgagtgtctcaggtggtgggcggggccacagagctcccaagatattacgtcttttttcttcagctaccaggacaggtagagaaagaccatcaggttggggcagagttaggcatgcccaagctcagagactctccttggacagggcttgctgcttttgctgtgggggatgggggtgtggttctcaggcccatggagttacgttcccagagggattatggctgcccctgctgcatcatacaggtcaccagggaagtaggggaaagccagcagtggcagacctcacccatttcccacgcagccaacaaggccaatctcctggggtgcataagatattttgatacaggcatatagtgtgtgttgatcatatcagggtaaaggtgtccatcacctcaagcatttatcctttctttgtattacagacaatccagttatactcttagttactttaaaatgtacgataaattattgttgactgtagtcaccctgttgtgctatcaaatactagatcttattcatgctaactatatttttgtacccattaaccatccctacttccccccaccctctgtattttgtgttgcaaagctcaattataggttattcaaccctttcccttcagagaaagtgattccttaatttggaatttggaaaattctgtcattgattattctttttctggtaaataactaataacatgttataatggtttagtatagattctggtatatttgtttactaacagtttccctttttctctagttatatttaaaaagaaagttgctttagtttcttactcactgagtcaagtgatacaatgtctgtagctttctagaaagaggtagatttccagtcagaaagtggtgagagttctgctcttctctctggagttagggcctgaaaacttaaacttagctattatcagaaacaagtttgtgtccagtaatcactttaaatgttttttgtttcctcttacctgttttcatattctcgattcttattttctgtttgtgctttcttttttttgttttcccttttctaataggtttaattaatattttctccccttttaaaaataagatttattctggatatgtttattcattctattgttttctaattcattattttcttgccttatctttactaattccttctttctgctttccttaactttgttccactatttcaatatttctccccaccttgagttaaatgcttcatttattttcattcactcttggtatttttttcactatataaaagctatgaatttttctctgaacattgctctcattatattacataaattctgatctatctttaattggctttctgggcaaggagttaagagatattctactaagcaagcaaagttgaatttaaattacttgtgctattttggaagatgagtatagaatattgaagttgttgggtatttctgaaaaatcattatatttggcctacaatttcaactgcttagcctattaaaacttttagtggcatttcctgcaaaactttttatttcattgtgtttgtgtgtgcatgtgtatatgtatgtatttaaaaaacattttgctaggctcttaagagtcttccaggctttggtactaagccatggggatgatataacacatagtcctcagcatgaaataactcactctcttgtaatggtggcagctacataaacagatggtaatagtaacatggaatatgcatgacagagatagtctgagggaataacaaccactaaaagaggccccgaacccagcttgtgggtgggaatggggaaaaagctgaactagccttcttggaagagattatatctaaactgaatcttaaagataggcaggtagatggcagaagaaggggagaaacagtttacagaataaaaactcacttgtgcatatgtagcgaaacgagtgacaggctaaggatgtcacaggatggagagtcagcagggactagctaggaatgaagttgggcgagaaggcaagggctggttcagggagagctttcatgccgtgtgaaggaacttgtcctttgtctcttagatgatggagattctctgagacacaattgctttgccttttagctggaccactcaggtagcttgaagaggatggatttggaggatgaggcagtgccactcctttttcctccatgctcgctggtgaagataatgaggaacagtgaactagctaaaggtaaagaagcaaagtattctgacaagccaaaaatttgatgataaaacatagagggactcagaatttacattagaggttagattcttaagaaatctgtgtggcaaaaacagaagctcatatcctgtgtagttactactactcctgctgtgatttaactttgtttatagcctaaaacacataaaaatatcaaactttccctgccatgtgagcagcggccacttcaaaaaatctgtgcaagcacgtgtatacttgaaatataaagagataaatgttctcaactaccaccattcaacaaataacttagaaatctgagcagagagcaggtcaaatttaattctttcccttggcccaagagaggctggttgtcttttggagatgagattttttggaaatctatgtgtatgtccctgaaagcagggttttctagaaacatcttgcacctgggctgggggcaggagaagtgtcgtggtggccaatagggtactgagcttccgtgtgaagtctcactatctctgcctgactccatgctggaagggagtgtagtgctctgaagagatgtagccctttgtggttattgccattagtgaacagaagaatgtggtgaattagcccagctttgtggtgagaagtgggaggcagggaatcagagggagcgctggccctctccgtgcaggcaagcctgagactgcaggacccagctatcattaggagcaactccagctcttccagcctgggagtttaatcaaagggataacagcagaccacccaggcgggggctccagtgtgaacgaatgtgctgtgtcagtctctgctccccaaccagccagtgcccgggatgtggccaggcctcctggaaatgtgctgacagatacagagaggggaggagatactttttgctcttcacatttttcatttagatggagagtgggaaaaaaaaaatccattctatttctttcatttttcttgctccttaccctgagacttccctgcctggtcctagagaaagatagatgcggaggtacataaagcttgattcacagcagttaaactctctcactctctctatacaaaggaattctttatcatttcttctgcttccgcagctaacaccgtaagggtccacagtggaccctgagtgaatctcaatttcagaaattccaaatgaagagagacggagctaaatctttgaaatggttacagatgttctctaggattgaggcagatggcgcccagtttatcacaagcttcagcaattggcactggaaactctttctgcctccttagtttatctggacacatttgaacttaggtacatttgtgctcagattttgtggccgtttgttaaccctagttcctttagtttcatattctttcttagtagaaaaagttgttgttctttttaccatatacattattctttcccatttctagaagcaggaaagggtaaatagaaaaaggcataagctcttgagtcagcaagaccttggacaagttgtttaacctccctgtgccttgatttcctcatctgtaaaatggggtagttttggtatcaagaccaattcttctcttggctacttgtgcctctctgttccaggacctggctccagttgatctgatctaatttcctagcttttctaggtcttgaggcttgaagctctcattttctttagttcctggcctactgcatggtctcttgttttaaaatagcctttgttttactctgccacccctttaaactcatcttacttgtactgccaaacttcttttaaaataacacacccttgttggctctagtctcccttctgcccctccacccctacacacttgctcttgcagtctgacttcatctcttacatttgtccatctctctctcaaaggccactcatgacctcagaattgccaacttcagtcactatttttaatcttcttcctttagcatgtggcactattatcaacggcttcttaggtgaaaatttcccttagcttttctaacccttcagtaattcctctgagaaatcattgcttcctcctgctctccctgaaaactagattccattttcaacatgtttttcagagccactggcatatagatcttatgtgtataaagttgatcatagcagagtggctctggttgaagaaggtggagtggcccctgggcatctgcttctccctggtcttttgggatcctccagcatatctctgaattctaggctgtaatcctcagaacttctttttcctctccatactttcccctgggataaagttccttttcctgtgatttcatcctggtacttctctatggatttctcccaagtatatatctttagtttgagcctttgctgagagtcaggtccacatttccacctgtgagacatttctacctaactatattgcagaacattcaaaatacttgatgtattttgaacatattttgaaaatactcagaaaagtcttaaacatatttaaaacttatttgcctctttttgttcttctctatattagtgacattgcaattcttggaattctagaatcccagggaatttaggaatggagccattggtttatcagtgcctctcttcacttcctcattctatgtccaggcagttgtcaagattctacagtgtctctgatacctatcctgtttttcacttttccatctactgtcctgcttaaggcctttattatctcttggatggagagctgcaattaccttttcactggtttcttggccagtctcttcctgttcaccctagtctttgctttgctctgaaagattcttttttttttttttttgagatgcagtctcactctgttgctcagactggagtgcagtggtgcgcgatctcagctcactacaatctctgcctcccaggttcaagtgattctcctgcctcagcctcccaagtagctgggattacagatgcctgccgccatgccgggctaatttttgtatttttagtagagatggggtttcaccatcttggccagagtggtttcaaactcctgacctcaagtgatctgtccgcttcagcctttcaaagtgctgggaattcaggtgtgagccactgtgcccggccataatggatcctttcctaaatcacaagtctcatcatggtactcttctgcttaagaatctcgagggccttctgttgtctataatgggaagcccaggctgttaaatgtgattcaaagcctttatttagaatctggctccaggctacttttccagcctgtctccctactatcacacatgtttttgtgcagctcaactagaatttctgttagtctccatgccttatgctatcttctcatggaaaatgttccccagttgccatgtctaatctgggcatctgtccaggctcagtgtagatgccacttcactcatatgcatactctttcactcatcacactaggtatgtcaagatagctctctcttttaacagacagtgaactccttgagggcagtgtcctttgctgcctcagcacctgactcattggtagtactcaaaaaatgtgctgattcgactggactacaaggtaattcattgagaattggatcatgtccatttttttcaccagttttttcccagcctgctagatattaatagtatgcactcagtacgtattttttgaataaataagtaaatgaagaaccctctgctgccttagccagaagtcatctttctattctgtgtgctccttcattccttcattactttttataacagatctattataattattttgcatcttttctttcctgttttgcactaaactacatgatgcagttctttctaactcatcacctagcgcaaggcctttcacttggcagtcatcacatgcttgctaaattgaaaagaatttcttttttacattttgtaggtttttatattttctttaaaaacgattgatggctgggtgcagtggcgcactcctataatcccagcactttgggaggccgaggtgggtggatcgcttgagctcgggagttctaggccagcctggggaacatggcaaaaccccaactccacaaaaaagacaaaaattagccaggtgcggtggcacgtgcctgtagtcccagctactctggaggctgaggtgggaggatcgattgagcccaagagctgcagtgtgccataactgcaccactgcactccaacctcggctacaaagtaagaaagaccctgtgtcaaaattttttcattgataacaccatacctgcccttcataattaagcagttgacattaatcagatgcttactttgtactaggcactgtgccaaggactttatatgcattatctctttaaccctaatgaggtgtaggtacttactttttgccaattaagatgaagaaatagaagctggtaggataagtgactctgctaatgtcacacagatggcaagttactgtgctaagactcaaactcagctctgtctgactctgtgctctttacctcagtgtttttctgtctctttcggtgtgaataaggactcaaacctctcattagacgaaagtgaccgaacttcaccctgtgagcttgttgttccatgatgttgctacagagttgtagccaagcctatacttgtgcctgctcagagaaacaaggagttgaactttgttttcttgatttgaaatgcttctctagttcttgaagcagcttgcaaaacatgtggctctgttgagaattatcagttatttgttgggcaaactcctcatcagattattttatagtatagtcaactgattcttcgaccagacaaaactcagccttgttaatcactagagatgcaataagaatagatcttatgatggcagcagcaactccccctgtcaacacacaaaatctacatgtataaattggaaaccctacgaagagatttgcccattttgtcaggtttcccaggaatgtctctggcaaatcttgatctggaactctgtctggattttggaacactaaatgtctatatatatacgtatattatgaaaatgatggagctcagcagaaagagaagatatgccaagagaatttagtgctgaggtattggaactgcagagattccctgcttttcctgaccccctttaaaatataattaacatttaacccttctctcctggtgattggagtgtgaatttcttgaggtttattttatcagcatccaggaattgaagaaggaattgaattgtggctagtgatttaataaatgctcgtgaagtgcttttggaggactgttcaaaatgtaactgtttaagatagttcttttcatttttctgattgaatatattctctaatatttctccattggtgaaaatcttgtaattggtgcagatctggcacttttggttttcctcttcttttaccttgagtgaaacagatcttggtccactgatatttcctattcaaggattaccttttgctctagcaaaacaggtgaaaacaggaacagatcctgttccagatcattcagagccccatggctgcaggaatcaaagctatggcatgttcaattgatccagtcatattctttttttcttattttttaaaatttttatatagaggtgaggtctcactgtgttgcccagactgatctcgaactcctgggctcaagtgatcctcctgccttggcctcccaaagtgctggattataggtgtgtgccaccatgcccagctgatcctgtcagattttgatatagctatacatatcaggatatatataaggaatatatatatatatattctttatatatgaacaccacagagaacattattttcaaatgacattgaggtagttttgaggataatatgaatgcacatttagacaaatttatccttttatcagttgaagtgattcttaacctttttggattcagaagtctcttggagaatctaattaaagctttattcctcctcctgaaaaaatatacactcaaacttataaatttgcattaatttcaaagggttcaaataccttcaccctcaatcaggctctgtcttgatgctccatggacttatggtctctaagttaagatcccctgaaagtgtttaggtagcatataaccattaatatcaataatttggcccaaactccaaatctatgagtatctttgttttatacattctttatatatttcagtgatagccccacattaggctgtaatctccatgaaggcaaggatttgggggttattcatatatcacagtgttacatattttggggggtacatatgatgtttagatacatctatacaatgtgttatgatcaagtcagagtaattgggatatccgttgcttcaaagatttatcttttctttgtgttgggaacattaacaagtcttcccttgtgactattttgagatatacaataaattgttaactgcaattttcctactatactttcgaatactagaacttattcattttatctaactgtatttttgtactcatgaatcaatatctcttctccttcccctttttcccttctcagctctggtaaccatcattctattctctatctccatgaaatccactcttttagttcccagatatgagtgagaacatgcaatttttgtgtttctgttcttcacttattacatttaacataatgacctccagttccatctatgttctgcaaatgacaggatttcattctttttgtggccgaactatattcctctatgtatatatgtcacattttttttaatccattcatccgttgatggacacttaggttgatacccagcagtgggattgctagatcatatggttgttgtatttttagctttttgaggaacctgtatactgttttccatattgactgtgctacttgactgttttttgtcattgttttatccttaatgctcaaaagaatggcaagcccagagtaggtgcctgagaaatattagtttgaattagtgaactaatcttaggaaacagcattcctagaccttctcagacaagaattatctaaaatttttctggacctgctacaatgaggaaattgagctatggcaagattataaactgcattgggaatgctttgctaccagttactcccatgttaagctcttattaactaaatcatcttctctctctctctctctctgtttttctttttgagacaggatcttgctctgtcacccaggctagagtgccacccaggctggagtacagtggtgtgattatggttcactgcagccttgaattcccaggctcaagtgatcctcctgcctcagcctcccaagtagctaggactacaggcatgcaccaccatgcctaattttttaaattatattttgtagagatggggtctcttatgttgcccaggttggtcttgaatttttggcctcaagtgaccctcctgcctcagcccctcaaagcactgtgattacacacatgagctactgtgcctgaccctaaatctttaatgcttaattttcttctccatttcgataaataagatgcatgaaatttgcagacatccttagtgaacctgagattagtttgagtccattgcaaatggtttcttaggcctttgcagtttcaggggcatgaagaaacaaatatacacattgtgtgcacaaggcacaacatctgtatgtcaaagctgttatttcatccatttaagatcaagcaaaaatcctctctaaaattattcagggcacagcaagagcaacacatctctcaactctagtcactgatcattttatttccctgaattctaaagcagtccctcccttgtggcccaggcaaaaagaggtgatttgggactcctaatttccttgatagccttgcagagacattaaccacttttctactcaactggtgaaactagctgctaactggaggtagggggtgggagggagaaatagagggggtggggaaagagagggaatgaaagaaagagtgtgtgtgtgtgtgtgtgtgtgtgtgtgtgtatgtgtgtgtgtgtgtttgggagtagaagggtctgcaaccaaggttctcatatagcatggttctgtcagaacctgtgagcaggcttactgttgtctactagatcaaggacagaatcattagtctgacattcaagggcctccccaagctgtttatctgtctgtccctatcttctatgacgcgaagcttttgctgaattagactactttctgtttctcagatgttctccctgcttgtctgacgatttttctttcctcctacctattattttaggcccagcccagatgccattttttaatttctttagctgttcttttatggcacttactgcattctggaggtcttaaatactgctttttgtcttacaatcttgtctggcctagtaattataaattccaacatggcttgagggcagggaagggccacgtttttatctgcacatgcgttagcgctttcctcaaggctttacctgtgataggcaatacagcacttactatctttgaggtgtggacttctcttaagcattcgggactgcagcatttttgagagcatgcagcattgaaatagctaggcttgtcttcaaaccctcttcacataccaaaaggttatgtatctgggtggatggtgggtatcttctaagaatcaacagggaagctccatcatattttaattatagtgctggcagcagtacgacttttaacaaacagcagtaacaagaagtaacacttgggcgggccagccaccggaaattggcctctttctctgggtttctcctacccccttttcaatccatcacctggatttattcctgctataatttaaacacctgtctagatggtatgcatgcaatgtgtccctaccccacacattcagatatttgctcacctgccttattcggaagattggctctaaaataaacagtgatttggtactaaaggaaaaacgcactgaggtcaccgtggcaatggacatgaggcagagaatgggagtggaacatctggataagctgctccaggagagtgggagcagaggaagaggaaaagcaggagcagggggaggaggaggagagcaaggggtgaaacatctgccaagcaggccccaaagcttaggtggaggtaggatcttgtgaccagatttcccacaggcagttactcacttagcagcagccagctagagggaggcaggggcagagacatgtggaacaagttgactgtttttaggcttaaatttcttgtttttttgttttttcgttgttaccactatttctcagggcagcatagcaagtaatcttggaattttctgaagtttgtcctaagctgttttgtccacttttgcattcttggcatatttaatgattactctttttaatgtttgagcatctgaacaacattgagaaatagtaaaaccttaaagttgctaatgaaactattttcccttctcattcccctttgttgttttgtaacttgtcttcaccccatcaaaggcatttctgctgttttttggaaaatcccctgcccgtgagctttgtggaggagaggaagcattgaatggttccttttacctgttctctcgtttccttagctaccattcctggtaacaagtgcttctcaaactctgcaatgcaagtaagtttcccgtggatcttgaaaatgcaaattttggttcagtgcagctggggctggggctggggctggggctgtggctgggccaagattctgcatttttaatatgctcccagtaatgcaggtgctcttggtccagagaccaaattctaagtcgcaaggctcagtggtacaaggcagtgagataacacagtgattaaaacaacaagattgggagaattttcatcaggcagaccaggaattgaatccaggggctgacacataataattatttgttcttgagcaagttattttatctctcaacctcagtttccccatctacctgtcttgaagactaagtaggttaatatacataaaatatgcttagcatgttgcctggaacaagctgtgtgtgtgtgtgtgtgtgtgtgtgtgtgtttcagacagggtcttgctctattatccaggcactgtgtgtgtgtttgtgtgtgtgtgtgtgtgtgtgtgtgtgtgtgtgtgtgtgtgtgtgtttgagacagcgtcttgctctattatccaggctggagtgcagtggtgtgatctcagctcactgcagtctcaacctcctgcgctcaagcaatccttcccacctcagcctccctagtagctgggactagaagcatgcaccaccacactcagctaatttttatatttttagtggagaaggggtttcaccatgttgcccagactggtctcgaactcctgggctccaacgatccacatgctttggcctcccaaagtgctggtattacaggtgtgagccaccgtgcctggcccaaactgtttttgaatttagccgtcattagtattaatatagttttgttgttattattactgtagtggatctaaaacgtagcatattaaaattgattatagtagaacgttttaaaggtccaaacacagacttataagcttcttatgtgtatatacttgtgtttttcacttaaagatgttgattagctttaccagtagggcatgttctttgagtcatggtttcaattaaaaaaaaaaaaaaaagctataggttttcaactatctcctgtctgttttccagacccctttgtgaccaataacatgaattcgtaggttggcaagcctagatttaatagcacagacactagttattagcccagagaagccaactggcccaatggctatgacctccactttaatatcctaatataggttgagtgtccctaatttaaaaatccaaaatccaaactgctctaaaatttgaaactttttgagccacctacatgatatttcaagttttcagatttgggatgctcaattggtataatgcaaatattccaaaatacaaaaaaatctgaaatgcaaaacacttttggtcccaagtatttctgttaagggacagttaacctgtactactaacaaaaatggtgagccagtgattgattttgtgagtggtgctgtctcttcatgtactgtaagcctgttcttttaaaaaattatttagcaatgaaatgttgatcatcgttgtatatcaggtacctgtaagtgctctttatcactttctcttcatttgatcagagctggttttgttatgttatttggagaaatgtagatggatagagaagtggatgtagcctggtaacgtctataatcatcatctttctgtcctgttagggaagaaaccttcaggtatgaaccctaattggcttgtagggtttattaaggtctcatccgatactgggagattttccctgcccttaggtcttctctaggcaggacaaggcagttctaaagccagaattgatgcttagattcgtttttgttcagtgactccttctgcccattctggaaaaaagtgggaagctgaaaagaaagaccagaggttttcttacttaatttaatctagagataatttgcttggtgcaaaatttagtcaggtgtaaatctgtatacgtaacatttagccagatctgattgagagtctagagctgtgctgtgcaataaggtaaccactagctacatctggcttttaaattttaaattatataaagtttaaaatccagttcctcagtcatagcaggcatatttcacatgcatagtagtcacatgtggctaggggttactgtattgaacagtgcacattacagaacatttccattatcacagatcattctagaagatagaaaatgatttatttcacttgtttttctgatagatcagtgatggctacttggagaaatgtgtaaagaagattctgagaccatctccaagtcagccccgagttgcttgattatgggttagcagtatgagtcctaggaagagactgctgggtgagggatgtaggggtgttagctctggcatatgtgctgagtgtcttctagacaaaaaatccacaagtctaagaatagaatatttaatctagaggggcaggttattatcatttggtaggaacagattttttgttttcttttagcaggaatcctttagagagaaaggtgagaagcttttaaagttttctcattccttgtatagtctctcatttaagtagcagtcacttttgctgtttctcaaattaacaatgatactttgcttttgcataaaacaaaatcacagtggctgccacttcttggtttatccatcacatcaggaatggttgttatgtgaataaacgtaaccctccaataatccaaaagtaatttcatgatcaagtcactttttacctgccaagaaacaaaactggccgaggatgtttttctttgttttacttctttaatgtcttctgatgaaagataacaagtgggaagtaaaatcaaagggaaagaaggaaaagctggtatagttttgtcaatctctgtataatcactgttttaagaatttgaggtctgtatctgatgatattttaaaaatctctaataattaagggtaactaggattgttttcctactagtttccaaactagaaaagatttttaaaactggagtaccagttctgcaacttttatgtgactttgagcaaattgcttatcataacctctctgagccttagtttctccacttgtgaaatggtgtggaacagtatctacctctgtgaataatgggtaaggactaagtgaaatataaaacccagagtgcctaacaccgctactgtaaggactcattaaaccatattatttgggaaaagtagaccacatgcgctggaaggcgaacactctctgttctgtcttggccctgccacttacaggtgtgtgactgttgtctagttgtttaccctcttttgactttggcttccccttttgtaaaatgggtaacagtagaacctgttacaaagggattgcttggggttaaatgagataatgcacttcaagatcatgcaagaacccagcactttgggaggccaaggcgggtagaccacttgaggtcaggggttaccagcctggccaacatggtgaaatcctgtctctactaaaaatacaaaaattagcctggtggcaggtgcctataattccagctacttgggaggctgaggcaggagaatcacttgaactcaggaggtagatgttgcagtgagccaagattacgccactgcactccaacagagtgagactctgtctccaaacaagaaaataaaaccataatgcaagatcattgcacatagtgagtgttccataagtggtaactgttaagatgcatatgatgatgtttaaattaggggcagtcttgccaaaggataggtttactaaatcttttatctcctctcctttccattcactaatctccagacgatatcatttatactaaacatggtaaagtgtgcacattgtttatttattgatattcccctataaattattaagcctcctttattaagttcttggcacaactaaagcagtaattggagaagctgttagttatcataaagacctttctcactgtactttttctgtaagtttcaagatcatgtctaatataaaaggtctgatggtcaaatcagggcaggaaagcagaggagtcagtgtggggcaggagtgagttcaggagtacagggagtctggttcattgtctgaaggcctgacctacattgcccctaggatataggaagaaggacaaggcatttcagagaaactagtggccagagaagttactaccataatttgctactatatcttccctgtcttattttttttttttttttttttttttgagacaagagtctcgctctgtcgccaggctggagtgcagtgcgctatctgagctcactgcagcctctgacttctgggttcaagcaattctcctgcctcagtttcctgagtagctgggactacaggctcacaccaccacgcccagctaatttttgtatttttagtagagatgggatttcaccatgttggccaggatggtctcgatgtcttgacctcatgatccacccgccttggcctcccaaagtgctgggattacaggtgtgagccaccacgcccagcctcttccctgccttttagttagcatatgcccttcttctcccccttgtagaagcagtaggggacagaaatgataagtcatatatggccggtgagtttttcttccaaagactggtccacactagagggtgcagcctccacagacactgggaattgctcctgacctatggaaaacaactttctttccaagaaaattatttttagtcctttggtgtaaagacacagtcctgagttgttttcacttactgaattctataactaggaatgaaacactatactcttgctaaaaatgaccttttttctttcagaatttttagggaaaaaaaatcataattctctcatttgtagtttcaaaattattaggcccttagaacattttatagccaaacatttgccttggaattaacatctccagtctgatgactttcactactgttctctagtgtctcatgcttaaaatcctgcattcagctttgtgtcttctctctcttcaacagtcccggtgcatcttactttgaaatgcttctcacaaccattctttcttttcttttcttttctttttttttttttttttttttttttgagacggagtctcactctgtcgcccaggctggagtgcagtagtgagatcttggctcactgcaagctccacctcctgggttcacaccattctcctgcctcagcctcccgagtagctgggactacaggtgcccgccaccacgcccagctaatttttttgtatttttagtagagacggggtttcaccatgttagccaggatgatctcgatctcctgaccttgtgatccacctgcctcagcctcccaaagtgctgcgattataggcgtgagccaccgtgcccggccccattctttcttttctgattccactaccactgcccaggttttaaatacatctgtatttgccataacaactttaaaataattttttattataaaaggtaatacatgctcagtttataaaatttggagaatatagataaggaagaaaataagttgtaattcagaaataaatgctacttatagtctggatttttacttctagtcttcaggaatgtcttttcacttgtgtttgtgtgtgtatgtgtttaaagaaatttggatctactctatacagtttcatattgtgatttttgctaccacgattttttttacttgagatattagcgtgttcctatatcattatttttcttttcttttctttttttttttttgagatggagtctcactctgtcacccaggcttgagtgcagtggcatgatctcttctcaccgcaacctctgcctcccaggttcaagcaattctcttgcctcagcctcctgagtagctgggactacaggtgcctgccaccacgcctggctaattttttttttttttttttgtatttttagtagacatagggtttcaccatgttagccaggctggtctcggtctcctaacctcgtgatccacccgcctcagcctcccaaagtgttggggttacaggcgtgagccaccacgcccggactatttttcaaaaaatgttaatgcatacgtaatattgtcttacttagggcaaaatttatttaacaatattgttagccatttagatctcctttttcagtattaaaaacaatgcttgattttcagtattcacagtataatgtagtgagtaagaaaatgggctttggcagttgaaaaactatggtttgaattcttgttctgccatttatttctaggcctcaattcaatcataggcctcggtttctttcttgtaaaatgagtattatggtacttaccaacagacttgtggcaatttaaatgagatgtgtgcgacgtactcatttacacatagcttggcacctagtgagttctaataaatattgactgctattatgatagccacctgtcattaatcatctgcaattgttttgttgtatagttcccagaagctagattgtagtatcaaagtatacaaatattgtaatatattttaataaggtattgccagttgatttctaggaagattctaccaatttatagtcacacaagtagtataagtacctaatttcaccctttgccatttgtggatactatctttaaatattgtataccaaagtgatatgcaaaaatgatgtcttgtaacttgcatttctttgtaatttgcgtgtctttcttataatttacatttaccagtagaaatgatgactagttttacatgtttaattggctaattgtattccttctttgtacattatttattgaagtccatgactatttttctcctaaccgtcttttttctttctaaatcagtggattctttgtgtattataataatgttatttataactaaaatttactgagcatttagaacattcagatgaggtaacaagggcagaaagactagttcgcctcgtttctttgaacattgtctactcagtagattcttgctgtttttgttatccgtctttgtttttcatagacccggcacagtccagtgccctgcacttagtaggagcaaaataaatgcttgttaacttacactgacactgaccactctcacttctgctctttgtgcacaggagccattccttcctgagtgcctttgtcacagccacagcttcagctcagaggggtcagcatctgttggccttgacttgattttgcctatatgttgttaatgatgctttttaaaaactctgtaaagtcaggttatttccctcgctttatttctaggtaacaaacctgaatttggcaactggcatcataaacagaagcagtgcttcagctcccccaaccctccgacccatcatcagtcctagtggcccgacatggtctacacagtcagacccccaagctcccgagaatcactccagctctcctggaagcaggtatgtgaagggccctgcaactagcatttgggttactcagggatggcctgtgtcccaagcaagccattcccaccttgagttctgtatggagatagcactaaggcatatgccctttctccacctgcctcgatcctctggcacctgactaagagagcctcattttatttgtaagacagttttcaagcatatcaaatgaaaaggacatttctgagatagttaagaaaatcaccttagggtaaaagagcaagaatttacactatgtttaaaccttgcttatagtcatcatttttatgtgccaactttttgcactttgtccttgtctcttagttttttttttaataccttgtgttgtttatagttttttttatactacattgtgtttcagtaactgtagactctgttcttttgaaggacatatttgtttcttatttttttatctagtttcatataactgaactcaaacaacctcgctgaacaatgctcatttgggaagtgggaaggaaatttcctttatgtagttgagagatgtggctaaagataaaatccacgtagcttctggcaataatgtaagcagcttccaaattaaaaaagaaaccactgtattgaattctggtcttgctgtgtgttttaattacccctgtattaaaaaaaaaaaaaaaaagaaatggattcccagcacatcttgctttagtgcctattaaatatggattaaattgcatcagtccctgagtcgaatgcgctagagagaaatgtgactgttacagtgaagtattttgaccagctgagatattgttccctccaaccaaagaagttttaccacaggtgcccgaccaagccctcacgccccatgccagtacttccagcctctgccttttagtatgctgctttgccctgagattcagagggggtactgaagacttggacatggaggaaatacctagttgttggtaaagtatctattggtgttagaattattacttaaggaactaatttgggaagcagaagctctgcccaggaagcagcatagatataagcacattacatcatcctgcggtacggtgtctttcataccggtgatcattgtggtcggggcgaaaagaatcatcttaactgagaattataaagaaccgaagaccaagacgcaggactttttaaagcagagcatcctccacacagttctctccccaggagaagtctgctgtaaaacatcagtcataaacaagaaattctgtttataccatagagctttattttccataaaaaaatttccagatattccattttcattttaaattcagagccttgtttttatggaagacattttcactgcaattttggatataatgtctgtatgacaaggctacaggcattgctcctactgtaaacaaaatgttaaaaccacacattttggagaaattgagttttagcactttttatacttgtagatggaatgagggaaaacatttttaataacaattgtggctgggtttagagctttcttttggtagcgcctgttagtagtgagatgaaagatgatgagttcggttaaggatgtgccaggacctaaggttcagtactgtgagtggccttctcccagccagactgcccacgaggctgcgataatgctcatggtgcattacacgatttacttctgacccattccagccaaaaagcaatccccacaaagtcccctggtcttttccttttctttttacccacagcagccttctctttacctcctcttcaaacacaagagccagttttcaagtcccatttcagttcagggtagccctgggacattttcctctacccccaggtgacctctggttgccagcactgcctgcaacctgagcttgagagtcccagttccacatggaattcccagaggcacccaacctaaaggagccctgagtgaattctcagaggtctttccagacttggctgtgatataggccgcagccagacctgcagcatacaacctgcacagcccaatgtcctggtttccatttatacctggtaagtcactgttttgtggatatttagtctcttgttgttcctcctttagtcgtaaggatgactaagtttaatgaatacaggatttgtagcttagagatctgagttttattactggtttgacattaagtgaccctaagctattcatttaatctttttattgggtaagcatacttacatatgaagtggcctgttttgagagcttttagattgcctttaaagcactttgatctccctggaagtaggtgctaggtaaataaaagttactctcaatagtttttctacagtagcaacagtggattccagtttagttctgataattcactaaactaggggctgccttgtaaactgtaataaaatgtaaagagaatcccattgctagctgtacttttcatctctgcatgtcagagaattcactgacttggtagccacaggaatgaaaactggtgactcacaagaactctgcaaatggtgttatttttcatttccctatggtgttgctattgttcccaattttatggatcacacaagttttcatcaaacgaccttgttctcccgctgttttgacatcaccccaaatgtagcctcagggttgtcgtctcccattgggtcagtgtaagctcagcccagcgcctcaaatcccttggttcctttggtctgtctggagtcctattcaggctttgttgtgggagaagaaggcaaagagcccacgacttgcccagacagtctgaggcctggccatgtagcttgcagttccctagacactctggagttggacttggccagccatccctctgttgttacttttcagaggtaataagtgagattaattgcaggccattctccggaagagaaagtagttagagccaaatacagtcacatgtttagaagcctgaggtgtgcctccaagcaaggccgacttagaattatacagtagggactccaggatgcaggtaccaagtgtttatgacctctctcttccttaaagtgatgttttcagtttctaggtgctgatacgtgggtgtgttaacttttctttagccaatgagaaagattagatttttcaagctgccttttaattatccatttttggggtacatgggaagtcattaggagctgaaagttgatgtgcagagccatctcatcattactgccagccttccatggaattggactgcatcagggaggattttctaggtgtggagcactcagtgggttcttagtgcgtttttctttgtgagacatggaagggttactgtaaagtcttggctgctgcttggaatgatttgggaagaacagggcctcagacagcttggcaggaacctgaggccctgtttttttccagtccagcccttccttgtggatcgagctgtcagggaatcccacgaatgtctggctcctgcccctttgtatgtttttccagcatttgtcattgaattatttttatccacctctggctttttcacacatgcatcctgggcatttgtctgttcctcgatatgaaagatgggagaatttgcagaaagagcacagctgtgagtttgttcctacttttttgtgataggacaagacattgtgggcatgggctgctccacctggccagctcccattgtctagagaacatctgtatgaacttgaaatgccaccgaggagtgggaaatcttgagaagttggaaccattttcgatgtcaccctgtccttctgccctcttattcaacaatagattataaatagcttggtattctgctttgcgtaattttaaggtacacatttttcagagattctgattctagtttagttaataatactttcctcccttcttttagattattcttagaaatgttgctggagattcaggtctctaacttctcatcttttcattctcagtcagtcctcagaaatactgaatttgttaatttcctttaaaaatatgtcttatgcattttctatatgtcaggcattgtgttagttgctggggaggagcagtaaataaaacagaatggttcccaatctcaaaatttactctctagggtatatcttccatgttctcagcacagtattgggtgctgggtagggcctaaaagacttttgaagacataatgtttgatcactaagaggctactgtctggcagggaaagggagtgtatacacatgaaacaatcagagcagtggcagggggcatatgacaaagatctgaattttatgggatagacaatttgaagaaagggtgtcaagaagggcatgtaaggagtcagtcctgtcccggatgaaccttgagggtcgtatgctcagtgaagccagccagtcacaaaaggacaaatccattcatacgaaacatctaaagtagtcaaaatcatagaaacagaaagtagaaaggtggttgccaagggctgggggaagaggggagggggaattagtgtttaatgggtatagagtttcagctgtgaaagatgaaaatgttctagaaatctgttgcagaatgatgtgaatgcacttaacactcctgaactatacatgtaaaaatggttaagatggtacatttaaaattatgtgttttttttttttttttaaacaaagaagagtatgtaaggatttaagagagctccatagttccacaaaaattacttagtggccaaatggcaaggttttgtttttatcctctgcctctgttataagggaattattctgaacatagtcctttaaatacttctctttcttgaaaagcatgttacctttataggaaatgggcccagcaatttctgttaggaagatggcatagtatggtgggaagagaagggactttagagtcagacagacctaggtttgccttattaagtgtgtgaccttgggcaagttgcttagcttttctgaaccataatttccccatctttttttcaatgcacatagttaaacccacctcattaagttgttgtaagattaaactgagttgtgtatgtgaaagtggccagcatggtttttactttttacttttttggtgtaggtttcttggtaactctcagttccctttccagaaaaaagaaagaaagaaagaaacttaaaattgaacttgcttgggatatggtattgctcaccacttagtttagtacctagtttacatcactctggccatcaccctgtgcagtacgctcctgggactggataacagaaatctggcctttctagccgaggatgggaaggcatcagagtggggccaacaagagactcttcctttttctttgaccccttggttggaggtcagcttctttctactcagcaggccctttttctctgctgtctcctgaatgttgaaatttccattgcagctcaatgttccagccagtaaacactcatattttccatctatcctgggggtcgagctttgggagagcttttctctggagcagtttggagcttataattttgtactttatcctgttatataaacaatgctttccagccaaagagcacaatcaaagagaaactactttttgtgggggggactaaaaaaaattcatattcagagtcctgtagaagtgatatttcactccttatgcctctttcttctctttcataaaataaagtttacctcacctttctcctgagtcttaactctcactattccttcccctgaggaaaacgatttctccagtacatgtatgataaaggcctgtacttccatctgaattttctctgctacttttctcactcagccagacacgtaacctctcaagagttatacgctgcatcagttcaagctctgtgacagattctacagttcctccttcaccgagagagctgagtgctgtcagtgtttgtgccaagagcaaaagtgattggcttctgcctaataaaggaacgttgggaagcttaggaaatctgtcaaagatagctggctggacgtcataccagggcctaggtagcataggttcgggaacctggggccgagtgtcaggagtgaaaaacgtggatctttcttatccacaagtcagaataaagcatggaatgcagtgtttgcagtttgccagtgtcagtttttctagttaagtttgcctctctcactccactccacactgctttgaagtattaatgataaaccaccttctatttccttaggatacgcgtacacacacacacacacacacacacacacacacacacgagtctttgttagaggcaaaacctatgtgaatatacttacactcctgaactgtacacataaaaatggttatgatggtacattttaaattatgtgtgtgtttttttaactacaacgttaaaaaaaaaagagtatgtaaggatttaaaagagaaccccatagtttcacaaaaattatttactggtcaaataatttttttatttaactgtttaatcttatttaactgtttactttataattttgtaactctacaaaatggatgattattttggttttaagaggcctggttatgacaaagttccttacactaagctaaatgagactctgtttttagaattaggaaattataggagttgttttatttataatttagtttaattctcctggcatggtttttctatcagcttctgtcccttcaagttaactggtttaccagctttggaagagcctgggaagatcacaggcgtgatgaaacacagtctttctttctgactcatgtagaagaacattgatgatccatatttaaagcttacctagtattgactcaacaaatttagaaggaaaaccagccagttttcctgatcctttaactaacccacctgcccttctcgctgctaaaagactctcagcgtattacctacccagtacagctaagaaatcaatgctcttttttaagaggtctcaggagttaagatgctaataagaaaaaactccctgtatttatgctttcataaaataaaactatagaactatatatctgcaaaggaataaaagtcctctctttcctgaagctgctttgtgggacaaagttttggtataggctcttagtagctaagtcttagttccctttttttgaaagaaacaaaattgtacttgcttggtatatggtatttgctacactgggacacagtttagagtcaactggccgtaactcacgtacaataaaatacagtattatagcagggaaagcagtaatatgtaatcacaatactaaggttgacattatttatttatattgtgaagtaagtacccacttattaaaactgttattataaatcattaaaatgctcgtaaagaaagataattaggaaaagccaaattttaaatgtttatttaaatagggagccaactgttctttgggtgatgtgtgcaaagctagtgagagaggcagtgtatgagagcttagggatttgaaatgtcacaacatatggcaggcccaggtgttcattataagttacaaactctcgtcctgcttggaccattcgtatgcttcaggagcagtaaagggactactcatggttttcatgaattatcaagctaagattcatattaatttcacttcagagccaataatcaataccacatttggcttggttctttttttttttttttttttttttttttttttgaaacaaggtctcactctgtcaccaggctgaagctcattggcatgatcacagctcactgcagcctctgcctcctcaggctcaagcgatcctccctcagcctcccaagtagctgggactacatgtgtgcaccaccatgcctggctaatttttgtattttttgtagagagggggtttcaccatgttcccagactggtcttgaactcccaggctaaagcagtccacccgcctcagtctcccaaagtgctgggattacaggtgtgagccactgtgcccgacctggcctggctgatcttaaaaataagttttgctatctttctgtgatgagaatgaaatatgggtgcatctcaatgatgtgactataatttaaaaggatttagatgagaaaagcaggctttctggcatagtaggtaaggcagccataaagaggttagtaaattggatgtacttaaaggctagaggaaatcaaatcacaattgacccttgaataactcaggtttgagctgctcgaatctacttatatgtggcttttcttccatcatctgccacccctgagacagcaagacaaaccccttctcttcctcctcctcctcggcttacttaacctgaggatgacgagaatgaagacctttatgctgattcacttctgcttaatgaatagtaaatatattatttctcttccttatgattttctcaataaattttttattctctagcttactttttagtaagaatacagtcccataatacatatatcatataccatatgtgttaattactgtttatccgtaaggcttccggtcaacaataggctattagtagttgagtttttgtggggggtcagaagttgtacctgaattttcgactgtgcaggggttggcaccccaacccctgtattgttcaagggtcaactgtacattcttttgaaactgggttgcaccaagtaaaactaagtaaatgaaagaccctgcctatactgttgaatactctcaaatatcttactagctgcttgagcccagtactgacatttgaaatataagcttcaaaaagagttttgttaccttcttcaacaaatatttagtaaattaaaatatgtgcaaaagcaagggtgaaactggtagtaagtaatgtttcagctaggaaatgatttcatctgatagttgttacagtaatgttatcctcaaaaagttaacatgtaaaattactgaatatctcctcagtgtgagagactgggccctgaaggaggtatcagacaaatccctgtcctcaagaaggaaaattactgatcataaaatttactaatgcaagtactataaagcaatatgtgcttaattattgaataggaagatgaaaaccttttcttaagtggtgagagttccgaggagaaatttatcactctggctggagaagctggcgaaaacttcatggaaaagaaaaggtgtgagttgaacctggaagggtagatggggcttggataggccaacaggctgatattcatcacttaagagataattgcacatatatttggtgcttggcactatgtgagaatctgagaggatcaaagaattgtaatccatactcttagtaatagctcattattgaccagaagccttatggataaacagtaattaacacatatggtatataatgtatgtattatatactgtattcttactaaaaagtaagctagagaataaaaaaatttattgagaaaatcataaggaagagaaatacatttactattcattaagcagaagtgaatcatcataaaggtcttcattcttgccatcctcaggttgagtaatactgtcctatacatttactttttttttttttttcatgtaacacagaaagcgagtgattttaaaagagcatatgggttcagatgagttcacaattcaaaaaagatactaaagacttgggtgaaaatataaggttctgcagaggaagagtttaaggtagggtgtaaattcagtcccaggtgtataggctacggataggttaagaaatggaacaaaaaagaagataatgtgcaagatatttaaggtatttgcagggacagtaagtgggagccagtctggctcagacagtgtgtcagaaataatgtattagtcaaaacacttggagtttcaagtgatagaaactgaaatcaagctggcatatccgtaaaggagattttttagttcatataaaagcctagaagttggtgtgggggaattaggaagtatcattaatcattctcctttcttccaagttcacaactaaatgagaaatagtagaaaagttagagaaatagtgagatattggctgtattgctaaggataaattgttggggatatagcataattaggcttctacctctcaagtctgagtctttctaatttgttttctgtattctaaatatttcctgtattgacattttggtcacttggataattaaaacaaattttttcaagaagaaggaaaaggatccaacacaccacaatgtgaaaaacaaaaacaaaaacaaaaattgtggcctgatttccaaagtgagcacctgcatctgggtccagtccaccttaccacttgcattcttcttcataagttcagtgtcagccaagtcaacagatcaaaagtaagcctattattgtacaacatggtgactataattaataacaatgtattatatacttgaaaatcactaagagagtagattttaactcttctcagcacacacaaaaatatgtaaggtaaagcatgtgttaattagctcaatttagccatcccacaatgtataacatattccaaaacatcatggtgtataccataaatatatacagtttttattttttcattaaaataattaatgaaacatgaaagataatattttggaacacaaatatataagccttgtatattttcccatcaccacatcctcacttatgccattctgtagcacttattctatttgtttactgtttactttctatcactctttcacttaagtgtatgttgtcttattcattattgtatcccagtgccttggtaagcagtaggaacttattgatgtacaaatattgagtaaaagcatgagtgaatggatatcctgttctcacacagggctcagtttattgcagtcttcctgcaaccttccctgatgtcccaagcagatcttattaggatttctcatccttaatgcctttcatctattggaatcatgctcctgagagatataattcaccatgatgtccagtatggtagccacgagccacatgtgtatatttaagttttaattaaaattaaataaaatgaaaatttcagtttctcagtcataaaagccacaagtcaaaagctcaaaacgagcttacgtggctcatgactaccatattggacagctcaggactggatagttgacccagaagatgtaataaagactcaaacttggttagtgaaataaaaagtaaaaaggaatgagtttctaagaaaggtacattgttgatatcctcttaggatcttctgtaggtcttgagcttcttttgtttagatctggagatttactacagatgctgttcttgaactaatttgtggtcctggaaggggaatattctaatgccttgggaatctcacaagatcagagcttcagtgtaactagtatttaacctatcagagctaggccaactgagaggaaggggtttttaaagcagatcccagcattatctttttattttctgagatgtgtccatggctagatgttgggggagtcttgcttctctaccctccctctactgcccacagccaccgccacccccacctgcctggctggaggttctgacatggcttctagagctgctgtaactctggggaacagagccaaacatgcggaagtggttacgtgtactagctcccagggaagccgtggctagcagggggagtgggtggggtcctgcctgatggcttttcagagacgccaaatctttgaagttttgttttagcagctgccaggtatgctgtttcagcactttgcagactctccctgtgttcccatatcacattttttctttactgtgtgtgcatagtatacacaatggagcttggctgttgggagggcaaatataaaattgtggagtaaggaactaaacacaacccttttggcttttggcttttgctttttactatgactctgatatgaaatagccactttaatgccctgttttcagctctgtccgtttctgatcacttgccaacggaggggtagagtcctcttctgttttgggaacatagtacagtttgaaaaactggaggtcctacatttctgtgatagattggggtgtcactcttgaggctagaacttctccctttttacgaaagaacagatgacacacacccccacccccacagcaagtaacccggatactgctggtctcagagtaaacttcttgctcaccattggctccttggcattgagcacaatgtcaacaataaatatttgttaaatgattgcacttgcagctgctatgctggaggagaagggctggggaggtagaatacacctttaaggcccagcctctgtgctttccctgccttcttagtaatccctttctcctatccagtctacagtcacctgaagcctttcccaattgcccccaaatttgctgcttcctctgaactccactctcggagtttagtgtatgttcttttgtgtagttaactgtcttttctttctttcctgagatgtaagctacattttatttctggaccaggaatgggaagacctaggtgccagccacaggtccacctgacttggggcaaatcatttgacaaaaccaaagcctaattttgctatgtggaaagtgatgcctggattgtcatgggaattcgatgagatcccatatgtgaacgtgctttgtaaactgtaaagtattacacatgattgggtcttttcagtactaataacactcatcactataaaatagtaatgtttgtttctgctgccgatgtacaaagactaatctctcccagaattgaggtaaatcaccagtttagtctcacgttactcagttagtttggcacaggtttaaagcattaaacggtccattccaggcactgtctgtcatcgcttctctttcagtctgcaagctcctccttttggagctgtggggtggttgttttcttaagtctcccttcttctcctatcaggcccaggctgagctctctcttttaaccacctctgttcttagggcagcaggcttgtccatccagttcccagtttcagcgggaattgctgtactggtgggccagtctcctcagcgtggccacctgcctcccgcagctctgcccatcaggaacaccaggtgccttcatcattctcctcagccaagccccatgcccttatcagcacctctcagcctcacttcctgcgttcctctccctgtgcttatttttctgccaggccatcccctagcctcctccctctttcatatcatttcatcctgcattttctttcgttctctgagttctgacctttcatccagaaaggctgtttcatatttcaagactctgctgttcggtacatcttcaccctcctgtcacccagtccccagcatctgaaggcagctccttctcagagaagaataggataaataagtgctgccacattttgggactatcatatggcctgagaagctcccaattttttttattttaaaatatcgaagatcttccatgtaagtgttatgacctaatgtttgaaagcatgtagttaagaggcagaccaatttggattccttctttttttagccactcactagctattttgcctagggcaagttctttgaacttaatattcttatctctaaaatagagaataaatgcctacttcctagggatgttctcaggagcaaatgaaaactaaatggcataagaaaagcacttttactatatataatgcctgccatagagtacgtgcccagtaagtgggaatccatgtaaacatttctatgtcatctacccttacccatacccatacattagaaatgttaaaaatggagacccagagaaatgaagtagagtgtgcaaattctcatgcttacctagtgataaagtaaggagtggaatccagggcttctagttctctgcctgataaattttccatttgatctctctgactcctcaaagggttatttgtttgagtttcctttctttaggtgaagtatgctattatcccagatagaggcatgttcatttattcattcatttttcattcaacagacattacatgaccaaaatgttaccaggctctgagtgtacaaagaccagtaatgatgaactcactgtctcaatggttagtccagtagggaagaaatcatcactgtgaagaataagtcacagtacaaaaaacatgctagtaaaaggcatgtggggcctagaggaacaagctaaatcagaggaaaaccaggattgattttgcagagagtgaattattggttttttactagatgaaaatggcggagatttgtgcaaaggcagggaggtatggaagagcatacctgaagtgcagtgttgtgggagcatcacattcaagtaggggagtatgtggttgaggataaagtgggaaagttgaaaagttaaagtgcttggtatgccatgttaaagggattttatcccattgtcagcccttttaatcagtgtgaaatgaagaaatcaagggagtttttaaaaaacatttctgcatctttatacctatgttttcatgttttcactgtctttccccttccctttcccattcttatttggcaaacactttttaccattgtggatctagcccagttctaccccttactctgtatattttttactccctgccatcccaggcagtctaaatacatacctatgcccaaaattcacagaccggacttctacctgggcagttctttagcctactacaagaagtcacacaccatcatttaaaaagaacttttttattctgtagatggattaggtcaggactttttcctttaacaagaaccacaattcagcatgcttaccatcattagaacttgcgctttgggctgggcacagtggctcacacctgtaatcccagcacttaaggaagctgaggcaggagaatcacttgagcccaggagtttgagaccagcctgggcagtatagtgagaccctcatctctacaaaaaatttcaaatattagccgggcatggtagcatgtgcctgtagttccagctactcaggaggctgaggtgggaggattgcttgagcccaggaggttgaggctgcagtgaatcatgattgtgtcacttaactccaacctgggcaacagagtgagaccctgtctccaaacaaacaaacaaacaaacaaacaaaacaatttgagctttgacttcctctagtaaggtaccctagcactcagctggccaaaaacctgctatggcagcagttgtcattcttcatgtctttgcaacacacttccacatacaagaactttgatcaacacagttgaagggatcaaaagatgcaagacaatactcaacccagtaaatttcacctggtggaatcaatattaaagtagagcattgtctcccagtgtccattaggtgtctatagttatactcctcattcagtcatccttcaggaccatgtggctgttttgagtattgctatttatttattgccctcattagactctaatatactcacaggacaaagtttcttcagactgtagtaaacacacaatctctatttgtcaccaggttgatgttatgcttctcttcttgtgtattgcaaatggactctgctctataccatgtgacaggagccaaccagctcaacatttcatctgacaaagagaaccattatgttgtattaaaatatgtagttaaacccacagaagggagaaaatatttgcaaactaaccatctgataagagattaataatcagaatatgtaaggaattcaaacaactctgtaggaaaaaaactaataatccaattaaaaataggcagaagacctgaacagacatttgtcaaaagaaggcatataaatggcaaacaagtatatgaaaaatactcagcatcattgatcatcagagaaatgcaaatcaaaacttcagtgagataccatctcaccccagttaaaatggcttatatccaaaagacaagtaatgatgctggcgaggatgtggagcatagtgaaggctcctacactgctagttggaatgtaattagtactaccactatggagaacagtttggagattcctcaaaaaactaaaaatagagctaccatacaacccagcagtcccactcctaggtatctgcccagaagaagggaaagcagtatattgaagagatatgtgcactcctgtgtttgttgctgcactgttcacaatagctaagatttggaagcaacctaagtattcatcatcagatgagtagatgaagaaaatgtgatacatacacatagtagagtactgttcagtcacaaaaggaatgagatcctgtcatttgcaacaacatgatggaactggaggtcattatgttaagtgagataagccaggcacagaaagacaaattttgcatgttctcacttacttgtgggagccaaaaatcaaaataattgaacttgtggagataaagagtagaatgctggttaccagagattgggaagggtaatgggggttaggggtgacagggggaagtggggatggttaatggatacaaaaaaaaaatagaatgagtaagacctagtatttgctagcataccaaggtgactgtagtcaaaaataatttaattatacatttttaagtaactaaaagagtgtaattggactgtatgtaacacaaaggataaatgcttggggtgatggatagatactgcatttaccctgatgtgattattacacattgcatgcctttatcaaaatatctcatataacccataagtatatacacctgctatgtatgcaaaaaaatgaaaaataaaaataaaatatatgtaatcaaatatattatacatactgatcaaactttacacacctgtgaagttttctcaacacagaaaagttgaagcctctttcccaagactttaatgaagagatgtgttgtaatccagtgatagaccatcatgaaaatatgccctaaattgtgctgtgttaggagagcaggccactatgacatgataatgctttaaagctgatttttttctttttaaaatttatcaatgtgattgcattggttacctattgcaacaaaacaaattactgtaacatttagtggcttaaaataataaacatttattatttcagcctctgtaggtttctgtaagaattgaggagcagcttagctgggtgtttctggctcaaattctcttataacattgcagttaaggtgtcagccaagagggttgcagttatctgaaggcttacctggggctagaggatccacttccatgatgtttcactctcatatgcgtaatgagttcatgctggctgtcgacaggaggcctcagtttctcactacatggacttttccacatggacttctccactggctgcttacatgacctcatgacatggcaactgacttccctcagaatgagtaattcaacagagagtagggtagaagccacaatgtcttttatgacctagccttggaaatcacatatcatcatttaaaaaattattattttaaaaattgtggtaaaacacaatataaagtttaccatcttaaccatttttaaccatttgaactgtacacagttcaatagcattaagtacattcacattgtgcaatcatcaccaccatccatctccataattcttttcatcttgataaactgaaactctatactcattaagcaataactctacattcttccctccccccaacgcctggacactactgtggtattttctatctatatgattttgactactctaggtatctctattagtagaatcatagagtacttatctttttgtgactggcttatttcacttagcataatatcctcagggtttatctatgttataatgtgtcagaatttccttccttttacaggctgaataatataaaatatttcattaaacatatatatatgtgtatatctagatatatgtgtgtgtgtatgggagtgtgtgtgtgtatatatgtatacacacccatacacacacactacattttgtttactcattcatcttgatagacacttggtttacttctgctttttggctattgtgaataaactgctacaaacatgagtgtacaaatatcttttcacctccctgttttcagttcctttggtttatgcccagaagttaaattgctggatagtatgttaattgtgtttttttaaattaattattcactttatttttcctatataaaagcactacatggtagccagagttggagcctgcatcctttgcacagaggctctggtgcaggtctttactagatggccagtgaattcccaattaggtgatttggtaaacacaatctttccagaagtaagaggtcagatagctaaagatcttggaggtggcggctgggcgtggtggctcacacctgtaatcccagcactttgggaggccaaggtgggtggatcatgaggtcaggagatcgagaccatcctggctaacacagtgaaactccatctctactaaaaatagaaaaaaaaaaaaaattagctgtgtgtggtggtggacacctgtagtcccagctactcgggaggctgaggcaggagaatgacgtgaaccctggaggcggagcttgcagtgagccgagatcgtgccactgcactccatcctgggtgatggagcgagactccgtctcaaaaaaaaaaaaacaaaaagatcttggaggtggcatcaaaggtagtcttggcacagttgctcagagggtggtgcaacccctggctaaggtgtagcagtcatgagtaccaggtataagcagcagctttttgagtgcaggacctaagatgttgacagtgcctttgggggcgagggtgaggcacatcagcacagagccgcagcagccagtcacttgcagtgcagagtgtggagcttgctgatcttgttccattggatccttgctgcatggggatgatggagagcagggtgataaccccacagatgctactgtccgcctccttggagcaattatccagactgatgtagccattgtagtcccttatggtaacaaatgccttgaacctggtccactggccagtgtgggtctgcttttgccacaagtatagtcttcaaaacctcacctgtgagagggtgtccccagaaatgtcgatgatctcagattccttgatgggcagggagaagagagagatctgctccagggacttgattttcatgttcttgtccaggcagcccagcatgcggatggtgacacactccttgtacttggtcttgcttctgtgagctctgtggtgtgggccctgagcacacctgcggtctagaccctcccatagcgctggtgtcatctgccatttgagattttgtcttggagaagaagagtaattctatttttaagttttcgaggaaccatcatactgttttccatagctgcagcaccacttcacattcccaccagcagtgcacaagggttccaattttgccacatcctcaaaacttattttctgtctttttgatagtagccatctgtattagtttgttctcatgctgctatggagaagtacccgagactgggtgatttataaagaaaaaaggtttcattgactcacagtttcacatggctggggaggcttcaggaaacttacaatcatgacagaaggcacctcttcacagggcggcaggagagagaatgagtgccagcaggggaaatgccagatgcttacaaaaccatcagatctcgtgagaactcactatgatgtgaacagcacgggggaaaccgtgcccattattcaattacctcccaccggtccctctcacaacacatggggattatggggattataattcaagatgagatttggggaggggcacaaccaaatcatatcaccatcctaacgggtgtgatctcactgtagttttgatatgcatttccctaatgattaggaatgttgagcatgtttttgatgcttattggctatttgtgtatcttctttggagaaatctctgtttaagttttttggcaatttattaatcaggttgtttttgttattgttgagctttaggagttctctatatatcctggctattaaaccctcaacagatatatgatttgtcaatattttctcccattccattgaatacccttttaccctgttgacaatgtaacccttgatccacaaaagtttttaagtttgatgaagtctaatttgtctattttgttgttgttgttgcctgtgcctttggtgtcacatccaagaaatcattgccaaatccagtgtcatacagcttttgccacatgtgttctaagagttgtaatagttatagcttttatgcttgtgtctttcagacacagtcattttttatatatgtatacttcaagttctgggatacatatgcagaacgtgcaggtttgttatgtaggtatacatgtgccatggtggtttgctgcacctatcaacctgtcatctaggttttaagccttgcatgcattaggtattactcctaatgctctccctccccttgccccccaccccctgacaggccccggtgtgtgatgttcccctccctgtgttctcattgttcacctcccacttaggagtgagaacatgcggtgtttggctttctgttcctcagacacagtcattttttcagcattctgttggtttatacaggccagccctattcagtgtgggagggaactacgcaaggatgttaggaatactaggaggtatggggatcgttgggggccatctcaaaggctggttcccacaataattcagaactatagttttaaaagttaaggcattctatagggtttataatgaaaatgggaatcccttgccttttctcttcccactgctacccaaccttaatttccatgccctagaaataattgctttcaactttcttgtaactgctttttctgttatttaccttctgtgttaattcattcttgcattgctataaagaaatacctgaggctgggtaatttatgaagaaaaaaggttttattggctcacagttctgtaggctatacaggaagtgtggtgccagtatttgcttctggtaggggcctcagaagcttccaatcatggcagaaggtgaaggggagcaggtatgtcacatggcaagagcaggggcaagaaacgggagatcccagactcttaaaacaaccagatttcgtgtgaacgaactgagcaagcgctcactcatcaccaaggggatggtgctaagccatgcctgagggatccacccccatcatccaatcacctcccaccaggccccaccaccagcattgggaatcacatttcaacatgagatttggaggggacaaacagccaaaccgtatcaccttcatagttctaaatcatgtttattctgccatttttggattttaggtttagatattatctattaactttctgtcagaaaaagattttgcactcttactctacacccttcacacccacacaaacacacatacccacagcattctttccttccttccatccttgcagtatacttagaatacagtttttggttagattcgtattcactggtttcattaccatgactgtgactgggaacttttgggcctcttagagtcattatttcttctttcctatttattcctttctttgtcatctggtctgactttctgggtgattcccttgataattttccatatgatctacttccctaagtctgacttagtacatgttgtgaagttaagaaaggttctaatttttaaatttcttccagttcaggacagtttacatggggctgtaaatcgggggattgggaagggatctacatatttacttttttttattttctgtagactgaaatatctatgtccatacttaaaaaaaatagttgtacaagtggtacacacatgtagccacatgttacagtagtctaaaaaatacacatatggaaagattaggtggcaaataaaatcttctcagaggtagctatacttaaaaggttggtttgtatattttttcatgtatttttctgtgatgtttttctatcctaatatgtctccatgtttttcagtctgttcatataaactgacttaaatatttttaaccactatgtcgtttttgaaagtatgaatgtgccataatttgtttttccatccttctattaagaagcactaagccgtatcctgatgaggcatctgtagggaactccttatacgtagatctttgtgcatgtgtgtatttctgtaggataaactcctagaagtggaattgttggatcaaatgtccactttgaatttttatagatgctgtcaaattggcatccaaaaagcctatcccagtatatcctccaatctggagtacagaaacatgccctttttccacacccttgccagcattacataccattgacctttctgtctattcctctggactgtcgctctcccacttttactgatgatgaaatgaggagtggaccctatcttcagatatattacttcaagggtgttttgtttggggcaggagtacaactgagaggaggccgagaagcaggagggtaaagggttctccgtgggctctttattttcttaatgttccttaagactagaaggaatccctgtgagtcaagttcatcttccctccacgctgcttaggtcttttctctcctggttttgtttttgattgattttacccagggagcctgatcctctccccttcctaagtaatgaataaccagaaaaagttatagaacccagcaaactgaatgaaaaaagcttaaggaaaatattaaaaaggaagaaaagtgtttgatgtacttttaatgtaaaatgtggaaaaagtagaaaatgggtgggggttggggaaaggagggaggaaagagattattcacggtaatgggaaccaaatgttggctaggaaagctgcagtattctcacactcttcctgtaaacccagcggcttttcaaagtgataataatcaagggctgacagcacaggacacgccttaacccttccatacctggacacttcctttgagtcagcctcaaaggtggtgtccactttgaagaaatcctggtatatttcagtgccctttttgcctccatagcaaaaagaagaaaggtggaggcaagttttgaacagcaaagcacctgcttgctaaaactcctttcagtatgcccaaatttcttttctgtggacagagagcagcctgcctgaccagtccaggatattttctccccttgctgtcctgagaggaacttgaaaggagttgagaacctccttgtgacagataggattctctttccatcagtaataatcgcgtttacttgaaaaccctctagtctgaagccctcctagatgccagtgtggaagtgcatgcacttatttggaggcttagacctttgtttctcttggaagtccactcttcccactgtggaactgagatgtaaatatactgttcagagctgaagggctccctgagcttatgacttccagctggtcaagaacagtcatatgcctcttggcctaaccattcatccaaggagggagaaggaaagggggttactaaatgaagttcctggttcagctggatcttcacatccatctagatttaaactttgttgagacacctttaaaagttcatcttacacaagaaggaaatgaaatcttattttttgttgtcaactatttcccatttcagaggagcagccaccacatgtagggcaatggtagcaataaggcaggtagcactgcagagcagatgagtgctcagattctgcagttagctatgcctcggttgcctcatctgtaacatgaggcaaggttaaagtgagataaagcacagaaacatttagcgcagtgcctggcacctcctcttctttttctcatcattgtcctcatgtggcatacaactgaaatggaagcatctcctttgtttgaaatgtttttagaagtcatctttgggatgattttatagtttctcattttatatttattttattttgttttgttttgttttgttttattttattttattttattttattttattttgagatggagcctcgttctgtcacccaggctggagtgcagtggcatgatctcggctcactgcaaccacacctcccaagttcaggagattctcctgcctcagcctcccgagtagctgggtctaccactactcccggctaatttttgtatttttagtagagatggggtttcaccatattggccaggccggtctcgaactcctgacctcatgatccgcccgcctcagcctcccaaagtgctgggattacagacgtgagccgcctggcctggctcattttatatttaaatctgtgatctaatctgagttaatttttgtatgaggtatgagattttggttgaggttccttctttgcctatgtatgttcaattgctccaacttcatttgttaatacacaaatggtttagaaaggttattgttcctccattgtattggttttgcaactttgtcagaaatcagttgagcatatttgtgtggatctttggatgactttagtatttctaaaacaaaggtctgtagcaataattgttagaaaatctttagcaggggctattttaagttatgattttctgtttctcattataattgtggagacatcaagacttaggttcaaaagcagctctttcctttattctgtatgtccttaggccttaacctaaccctcagttttctcatgtgtaagatgggataatacctgtctcaacaggttgctatgaaggctaacaaagataaggcatataaagagctcagttgggagtctggcatttagaaagccctcacactaatgatggtagtggtggtgagacttggctgtcctcattcttggtcactctaagccacactcactcatgccctttccattacccaaacctaatttttttttagccttttcattgcagcttcatcataagtgcatgaatgattccagttaaagctgttgtgcagtgctttgcctaaatggaagttttgaccagtaacatttctatttctgaatatgtgagagatctgcatcttaccagctttcattacagcatctctccaccctccacactcctgccatttagccacattggctttcctattgttccctgttcttttacatagtattcctaatgcccggaatgtcctttccagttggcaagttactggtcatcttttgagatgcagataaaatgtcatttctacatggaaggcttccttgatttttctccatagccagttgttcccttctcttgttttctaaagctagtgtcctgttcccagcacagtggcatacagagttggaggagtagcaggagttttttttcttaatttaaaaaagtgtacacctatttttaaactacataaatatatccattatgtgttgacattaatactaaatgataaagatgaatagtatgatcacaatgtactggtcaagactggaatgagacataccgaaggactccccgtggctgtagaatggccctaggggtgacttttttccttcttctttgcactttttagtacttacacattttggtagtcagcatgtttttaatttttaaattaatttttatattgtttgaaatgccctacaacttgatattagttcagaagtatttctcccttattttgaaataagaatctgtgctgtaagttgtgaaagagaggaacaggagaaggaaaagggagcttaaccacatttactgagcgcctggtttatgccagatcctgtgctttgtatgatttgtgctgaacacagggttgtaatgtgggtattgttatcctcgtgtgtaaatgatgaaattgtcttagaggtgataccatttgtccatggtcacacctgaggtaactgatggcccaagaatttgagtccaggtctttctgatgtgaaagctcatgttctttcctctactttaactttcctagttttagagggaggaaaatcagtaccagtctttacacaatggcgtcccagaccagcctagacctgtttttttggtgatagcgtacaaaggacagatggaaatatttctgaaaagaaactatcactggtggattataagaatctttctgtgaacaaaaatgaaaaaaaattaggggctggtgcgatagagttcagcattacaaatatctttaccctagtctatgcatttgtatagtgttttacttttgtcaaatgccaattccatagagaagctttgagtgtgggcagaaaacatcagtagcctgaagaggctaactatcaatatatgacttgtataatatttacaatttagactaaattttgtcttgctttgtatgctgactctcctgaatagaacttatttttttaaatagatataaaccagcaggtcaggcaagtaagaatggttgttttagttggtggggaattacataagggaaatcttgtgactctaggggatagaaattgtggattttttggtcctgatgaatttttacaatggcctaatcacacaggtgttggtcaatcaacacttcttgtaaatgtgatctgtcattttagctatggtttaaaaagcatatggtttaatagttacagtattttagaagcgaaccatgatatcatgataagatgtaaagaattaaaagagatactggccgggtgtggtggctcatgcctgtaatcctagcactttgggaggccgaggcgggcggatcacctgagatcgggagttcgagaccagcctgtccaacatggagaaaccctgtctctactaaaaatacaaaatcagccaggcatggtggcgcgtgcccgtaatcccagctacaagggaggctgaggcaggagaatcacttgaacctgggaggcggaggttgcggtgagccgagattgcaccattgcactccagcctgggcaacaagagtgaaactccatctcagaaaaaaaaaaaaaaaaaaaagaattacaagagataatgaaagagttccctgttggcctccaggccatttatggactcgaagtgtgaggaattagtccataaggcagacatagagatgaatcatgcatttcttccttggcaagtgtaatgtctgaatttagagctttagaggcaaagaattacattggattaagttcctaaaatacaagttctatatttcttttttttgagagggggtcttgctctgtcgcccaggctgcagtatagtggcacaatctcagctcactgcaacctctgcttcccgggttcaattgattctcctgcctcaacctcccaagtagctgggattataggtgcccaccaccacacctggctaatttttgtgttttttagtagagatgggatttcaccatgttggccagtctggtctcaaactcctgacctcaggtgatccacccacctcggccttccaaagttctgggattacaggcgtgagccaccgcatctggctgtatttcttttttttatcacattaataccaaagctgattagcttctttataccaagagggtccagtttgccatagaggaatatggactttctcttggtttgtgagaaatttggattatgtctcactgaacctcaaaaactagatcataaataagaaataatagtaacaataataattaaatgctttatgtaccttaacttatgtaccttaattcatttaataattaatgtttactatgtatacaactgttctgaaagctttatatgtattaatgattcagtgctcacagctgctctatcaggtaagtactgttatcatccccattttacagatgaagaaactaagcacagagaaatgaaatcacttgcccaagataacacagttgatgaaaggcagtcaggatccaagcccaagcaatatggtggcagaattcgtgctcttaaccactctgccagtgattctttgtgtgtgtcacaatcacctgacaggcttgttaacacacagattgctgggcccaaccacagagtttctaattccagtaggcctggagtgaggctccattattttcatttttaacaagtttcaaaatgtggctgctgctgttgctggtggtccggtaagagaaaggcttaattataagtatacattttcttttcttccctttggtgctgtttttttttttaatctcttgtgatttctctggtattttccccattttataaaaatatctttataaagaaagaaaaagtacaggtggagaaggtttaaaaaaaaggtggagttttggagttgtctcctatttcccttggccaactgaaggaagggggcagaggcaggttactggagccagaaaaactgtaggcctcactgttccaagttgcctgatattttgcttcctggggaaaagagaagtgaagggagcctaactgatgtgatggggcaggaattctaaatttgtgacactttgcaagctgtttatgtgcactaggtttgaacccagctacaattcaatgtagaagttcttggaaactggcatgtcagctgccctagacaatctgcacattaacttccactctaaaaacttttcctggcttgcctttgcagagtgtgaaagctaggtgatggcggtccagttttacaataagggccagctgtgcttatgtgtgctgatgttactgtcacaaagacttttcccttgatttgataaaaatcctgctgagccggactcagtcttcattgttgaatgaactggtgtcagggagttctcctttggctttcttaaaggtcattctttgctcacttcttttttagttcacagctacatttttttaggcttcatgtggtatgctggttatgccaaaataaagaactggatcaaagacatttcatgttcataaggctgaggaccaatctgtcttttcagatccagactcctaatagataaaggaccagggagtctctatctccataaccagctcactgctagaatcctaagttgccttctacaacagtgctgtgaacttaaccttttgaaaggtttggtttttatatccagctttttgttccataaagcttgctcccagggtctctgccagatgtactaagaaatccagctttgtccttatttcttcctcctggggaccattccattgatcatggagtggtaggggtgtggaaacagcagaagtctggttcacattctctatccattgtcaggtccagctggctggaatctcattgtacttttaaaggacagacatatcagcttctagctttttgacatgatacctcaatgcattcttcccaaatttatgtaattgtcacacagttatttaataaaatcaaagtaaagttagccaaaacatctccctccccagcatcttcccatcatcacttctgctgctttttccttttctgtatctctgcttattgagtggctaatcagaagtctctcctcaagagcttgtaattctgtgttttaaattagatattttatttggatcctacccatattcttaatctttttcattgagtcaaccttattctctctgttgaatttactatatccacaaagagcagttcttatgatggctaatttctgatttatgtttctggtgcttgtgatagtgattcagtagatgatttaatgcacaaagaaggaggtcatatgctgggaaaagaaggaagagatagaaataagttagacgccgaatatataaactggtaattgagatgtcagttttaggccaaaatctaatagatcagcaaaccaatgagttggcagtccttagagaagtagaagggaatcatttaagcccagcactgattcatgaaaaaagtaagttatgctagagtaacttcatttcccttcaaggtagaattactttggtaagagaagaccaggggactacaaaggaatgactgtaactaggtttccccaaggcataatgaaatcttgtgagcacaaaagagaaatgtgaatgtggtaatactgtcattaagaatatttggtgactggtcgggtgtggtggctcacacctgtaatcccaatactgtgggaggctgaagcaggtggattgcttgagccaaggagttcgaggccaccctgggcaacaggtttgagaccatcctgtctctaacaaaaatacaagaaattagctgggcgtagtagtgtgcacctgtagtcccagctgcttgggaagctgaggtgggaggattgcttgagcccaggaggcggaggttgcagtaaaccgagatcatactactacactctagtctgagtgacagggtctcaaaaaataaaaataaaaaaaaaaatctggggccgggcacggtggctcatgcctgtaatcccagcactttgggaggccgaggcgggcggatcacttgaggccgggagttcgagaccagcctgaccaaaatggagaaaccccgtctctactaaaaatacaaaattatccgggcatggtggcacatgcctgtaatcccagctactagggaagctgaggcaggagaatcgcttgaacctgggaggcagaggttgcagtgagccaagatcacgccattgcactccagcctgggcagcaagagtgaaactccgtctcaaaaaaaaaaaaaaaaaaaaaattggtaactaaatgtgcagctgtacccaaacaataaatcaaagtttgagaattaagtttctgggactctgtcattgactcatagttcccagtgtttatcaatgaatttattcattcatatttatttaggtgcctagtatatgctaggcacttaggtaggtagaagacacgtgaatcctgttctaagataacatgaagtaggaattccatggaataatgaatacctgggatgacaggcaggattcaccgtgatttaaacgggctagaataatgaatctaattcatggaatttaatagggaaaaacataaagcctttcacatgagttcaaaaattcaagtgtaaagaagactttaagggtttaggttgactttaaatataatagaatttaacaatagaaggacaggtgcagtggctcatgcctgtaatcccagcactttgggaggctgcggtgagtccaggagttcaagaccagcctgggcaacgtagtgagacctcatctctacaagaaataaaaaattagccaggtgtgttagcacacacctgtagtcctagctactcaggaggcggaggtggcggagggattgcttgagcctgggacttagaggttgcagtgagccacgattgtaccactgtactcggcctgagtgacagagtgagaccttgtctcaaaaaaaaaaaaaaaaaaaaaagttaatggaataagaactgccaaaagcacatattatcttgtgggaaaatgttcataacattatcagatgaaaaagcaggttataaagcatagagtatggactcattctgtttgtgcaagggaaatacacacagaggaagaatatacgtcaacatggtgacaaaatgtagcagacgtctttggttgttggatcacggatgaatttctctatgcctttttgtctctcaggttttaggcattgagaatataatacttttattcttaaaaaattgctttggttttgtttcattttgaaaaggtgaaagggtatatagccgctgctggtaatttagccttgggggaggggaggaagatttggtaatctttctcattcgtcagtgctcacatccagtgcctgaaccattgcttctctctggtaatcagcattattagtaaacccccacttccccacaggagccactctgcccagaattagagcattctgcagcgggattggcgtggagcagcaggcttccaccataggaaagtcccctccagcaggggccaccgtgcagccgctctctctggcgggtgagactggcaaatggactttactctcctgctcacacatctgagtgattctggcgtcttttttttggatccaatagtttggctgccctcatttatcacccaggtgatctcacatagacacaaaacttggtgtaaaggcattgtaaatactgctttgaagtagtatacttcttctttctcagaagcagtgcttgttgtttagtacccttattggttaccccgtgccccgaaagcttgggttcactttccatgggaagaatgttaataatagctaatgtttactgaacatttattatgcatgccatgtgctaaacgctgtacatagattatcacatgtaatttttagaccaaccctatgagagatgggattaatttttattctcatttcacagctgaggaaaccaaggcacagagaggttaaacatgttgcttctagtggtagagctaggatctgaaccttgcaggcttgcgctcgatctcagccttagtcactgcattgctgcctccccttctgcaggtggtcctgtgcagacccgtggtgtggacccagagtgcaaggcctcctgaattctcactatctcagtgcttgcattgggtttgattccttcccagcacccaaaaccttttatttctttttgtcttctttcttggattatttctttaatcctttcccaggagactttcatcctctcaagtaaacaaattatttagaagtttttaagtcctttcaccctgttctcaagcaaggagaccagcttgcacttacaatttcgtgtagttatgtgcttttgacctagcatcaaaagttcacatagtttttccagattatttctgagcttttcatgatctctaacaccatccctattatactttaactcttcccatagaagaaccatttctgtataactccataggttcaaaacaggaaaagcagaagagagtatactcttatctcaaggtgtaaactcaaaggttaaaaaaaaattaatttctttagtattataatttttagagatcacttaaaaatcttgttctaacacataaattctctaagaatcaaagcacttgtcaccatgagtgtgaactcttggcaggtccgtctaactcacttaaataatgttaagcacagatttcatttggctagctatcagtgttcccagtcagcagttactgacagttattaacagttatagttaatttataatttaccttttacattaagatttcttagtagactgtttcagtatgtattaagtttatatctaagtgcaattcagcttttcttttttactaatgagagtagttatcaatcattcattgaacgcatttcataaacagatttattctttacagagcctccactgtgcaatttcagtgctaaatttaactattatgacccttgactctcttctaactacatttgacttttattatcaatatatcatcaagcttactttcagagccaaccattctttctgcccttcatccacaggactcatttacaccaagattgtcactgtctttgcatttctcacttcttcagaccttcatgccagtttactgggtcattcggactaacatgattttcatcactaatgttaacatataagctagctccccttgattctgcctaacatctcctgggctttaaacccctgtgttaataccacctattccagagtcctgctattcctgacattttttcacctcctcattcttcctgtggactcgcctgacaagtcactgctctaggtcatgagcttttaaaaagcaggaactatgtgtttttcttcttggtagtccgtaagcacctaggaacagtgtccaataaatgtggattgaattgcactgaaatgaaataactgcttaggcatgtatctttacatatgatcccagtattgcaaagtacaagagagaaaaagttattttatagctaaaatcaggaaattataaaaacaggaaataataacaagagttttaatgaaagataagtgaaaatgctgtaactttttgtttgcatgtttgtctgtttaaaattgaggtataattatgtaaactaaaaaatcatctattttggctggacgcagtggcttacgcctgtaatcccagcactttgggaggccgaggcgggcagatcacttgagatcaggagttcgagaccagcctgaccaacacagtgaaaccccatctctactaaaaatacaaaaattagctgggcgtggtggcacacacttgcaatcccatctgctcaagaggctgaggcatgagaactgcttgaacccagaggcagaggttgcagtgagcggagaccatgccactgccctccagtcagggtggcagagcaagactccgtctcaaaaaaaaaagagagagaaaatatatatatattttactgttcaatttgatgagtttcagcaattttatatatctttgttaaccaccatgcaacacaacatacagaacatttccatcacacttcaaaattcccttgcgtctttttccagtcgatactgcccctccccactagtaatcattcttctgactcctctcactgtagatttgctgtgcctgttcatgaatggaatcatacaatatttgttcttttgtgtttggcttctttcattcaatacagtgtttttgagattcatctgttttgttgcttatattagcagttcattcgtttttattgagcaatacttcattgtatgaatacaccacaatttatttctgtaatgataggcattaggattggttccagtttttgactactatgaatacaaattcagtgaaaattcttatgcaacttttttttagccacatttttatttcttttgggtcaatacctagaagtagaattgtcctgtcgtgtaaatatatgtttaactttataagaaactgaccagtagttttctgaaacgattgcatcattttacacccccgtcagcaatgtatgaaagttctagttgctcttcatgctcactaacatctgatattgttctccatttgattttagtcatgttagtagatgtaagatgttagttgcatttccctgatgagtactgatgttgagaacttttcatttgcttgttagccagtcacatattttcttttgtaaattgactgttccaatcttttacatgttcttaaatctcattatttttgttattcatatcaacagttaccaatagggcatttttatattttatcactagaaatcctttgtcacatatacatacctatattgcagatatttttcctcaaaggcatgtcttgcttattcattttcttttccttagtgatgtcttttgatgagcagaaatgtcttgatcatggtagttttatagtagtcttgaaatcaggtgatgtaagttatctttttcaagattgttttgactaatatagattctttgatttttccctaatgtggcaatcaacctttcctgccaccagaggtatgctagaagaaaaaaaaaaaaaaaagaaataagaaaaaaaaaatcaacatgtcagtttcttcaacaacaaaaacaaagcctgctggaatttttattgtgatcgctttgaatctgtagattgattagggggtagtttccagttctggctaagtctttatctgatcaacctacttgataaaatataaaatacaactatttaaaggcactggagggtgaacaaaagctgattgatactggagatgaatcaacatttgaaagaagggaattgccacgggtgagttttctgggtttttgtttgtttgtttgttttctgttgttgccttttcacttaagggcaagtcatagtttgcaccacatggagcagataaaacttgccccaaaatctgcagtctaactggcttggtgaactggaagatggagttcaggataaccacatctgctgtagagggagaggggaactctggaaatgagacatctccagaagaggggagcctaaattctatgtagaaagttttcccaaatctctgactgacccctgactaatgcatatgcaagacatacttcaaagcatgcaggtaacacaaaaagaactgatctgagctgcagcccacggaggagaagaaagaattgcaatttgagtttctccaggttaaccatctacttaaaacacatacacacacattctttagagcgacataatacaatccagtctctacaacatatcattcacaatatccaggatacaatatgaaattatttaatgtaggaagaaataggaaaatatgacctatcctcagaataaaagataatcaatgaagaccaatccttagaaggcccagatgatagaattaacagacaaggattttaaagtgactcttataactgtgcacaaggatgtaaaggaaaatatgctttaatgaatgaaaaatacaaaatattgaccaggtgcagtggctcatgcctgtaatcccagcactttgggaggccgaggcgggctgatcacctgaggtcgggagttcaagaccagcctggccaacatggcaaaatcccatctctactaaacatacaaaaattagccgagtgtggtggcacatacctgtaatcccagctacttgggaggctgaggcaggagaattgcttaaacccaggaggcggaagttgcagtaagacaagatcatgccactgtgctccagcctctgaggtacaagagtgacactccatctcaataataatataataataaagacagatttccaaatggaaattgtgaaactgagaaaaacaatatctgaaatacagaatagacattctaacaatattgagtctcccagtgagtcaacatggtatatctttgtacttatgtaggttttgtttaatatctttcattagtgttttataaattcagtgtagtgaccttatgtattttctattagatttattcttaggtatttgatgtattctcatgatattataagttgtattgctttttttttttttttttttgagacagagtctctctctgttgcccaggctggagtgcagtggcacgatctcagcttactgcaacctctgcctcccgggttcaagtgattctcctgcctcagaatccccagtagctgggactacaggcacccgccaccactcctggctaatttttgtatttttagtagagacatggtttcaacatattggccaggctggtctcaaactcctaactttgtgatctgcccacctccgcctcccaagtgctgggattacaggcgtgagtcaccacacccagccgagttgtattgctttttaaaatttcattttccaattgtgtatttctagaatataaaaatatgatttcattttgtttatggaccatgattactgcaactttgctacatttatttattagttctagcagtatctctctaaagtttataaggttttctatgtaaacaatcatctgtcaatgaataatatctttttttcttgtcttaaactggctaggtcatcctttactgctgttgaatagaaatgttttctagtttactaagagtgtctgtcaggaaatgggtattgaattttgtcaaatgcatttcatgtctaacggtattaatatatgacttttcttcattctcttaatgtggtgaattatatgatagattttttttctaatgttacccttgcattcctatggtaaatgccacttggccatgatatattatcctagtgtatttgattggttggttgattagatagatagatagatagatagatagatagatagattttattagctaatattgtgttaaagtttttttatgtatctgtgttcatcaggcatattggtctgaaaagaccaaaagaaagtaatttttttttgtactatctttgtcagatttctgtattagagatatgctaacctcatgagttgggaagttttttttttctctgctcttttttggaagagtttgtgaaaggatggaattatttcttcttgtttgatagaattcttttttttttttttggtggggagggggagacaagagtctcactctgtcgcccaggctggagtacagtggcacaatctccgctcactgcaacctccgcctcccaggttcaagcgattctcctgcctcagcctcctgagtaactggaattacaggcaccagccaccactcctggctattttaatatttttagtagagatggggtttcaacatgttggccagactggtctcgaactcctgaacttaagcgatccgcccacctcgacctcccaaagtgctaggattacaggagtgagccaccacgcctggcatagaattcattttgtaatcatccgggcttagaattttccttctatgtaagaaaatattaaggtttttaaaaaggtttgattacaaattaaatttttaaaatacgtattgcagcaggtctgtgattctcaaagtgctattattggacctgggggctgcggagaggttgggaggaggggggatcctcaggaccctttgaggaagccaatagaatcaaacattttcatagtggtactgagacatttctacttttttcactgtgttgacatttgcaccgatggtacaaaaacgatggtgggttttgtaaaactgctcgtgccttagcacagatccaggcaatggcaccaaactgtagtagaagtcactgtattcttgaccaccatagcattttcacttgaaagaaatgccagtgctacttaagagtatccttcataagcagtaatattttcttaaactcaaccctggagtgtatatctttttaatattctgtctgacaaaatgagatgtacacataaagcaattcggctgcttagtatgtaatagttgtctcaaggaaaggcatttgtgaccctgaacttgaaagagcatctatctgatagacaaactagggttatttggatttggatatttggcagttgtttcctcaaaagtaaacagtgagcctatcacttcaaagaatacaactgacagtatttgttgtcaatgataaaattacagcttttcaggaaaagtttgacttttggaaaacgtgtatccaccactgtgagtttgacatcttcctaatacttgaagatttaaatatctgtacatttcacaaagtgccattgaagtgaatagactttcttgtaaagaaataatttctccccagaaagcacctccttcatggccttatagtgtttctcatcagaagcaccactggcattttaagcagcacacattttcttaatacaagactattcctttcatttctggatatttaacaccctgacctccgccaattaaatgtcagtgacacctccacccccatcattgtgacaattgaaagcacactcacagttgcaagcacgatcaaaaagagcaggggcatccttgtacatggtagcttgtgtttggctggacttgggtggaggaggctgggaagatggaccgtggaatcaccctctatacaagtgtcacagtcctctgcatatctttatggagagtgcaacttccattgagattttgctttacatttttcagattccctccaagttccctaaaaccagtatccatttgatggaacagatattaaaccagaggaaaagtatagctcttcaatgtttattggctggaggttgcaggtatgctgcaggaagggcagttgtagagaaaaacatttcatcctgcagtgccacagtacaatatagaaagtaagataaagttctaaatggataggctattaagagaatgtagtatttagaaaaatttgcaatattgttgcctatttgctacatatgtaaaggggaaatacagcctaattcactttgaatcagatgttaagcacagaaccttcccacagctaattctcttggctctgtgtactctgttgtagaagtaaagtaaatcaattagaagatatttacggggcctgtgtacaatattatgttttagcattgagcaaggaaaaacactaaattttggagagaatgattgaacctcaaaatttttggtaggagtagaaaaaacattattagaaaaatagaattcgttgaggttcaagaatgggatggaattttgcattgaaatagaaagtatgagatgcctagaaaggaatatttagatatataaacttgggcaccagaaatcaaggaaaggccaagttatggtacacctggcctccgctgtgtcaatcattatagcattagcatactgcaaaccccaaggcttgtgctttaagtgtgagaaaccatgggctgagtgacacccactgtaactcaaagcaagcaagtttctcgtggcacttattacattacacagctgagcatttctgcccccacccagtgttgcagtgtaaaaatgcctgcctctttgctaaaagcctctacttgcttgagaaacttccttttgtgatttgtagactgggcttatgttactgaggagattaaaaacagatttcattataaaagtttatgatgttccagtccgttcaatatgtgtgcagttggaggaacacatcctttcttatccataattccttatttgatcttctcttgcccactgtcctaccctttatatatccacagacccccacctcatattcacacacctgcaaacctgtccatgatcatccccacataaaggggcctggtttggtttcagactttgatttctgatacacaagaaggcattaaagtgaatgtctcctggggatatttgttattaaaacagcttttagcaaatgaaccaatctagccagtgagatgaattctgatgtaagcttcatagttatataaatactgtaaaatctaatcactgagtctagattgctttctgtagctagcaacttctgtaaccagcaaagcaggaacgaaagcagaaccactgttgatgggctttctgaactttagtccagttgtaactaatagtttaattctggattcaaagcagcacctgccctaattggtgtggaaatctcaaggttagccagctaaagcagtttcttctttttcacctgtttctttcctttgtattcatttgttcactggatcagcccactcctgccttgaacctagatacctttcttggtggctccccctttcgttcacagctcactccgttcctttagctgagccagtagctgttgagtagttttgggtgttttatcttcagtaagcttttctcttccctcactaatgagaaaagagataataggttcctcaggctcctcctttcctaacgatgtcatcctgttttactgtcactcagcaccctgctttgtgaataatgttaacatttcactaatgtattgaagtatttatttatatttgatcagtgctcaccatgtttctccatacgtctagaagtctcttgggaaagatcatgcccttttaactgtctgataacatgcacactgaggcacttcaagaaggatcactgaagatcaaatgtcgcactcagaaaacttaatagataagctctgagctttttggtgtgttctccaagaagattaggagatggtatacaattgagcaactgaactgtgggagccaaactgtgggaggagatgagtaagggatgtgacatatcagaggtgagattatgggatagaaagccgaaagaatacagttcacggacttacccttaacgagagatttggaaatctctctaagagagttgggaaaccaaagcagaggcccgaaaagaccaggttgtgagggagggcacaggcaacagaggagcatggacttctgagcttggcaaacatttcactttgctccctccttcagtgctctgttgagtcatcaggacccaggctataaataaccctatgtggcttttaggtgaggactctggaaggtctgtgtagcctcacttcagggttcctacacctctgtcattgaaatgactttaatgacaaaggaaagaataacactgatttaaatcactatgaatacttttctcaatttaggcaccctttcatttttctaagcccccttaaccagggtttggagcaaggttgttcattatgaaagtcttatgtttcttctatgtacaattttcctgtcactgtacctaaaaaggaaaagaaatacagtgtaattaaagatggtcccaagaagaataaccaaaagtgttaaggagatggaaggactgacaagactgttctcaaaagaaatgagacctttagaaaatcatactaaaatatatttagcataaaatttaccattttaaccattttaaagtgtacaattcagtggtatttagtacatttatactgttttgcaactattagccaccatctgtctccagaactttgtcattatgccaaactgaagctctgtactcactgaaaaatgacttcctattccctaattccatagcccttgataatcaccattctactttctgtctctaaaatttgcctattccaggtacctcacataagtggcatcatataatatttgttctttcgtgactgacttatttcacttagcataatgtcttcaaggttctgtacatgtgctgcagcatatgtcagaatttcctttctctttaagcctgagtaatattgtatgtagattcatctgttgatggacatttgggttgttttcaccttttgcctattttgtacaatgctgctatgaacattggtgtacggttattagttttgatttcaattcttttctgtatatatctacaagaaaaattgctggatcatttggttattttgtgtttcactttttgaggaacccctaaagtgttttccagagtaactgtaccattttactttcccaccagcattgcacaagggttccagtttttccacatcctcagcgacccttgttatcgtcaggtattttgttttaataatagccaaatgggaatgaagtagtataaatggggtcttttctactgggaaaagtgatctgagaggggaaatgtaggaggctatagttgtaaagacttctgctaggaagtacacagacatggtcaccagaatctagaatttggagctgggtgcagtggctcacgcctgcaatccaagcactttgggaggctgaggtgggcagatcgcttgagcccaggagtttgagaccagtcagggcaacatggttaaacccccgtctctacaaaaaaaatatataaaaattagccaggcatgatggcacacacctagaatcccagcttctcaggaggctgaggtgggaggatcacctgagcatggggaggttgaggctacggtgagctgtgattgcaccactgcactccattctgggctacagattgagaccctgtctctaaataaataaataatttgggcaaggaagatagtcaaagtatttaacaaatactataacatagcataggtactgactactcaaaaaggccaccggcccttcgccttcctcaggtgtacagattgtcagcctcagtggggaccctgtgaggtaaatttggaataatgaaaaaaagtgtcttcccacaccatttatgttacccagtcatagggacataagctcaaatataaacaacttctaaaaaatatttagatatttaactgatgggtggttgagagaaaacaaattctgtgtgatgaacccttttccttttgaagttgatgttagagaaaatgatcatgcatctgttcctgccttaagttagccccccatcctgcattggaagctctctggactcttcttgtaggtcttctggcaatcacaggggaatgaaattgctatttcagttgttttacatccagctaatatttattgtacattgactgtgtgccaggccttatgatacgtgctaggaaaagaagagagtgcaaaacagaccctgtccttgtcatcatggagctacggtttagtgggggagtgagataatatcacacaagtagatttgtaattccaaactgtgcttggttccatattggaaaaatacctgagatatttctctcctttcctctagattgttcatacagccactcactctaagaaacctgcttgcttttctcttcaggagcctgcagacagggggatttgcctgggaaggagaagtagaaaacaacgtgtacagccaggctacaggggtggtcccccagcacaagtatcaccccacagcaggcagctatcagcttcaatttgccctgcagcaacttgaacaacaaaaacttcagtcccggcagctcctggaccagagtcgagcccggcaccaggtaattcaagataagtcttttccatgtgttatatcttcctgctgttggtaaaaaaaaaaaaaaaaaaaaaaaggtcagtgaatgagaaatgtaggattagttttccaaccccgtgccatcctggcttggacagctcatggggagtctactcttgaggaaaaactgttctggagccataacactggctttgcttgaaagtgatgcttaaccagtgtttgacatgtttttttttcatttgaatgcttctatacaaaaatctctattgtggtgtttaccctttctgttgtatgatcttagtttataacctcccatagggtctgattctaagatacctgaaagcttgtattttaagcatctttatttctaaatgttctactttcttgccttgatatacttggcatatgtgcgtgatattactcattatctaacaagattttcaaggaataaataagttgcaagttcttctggtgggaaatggacatatgttagcatgcaggtcatctataaatgatagctattcattcaacaaatgtttactgtgattctactgtgtactaggcactgttttaaacagtggggctataaggtgactgtacacacaaaaatccttgctgttgtgcaacttatgtgtagggagatgttgattcgctactcactgtctataaaatgccagaaactactgagtgagggagctatataagtatatagcactaatatattagtatggccccaattgtagagaaaggatgacctcaccgaaaattcaggagttaaatttttcttggtgactcaggatcatcattagaatagttactgtgttctacagtggggttattggaatgaattagtactgattctataagcttttctgacatttggttatgtgaagaaataactttttatcagtttgatctcctgatcatttttttcttataaaaatgtagtacatagtgtgtatgagtttgtgcaaaattatttactcaaagactaaagcaacatttcccaaaggttttttcctctaagtaaaacaattattattatagtctgtcttatcttttcaactaccacccataataaaatgtcattttattatttcaacatagttcatcaattgatcatctttacctgcggtagtatactctgtacattatattaattcatcataattgagaaattgtaagtgccggcatttgcaaagtagttctttagaccatttttactggagaaaaataaaatctcttaatctggaaagcatagaatatagcatctcattgtaatcacatcactttctgtcatgtaaaattttcttcatttagaaaatcttgaggtcttgaggatagtagacacatttaagccagtttgcattttcacaattccagatacaaatgtgtgtcttagttgttgttttttttttttaatctgtgttcttaaatttcttaaagctttttaaactttaaactccctgtcattcagagtacttgagaatgccaacttaatcagatactggatagtggaagtatcactgtatagcctgaagatcaaaaaactacttctcaggtccttggctcattacctgggccacagaataatgtgtgcaccaaacccccgcaacacgccatttaccttcataacaaacctgagcatgcacccctgagcctaaaatacaagtcagaaaaaaaaactctctggctctaatgaatctagacagttggtaccttttaaactatgcttcaataccttgaaatggaggatgactggggaaggagaggcagttttgttgattttcacttttagaaactgcttcatttttaagtccttctcatagttttgattagcttccagcaactcacattcctttgaaaattcaaagtactgtactactattcttgtgtggaatttcttttcactgaggattatactggtttagtttcactgaattatgaagtatatggaaattatgttttttagaatctgtcagaatatctgttttagcgaggaggcagaactcccaagaagggagttatctcgttctcctggagagcaaacagaaaatcattcatcataattgtatatatgtgtgtaacattatttcttctccccaacaccccgaacccgttcttctaaaccacagctgatttaggtaaaaatgagtaagggtgaagtttctgggactgtaggagagagctaaagtaactaaattccattagcttcaagagtttataactaataagataacaaataagatattaaatattctaacaggaagaatatgtagaaacttagagcactttattttagagggtacttagaatcattccacagtggaagcaaagccctagtagattttatacctttgtagcttagctgtgctagatctgaccattataattatcactaaattgttgattgaagcatggtttacattctcagtattctgtatttctgtcctggggttaccctttagatagcaatggtacttttccaatgaactccttgcacttggattcatttctctaaagtgtagggagccattggtataactcacagtgtggttaactgcctgtttgaaagcagtagatagaattgaaatctgatttacctagcattcatccataaaagaggcctgtttatggaatgcgatgttaaaggaggccttatatttatcttatatcatattatgtttatgaacagcatctttcacatagtaatctcctaataatgtctggggaaagttcatgcagcctttctctcattgtgtacataggaagttctccattcttttcggcctccagtcagaacacttagatatccaacttattgaaggtgttaatttctgcttaaactctgattcaggatatgagtttggaaatggacatctctcagtattcatggggaatgagctttgatcttcatctcagtatagcattgcactcataaatgtagcaattgtcatatacttaatccactcctgcaaaagactgatcctgtgacatgggagtgagagaggaaagtcacccagagccagtggcggaagttttcaggaacagagatacaagaaacttggcgtgatccagtccatatgatagagagcataataaacaaaataagacaaaattgaaacaatgagcttttacacactgatggtaaaaacagcagtttgaaaaacattgttttaagtcagagcagaggtcagcaaactttttctgtaaatagccagatagtaaatattttaggctttgcaggccatagcatctctgttgcaactactcagctctgccatggtagagtgaaaacagccataaacaatatgtaaatgaatgagtgtggcggtctttcaacaaaactttatgtacaaaaacaggcaatgggctggatttggcctataggtcctagtgtgcagacccatagactagagtaacagaaccatttgaagggcttgttaaaacaattgttcctccatcccatttctgattcattaggtttggaataacctaatgaataggcagaatcctccctttttgttttaataataatagccaccacttaagcacttgctgtgttccaagcactattcagggttctctatacacattaactcatttaaaaatgaatttcagggccgggcgtggtggcttatgcctgtaatcccagcactttgggaggccaaggcaggtggatcacaaggtcaggagttcgagaccagcctgaccaatatggtgaaaccccgtctctactaaaaatacaaaaattagccgggcgtggtggcgcatgcctataatcccagctactcaggaggctgaggtaggagaatcacttgaacccgggaggcggaggttgcagtgagccaagatcatgcccctccactgcagcctgagtgacagattgagactgtctccaaaaaaaaaaaaaaagcaaaaaaaaaatttcaggatggttgtgggaagtactgaatctcaagagttaggaatgatcaaacaaatctgttatatattgatacagcccaatgcatgtcttctaattctgtctttcttctcctgctgtcttcctgcccctgaaggagaaggcaaaagaaaacttttctttcagctgagtcggggactttcttgggtaacagtgactactggtgacatcagcatgagtagctctccatgctggggtctgtgaggagggctgcaccggctgtgaggcctgactgacctgattctaattgcagacattgagctgatgttattcttggcgcaggacagagcgattactcagtagtttctgttaaagtgatcctttgttaaacttctgctcccaacccactccctgcttccttccctcccactctcttctctgcctcatccacagtgaaaaagagccccaaaagcagaaaaattaaggacatattgatggccaacacagaattgccgaagtttcctttaacaatcatgggagaaaggagagattttaaatacatcttaattcttcactggttccggtctctttcgaaaccccttcaatttttagtagacttaattttcaacattagtaaataactcaaggtaggagaaaactgtgcgtcctaaatttctctcatccttctgccccatctgttctttacttttcccttcccaccatgtccaagtttaccaaactaatctggattcaataatcctagcagaaactaatgttcctataacaggcaggactggcagcagctcattgttcacatcaagaggtctttcagtttgctggtaacatcttgagtgcagtgtgtaacaagctttttgctaatgctgtgtgtgtatatacacaatcccacaggtgtggaaaggattcccatataaaccgaaccatgtcttgttattttgctcctaaaagttcattgcacgtgtctaaaaaaattctgcctcctcctgcaggaatgaattctgtttcgccaagccttcagctgctgtgtgtttgtgttgtggaggaggggaggggaaagaaagagaaattcagcaggcaccctgtctttttccaagcagctggcaataacatgctagctcctcagcgtggcacaaagagcaggcaaacagtctagccatgcaggaggtgtcttgatacatctttataatggcgtatcagagaggaaggttggactggggacatgagaggggaggagtgtgtgtgtgtgtgtgtgtgtgtgtgtgtgtgtgtgtgtgtgtgtgtgtttaagttccagagcatattgactccggaacttaatgtcataacctattgcttcgttgtttttttgtttggttggttcttttgttctattttattttcccacttgacttttagcaggaactcatacttagtgtctagcttttagttattattgattttcctaggaccacttgatttagtagattttgccaagccaaacttttattcttatttaatgaaaatacatagaaaatacatgaaataatactgcattcggttgttttggaaataggccactctagacaggctttggagtcagataacccacagcttaagtcttggccctgtctagtccgtgacttaagacaggttattcaaacttttaaaacctcattttccttatctctaatttgaagatgatgatatatacctgtgtattatcatgattgtagttctcaggatgtgatattgatattaccatatgtcaagcaccaaagtggccatttttttgtattatctcagtggatctttacagctgccctcttattagcctcatttcacagatgaaaaagcatagtatcagttagataactttctctgtgtcacataagtaataaatggtagaactgggatttgaacccaggtctgtcagcctgcagcatccaagctcatggctattatgctatatgctgcctcctgctgctaataaggcattcaataaacagcaactgtaagtactattacataaattctaacttgcaatgtatacattcaacaagtattttttttttttttttgcgatggagtctcactctgttgaccagtctggagtacagtggcgcaatctcagctcactgcaacgtctgcctcccgggttcaagcgattcccctgcctcagcctcctgagtagctgggactacaggcgcacaccaccacgccaggctaatttttgtatttttagtagagatggggttttcaccatagtggtgaggacggtcttgaactcctgaccttgtgatccacccaccttcgcctccaaaagtgctgggattacaggcgtgagccaccatacccagccaacaagtacttactgactccgatgaaactatgtttgaaaagttattatcaggtctcttcaccagtctcctactattcataagcaccatctcaaaagaaaagttttcctgcacttaggcctagacgtcatcccaattacctcaatcttttttttttttttttcctttttctggagaacggggtctcgctatattgcccaggcaggtcttgaactcctgggctcaagctatcctcccacctcttgcctccctgagagctgagattacaggcgtgagccaccacgcccggcctctcctcaattcttaatgaaagaaatatcttaataaggtgttcttgggcgtaacaatcttggaaatgcccatcctttaccctcccttgtacttttattaagtaatgggtttagcacctaacaacacatgcagtatcctgacgtttgttctagaggtttggatagtaggagcacttgtatgggttgttactaattcctgtgttattaataatacaggaatgatttctgtaattattattttgtcctttcaacactgttactggtaatgctattttaattttatttctatgataggtgtttttcagaagactcccaggaaacctgacaggtgtctacaaatgtgactaccacagatgacatgtttgcttaattcatattatgcttgctttggttttttttttttttttgagacggagtcttgctctgtcgcccagctggagtgcagtggctcgatctcggctcactgcaagctccgcctcccaggttcacaccattctcctgcctcagcctcccaagtagctgggactacaggcgcccgccaccacgcccagctaattttttgtatttttagtagagacagggtttcactgtgttagccaggatggtcttgatctcctgaccttgtgatctgcccaccctcggcctcccaaagtgctgggattacaggcgtgagccaccacgcccggcctatgcttgctttttcaatatcatataagtctgatcttagtgtattattacaatacagactttctttcattgtgttaacttattactgatagtagcataagtaccctggttatcatcatgttgctttctaagctgctcctaggggaatattcttctggaatcttagaggaaaatgaacacgcagtaaatgcttcctgtgcaccagatgtagtcttatctccattccactgatgaggaaatcaatgttcaaagagtttgggtaacttagccaagatcacacagctgcctgattgtggagataatatttttaccaggtcagaggacttccaaagcccctttccactctaccgtcctcccccacgacagaattgactcttcgttttctttttagtttacatacttatcagtcagataaggcattccagcattattgctgctgcactgctatatactctcgtatacacaaatctttaaaaaaaaaaaaaaagggtcagtgtaaccaattaagattcagaactcagcttggttgctgcagctgtctggtgaccagttttattctcttccctcactccgtggcctgtggtttgtttgtttgtctgtaggtatatgagggactcccagcagtaactttgtgtgagatgatgaaagacttcaatccatccatctgagatggtggcagccaggggaaaaatacttaatgaatatgtgacagtaaggtctgtataagatatgcacagtaaaccaaccatgtgagatcctgggccaaacaaaacaaattatacatttgaagacagagacaagttagatgtttataacctcaaagttgtaaaggaaacttagagattgcctttgactaattatttcattttagtaatcaggacacataagatacagacacgttaggagaacggggccctgatatacaaataatttcttataagtactaacaaataaaagttaaaacacacaattgaaaatgaagcagacctatctttatttagccagttgagctttctatctggggtcatggctgatcctttgatgttatctgtatacatactcacactttcactttaacaataagtaacaaacatttgcttacagacaataattttttttcaaactttcctttccttctcaagaaagagaatgatcttggagcaaggtgaatgaaatttgtctttatatacatctggtggaaactggacacatttctacgtttgctttagaaaagagatatgatttaaataaatttgctttagatatgtttgctttaaaagggaatcagcataacataaataagaaaggcagcatagtatagtgaggttcttaaatcatactccatgggtttgaatcccagcttactactcagtacctctgcaattatgaacaaatttcctaacattttttgtgccttggtttcttctgtaaatggtgatgatgaggagacacaggtcatatggttgggagggataaatgagataacataaagcacttaaagcaatgcctgacccatgataaaaggtcaataaaaggccgggtgtggtggctcacacccataatcccagcactatgggaggctgagatggatgaatcacctgagattgggagttcgagaccagcctgaccaccgtggagaaaccccatctctactaaaaatacaaaaaattagctgtgcgtggttgcgcatgcctgtaatcccagctactcaggaggctgaggtaggagaatcacttgaacccaggaggcggaggttgcagtgagccaagatcgtggccattgcactccagcctgggcaacaagggtgaaactccatctcaaaaaaaaaaaaaaagtcaaaagttagttgctcttataattgtgtatcaccttttttttatcatttaggtagaaaacatgtaaatgtatcctcttaacaatttttatgtatacagcacagtattgttaactatatgcatactgtaccacagatctccagaactttttttttttttttttgagacggagtctcgctctgtcccccaggctggagtgcagtggctcaatctcggctcattgcaagctccgcctcccgggttcacgccattctcctgcctcagcctcccaagtagctgggactacaggtgcccaccaccacgcccagctaatttttttgtatttttaatagagacggggtttcaccgtgttagccaggatggtctcgatcttctgacctcgtgatccgcctgccttggcctcccaaagtgctgggattacaggtgtgagccaccacgcccggccctccagaacttttttatattgcatgactgaaaccgtactcattgaacaactccctgttttcctctttcccatccagcctctgacaatcaccattctactttctgtgagtttcattacctcatgttgagtgaaatgattttgtcattagattcttttacttagcataatgtcttcaagattcatccacgttgtagcgtatgacaggattcccttcttttttaaggctgaataacatttcattgtgtgtgtatacacatatacataccatgttttctctttttttagttttttttttttagtttttttgggtactacataccacattttctttttccattcattcattgatggacatttaggttccttttacatcttggctattgtgaataatacatcaatgaacacggatgtacaaatatctcttatgtataatttttaaccgtaaatatacatggcattatgatgtcaacttgggggttttacttaaaccttccgggccagaaacagaaattgattaaaatgatattaaagaaagtgtcttaggagaagcccaaggctcattaagtattaattagcacatttttaaaactaatagttacttacttgaacaattaaatatggtatgcaaattaatttgttcataattattagagctatgagaagaataaaaagcatgattaataccatgattaaatggttattctttatttatttatttatttatttatttatttttgagacagagtttcactctattgcccaggctggggtgcagtggctcgatctgggctcactgcaacctccacctcccaggttcacaccgttctcctgcctcagcctcctgagtagctgagactataggcatgcgtcaccatgcccagctaattttttgtattatttagtagaggcggggtttcaacatgttagccaggatggtctcgatttcctgactttgtgatccacccgcctcggcctcccaaagtgctgggattacaagtgtgagccaccgcacctggcctaaatggttattctttagaataatatctgtgtagattattgacatgtttgtccaaaggcataaatatcttacaaacataaaaaggacaagaaacagcattagcatcaattgtgagctagcttttcatcgggtgcaagctgctttctcaaagtaatcaaaggaatgataagtaaatttaatcctttcagacatactgatgaaatacaaattggtacaacctttcctgagagcaatttgggaatatatgttaaaaagttttgaagcagaagaataaagagatttctgatctggctattctactttgaggaaattattttaaggaaatgatccagcatatgtgaaaaggtatagataacatgatgtttatcacaacactattcttaaaaagcaaagtaaactggtaacaacctgaatgtgtgtgtgtatatatgcgtgtgtgtgtgtgcgtgcacatgtacatatggtatttcaaaatggaactataagattttgggggtgcttttctgtttgtgacacagagaaaaaaaaagacactgggggccttttttttttttttttttgagacggagtctcactctgtcacccaggctggagtgcagtggcgtgatcttggctcactgaaagctccgcctcccgggttcacaccattctcctgcctcatcctcccaagtaactgagactacaggtgcccaccacaacgcctggctaattttttgtatttttagtagagatggggtttcaccgttttagccaggatggtctcgatctcctgacctcctgatccgcctgcctcagcctcccaaagtgctgggattacaggcgtgagccactgcgcgcggcctatattttttaactcaaaaatctattgtgggctgggcgtagtggctcacgcctgtaatcccagcattttgggaggctgaggcagacagatcacgaggtcaggagttcgacaccatcctggccaacacggtgaaaccccatctctactaaaaaaaaaaaatacaaaaattagctgcgtgtggtggcacgtgcctgtaatcccacctacttgggaggctgaggcaggagaattgcttggagtcggaggttgcagtgagccgagatcgtgccactgcactccagcctggcaacagagtgagactccatctcaaaaaaaaaaaagaaaaaaatatattgtgaacatatttacatatttccatagcttcaaatatagatgtatctcagtgtgtcaatttatagcattgatgattggtgaagtataataaaccatagtagaaaaaatgccattaaaaacagcagtctaggtctacgtttatagatagggaaaaatgctcagaataggtatttgaatgaaataaaaacaggctccaaaacatcaggtgtcatgtgattccgtgttttgtcagcacacagaaatacatgcatacatacatatagaaaataagtttgtatatgcatagaaaaacatctaaatgttaacaggttatctctgagagcagaattataaatcattttgaatgaacatttattaaagaaatttgtttcaaaaagaaaaacatcagtctgccaacctttttatgtatgtgtgtgtgatcaaacagtgctgggcattgaaggagatatgaaagaaatgtaaagcaaagcagagtctatggtcatctgagtctgaatttgcatcagaacgtcaaccagtgtctgattggttttgtggctagatgaaggtgtggctgctaataagggaaggtcacccatgtgatgtcttagggcaaggtggtttcactggcttttgtggtcatgaactgcagccctagtcttagccagctgtgtcatagctacactgtgctggtcaggtcacacactagtccaagctcagttttgagtatatgtgaatatctagttgtaattatcttcattgcttcttaaatgttggcaagtacagttaatttagggactctctgaagaatcacactgatctcaattggttagtgaacaatagtttcgaaatttttctgtccaggtaagcatctgtctttgtatcctttagagtaggtcatttgaggtagtaagaacctcctttcctactcactgaaggagggggagcttcgtaattggttttagaaatgagaggatatgttggaaggcttccgacacctttgacagctccatatcctgtctcaggtatttgtgtgcttggtctctctatatgaagaggagcaacttctggattgctgtcccattcctattggagtcgtagtactgcccagtgctttatagcagcaccagaaaagttgtactgtttctcttgctcagcacccagtcttgtcccagccgacaaacactgtgaatggaagacagccaagaactccatacagtgtgagacaaaggccttttggaagcttacttttgccaaaatagaaacagttactctcactctcaccttggctgcaaggtttttacagcatcacagggttgcataaaagtctggatgtgttctttgctctgaacagtcttggcctgattctaggaaggtgagtgattagtaacttacatgctcaagaaaatgtaccttctcaatagtttagcttccagagggaaacggacaagaaatgtctttgcatatgtcatgggaattttatccaaattgggacacaatctaatgtggggagaatactgcatagaaatgtttgcttgtcttaaattagagtacaagggtcacaaagagacattaacctactcaaatagagagtagcgtttgcctactttatcccccttcattctcaaaaaatgaatttacagaattatttcactacaaagaggcatccagctctgctccatcaccaggaagcctgagtgaaggctaaaaggagtgtttttctggaaggaattaaaaaaagaaaaaagtcctcccagaatttaatctctaaacagtattatctttctagtaagagagcccagatcttgcttccctggaaccttccaagttgcagtctgtgttctgtctatcagaaatttttccttcccacccatgagcacccttctgttgtgggagaaggagggcctttccagtcttttgcctggggccaagccaaccctcaaactgtggtttttctctgagtcttcttgctgtagtatggctgtttcccacacccagcaaagaaacaagagtcatgtatatgctgagtgtatgttgactaggtcttgagtggaggccagtgcttacacagctctctcattcccaggacattgactaatgatggtgcagctcctatgcctgtgttgttaatattgtatatcgaaacctcatgtttcttacaaattattagagagaacttcatctaattcttctgtccttttatgaatgaatatcaggacagaacaattcacatgatggagcagttcagttggtggggctgtaggattggggccagtacaggactctcagggtgcctggagaggctgatttctgctgctagtttacacacaaccatttatatgtctgcttttaacattgtctgagtgtgttcctgggtttcttcttatcaggtttgattgctttaatcccatcccacttagccttggctttggtgaaacacctggggacttgtctacattaccgactctttggagtttcagatggcatgcaattataatcatttcattatccgttcagtgtattacagtataatcaccaaaccacaagtcgcaacctagaggccttttactgtatttggaaagagtgtctgccttctgttgttgtattgaggcttaggcaagcttgaatctgtggtagattgagaattatttctagtatcagttaagattccgtttggctgcttataacagaaccctctctaccaccaatagtttaattaagttaaaagggtttttttcccacatagttagaaatctagagataggctcttgcagacttcatggtgccatcagaaacccatgctccttctgtctttattctctgcaatccttagcaaataacttttaccctatgcctatccacctcttgctagattccatgctgtaggtgggaagaagaacagggaacatgaaagggcataaggtgtgcaccagccgagtctgcccatttaaagagctttcccaaaaactgcacccagaaacttctgtttccatctcattgtccagaacatatggcatgtgttatccctaggtaaaagagaggtttagaaatgtattttctttagctgggcaaacattatgacccaaacaaagtcagagtagtaatattaagaagaaagggagaagcgattttatctaggcaagtggcagtctcctaggcagtaagttctcctaaattattttattttattgtttgaagtgaaaactaatcttatataaaacatcagtatctaaggtcctaccataaattttgcatttaggaaggtgtgaagttatttttgtttgagatctgcagaagggctgacatattttgtgtctgagtatgagttggacacaaataacacactaggcactgtttaaagtccagaaaatggtccttttacaagattacatctggatataaatacacatttgcctattttgttgtgtaggaatttagtttttgctaaaaaaaagatgaatagttgggattggtgtttttatttttaatttttaattttttccatttattaagcacctttctactagtcactgtaggggaaactaaaattaatcatatataaattcagccatttccagtgtgaatcacccagaagggagaaaaagtacacacgtaagtggctataatacatggtagaatgtactgtgatgagtcatacaaatacatttttctaagcattcagaagaggaaaagattatttctgccagagagaattgagtaaatatgatctggggagcctaaacatatgtttccgttttaagaatttgctttcacaactagtgagtgtcataagtctggaaaaatatcttgaagaaatgcataagcaactgccattcacaaaggattactgataggtggacttcgctgtcatcccatcctttagtttctcagtagaactgaggtaggtagaggtttgggaaggaatggaacatttgttgagtgcctactgtgtgcctaggtctttgctttatttcaagaaatccttattgaatgcctaggctaaggttacctacatgatgacctccaaaaatccaatgaagtaattttttttaattaagctcctcatcttctaaaggtgaagtaattttaactgcttatgagacagctctgagaagttaacttgaaaagatcacccactttgtaagtgacaaggcctacatttgagctgaggtacatttgaccgcaagccatgtcttttccatttactctgggtctctctgcctttcattgatgacctaatctgcttttctagccagtgttgaacagttaattccttctttagcccaatctaataggaatcctatacccagctggttaaaacttgggcttcacttgggtatcttgatttgtactcacagataatgtattacctgcttaaatgttactggaactagacttcttttgtcttttaaataattagtttatttttgtaataaataactatatgcacgcagtatgaaattcaaaagatacaaatgacatgtagtaaaaagttagtctccctcctgccttgacccctagctaaccaattcttctccctgaaggctaccagttttttgtgtatacttccagaattgttctgtgcagatactaggagagagagagagagagtgtgtgtacatacatatatagatatatatggtgtgtatgtattctttttaaaaaaaacaaaaataggagctcactaaactcactgttctgaacctgctgttttcactcattatttcatttgtatttacatgtttcagattttgggggaaaaaattatgaatttgaaaatatagttgtcaccgtggcaacatttattgaatagatgttcttaccaatggcagttcccttacaacattaaatatataatttaataaagaatattttgatttccaagagctcttaactaacaacattttatcccctcctctactactcacccagggaatttctttatggatggctcagtgtagaactgttcttcagccctcattctgatttttggtctcttcccatcttgaatgaggcacttcccaaacactccttacacctaacctcaattattaggatgtagtggtgaaaatagaagcctggggcagcctgttcctgtgtccctctttacttccaattgagtttctcacacagattttaaggccctcaaatatggaaacaacagctgcaaagaaagggtttgttgtagaccctgtcccagaaggctgcctcctgctggaagctttggttccttgtcctgaggaggcctgctttagcagggtcagggctccttgattctcttggaccatccggaaacctccccatgtgtacatgctcaacagtgctgccctcctggctttgcccatgaccttgcatctgtctttgttcctcttccccccgctttttttgagacagggtctagctctgtcaccgaggctggagtgcagtggtgcagtcttcaccctttgcaaccttcacctccctggctcaaaggattctcccacctcagcctcttgggtcgctgggactacaggcaggcaccaccacgtctagctaatttttgtattttttgtaaagacagagttttgccatgttgcccaggctggtttcgaactcctgagctcaggtgatccacatgtctcagcctcccaaagtgctaggattacaggcattagccaccgaacctggctttgtctttgttcctcttctgtggatcagagatggagaaaaattgtagctcttcactttctccctcaggtggtttacacaggttggggacatctcagtcagattggtctgactgaaaatgctcagaccctttacctctgaaatctctttgttctttgtcaagcatctcagtgaaacacatttactccacacaagacccctggatccccctctcatatctgcttagcctacgacctttgacacatttcctgaaaatgagacattttatgtcatgcatatagaagggttggtgaacattttactaaaattacccagttcatcttttaaatctgaaaaaataaaattcataaagggcaaaaataatactagcaaactctgtctagaagatgaatatttcctaagagcatctcatattatttcatcctgcctcaccatgagtcctttacatgttgtaggtacaaatggaaatcaattgccagaaattgttttaataaaaaatactatgtattttgtcaatgatgttatttttctcttaatattatttctcatttaaagtttttacaatgcatgttgaaagcagtattaatagtattgaaagactagtaacaaaattgagacacaaaaagaccatttctaatgagataaataagttgtaagaactttttaagcatctacttgaaggaagaatacttttacatcctaattatatatgttgacatttgtgatgtttagatggtgatttttaggtctttatttataggcttaccctctgagcaaaaatatccatttgtcgattgtattcatgtaactagcatttgtatagtaattttactttgaaagcgctttcaaatgtaaaatcttatgttaatctttaggtcaacaaagtgtttctagctagaattctaaactagccctcaagattataaccaggcctggctcatggttcctgtcgcaggaacctcatctttctgtattgctcaccatgccttagccacactgactcctccccttgcctcctgcctgcaaactttctagaggagctcagagttttggattgggcaggaatcaagtcaagctgcaagacaattttattctgtgctctatttctagtacttcacgcctcgaaagagacattcattaaaaaagtgttgaatttaacaatgatggaaactacactgagagatcagatgcttttctaattcacgcatgtggaccaacacttagtatcgcaggtgccctgattcctagcccagtgtactttcaacaagaccatttcaacaatctgcttcaaaatattccccttctctgaatctagagctgcactggcaacattagagaagtttttccttaaaaaaaaaattaacagttgtccttttctttttgccccttgacaggattacagactagttacatacagtaaatgggttgtgaaggtgatgtccatcgatcatttttttccttttttttttgtaggcaatctttggcagccagacactacctaactccaatttatggacaatgaataatggtgcaggttgtagaatttccagtgccacagctagtggccagaagccaaccactctgccacaaaaagtggtaccacctccaagttcttgcgcctccctggttcccaaacccccacccaaccacgaacaagtgctcagaagggcaacatcccagaaagcttccaagtaagtttttttctgttcaatttctactgagttttatcagttctaagctaatagtactctttatttattactcttcaagaccgttcgtactgaagtactggaaacaagaacacctgctgggaaataaaggctaaccctagttctcagcgtgggctacaaattagaatcacccagggaactactgaaacaagcagatggcagggctttaccctgtgggagggacaggccctgcagaatcagatcttttcaatttcatataaaattcaacatcctgcttccccttggtttgttcacttttaggcatttgaaaggggagatacaggattgagatttcatctaagaggataatataacttcattgacattagtcaccaagctctgtgtagcaacagtgtttttaataccttttgtagtctacctgtttacaccaaaaagacatttcctttcctgagtcaaatttttgttaagtcaaaatccttcactgtatctccagccactttttagccagtgaactagaaatagattggtgaagagcgttggttctagcagcccttcttcagtttaaacttggggaacttttagagatgtctggaagaggcacgcattgcctgctgtgtttttgtgtcgcagacatttgtgtatttctcttgctgtcattgaggcttctcattcatttgtccttcggaagatcaatattagttgtgagaagaatcctaaaacatagaaaaagtcattactgttttttcctccttggatggtaaatcaaattctggatttagatagaaaacaatcccttgtggctgttttaattatattgctgccattattcatttatccaacaaatatttattcagtgcccactaagtaccaagcgctgttctgggaagagctggcattgtaatgactgcagaactctctggagtagtaggaaagggcagtaggaaggctgcagtttgtggttgaatgccagtagcaaaataggaaatgtgtgccttctcaccctggaaatagtggagtcaaatccttaggtctgcagcctctgtagccagactgcctggattcacatcctcaggccacactttactaatatgataccttctgcaggttacaagttacttaatctcctagcctcagcttcctcatgtttccatttgtaaaaataaaacaataagagtatctacctcctaggtcagttgttaaatgttaacagagttaatatgtgtgaagtacatagagtaaggcccggcccaggtaagagctcagtaagccttggtcaccatcatatgcattctaaaaccacactctccttcacagatttggaaagcccgtagttaactaggaaaatttttgagccaaatgcgaatgttgaatttgccagtgtgccccttgtggattctctgattattgccagtaccctcagaaggcccttggtggcctgtgtggctagctggtggagaggtgggcccaggcggcagggctggacatttgaagacgctgcttgctactgccctgaactcactgctggcaggagaactctgcagcctcctgagatggaattgcagctctttggacagactttgctttgcagcatttttgtggtttcttctttgtgacaggcaagagtgtgggaaaaccggaaacagctcagcatcaaaaatgcacagaaggggggaaaaagcggagatttcttcagaatttaagtaatataatccaggtatcaaaaggcatgctgtgaggcgttgttccaggaaatagtttccaatttgcctctaaaactctaggacaagtctctgaagctaagttaatactaataaagacttgaacattctctcacttacatgtgaaatgtacagcgttttggggaccccagtgttttcagatattctcctgacttttaggaaaaagaatagcatggcttttcatctgaacagtgaaaagttccccctatgaagtatcctgataaagttaaaaaaaaaaaaacaactgggccaagtgtggtggctcacgcctgtaatcccagcactttgggaggcagaggtgggcggatcacgaggtcaggagatcgagaccatcctggccaacatggtgaaaccctgtctctactaaaaatacaaaaaaaaattagccaggcatgctggcaggcacccgagtggtaccagctactcgggaggctgaggcgggagaatggcgtgaacctgggaggcggagcttgcagtaagctgagatcacaccactgcactccagcctgggtgacagaacaagaccccgtctcaaaaaaataattaattaattaaaataaaaaaactggccaggtgcggtggctcacgcctgtaatcccagcactttgggaagccgaggcgggcagatcaagaggtcgggagatcgagaccatcctaactaacatggtgaaaccccgtctctactaaaaatacaaaaaaaattagccgtgcatgatggtgggcgcctgtagtcccagctacttgggcggctgaggcaggagaatagtgtgaacccgggaggcagagcttgcagtgagccgagatcgtaccactgcactccagcctgggtgacagagcgagatcagagagttctcacgtaccacttgcccagtgttttttccattgttaacatctgacattgccatggggcatttgaggaatgtaccataccaggaaactgtcattggcacattactatgaactaaaccccatactttatttggactgatgaagtaatttttttaatctagagaagcttttcatggctctcgaaatcaggatcctgagtatcagttgatatattctcactgttctgtagtaattcttgttcctagccagcatagcaagttactcaacatctctgtgactcagtttcctattttaaaatgggaatagtaatagtacctgcctcatagggttattaagataaatgaattgatgaatgtcaagcacaaatacagtgcctggtatgtaatacatactaaatcagtgttaggtactattatgcatttcaagaaattttcatgtaaattttttactttcttcctacaagatgtgttgcttcatttgcttggatcttactgtggcctttactccggctcagttcagattaatcaggaaccctcagttatgactggtgatactgagtcacactcaggaatgccatagtcgcctcaagagacacaactaatgagaagttgtaatgagcttttgaccatgccaagccctgtgtttttgggttgaacttcaaacttcttctagcacagaagttggcattagacaaatatagaagcaatttccaagagcatcaaagtttccacatcctagagggttgagttttgagtttagagaagaatagaacgttaaagatggaatgtcacttggattttggtgcaaagggagttgagaatcagaacagtggggtcctgtttctttatgataatactcaagttgctttccctctaaaggtttcattttaccatctgtaaaacgaaacccactgtccctactgaataattaaccaaaatgacttgttttctgtctattccattgaaagcttttttatgagcacatttgctctttaatcctgatgctttcaagccattttcctcagcccctcttgtcccagcagttctttgttgtagttctcaaattcatatacttgtatttcatttagctaaatctcatttgtcagttctgtgaagggaatgatttaaaatttttttttttaccattttcctggtgccaataatctttcttgattttcttctccaatgtttgcaacacttcataatttagtacccgcttcagatcctcctttcaaaactatttgtggtatttcttccaagcagtcagctgaactgaggacgacagcctacaaacaactacatgcatctgaactgtctcttgtaaatgagcttttttcagagccagaatcatactctccaggaaatatggagaaagaaacctgaggagattgaagtttgccaggcacaagggcaaaactcagactgaatgaatttgaaagggtggggccaaagatgttgtaacctgggagacttctctgaagaaagaaaactgtttaagaaacacagactgaactgcagtacttttccttaaatagctgagatgaccttctttaccctgggcttaggtgattctcatcagggtgacctgagtggaagttggtggtaacgactgttctgtgtcagcacccaggacagtggtgtctgttaaggctgccagggattagcagggaggaaagccatcaggactgggtagcctggtagcaccaaatcccaattaatgttacctgaacatgtggtgaggtcagccgtatgatgaaagatgtttaagagattaatgtcagaagaatatgaaaataaacaccggcttaaaaaatgttatatctttttaacatatgagtcattaaagtgagaagatttaagggcaaagtaattaggacttaataattgtccaaaagttcttgaggtgagcatagaagataccatattgtgtgttaaccatgttctgccagctttttattatgtgcagtttcaagaaacatagttgaatctataacatattcatccttaatacaggcttctctacattatgcatttccaaggtaggtaattataaaatgtttttggtagaagataaagggatggaggcatagttgtggggatatgagtacaacaaggtacgcaggtgttcagtggctgagctcaaactggaacttatatgacccgctgtgctcacctcagactcttccccctacatcactgatttcaaaggtccctgccaatctattcatctatatctgtctgtacagcaaatggcagatcaattatcctaaaatattgcttttgaagaaaatacaatgtatgcacttaggaactcactcctctctttttccataccagttttaccacttaaatgaccaggaaatactgaaaatgaaatactcaaaaggaggaagaattaatgccactcgtattagaggtgctgggggaatttcttttagatgtagcacaggaagactggattgaagaacaacatggagggcttttgtatagtgtcttctgggagagtgcattctaggaaatgaaagggaaacctggaatactgcagacaataataccctctgactctgaggggcagggcctgagggtagaaaggacatgagcgccagtcaggagctctgccacttagactctctgtcttctagtaatcctcgtcatttggacctcagtggtggcattaggaggtctctggggttgcttttggcatggacagtgacgtcagtcagagggatgggtgctacaaccacacctaatcaaaagttgcgtgatggtgtgtgtctcattggggaggaaagctacatgagagtcatggaatgatgggtcttcccttgctgattcatattggcataatttaaattaaaatccgacttctcatgcctgcctcctgggatgttaaaatggttgtcgaaatggtaatataactgctggatatttcccatccctcacttccctcgtccttcacctgagtatgaaaacgcttttttaaaagattttggcaggaatttatgctaacctctgacagaatccatccacatcagtttctccgtgaatataagcccttggcaaatttagaccttctttaaggatgagcaaatactggaatatcttggggcctggcaataggtggtatagcttaaaagaaggcttcagttgggcacagtggctcaggctgggcatggtggctcatgcctgtaatcccagtgctttgggaggccgaggcgggtgggtcatgaggtcaggagttcgagaccagcctggccaacatggtaaaagcccgtctctgctagaaatacaaaaaattagctgggcatggtggcaggtgcctgtaatcccagctactcaggaggcggaggctggagaatcgcttgaacctgggaggcagagatttgcagtgagctgagatcacaccactgcactccagcctgggcaacagagagagactgtctccgaaaaaaaaaaaagaaggcttcatggagaagattcagaggcttctaacctctggaatgagtttaagcaagaaataataacattttagaaaatacctaatgtgtattcttaacaaaatgtaagagtagagagcatctgtgtggagaactagacaaagctatcatataaaaggagcaaggggcctgcagtcagggaggattgcacagagatgagaactacgtaagtgaaaaattgggctgaacacagtgaatagaaattggccactgcagaaaattgaattcgcaaactaaaagacaaatgccaaaaatttgaggaggaagtatacaaagataaaactgatgacagaaaagacagattcaacctaaaataacaaattccagaaagagaatagaaataatagtcagtagtataggcaaaaaagacccaagataaggacataaagggattagttaataagattaaatcaatagatacataactttgtgccctacagagatcttgtggaatagttttctaaactggaacgtttcaattaagtcctcaaaaagtagaaattatacatgcctcattctcagaccactttacaataaaatgagatattaaatataaaggctgggtgcggtgcctcacacctgtaatcccagcactttggaaggccgaggcaggtggggatcaccggaggtcaggagttctagaccaaccgggccaacatggcaaaaccccgtctctaccaaaatatacaaaaattagccaggcgtggtggcatggctcctgtggtcccagctactcaggaggctgaggcatgagaatcgctcgagcctgggatgtggaggttgcagtgagccaagattgcgccactgcactccagcctgggcaacagagcgagactcttaaaaaaaaaaaaaaaaaaagaggaaggaaggaagggaagaagcgagggagggagggagggaggaggtcaggcaaagatatactcaaaggtaatctgtcaaagaaggaaggaagggagggagggagggagtcaaagatgtactcaaaggtaaattcataatcttcatcattttcattactaaaatactgaaagatgaaaaagaaattaaccaagatacaaatggtaaattggcttcaatagataaactggcttcaggtgattgcccagtgttgttttggaaagacccatgaggacttccctgagctcagcaaaaaagagtgctttgataggttagtagcatccgccacacatagggaagatgctgagagtcgtgaataggccgcatatttgtcataactgaagtaagcttttatcacatgaagttagaaaaggaaccataaaacaaagctaagaaaaacagatttaaggaaattaagaagaaaagtaatataaagtgaaaagcaagcagtaaaattagttaagttcaaaaccttatttagtttgggtcaggggaacccagaagaagaaaataaacatacttctgccagaagaataagagcagtaaacataagaaaaatactttaaaagtagatatagaagagactgaaaaattaggagaacacggcacactatgtacaattttaaaaactagatgaaagataatattttgaaaaatatcaagtataaattggttcttcttgaagaaaaagaagatttaactagaacatagaacaagtggaaattttcaaactgcctaaattggttcttcttaaacacatgagtaggcccaggaaccatttttaaaaatcgtctccaaaatagttcttcaaactatttttctgaaatcttttttgtttttgtttttgtttttttgagatggagtctcgccgtgtcacccaggctggagtgcagtggcgcgatcttggctcactgcagcctctgtctcccaggttcaagcgatactcctgcctcagcctccagagtagctgggactacaggcatgcaccaccaagcccagctaattttttgtatttttagtagagacggggtttcaccgtgttgcccagggtggtcttgatctcctgacctcatgacctgcccacctcagcctcccaaagtgctgggattacaggcgtgagccgctgcacctggcccatttttctgaaatctttggaggcttccaggtgcgcacaagataaagttgagagtcctgactctgacattcaagccttctgcaatatgacctctctcctgtctcctgccttcttcatactctatcaccgctttgcacacagactgttccacacacatgcttcccattctttgttcctacatatccatgtcatctctgcagagtgcccttaggcctcttgaacctaagtcctgcctttaattcaagattgggttttagtgtctcaccttggtgcatccttcccagctgccccttcgtcacctcctcatctgactctgccatctacctcctggttttatttttccttttttcatatgttctgctttctatagctctctcaaagacagataccctgtcttcaccctttcatcacatatatattgaatgtctgttttgctcaacattgccctagacagcagtgtccaatggtgataacaccagtggacaagacagatcagatctctgcttgcatggtttgtttttgagagaagggataaactcattcccagtgcctgagatagcttatattcgtaagttctcagcaaatggcagtggtgatggtggagatggaagtggtggagatagtgatggcagtggtggtggtgacatggtattctgtgtcaagtcatatgcatcaaagatcagtaaataacaatgatctcattatttatgccttgtagagtagcgtatgggagacagtagagtacagttgttaatagcctggaatttgaaatgggattcggattctggttccttggcttaactaacttttctagagatagcactaagcttctgtttcattatctataaaatatcacttatgtcttggagttgttcatagggttaaatgagataatgtgtttccctgacatatattgcatccaatgtctgctggtcagcgtagttgtattctgcagctgctcttgtttcctactaaaagaaatcacatttgttttgttggtaggttgttatttataagtgtgatttggttctgctggtgagcctgtggaaatttaaacatattctgatttcctcaacactaataactctaaaggcaattgaagacaaaggctcagtttcaaacaaaagaaaaaattagatttggagttactgacttccaggccagttggctcccaaagttcacactttcacatccatttcccccctgtgctgcaaatacatagctatgatggatgaacatttaaagaagaaaacctacgggacttagctgtgcttcaaaacaaggcacatatctccttggccccaaaatataccaaaataaacgagaatcaatgaatgaagctgaagctacaggctttctgaagcaggcagtggcaagctcctgtgtcatattgggagctgaaagtgccctacaagaggagaacctaaagccacgctcattacttgaaaataattgattttcaacctgggacagtttcccccccaggagacatttggcaatatctggagacatttatacttgtcataactgggggagtgcgactggcatctagtgggtagactctacagatcctgctgagcatcctgcaaagcgcagaacagtccctcactacaaagaattatccagcccaacatgtcagtagtggcaaggttgaaaaccctgcactgaaggatgcagtgtgccctcctaatgggagagtagtaaaactggcatgaaccgactaactgagtctgtctttatatgagactatgggccttacagagtcaggaaggcaatgacatacccttccaactgttcctgtctcaaaactgcctttggtttctaaatatcactgaggcaagtgccccaaaatgccaccataatgcctggtttggggctggtgtcaggggtctgggtgaaggcaactatataatcttcagacacggaggaatgagcaagcacagagaccagggcggggaatgattcccattcaaaataagcccgcaaaccaaaattccaaaacacatgaaaaaatctaattctaagaaagattgccaggaaaatcaagaactggaacgtgaattctttacagataaattaatactttaaaacagtcagacatgttagatcatgtgtctaataggagtatctcgtggaacatgatatgtgactctgataggagtatcacaaaaaagacctaaaggataattggacaagcaacgcttttagaaaatgacagaattttccagaattgaagaagacatgagtcctcagctaaaaaattcattcatgtaccaaaataaatgtacctctagacacatcatagtagcaagaaaccagaacattaagcgtagagagaagtctaaatattaccagggagaaaatctgcgtaaatgacaaaggaacacagagtaccagcattcttctcctcagcaataatgagtgctagaaaacagtagccaattacttcgaagtgttgataataaactttcagtctagaattttatacatagctaaactggcattcaagagtgaaggcggctgggcacagtggctcacgcctgtaatcccagcactttgggaggccgaggtgggcggatcacgaggtcaggagatcgagaccatcctggctaacacgttgaaaccccatctctactaaaaatacaaaaaattagctgggcggggtgacgcacgcctgtaatcccagccactcaggatgctgaggcaggagaattgcttgaacctgggaggcataggttacagggagccaagatcgtgccactgcactccagcgtgggcaacagagcgagactccatctcaaaaaaaaaaaaaaaaaaaaaaatagtgaaggcaaaataatttgagacattcaaagtctaagagtatacctgaaattcaaactaggaaatagtaaagactgtatagagatagaagtgaatccagaagtattaggcaacaagaaacaatgaaatacaacaaatccgtaaaatgtcaataaatgttaatgactataaaataattattggtctttaagaagatgaaaaccatttagagataacaaagataagatacagggacctagagtatttaactgataagggtccgtgtcgactttgaggtcaggacagaaatactgaatgactttacacttaggaaaaaatagctaaataattaagatgcaggctgtagtgttcaaaccaatagagcagggaaagggaaatgtagatactttattaattcagtggaagataggaaagttagaagcaaaggaggctgggcgcagtggctcatgcctgtaatcctagcactttgggaggccaagacaggtggatcacctgaggttaggggttcgaaaccagcctggccaacatggtgaatccccatctctactaaaaatacaaaaaattagctgggcgttatggcgcatgcctgtaatcccagctactcgggaggctgaggcaggagaatctcttgaacccaggaggctgaggttgcagtgagccgagatcacacgccactgcacttcagcctgggcgacagagcaagactctgtctcaaaaaaaagcaaaagaaaaggatgataaatagaaaacaaaaactaagatagtagaaatgagtccaaatatacaagtaaccaaaataaatgttgacaaattaaactcttccattaaaaaagagatgatcaaattgcatctttttaaaaacttaagttattggctacatgaaagagacatacataaagtaaaatatcaacaaaagatagacaataaaaggttggaaaagagcaattatgaaatactaatcagaaggaaaactggtatagcaatattaatgccagataaaatatagcaaaaatcactaaggaataaagaaaagcacttgtatgcacttaacatcataaacttaaaaatatagaaaccaaaagctgacaaaattataaggagaaacttgcaaatcattaatattagtgggtaatttatttgaatatacttctgtcagtaacaactcaaaaattactgaagacttgaatatttgaaatgcagaattaacattttgctttaataagtgggttttcatctttttggaccagcacttaaaatagaaaatacattttaggggcacatgttctcaggacttcctgaggggtatgtcatgggcgaaatgatctaaaaaaagaaaaaacattttatatgcaacccagcaaaaatacttatctatatgtatgtgtgtatgtgcaattaaaatttcactaaatactgtcttctattttttaacgctgattctgagccctgaaattcattttacaacccaattatgaatcacagctcacagcctgaaaagcagttacagctatgcatggactcctgcactcaatggtattcgagtatatgtggaatgtttataaaaattcagcacatactatgtcacaaatgaaggctccgtgcacttcaaaatatcaatatcaaacggttcacactcttcaaccacaaagcacttaagttagaaataataaaaagaggtttttttttaaaaaaaatccatgtgttggaaattttaaaaaaatagagtacctattactcatgcattaaagagataatcataatgaaaattataaaatattttaaactgtatggctctaaaagtactacacatcagatttgtggaataaccaaaactgcactcaaaaataaactcttaatacatttatttaaaagacaagaaggattaaaaataagtgagttaattgtttaattcgaaaagctatgaaaggacaacagagtaaactaattaaaatatagaaaggaaaaaaatacagaaatctacaacagtcaggtgcatggcagaacattagagaacagtgcttccaactgtatctggcatgtggtagggggtcattaaatacttgttgaaggaacgaatgaaattgacaagtactgggatggcctctggaaagactaatgaataaaaagagaaaagggcctactcaggaatgaagaggactataaccagaaatacgggggaatagataatatgcagtatatttataaaatggagtcctgagtgcctttactgcacaaaagttgacttcactaaatgtttcatgatttggttttggaacctgaccctaattaataatgttctaattgttattttctaaggattagcattaacttccatttcagaatcataaaccctagactgagagataaaaggaagaagcagcgtatacctgtgtgtgtgtggatatgtcgaaaattgtaggctacttactatgagtaaatgtttggtaggaaaagtcagggtatgtattttttgttttgttttgtttcttttttcttgggaattgaaagaggttggttattgctgtattttataaaaacgatcaggtttgggggtgtttgttttcagcaccttcacagatgcagccatgtctgttttgccacagccctggtaagatcagcatttgtagctttgctcttcctgtaaaatcttgagcattttccttttgtgagtccttccttctacagaaaggtcatctctgatgtggtggcatgagtccaagataaacttatactaaaccattgaaatagaaaactagtacccctgtgttggggatgtggaaagccttgaaaagaacccaaacagaaataatatagcagcaaaccacagtcaaccttgtgaagtaatgaacaaaacagaccttaaagaaagcatatcgctttcagaaaagtttccactgatcaaaataatgggcaaaagaagaacagaggaaaccacaaataaagaaatgaagatccacgaaaaacatgtcagaaaccttaccagcaaaagggatggtggggctattgctcattataaccctcctggactgggttttatgtataaatatatgttatatagttatataggctggctatatggtgtggtcttgatgccagtggaattcctagccagccagttgattggcttatattccttaaatagagacttgtactagaaaaaatttttcaaaataattaatacaggatgtaatatccctataagatgaaatacaggcatttcatcttacaaggatattatttgtttttaatgcatctttgaacaacttctttgaaaggcacaggagagctgttccctcagagtaggaataatgctcatttgaggtgctttctcagacctcagaaaaatggcagaggcaagatgagtagatagatgtgaagcaagtgagtcaaattcagggttaggaagtgtacatgtaatatttaggtaaactctttagctgccagctgtgaacatgtcccaaggaaagagattttgccttcatagagaggagcatgcgactgttcattgagttcttcgaattctttgttgctactatatgtggtcatgtgtcttattatagtttttaagtggctaaattaatcaggcagtgtgctcttaagcagtttttattttattttatttttatttattcatttatttatttattttttgagatgggagtttcactcttgtcacccaggctggagtgtgatggcgcaatcttggctcactgcaacctctgcctcctgggttcaggtgattctcctgcctcagcctcccaagtagctggttttacaggcatgagccaccacgcctggctagttttgtatttttagtagagatggggtttcaccatgttggccaggctggtctcaaactcctgacttcaggtcttcctgcctcagcctcccaaagtgctaggattacaggtgtgagccaccgcacctggcttaagcagtttttaataatcattgacagtttatcctcagagaagaacctaaataagaccattaccagagctgagattgtagtaagcttcttactctcaacctttcactacatcaagcagctttccatctcctagacagttgtaccatttccaagaagaacaattaaggactagatattcacatctatcactcttctcatgtttgaactctaacttttgtgtagtgtaaagttaatggcaccttttgtcccatcttttcagtatttctcactgtcaagctcttgatacttctataactccagtttttctaacttcatctttagccacttctttatattctggtgtactatgaccagagaacatcagataatggaactgtatcacacacatatttaactttatacattcagctattcagagagaaattgattgtaatttcaacaaagtggctgattccaattgattttacacttaggataagatgggagaaatatcactccagtcagtcagtttcagttcccgtgggactttcttatagcaagggcatcccactgcactcttattctcacgcttaaagatacatattttaggccaggtgcagtggcttatatctatagtccccgcactttgggaggccaaggcaggcagaccgtgtgaacccaggggtttgagagcagcctgggtgacatggcaaaactctgtctccacaaaaaatacaaaaattagccagacctggtaccacacgcctgtagtcccagccacttgggaggctaagataggaggatcacctgagcccaggaagttgaggctgcagtgagctgtgattgtgccactacactccagcctgggtgacagagtaagaccctgtctcaaaaaagtaaaaataaaaatacatagtttatacaacatgatcccataatacaagcctacttttctaaatacaaacctacttcatttggtgcacagttgaataaatcattctgacactggcagaaaaatacatattagatttattaagagataacctgtcaatctcaaatgtggcgtctcttcctaagggatcttaagaataatttttactatgagatttttgtcttataggctgccagttaattaccttgtaactttaatagcaaattgctgttaacttccaggttcagaatgcctatggccattcttctgtagtttagcactaatatttcagactgatgttggagtcaatgagtcattcaatttgatatttctgtatgtagatagacttatagtgaatgcagagagtgttaagcagtattgctaagtaaaaaatgacaatactactactagtaatagttcatgtatatttagtccataatataacaccagtcactgcttagatgtgctttatattcaccatcttacgtagtcttcaaaagcctataaggtaggtcttgttatccaggtgttaaaccatagtaactgacttaaagacaaccaagggaacacatacatacctcccaacgtaaatatttcctaaaacacatgtattcctaggaaagcagcaaagaatcattgcaggggcaagtgcaagttgacatgcaggctctagacaagctgagtttcaaaagttctcatttaggggaaggttgtccagaagttggaatatattttcccaaggaaatgatgttatcacaacaaaagcatatttacccataatgtgcctaaagtagtaataacagacctaaaccattttgtgtaccagtgtttccatggaaaaattcactcaaaagtttccccttggattgctgtggacacatttctacatcacagggagaatggggactctatgctagaagcagtagaatcattagaagtgttcaaattctgaatctgtggtggtctccaaggcctttgatgggagttgatgggagggaagaggatggaagagtgagtgaaactgggaaccagggaccatagggttagaggatcttcagtaaagaacgggataaagcctaagaaggtgaagggtggattgggggttccagagaggagagggaaaagtttcaagagttttaaagacccagaattcattgagtctaagcccccagggactcttctcatccctcaagcagttttctattattcactaccagtttctactactgacccaaagattttgccggcttcttccctttttttttttttttttttaaaccactaatactttgtgaaattgagaccagcccagggctttgctccactcagctgctcctaaagcaagcacagtggctctaatggtttttaacttctgtaaaggaaagagcttatcttaggccctccagaactttttcacttggacatggaagagcaaacatcatctacagatgctttgggagagtttttgggtcccataaggggctgaaataaaatgcgtgaggatttccgatgtggctgtccaaggccgaggctgatgggaaaagggagaagctctctgcccctttctctcctgcctctgtggctcccttgtcctcaaaatgaaagtggaaaggagagggtaggccccaaattgcttgccagaggggaggggctatgagacagtctgatccttgcgccaatgctgggctagaatcttctcaagcggcatgtctctttcagggttgtagggactgtgtgggcacctcagacaccacctgactctccaggtgcacctcataccactttgctctttacctactagccaatgatgatatgaatcacctgggcacctggggcactgtccccaggctcacctggaaagctgtgtgattaacaagtgaccccaggtcattcctgtcaaagacattcagcaaacactgcctgactgtccccacccctatcctatctccttagctggtctttaaaggttcctgggacattccaagcccctttctgcctcagagtcattatatatgcaatttcctcgtgaaacgctctttcctctccctcctcctggctaatgcctacctctcctaacttcatgactcccttgaaattatttccacagaaagaccatccttgaccactgttctcatcatctaaaccaggttcccctgcctcgttctcataacactgtgtgctttttctctttagcatttagcacacactttgtgttttatgtacgtgctttaacgtatctcctcactagtacagaacacaggaaatgcttgataaatatttcttgtgtgaatgactgactggaaaaatagtgtcgggagagagatactaaaggttgggttggatgttgctcaacaaaaacaaagaactgagcatgttgaaagctttgatctctcaggtacaacttttacacatcaactaaaatcaaggcagatagacccaacaaaaatattatattataaatatacaacaaaaatattacaaatatttcaaaaaaatttataaatatttgatgtgtgcaaaatgcagcagcagtgaataagaccaatacaatctctgtcattatggagcttacattctagcaagggtgatggatactaagcaaccagttacacagtttcataattataattttgaaaaatgcaaagaaggaattagagctgtaagcgcctttaacagggaggcttgacttgggctgtagggcatcagactagtcctaggatttctgagacatatggctagggaacctctgcccaaagaatcagatatactctgtcatatctcttgtcaaagttggcatgaggggagatgctgtgtacatttctcagtcttgcgattattgacaccatggagtagataattctttgtttggggcattttcctgtgtgctgtggaatgcgtagcagtattcctggcctctgcctgctagctgccagtagcaccccacagttgtgataaccacagatgttttgacattgttgggtgtccctggttggctcaggggacacataatctctccttccccacttccccagttgaaaaccactcttccacatgagacttgcttttttaaaaatgtgttttcatatgatttaggtaagtcaatgccagaaatataattttttccttcaataaacaactatttattgagtacttgttatgtgtcaggcactattctaggcactggagacacagcaatgatgaaggcccatgctttcttgatactacatttcagtagggagaaattaacaataaatctcaaaatatatactatttcagaagtgtggaggtttgtcatagagtcttctctgataaggtgacatttgaacaaagccttgaaggaagtgagtgaatgagccacaggagaagcagcaccaagagcaagaagcgaagccatcagaggtcctgcacctgacctcacctttccgcctgcaggtctgaccaagctcctttgtgtttcagagggtcctccgcggaagggcagctgaatggactccagagcagccttaaccctgcagcctttgtgcccatcaccagctctacaggttagtgggcaccagctcttctgcaactggatagatgacagggaaggtgttgggcttggcacattctctcttctgcctccaaagagagccccagttcaaagaatgaaacatctagcctctcaaaacattggcaaatgggcatttttgttgcattcttctttaaaatagtcttggcagcctaaaataggcattttctggaactagcttggggtaaatgaaacctcgccatcttataaaatgctgtcagatttgcagcatttaatacagatgtcccatattgactggtatttcactgtctatgttgtatttccgcatgttgtatctctcacttaattctcacacagccctgtgagtttgatcttatcccctccacatgaggaaacaggctcagaaagttgagggcttgttgaagtttatgcgtggatgcagagctggagctctggtctttgatctacgtgttgtgctaatgccatggtctgtggacaggttgttactgacagcctgaagcctctcagtgtaggtgcatacagataagttaggcagtgttggtccagagatagtttctatgaataataattaataaaaatgaactattaagtcagaaaattgaacaaatatttattattgagtacctactctagagaaaataacatgctgggcactgagatacacaccgggtgaacaagacagtctgctcttagggaactttaaaggagatagaaaagtcagcagggaatgtgctgcaaagtgggtattattgcatgcctgagacacatagaataacaacagactacattgactgaggatttgctatgtgtcaggcacagttctgaatgctttatgtgtaataactcacttgttcactgaacaggcacataatgtaggaactatattccccatttatggctgaagaaataaaggcacaggcagattatcaaacttgtctgaagtctcacaactagtaagcagtggggcatatttgaacctaagcagtcgagcccagatctctagggactgggaacggcttcctagaggaaaaacatcgaagctgacactggagtgtggacgagtcagccaggagaggaaaggcacaggtggaaggagttctaggaagagggaacagtgcaagcaaagaccggggggaagtgaaaacgtgctgtgttccacaggcttccatggatcagtgtggctggggactggggcatgagcagggagtggaaggggaaaaggttgtgaggtagtagggccattttatgagccatgtagggaacttggtcattgccctgacagcaataaggagccatcgaggagttttaagcaggagggggctgggtggctaggggtcagggattgacataatacaccttaaaatgattacaagatctctgagaagctcaggccaggtacagtggctcatgcctataatcgcaatgctttggaaagacgaggcaggaggatctcttgagaccagcctgggcaacaaagtgagaccctatctctacaaaaaaaaaaagtttttaattagccaggtgtggtgtgacatgccgctagtcctagctactcaagaggctgaggtgggaggatcacttgagcccaggaattcaaggctgcagtgagttgtgatcctgccactgtactctggcctgggtgacagggcaagaccctacctctaatttaaaaaaaaaaaaaaaagccagttacttgactacatcctggggataattatatgtatctcataaggcttatagtaaggattaaatgaagcaatatatagggaaggcgctataactactgtaactacacccgggccactactacctcataaccttttctctttccactccctgctcatgccccagttcccagccacactgatccatggaagtatgataggagtataaggatgtgttctccactgaacattttagaacctgaattcaagaaatacttgatgggtatctattcacctcactcctccaaaaaaaaaaaaaaggaaagaaaaaaagaattactagaacatggtagttaactatatttttaagaaagtaaaccttcacctgggattgttatgaactgcgaagtaatggcacaagggaatcatggccaagtgtgaaggatttctgtgagataccctatgagaacccctttggctcttcaagtttgcttctgctggagaagttcacaaacccaaggagttccctgactatacttcatttgcgtgtctgattgataaattaagtgttgaattgaactttgcatgcactccagctgagccagttggaaacttgggtggtcaggtgggtcatacttgcagcatcttgaccgtgaattactgtttactgactcttggtaacgttatttagaagattttgtggcactcatactgaacttggtgtcagtatgaaaccacagagcaagaagaagaagttgtatttcttcctggcttctcatagtgacctttccctgctaattctactttatggtaacaagcagatcattcttcttcattgtttaggtagtttattacttactgcttttgtcaccaataggctctgggcctctgaacttttcgaatttgtttctactctgatttttctggtgttcctgatcgttagttaaagaaacactgaggtgcatgatatagtaagcttcaggcattttctatacttcccaatgaacattttaccttcacagcattagtaactaaatctgttacagttatttgtacaactagtaagtaactgccaggcacaccaacatttgaactgaaaatcatttgctttctgtattacaagtagatttaaagcagttctatcctaggggttcagaaggatatcctacaaaaaggagattaggttcctagtagcaacatttttctgtaaacccacaagaaagaagaacaactctcataataagtctaaaagtttacacctctccctgagacctgggaagcgtgtgcctatgtaggaatccctaaaccatctttgaaaggtatttagcccatctggtccagttaattcaatccgttaaacatgatattgagtccaagactatagcagaagtctgttttctagttccttaattcttcctgtaagtcttgcctgccaggctttcggctgtgtgactgttctctcgcagtctgaatgagatagtgattcgtcccagggcactgttgaaaaacaactcagagtcctttcctatagatggtggcttaatggcattcttggtattatgaacattaaatgagatagtgaattgaaagctcttagcagagtacctggagtactccatgaatgtggtttttccttgacttaccaacctcaggctttatattagtagtttgctgtggaagggaagttttagagtcagcaaatttggaaacttgagaaggaagctggagtgagagctcttggcccaaagccaaagtcgttggccttccttctttataactgtggtgttcttcttgagttctgaggtggtgatggtaaactaaaatagcagagagcaacagattagataactgacatttctctcatgctgatttgataatgtaaactaccattactgtaggagtctgaagccgcagcagctgccctcatccctgccccttagcttctgcctaagcctttcctgttctggagcccaacctctccctccttttatttttaagctcttagtagtctgcaattggtggaagggaccttaccacctttagaaaatcaatgatggatttcatgtgcaagcagtgagcagtgtccttattaaatgttcgttgtttctggccctagtaaaatgtactatagctttgtgctttttggatggggatggggcaacagcacatcagtgtgactctgactgcccacttcgttgggtccctgagacaacaagagaaaggaacattactatatagtaaaccctgtggagccaaaaccctaaggatctagatgtcactttaactttcaagcaaaattacttgcctggcagctctcaacagaatggcctattttcatgatcagattcttactcttttcaccacgtgttgtatagtttttggagctcctgggtggatctggagtacagtcacataaaacccctgattgctccccagattttctttccagagccagaggggtaagaatttgggttgatcacccacttttacgctgttcaaaagcaaaagagagactgtgaattggaatttgacaggaagtggggtggcgttatctgggggaacggtgatccccttaacctagtttcagattttaccttgtgtcctttgggccaaaatcaaatgtagtgttaagtagagatacttttttccatttttcaggatctttggatactccccaagttattttcgccacatccaaacccttgcccacacaatctgaagcccttgctacagttataggacagagaaaatcaaagtcggtgaagtcagggccaatttaaggtaacggtaagaataagagcatatttttatcattttcacttgctgactttatactacagcaagagacttagtggctaccaaaagaagttctagcttctcaaaatgacagtgaagttggggctttataaaccaaaacttagaaggatgctcccaaactgggtcaaagttgagctccaaatagtttgctcctataatggtctaccagtaggtggcgctgtggcagtaagaactttctctactattactagaggcttttgtttaaaaatacgaggattttaagacaattcaaataaagaaactaaaaccataattgagttatcacaaagtataacataatatatgggaaaacatgatatttgaaggtaaagttgcagtagttgcaaaagagaatggatatttattattaaggcttttagactagaatttataaactggactttcagattatgggaggcagggagggaacaaattttttttcaaattttggtgaggttgatgaattgtgtttttgctgagttacttaaataaacatatgctataattagcagcaaaacaaactgtaaacctcatcctccatccaaccaaaaaaagctcatacaccgaaggcatggtctaacttgattttgtgaagctgtttccacacttcaccagcactgccgtcagtattttgttcccagccatggccttcaaaattttccagaaaattctgcgaaacttcaaggctttgataattcctttcctctttgttctgccctacacactgatgcattaacggcacacctgccatgaggctaatactcttcttacctctgggggaatatttataaacttatttgagaaacgttattcatcagaataccccaggagtgcaaaagagagaggaaaattatttacccaccacaggattcatttacattggatcagcaagcttcaaatatctttccctagcccatctaaactcttcccagaaaggaatgagaagagagaagggaacaccaaatccatggcttggtcatataccaaaatttactggagaaactgaaaacaaccagagttcttttggtaattcttagccaatggccctttaattctgatactaagcagcctgtccaatgatgaacaactaataaaatatagaagactaaagcaagaaggtcagtatttcccttaggagactggcagccagaagaacaaatgtgacaccaagctccaaactaaactgatggcctgccaagaagtactcatgtccatctgcttctaggactgtgatacttggacctgccacagttataatatcactttccttgaacctcattcattagtatcctttacaatccaccctgaacattacatggcaaaatgggaccatcagcaaaagaagccttgggaaagagcccatttctcaacattttgatctctgttgcagatacagccatgctgagcctgagctgtgtataagcgagggatgactgatgctgtgctttgtgattagctgaggcgatgagacagcatgtgtgtatggacaaagaggacagagtggatcagagggtctcagaagtccagctcctatgacacgactgtcactgctgggaagctgcagagtcaggcccaccagcctggcatgtggccgatggcagtgggctgcatctcttgagcagaagaattaggttgtttacaaagtgaggaggcagaaccccacaggcctcagccctcacctgaagcatgctttctttttattgcaaatgcagtgcaggcagcagaggtcccttcaaccataatcacgaacgaatgtcatcaccggccatgacagtcctagaacctcttcatatgtgggtttagagaggcagtcaggttagagaatttgagttgtgtttgcattacatgttttataaaactgagaaaaacgtcagttgtccttatcagagtggagggagctgtgctgaaggatattaggagcaaagcctgtgtatgacccctgtatgctgcccagggcaagtgtcatatttaaatacctacattgttctttgttttcttagattctgtatttgtctgttcatcagagggctaattatattaactatattttcttattttctgtatgtatatatatatttttttagacagggtcttgctctgttgcacaagctggagtgcagtggtgtgatcacggctcactgcaacctccgcctcctgggatcaagcgatcctcccacctcagcctcctgagtagctgtgactacaggcatgtgccacaatgcacagctaatttttcatatttttagtagagatggggttttgccatattgcccaggctggtctcgaacccctaagctcaagcaatccacctgccttggcctcccaaagtgctggtattacaggcgtgaaccaccacacctggccattttctgtattcttagtgccctggcatttgggatccttgcaggcccaggcgagagagtgcctttcacagggctagttaattcctaaacgtagtaacaacttgtccatgagcacatcttttatatgcaaaccaaccagtcctgagtatctacacccaacctccttatcaaactttcacacaccaacccaaaatttcccctgccctaaaatcgtctcagggccaggtaccaggcaactagataccatccctataccctgaagccccctggaattatctaaactagccaatccagccaatccaaagctgtttaattgccctgccttgcctttcctatggaagccccagcaaaggttctgacctaggcttttccccccactgctgtcttctgcctccagactgacactggtgcattcactgtgaccctgcttagtgtgcagtgaccccctctctgggagctgtcagaataaacgataccttccttcggagccttgtttttgttttcctcctgtggccacaccaactttgacataccgtatccaacatgtacattcttagaacaaacattaagaggataaatatctttaacttgcgatacaaggaaccaggaagaaccatgaattaggtttacatcacccagttctaagcaactgggcatagcacttcatccgtagcctgtgttacacaagtgatgttttaacagtatgtgttttgctggcattgacctggctgtagccacacaagaaggatgtggatccctctacatggcagaatcacctggctgtcagccattgaagtgcatgcgttcctgtcctgaggcctcttgcatttcatttagtaactgtttctacattcagaaacaaaacccaagtatagctgaacaacctggttggaagtgaggaagaagacagcctggcttttagtttgggggagagaataggggtacttctaagaatctatccaaaaggggttcattggccttgaagaaaaccagagaactccatttctaaaatggattaagagataggctatggaggaagataacatctgaaaattgatatttttttcttgctgaactggcaaaatcccaagagaggagtgatgattcttcagttattaacaattactactttgttataaagagacacgggaagtacagtggcccctttctcaaattacacttacattacagaagcacacacacctcttggaaaaaaatgcctggcagcctggattgttagaattgtgcctactcctacatcttgctgcagagttgtgtggtcctgtgtaatatccatgcactttggacagaagacgatctagtctattcttgcagtcctgaactgggcaagtaaccagcataaggctgcccttctttctgtctttatatatatcactccaggttatcgatctgttcactgtggttatccatcctgtgaacccacacatcttatagccacatacctttgctttattgtcctcatatcctcagggcataattgctcctgaaagttctaaagaaagaaaatgacatgctaagccacgcctgtctttggaaaaagcaagctttccacacggaaatatttacacctctgcttacctgatctgtagagtttgaaccaggtcccaaaaagtgtaggtagataatagcagggcttggagaatgatgacttgaagtgtattgccctgttggcatgatttgtattgatttttatcctgtattctttcaaattgtgattataaagaaaaagactcagattctcttaagtcctcaaaatgaagagcattactaaaactaaaacagtagtctcttatacttctttgttctcgtcttttgaacatgcaggtatttccagtttgcaccatagatgtcaaggggctcccttctcttaaaacttgaatgcagggtttttttgttgttggggggtgggtggttggttgcttttgtttttgtttttgtttttttgagtcagagtctcgctctgtcacccagccagactggagtgcagcggcatgatctcagctcactgcaacttccgcctcccaggtccaaacaactctcgagccttcgcctcccgagtagctgggattaccggcatgcgccaccatgcatggctaatttttttttttaatttttagtagagacagtgtttcaccatgttggcccggctggcctcgaactcctgacctcaagcgatttgcccaccttggcctcccaaagtgctaggattacaggcatgagccaccgcgcccagtctggttatgcagttagttgataccagagaggagtagcttgaatgtgtggacttgccttcgctataataaaacatagcctctatccccattataaaatggggaaagaagttagaaaaccaacctgattttaagatgatgaggtgaagaaaaagcagctgcttagaagttgctgtatgtatcatttagttgtttggtgttggttagaagaatcactcttattttaatatctaatgaactgaaaagtgagagtgaggtattttccttccctttttatttatttgtaatttgattcccagggaaattaagacttgtgacaagcccaaatgaagatattttggaatttgacaggagagttttttaacttatgcctaagcttcaaattatattaggcaataaattattgatagtttttaatcagatactggaatatggaattttcaaaatcacaactcagaaaaatgaccgctcacaggccttctgttttatatttattcttcctttttagtattctccaaaattaatcatcatcgtacatgtgtacatttattcttattattaccacaagagccttctgatgatcgagaggagagagaccctcagttcacctctggaagggaagttgttgtacatgagcacagggaggaatcagtctcaagagccagacctcctgaaaacctgcagcgttgctgagagaatcagcagctttactggctgaacagcagctcgggttagcccatcccgtggccaggtcatttgctggctcctccgcagccagcttccattgttgtctaggctgacagctccgccctactcatgacgtgactctctctatgggattgtttctctccttttttttttttacattcagttttcagaagacagaatggaatacttctcattcattcctccagcaaagtgcccctggtgggcagagctctctctcccaggccttaactggcctaaataaagtgggtggcagctgccttccagacagatgccagcctggtactagggtagtatgattgtgtgatacaaagctgccaatgtatgcatgtctgaccattttttcagatgggattgtagctaggcaggtacagcatagccttttcatgtccagcatagggtcttaaaatataaaaccacatgcaataaaataacaaggtataaagggaaagtcagggccaaaaaacaagataattccaagttttcaaatatcagcctaaataaacttattgtcgttgaggtgaaatttggttctaagattcctaataggcagggcaaacagggaaacatgataaattggagtatatagttctcacaatcaaaaaggaagaaatactccagggaaagtcaagatatttcctagtattggttctaaaggaagtattttacatactttatatacaagacacctaataaagtagtagtcaactgctaatgaactattaaaaaatagtcaatagtagcttctcagtcaacaggccaatagagtgctgtgtttcatatgcctactccttggcatgaactgtgcaaagataaaatattatagtacacgtcaatgaagacagttttgtgaggggacaaaaggaatatagtctaagtttccttgtggtcttcgtaatccaagggtaagataatggttatttagaggattgggtgaattgcatgtgtcttaggcaatcctaaatataacttctctcaattgattgcttgataagaactagttgtgctcttaggcaaggatccagatacctggtcttttatcttactgtttgaagatgcgtctattaatatatgcttgggaaagcaggtggcagaggtaacatcttctgaaagctttggcagctaagcagtattctcgctctatcatgtggcatgttgattgtctgctccctgactcccatacacagtttcctctgcctaggcaccatctccccacttttgctccctccctccccaatatgcctattcctgtttgtcctcaaccacttttctcctgtccagccctaccctatgttaatctgatttagatgcttttgactctgctctttagaactctgtaattacctctatcatggcttttacaatactctaggatctttatggttacttaactgctccctctactaagcttgaaatttcctggaatgcgaggatcaggtccaagtggactctaaaactctagggtctagcatagtgcccagcctgtagtaggggcttaagaaatcccaattcagaaaagaaaacaaaaaataataaggtgacaaataaataaccaaaaataaaaaagaaattctgattgaatagatgaatgagtaaattttcatatttctgcctttttttattcttctactgacatttggaatacctgcctacatatgcaaattcttcctattcttaggccaagctcagtggctcacacctgtaatcccagtactttgggaggccgaggtgggcagatcactggaggccaggagttcaagaccagcgtggccaacataacgaaaccctgtctctattaaaaatacaaaaattagctgggcgtggtggcacacgtctttagcaccagctactcgggtggctgaggcagaagaattgcttcagtccagggaggcagaggttgcagtgagccaagattgtaccactgcgctccagcctaggcgacagaggaagactgtttaaaaggaaaaaaaaaaaaaaaaatatatatatatatatatatattttatcccctaagggcccagttaagttttttgttttgttttgtttttgtttttatttgtgttttgagatgagtcccgctctgtcactcatttatcttgtcgtttaaaaaattcctagagacctacaatttatatcacaaagtttaacacttcttcagattttgtcatcttttatcactgcttactttttgggtgaattgtctcttcaataagaccataaactttttgagggcagaattatatctgtatgtttcttcaatccctagtaatacccaaaatgtttcattactttgtattgtagaccctaaagaaaagaacacatacatacataaaacttttctgaaaaatagtccatttcctctgttctcctggatttaagtcaaatgcctaacctcagaagataaaatcttctaatgaagatttcataaaaaatgcattttattattaaacagtcttcaaaatcagaataaccttccttataaattacctggtatttctatcccatttcttgcaacattgtaaaactacttcctgtaaaataatgaatgattgatcactactcttgttttttttttttttttttttttgagacggagtcttgctctgtcgcccaggctggaatgcaatggcccaatctcggctcactgcaagctccgcctcccaggttcacgccattctcctgcctcagcctcctgagtagctgggactacaggagcctgccaccatgcctggctaattttttgtattttcagtagagacggagcttcactgtgttagccaggatggtctcgatctcctgacctcgtgatccgcccaccttggcctcccaaagtgctgggattacaggcatgagccactgtgcccggccgatcgctactctttagataacaacatctgctacacattcccaaccttactataacttgttacatggtagatttcagtatgaagatgttccattttagaccacattcaagaatctcattataagggaacaaagttaaaatgagattgaatttatttggaaaacattcgctttcagctttttttttctcccctctacatcacctaactaactggaattgtttattgcacagatcagatttctcttttgaacactgaactgtctttcttatcttctgaactcaccatgaattctttaggttcctcttaagttgtgtaatacctgaaactgaacaccacactctaatctgacaggtgttgagtattgtgtaaaatttatcatcatggttccggagtcatatgttacactttaaatgtgcacagtattcccagaaacaaaaccaaagttctctcaacccttacttgttaccttccttacttctttttgcttcacagggccatgcagcattaccactgctgttgtcagtaacaatacctaagttttgtaagaattccagaatgcagggtggaaagatcataactgtgaagttagactgacctgtgtgggccctgtcactgtccagttggcaactttaggctaatcacttaacctctttcagcctcagtttcctcatctatacaataagcataaaaatatcaatcttgcaggattgggatatgaagatgatagattgcctcaatagcaacagcaaaaattcctgtataaaaatgggttagaatagacattcaaagaagatatgcaaataactaataggcacatgaaaagatgctcaacattgctaatcataagagaaatgcaaatcagaacccatggtgagataccacctcacacctttaggatggctactattaaaaaagcaaaaaataagtcggacatggtggctcctgcctgtaatcctagcactttgggaggccaaggcaagaggatcactggaggccagaagttcaagaccaacctgggcaacacagtgaaacaccgtctctacagacaataaaaacaattagacaggcatggttgcacacacctgtagtcccagcttcttgggagacagaggcaggattgcttaagcccagaaattcaaggctgcagtgagatatgatcgggctgctgtactccagcctgggtgacagagcaagactgtcacaagaaacagagagatagagagggatgaggggaggagagggaggggaaagggaagaaggaaagaagggaaggaagggagggagggagggaagaagggaagggaggactaaaaactaacaagtactggggaagatgtggagaaattggaaccccggtgtactgttgggaatggaagatggtgcagctactatgaaaaacactatggtggttcctcaaacaattaaacatagaattactggccaggtgcagtggctcacacctgtaatcccagcactttgggaggctgaggcaggaagactacttgaggccaggagttcaagaccagcctgggcaacataaggaaaccctggttctacgaaaaataaagtagccaggcacagtggcacatgcctatagttctaactacttgggagactgaggtgggaggatcacttgagctgggaggtcgaggctgccatgatccatgatcacaccagggcactccagcctcggtgacagagcgagactctgtctcaaaaaaacaaaaaaattgaattaccatatgatccagcaatttcattctgtgtgcgtatgcccaaaagaattgaaagcagagacagaaacagatatttgtatcctcctaacagcattattcacagtaatcaaaagacagaagcatcccaagtgtccgtcggcagatgaatgagtcaacaaaatgtggtctatgtattcagtgaaatactattcagccttcaaaataaaggaaattctgcaataagctacagcatggaactttcaggacgttatgctaagtgaaatgagccaatcacaaaaagacaagtactatatgattccacttatacaaggtacctaaagtagtcagaatcggaaaggtagaaagtagaatggtggtcagcagggggtggggagagaggggaataggatgtttttgtttaatgggcacagagttgcagttttgcaggatgcagagttctggagctgaatgatgggatggtcgtgcagcgtgaatgcacttaatgccactgaactgtacacttgaaattgttaggatggtaaagtttatgttacatgtattttgccacaatttttaaagaaagattatagattgtgtatgtattataccccagattaggtgtttttgttttctcgattttgcatttgaggaaactaaggctgagagaagttaagtagcttgtccaagccacacggtcaatgatggagctgaaattcacacccaagcagtttttttctagaagctgctgaactgcttcttcatctgaaaactcggcccgtcaaggtgatttcattttatcagcttcctttcctaatggagctaagcggctggtgatcaggccctgtggcctccgcctccctgcagtgtctggttgttatctcaaatggctcattagggggatgcctggcagtaggggggcatgtgtagtttaggctggctgtctctttatccagccatttaactttctcttatttagatggagccagacctggagagggaggataaggagcaaggtgggccttctgcctctactcccctgggtgggggtgatctgggatctttcccacatgcccgaaccgccttcgaagggacagcagttctggttggcagaggaaacatggatgtagatgaagctctgcagcagagggtggagctgaagtgaggaggtaggaggtgggggaaaagccgagagggcttgggaatcacccctggattagttaagagagcattccctgcaggtaacagaaactccgagaaatcagtggcagggtaagtaagggatttatttttctcacatgtcaaaaagtctggagacaggaggtccagggctagtgctgctcttcagagacataactgaggagccaggctgctctctttctgctctactaactctaatgcattggctttcattttgctggtcataagatggtttctgttcctaccggcattgtgtccatgtttcagtgagaagagggggaagggcaaaagacagatgccaggtcaatctgtccccctttcaaaaacactttcttggaagcccagcagttctaactaccatatcattggccaacactggctcccttgcctacttctccttagcaacagaggtgtctagagaggtggtcttttagctgggcacattgccttcccagtcagatctgggctcttttattgaggaagaaggggggatggctaatgatatacatctactggtttcaatcacagcacattttctttccagagactccacccctgctggaggaacttcatcacacttctgcagcccctctaccaccagcttcttgactgctataaatagatacgttgttccttgacccaaatttgccccagtcctgtctactagtacatggagttgggggtccctattacctttcagttacagtaacacatgagagccctcatgtttctggaagtgtttaaaaggtcaccgtaaatgaggaagatggaaaaaatgagccatagagaaaaaaagtaccctataaatatacttatcaaaattataaatttgctctgagtacaatataaaattatgatatatcacattcattcacataaattatttactatttgattatccttcagctgaataatgactatgtatactcttaaattatggagattaatattgttataactttaattttattatgatagtaaattctgttcacgaatgttgtcttcctaagatttgctcacagtatagctgctttaaacactgagacaagttattaatgattcctgtttcatttaaagaaaagcttctggccagtcgcagtggctcacacctgtaatcccagcactttgggaggctgaggcaggtggatcacgaggtcaggagttcgagaccatcctagccaacatggtgaaaccctgtctctactaaaaatacaaaaattagctgggcatggtggcacgtgcctgtaatcccagctactcgggaggctgaggcaggagaattgcttcaaccagggagtcagaggttgcagtgagctgagatcacgccactgcactccagcctggctccagagcaagaccgtctcaaaaaaaaaaaaaaaaaaaaaaaaggaaaaagaaaaagaaaagaaaagcttccttgtgctcaggtctttgctgagattctccaaaaagaataggacagggaggggcctggtaacttgaaaaatccaaaacagaagttcactcagcagtatggagtcataattttaaaaaaggattttaatctaatagtgaatataaagctacagtaaccaaaacagtatggatgggatagaattaaatgtccagaaataaacttatatatcaaatagccaattgattattcagtggactagtctcttcaacaactattcagtggtaccaagactattcagcggaatagtctcttcaacaactggcatttgaacagttggttatccacatgcaaaacagtgaagttggacccctgtttcacatctacacaaatattaaccaaaaattgataaaatacctacatgaaagggctaaaactataaaattcctagaagaatacataggaataaatcttcatgtcgttggattaggccacagtttcttagctgtgataccaaaaagtacaagcaacaacaaaattagacaagttggacttcatcagaattttaaaattatgtgcttcaacggataccaccaagaaatgtgaaggacaaaccgggtgcagtggctcacacctgtagtcccagcattttgggaggccaaggcaggcagatcacttgagctcaggagtttgagaccagcctgggcaacatggcaaaatcccatctctactaaaaatacaaaaattagccaggcatagtgcctcacgcctgtaagttccagctactggggaggctgaggtgggaggaatgcttgagcccaggaagtggaggttgcagtgagctgagattgcaccactgcactccagcctgggtgagagtgagatcctgtctcaaaagcaacaacaacaacaacaacaacaaaatgaaatgtaaaagacagcccacagagtggcagaaattatttgcaaatcatttatatggcaagggacttgtatccagaatatatacagacctcttgtagcccaacaataaaaagataacccaatttttttttaaatttaagttctagggtacaagtgcacaacgtgtaggtttgatacataggtatacatgtgccatgttggtttgctgcacccatcatatttctcctaatgctattcctcccccagttccccacccctcgacaggccctggtgtgtgatgttcccctcgacccctgtgtccaagtgttctcattgttcagttcccacctgtgaatgagaacatgcggtgtttggttttctgctttgtgatagtttgctgagaatgatgatttctagcttcatccatgtccctgcaaaggacatgaactcatccttttttatggctgcatagtattccacggtgtaaatgtgctgcattttcttaatccagttctgtcactgatggacatttgggttggtccaagtctttgctgttgtgaatagtgctgcagtaaacatacaagtgcatgtgtctttatagtagcatgatttataatcctttgggtatatacccagtaatgggatcgctggatcaaatggtaattctagttctagatccttgaatggttgaactaatttacactcctaacaacagtgtaaaagcgttcctatttctccacatcctctccagcatctgttgtttcttgactttttaatgattgccattctaattgacatgagatggtatctcgttgtggttttggtttgcatttctctgatgaccagtgatgatgagcattttttcatgtgtgtgttggctacataaatgtcttcttttgagaagtgtctgttcatatcctttgcccactttttgatggggttgtttgtttgttccttgtaaatttgtttgtgttctttgtagattctggatattagccctttgtcagttgggtagattgcaaaaattttctcccattctgtaggttgcctgttcactctgatgatagtttcttttgacatgcagaagctctttagtttaattagatcccatttgtcttttttggcttttgttgccattgcttttggtgttttagtcatgaagtccttgctcatgcctatgtcctgaatggtattgcctaggttttattctagggttttatggttttaggtctaacatttaagtctttaatccatcttgaattaatttttgtataagatgtaaggaagggatccaatttcagctttcttcatatggctagccagttttcccagcaccatttattaaaaagggaatcctttccccattgcttgtttttgtcaggtttgtcaaagatcagattgttgtagatgtgttctgttatttctgaggcctccgttctgttccattggtctatatatctgttttggtaccagtaccatgctgttttggttactgtaaccttgtagtatagtttgaagtcaggtagtgcgatgcctcctaagctttgctctttttgcttaggattgtcttggcaatgtgggctcttttttggttccatatgaactttaaagtagttttttccaattctgtgaagaaagtcattggtagcttgatggggatggcattgaatctataaattaccttgggcaatatggccattttcactatattgattcttcctatccatgagcatggaatgttcttcatttgtttgagtcctcttttattttgttgagcagtagtttgtagttctcctcgaagaggtccttcacattccttgtgagttacattcctaggtattttattctctttgtagcaattgtgaatgggagttcgctcatgatttggctctttgtttgtttgtttgtttgttactggtgtataggaatgcttgtgatttttgcacgttgattttgtatcctgagacttggtgaagttgcttatcagcttaaggagattttgggctgagacgatggggttttctaaatatacaatcatgtcatctgcaaacggacaatttgacttcctcttttcctaattgaataccctttatttctttctcttgcctgattgccctggccagaacttccaacactatgttgaataggagtggtgagagagggcatccttgtcttgtgccggttttcaaagggaatgcttccagtttttgcccattcagtatgatattggctgtgggtttgtcataaatagctcttattattttgagatacattccatcaatacctagcttattgagtgtttttagcatgaagggctgttgaattttgtcaaaggccttttctgcatctattgagataatcatgtggtttttgtctctggttctgtttatgtgatggattacgtttgttgatttgcgtatgttgaaccagccttgcatcccagggatgaacacttgatcatggtggataagctttttgatgtgctgctggattcagtttgccagtattttattgaggattttcgcatagatgttcatcagggatatttatctaaaattctctttttttgttgtgtctctgcggggctttggtatcaggatgatgctggcgtcataaaatgagttagggaggtttccctgtttttctattgactggaatagtttcagaaggaatggcaccatctcccctttgtacctctggtagaattcggctgtgagtccgacaggtcctggactttttttggttggtaggctattaattattgcctcaatttcagagcctgttattggtctattcagagattcaacttcttcctggtttagtcttgggagggtgtatgtgtccaggaatttatccatttcttctagattttctagtttatttgtctgatggtagtttgtatttctgtgggatcagtggtgatattccctttatcattttttattgcgtctatttgagtcttctctgttttattctttattagtcttgctagcagtctgtcaattttgttgatcttctcaaaaaaccagctcctggattcattgggtttttttgaagagttttttgtgtctctatctctttcagttctgctctgatgttagttatttcttgccttctactagcttttgcatttgtttgcttttgcttctctagttctttccattgtgatgttagggtgttgattttagatctttcctgctttctcttgtgggcatttagtgctataaatttccctctacacactgctttaaatgtgtcccagagattctggtacgttgtgtctttgttctcgttggtttcaaagaacatctttatttctgccttcattttgttatttacccagtagtcattcaggagcaggttgttcagtttccatgtagttgtgtggttttgagtgagtttcttcatcttgagttctaatttgattgcactgtgatccgagagacagtttgttgtgatttctgttcttttacatttgctgaggagtgctttacttccaattatgtggtcaattttagaataagtgtgatgtggtgctaagaagaatgtatattctgttgatatgggatggagagtactatagatgtctattaggtctgcttggtgcagagctgagttcaagtcctagatgtccttgttaattttctgtcttgttgatctaatattgacagtggggtgttaaagtcttccactattattgtgtgggagtctaagtctctttgtaggtctctaagaacttgctttatgaatctgggtcctcctatattgggtgcatatatatttaggatagttagctcttcttgttgaattgatccctttaccattatgtaatggccttctttgtctcttttgatctttattggtttaaagtctattttgtctatgtattttaaagactaggattgcaaccccagctttttttttttttgctttccatttgcctggtagatcttcgtccatccctttgttttgagcctatgtgtgtctctgcacgtgagatgggtctccttaatacagcacactgatgggtcttgactctttatccaatttgccagttcgtgtctttcaattggggcatttagcccatttacatttaacgttaatattgttatgtgtgaatttgatcctgtcattatgatgttagctggttattttgcctgtttttttttttttattgatcattcttgggtgtttctcgcagagggggagttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgattcttaatgagcatgctgccttcaagcatctgtttaacaaagcacatcttgcaccacccttaatccatttaaccctgagtggacacagcacatgtttcagagagcacagggttgggggtaaggtcaccgatcaacaggatcccaaggcagaagaattttttttggtacagaacaaaatgaaaagtctcccatgactacttccctctacacagacacggcaaccatccgacctctcaatcttttccccatccttcccccctttctattccacaaaaccgccattgtcatcccggcccgctctcaatgagctgctgggtacacctcccagaccgggtggtggccgggcagaggagctccccacatcccagtaggggcggccgggcagaggcgcccctcacctcccggatggggcggctggtcgggcggggggctgacccccccacctccctcctggacggggcggctggccaggcggagggccgacccccccacctcactcccggacggggcggcaggccgggcagaggggctcctcacttcccagtaggggcggccgggcagaggcgcccctcacctccaggatggggcggctggtcgggcggggggctgaccccccaacctccctcccggacggggcggctggccgggcgggtggctgacccccccacctccctcccggacggggcggctggcctggcgggggctgacccccccacctccctcccggacggggcggctggcctggcgggggctgacccccacctccctcccggacggggtggctgccgggcggaggggctcctcacttctcagacggggcggttgccaggtggagggtctcctcacttctcagatggggcggcctggcagagacgctcctcacctccgagacggggtcgcgaccgggcagaggcgctcctcacatcccagacggggcggcggggcagaggcgctcctcacatcccagacggggcggcggggcagaggcgctccccacatctcaggcgatgggcggccgggcagagacgctcctcacttcctagatgggatggcggctgggcagagacgctcctcactttccagactgggcagccaggcagagggtctcctcacgtcccagacgatgggcggccaggcagagacgctcctcacttcccagacgggctgggggcccggcagaggctgcaatctcggcactttgggaggccaaggcaggcggctcggaggtggaggttgtagcaagccgagatcacgccactgcactccagcctgggcaccattgagcactgagtgaaccagactccgtctgcaatcccggcacctcgggaggccgaggctggcggatcactcgcggttaggagctggagaccagcccggccaacacagcgaaacccgtctccaccaaaaaagtacgaaaaccagtcaggcgtggcggcgcgcacctgtaatcgcaggcacttggcaggctgaggcaggagaatcaggcagggaggttgcagtgagccgagatggcggcagtatagtccagcttcgccttggcatcagagggagaccggggaaagagagggagagggagaccgtgggccgtgggccgtgggccgtggggagagggagagggagagggagagggagaacttgtctatgtattttaaagactaggattgcaaccccagcttttttttttttttttttttttttttttgctttccatttgcctggtagatcttcgtccatccctttgttttgagcctatgtgtgtctctgcacgtgagatgggtctccttaatacagcacactgatgggtcttgactctttatccaatttgccagttcgtgtcttttaattggggcatttagcccatttacatttaaggttaatattgttacgtgtgaatttgatcctgtcattatgatgttagctggttattttgcctcttaattgatgcagtttcttcatagcatcaatggtctttacaatttggcatgtttttgcagtggctggtaccaacaacccaattttttaaacaggcaaaggatttgaatagacatttctccaaaaaagatatacaaatgaccaatgaaaagatgcatcattagtcattagagaaatacagatcaaaaccacagtaaatgccacatcacaccactaggatgactgtaatcaaaagacaggtaataacaagtggagatgaggatgtggagaaattggaatccttatacactgctggtggaaatgtaaaatggcgcagctggtttagaaaacagtttggcagttcctgaaacagttaaacatagagttaccatatgaccttacagttccactcctaaatatacatttaggagaaatgaaaacatatgtccacataaatgtttgtatacgagggttcatagcaacattattcataatagccaaaaatgtggaaacaacctaaatgttagccagaaaatgaagtgataaacaaaatgcagtgtatatatacagattgcctaggaactggggctggcgggggccgagaaatggggagtgactgctaatggcattgggtttctttttggagtaatgaaaatgttctaaaatgagattgtggtaatggttaccccattttgtgtttgtgtttttgtttttgttttaatttttgtgggtacatagtaggtgtatgtgtttatggggtacatgagatgctttgatacaggcatgcaatgtgaaataagcacatcatggagaatggggtagccatcttctcaagcatttattctttgagttacaaaacaatccaattatactattttataacatacaattaagttattgttaactataaccaccctattgtgctatcaaatagtaggtcttattctatttattttttacccattaaccatccccccgttttgtgtatacaataaaaaccaccgaactgtatactttaaatgagtgaattttattaatatgtgaaatatatcacaataaatctgaaagaatcaatagttaatatttagaaagtaagaggaaaaaaaagcccttcaacataagcaaattgtcttcacatcttagatggacaaattgttgatcaatacgtatttagtgtgtcctgttcattcgtccaacaaataatttgactgcctcccgtgtgtgaagtgtgttctaaggtcttaggcagaaagatgtctgggctctgctctgcccctgctgttttatcctcccaggaaaggtggtgtgcctaggggacagcagctgtccctgggcctggcctcactctctttttccctgtttggaaaggtgtcaggctcccgagtatttctgttgctttcgtcagcacagagcaaggaggaccttgactatagtttcacagccttaagcttcacctcatgcttcaaatccacgaaagagcagctgagaatggggctagctgtgccaccaattgcttctctcccattgttaatccctttaattctgctgttcctaggcacccctccctgacaccatcctgttgcccacttgtgatgtgattgaacaagtggtttggcctttgaaaggtgattcttagagatacctcaagtgacccagcccctggtttgctgggatgctcttggtgttcgtttccatggagcaccagagattgtctgtaggcgaaaccctttccaaccaaacccaactcaaaaaggaggtaactgccactgacctcctctgagatcctggcctagccgccagggtcattagggaaagcagcatttcattgcttagcaaagatagtgagaaagctccagttctttttggctcaaacagaagagtttatgtcctgacacctgagttattaaattatggcacagctagctctgtgatgaatgaatgacaaaaacatatatatatatatatatatatatatcactgtatttctgctttactctatcatttcctgggcaaaatgttattttatttataaaattcatccatctctttcacaaacctcagcttttatggcaaaacacacagacacgcactgagccacttttcagcctatatgtactcttttcagagagcattagaattaaactaattagaattcctccctccctcccctgagattgatgtatttctcagcattctacgatgcttattacactaaaaaaaagacaacttcctaatggcgtgaggacagagaaagtggcatgtgtgttgggggtaaaagggaatattcgagcattaacctgcctggtgatcgcagggcacaaggaaagcctcttctgtcctgggctgtccccttagttgtgataggaaggggagtagcaggaaatggaatctgccctggtcatgggattttttgaaagaaacaaagcatgatctgatgaagagcaggttaatcctgctatttcatttcccttgcagaaagggtgggggcaggattgtgatatgaagtatttagtttcacatctgttccaggaattatcctcggcataaatccatttttcttttaagcatcgtaaagcatcccagggagctcctcctcctgcccaccctccccacccccacagtttatttcgtggccacggagcagctgacatacttccagagagatcatcttgtcattgtacacaaggagggaatctctgagtcttagaagtcagaatttctgtggatcagtggtatcaattttgtgtactgctttccatgaagtgtttagaataaaactaattagcatagcagcagcgtagtataatgaaaagagctctcaatttaaaattagaactgattctcatctcagctttgctaccatttgtgtgaatttgggcaagtcaccaaacctctttggtctcagggtcctcatggtttcccaaaatgtgttcacaaaatacaagtcttcacagtcaaataagtttgacaaatgctatttaccctatgccacttcttagagttgtaatatattaacatattaaagactctgaaaagtctttcaataaagataccttttttttttttttttttggtggggatggagtctcgctctgtcgcccaggctggagtacagtggcacgatcttggctcactgcaacctccgcttccgggtttcaagcaattctctctgcctcagccgcccaagtagctgggattacaggtgcccactaccacacctggctaatttttgtatttttagtagagacagggtttcgccatgttggccaggctggtcttgaactcctgatctcaggtgatctacccacctcggcctcccaaagtgctgggattacaggagtgagccactacgcccggccaaagatacctatttttcactcagcatttcttaagtttatctgacctggaaccatttttcctataatgctgattagtatctcgtcactttgagaaaggaggttcaagtccaaattgctggtaatctatataatctgtcacacgtcatggttaccaaactcagtttaaagtaacttttcaaacttcaaatctcattatttggaaaaataaaaataattttatatatggcaaggggacttctaatttaaaaaactgaacgtaagcaccaaagcaattaagcagaccagtacagacttgtaactagagttgcgacaaagtttctttgacttctgttttctattcccacctttcagatgtttggtgttctcctgtggccttgcttgtatggtctattaattattctttgaataactaattatgctcagcacaatactaggtgcatgtaaagaataacaaatccaaagatcctaacctataatgtagagaatgaacacatacaaggtaaaacagaatttcaaattgtagagtaaggcaaaagaatgattacaaattcatatgttgacagatactagcacaggttgagtatacctaatctacaaatgcaaaatctgaaatactcaaaaatccaaaactgtttgagtgctaacgtgacactcaaaggaaatgcacattggagcattttggattttggattttcagattagggatgttcaaccagtaagtataatgcaaatattctaaaatctgaaaaaaatcaaaatctaaaacacttctagtcacaagcattttgaataaaggataatcagcctgtatatattattaattaaatatctactgacgtttcttgcagagaacaagaaattcacggaacaagtggatcagaggtcaagtgggagataagtgacggggggaaatgcaaaaataggattaggcaaagaaagcacttttatggttctgagagaaagaagcgatttcacctggtataaatattgaggctaagattaagttctaagatcaaccttagccggacaatcctaacatcatttaaaagtctggctatgataaatcttttgagaaatcagtaagggcagtttatttaatcactcagcttagagaaatatcatccatatatttagagtgttggtctttaacaacactgagtttttgggaatgttggctttccctttctaccgctctagctgttccttcttcctgataaagctccccatccttgcttgcttgttaattttcatattattctctaagatcctgtccttgatctgctcccgtagtttcagctgacctccatctaggacaattccaaacctgttcctccagccaagactgtcacatatggcttcaaagatttgttgtgcccagcacaattctggggcaccatacacaccaaacatgaacataagtagtacttctcctgctcacacgtctctttggatccatgttccccagccacctctagacgtgtctcctgaagggatcactggcatctcaggtgtaacacatccagaactgaccttatcatcctctcaagacacacccctcctctggtccctcctgttcaccttcattagaggtaaagccagaaactgagaggcatgtgagctcctcccctcagtccgcatatttgattatcattattatacttttccctttaaatatccctcagttaacaacttaacaagtccaatttcattcatatccactgccttaattcaaacacataacactttctgtttgaattactacagtgttttccagacggatctcttcatcctaagttgtatcctgcctttatcctccacactgctctaaaagtggtcttttagaaacaattatgactatgatgcttccccactaaaaagtcttcagaagctccctttaaagtgcaaactctgtaagtggattgccaaagccagtcatggtttgctcattaaagaccactccccagccactccctcaacacataggtttaaattccagtcattctaaagtacttgccatgctatcccaaacttcttcaccattgcacaagatgtttcctcttcctagaaatcccatcccttactatcaactcctgtagcaccctttgccttccattgtaacagaatttgctacaatgttttattttattttacttattgccctctaccactagattattaagtcccaaaaggattggggattatgtcattcacctctgtatcaccagtgcttttcatagtactgggcatatagtaggtattcaatacataaatatgggataaaaggtaaatttctattgctattgtaaggtttagcattcactgaataagtggctgtacagtggtaagatcagctatgcaatattcatatcttgtaaattatgggtattttaacaactacttctgtacttcttgtgtcctttggacttctgagaggaaacagaaactccatgcatctttgtaatcaactttttttctgatattcggaggctattctacttcattcatccagaactttggggttgggaggaaccaaaaaacaggcctagagtggagtacctatctttaataagctaaagatattaacttcactatatactgatgttaaaaagataaggagattttatacaaatcatttagaattgactcagtagcaaactagggtgtatatgtccatacttatgaattcaccattttcacgatggagttttttgctgtttgcctctacttctcattcatcccaacacagcctgtatggggaaataaaaagtaaaatagaatgttaacaggccattttatttttttttactgttttaacccatgacttcaaggaagaaagatgcaaacaaatacacaaggtgaactgctgtggtagaaaaactccagacttagtagcttctattctcattcctggcacttagtagctgtgcactctgaagcgatttagttaacctctccagactgttttgtcactgtgaaatggaaatacgttcatttagaaatatttttaatgcctgtgtgtgtgtgtgtcaggtgctttgctatgcactcaaaatagttgccatgtcttcttcatgaggttgatgtgaaagctggatgagatactgcctgtgagagcgttgttggtgttgttttttgtttattactatcaagtgacacctagaacgatctcagtcttcagtcagcgaagactccgttactttgacagaaaagtacactgattcatttgtagcaaagtttgaagcaaagaaatatttgactttagccccaattcagagaaaagtttaagtagccccaatcttctttgcccaagcattctagttaatacagttttttattgataggtgaagttgttattgtattattgtctactgccacataacaaattttacctgaaaacttaacggcttaaaacaataaatatttggctcggcacagtggctcacgcttataatcccagcacttgggaggccaagacgggaagattatttgagcccaggagttccagaccagcctggacaagagtgagacctcatctctacaaaaaaaaattaaaaaattagccaggccgggtgtggttgcatgtgcctgtagtcccagctactggagaggctgaggcaggaggattgcttgaaccctggaggtcaaggccgcagtcagccggatcatgctactgcagtccatcctggccgacagattgagactctatctcaaaaaataaacacacagttattatctcacagttcccatggatcagacttcttaggttaactgagtgtctctggctcaaggtctctcatgaagttacagtcaggctgtcagctgggagcagtggtctcattggaaggataaactggtgggatctgcctccaagttgtggttgttggcaagcttctttccacttaagcttctctaaaggctgctgttatggactgaattgtgtccacctcaaaattcatatgttgaagccctaacccccaatacctcagaatatgactgtatgtagagatagctcttttaaagaggtgataaagttaaaatgaggccatgcggcagggccctgctccagtgtgacttcttacaagaggaggaaatatggacacacaaggagacaccaggtatttgcacacatagaggaaagaccatgcaaggacacagcaagactgtggccatctgcaagccaaggaaggaaccaaaccagccagcacctccatcttgggctttgagcctccacaactgtgagaaaatgagttcctgttatttcagccacttagtatgtgacattttgttatggcagccctatcaagcgaatacagctggcttatcccatagtggctggcctcccctgagccagaaagccatgagagcctgagaaagctcccacagcaggagccacaatctttttataacttaatcttggaagtaacatcccatactttctgcagtattctctttgttagaagtgattccagtgcacacccaaggggaggcaattacataagggtatgccttccaggaggaggagtcacagaggtcattaaaaggctgcctgccatactagtttggggttgcttttaaataagttaaagtaaagcatttagaggtggacagattggcaacttttacgtgatactgtagattcaacctcaccaaatacatgagcactctgactaacttaatctataagctatactctcattctgtgaacctaagattgttatgatctgtaagataaaaacttttgacatttaagacaaggttttctgggggacgaagaacattttaatggactagattgaagagaaaaggtattatcaataaatgcttaagtctaggttgaatatggtgcttctcatccagggctgcataccaagaggaggtggggggaaggaaggagggataaagtttatcattagtaaaaaagcacagtcaaactataatgtaatcttatgtatggaaagtgaaaaaaaattatagctttcataaactgcagaaggtaaaactgaagacaatcttggctgatggagaataggtcataaaaagctgagaaaatgctctaaccattctctcattgttaatggacaaaaagggagtaaatgagactgggttccgggtgagcatgcagtgcaccataatacccaaagagcttttaagaacatccggtgaagagtaagaaaacagttaaggggctgcatggattaatttgggagataaatataaagcagcagtcatattctggagcctttaagaactaataggaagaactttacaagagaaggattggggactgttgaacccaagctttagttcaaaggatccagaggacatctgctttgtggtgatagtgagctgacatctgattcctcagtaagtacactgagttcccagtagctttagcctctaaaattagtagcattgtcagcttgattgtcttgtgtttgtctaacaatcagagtctatgtggcaaagctgtcattattcccaaccaaggtcaaacttcttttcaccaacagccctcgttggtttcttgagtgatgctaatatgaggggagattctccctttgcctttcagagagctctaaggagctgtcaatagtaataacatctccacgtattcagctgcaataatttagctcctgcttcattggaactctctcttgggtgagcctttaagagaggaagaagctgtttcctgttatctccaggctgcatgacaacaagatgataggctgattctagggcccatttcagttttccatacaacaagttgtgaaactagagagtgagatggatggtgggaggatcccacaagacccacactaaaaagatgtgttgggatttggatatttctatggattacctaaagagttctcttgaaagtagatgtttatgttgttgtggaacaatttctgagagatattgttaagtaaaagatgccccaaaaaaacccaacccactgtagattatgctccccttcatataaaaaggggaggaggaatatatgtttgtatgtgcatagacagtcctgagaagggtgagccacacacctatgcaaaccagtaataggcagctgcctgcctctgagatggagacccaagagtctagggtagaagaaatacttttaactccataatcttttgtattttttttttaatcatgcctagatgacttttaaaccacacaaataggaacagtttttaaaagagaaaacccttgaagaaatgacacttaagttatggcatatagcccttaaattcatgctctattctcttaaatagtaatttgagttttctggttctctctcctttttgtcattagagtttgaaaaatcatggtaggaatagcagttatttattgagcacctgctgtatcccaggtgctgtaatttttacatagttttttttttcacttaatcatcacaacaatcatatgagaaatacttcttaaactgccatgtttttacagtggagacttatattccttctttgggttttctttagaaaatagagagttccaagattaattttctacgaaatgtctgttactttgctccagcaaagattagaatggcccttgtcctgaggggtgcatcggatcagttctaccttcaagtttttctcctctttctctggcttgtcttaaagtgtagtcagatctttcttgctctccctccctctctgcttcacgtctttccatccgtctctcttcctcgctttgtatttctcatcacagcttcattgacctccctatttcttgcatcatatggcttcttccatgtggcaagatcagatggaagggtgtggtttgagcatcttccatcttattctttccagcagtgaccacagagtgagggaagcatctctctttctactttaatatatatataactccctaagaaggactgggatcggcttggcctgggtaataagaccacctcttgaagtaattgctgtggccaaggggattcaggttttggccaggcctgggatcatttttgcatcaacttttgtgatcaagaggatgtggaattaacatttgtagcctggcagtaatagcttggttggaatagaagaagtggggagcaatttcccaaaggaagagaaaggggctgaaaccctaagcagatgggaagtgtcactaggcagacaaaaatagtaaatttccctgctttccacccttagcttcttatacaaatgcagagttaaattataaaacaattcatgcaataagcactttatataacactggagcagaataagtgatagatcaatatccataattatttaacatctttaaaattgtggtgaaatatatgtaacataaaatgtgctgtttcaaccatttttaagtgtatggcattaagtacatttacatttttttttttttaagtcagagtcttgctctgtcaccaggctggagtgcagtggcacgatctcagctcactgcaactgccaactccctggttcaagcgattctcctgcctcagcctccctagtagctgggtttacaggcatgcaccaccacgtccagctaattttttttttttttttgtatttttagtagagacggggtttcatcatgttggcgaggatggtcttgaactcctgaccttgtgatctacccactcagcctcccaaagtgctgggattacaggcatgagccaccatgcctggtccatttacattcttatgtaatcatcaccaccgttcacctccagaatttttttcttcttgcagaactttagctctgtacccattaaacaataactcctcattcccttttgcccccagcccctggcaaccaccattctactttctgtctctatgaatttgactactctaggtacctcatataagtggaatcatacggtatttgtcattttgtgactggcttatttcacttagcatagtgttctccaggttcatctgcgttgtaacaagcagaattcccttttttaaggttgattcataatttaatgtatgtatacaccacattatccattcagcaatcaatggacacttgagttgcttccacctttaaatattgtgaataatgctgctgtgaacatgggtgtgcaaatatatgtttgtgtccctgctttcatttcttttgggtacatacacagaagtggaattgctggattgtatggtaattctgtttttaattttttgaggaaccaccatcctgctttctgtagtagctgtaccattttacacccccaccagccgcacacaagggtttctgtttctccacattctcactaacacttgttattttatggttattttaaatgtttatgttttgatagtagccatcctaatgggtgtgatgtggttttaaattaaacattggtaactgagataatactagtgccatttataaaattagcatcatggatgagtgggacagacaatactgttagaattttcaaagtcaagtttcgatgatgactgaatgttaaactcagctaggtttttctcaaaagagaaggagaagtcggagccagaggtagaattgagcaatcatctgtatggagatacttgttaaaactgtgagtggatgcattctccaaggaaacgagtttaaggattagcagcaaggttcaaaggatggaggaaaaggagccagtgggggagcccatggaggcagccttgagagacacctggatatttcagaaactcggagtcccaggatgggaatgatcagtgagctcagatgccaagacagatgactttatgtaaattgcctgtgaataaaattttgttaaattgaatcattttacatgaataataacctgtagtgccctttataattttcagaatgctttcatatggatttccttatttggcccttgtagcaatccagtgaggtacacacgtttttattctcatattacagaggaagaaactgaagcacagagagattgcaattttcctaaggttactgctcgtaaatctcagtttcccaagatgatcagttttggggaggctgaaggcacagtagttcagagatgcttacagcagagtaggcatgagtgtcttcccataatgccccagaggcttgtcatccctagcacatgagatctctttcagtacctcctggaaacaatatacactggccactctcggcttcctgtgaactagtaaagagcttgattgcctatactctagagcagtgattgttaaactgtgagtcgtgacctagcagtgggtcatccaatcagtttaacgggtcgcaaccaggctcacaagagctggtggaaggtgtcccttcccaactctgccttcagtaactttgcgttggttatttgaactcaattgtggtggaaattggccaacaacacaaagttggggctttcatttgttttaccgtagagagcctgttaaacattttctagcacaccactggtcacaatcatcattcccctgcctccccaccccagtgcagcagaatgaaatagaagaataccagggtctatctacagtaaaagtaagtgtaagtattatgggaattttatttaagtcataaagatggttgtgcattcagtggcaatgtgagatgtactttttactatgcattgcaatcagaaaaaaagtttgaaagtcactgttagtcactggtctagagtcccttcatttcatttcattttatttgtttagacagctttactctgtcattcaggctggagtgcagtggcatgatgacagctcactgcagcctcatacttctgggctcaagcaatcttcctgcctcagcccctgagtggctggaaccacaggtgtgcaacaccacgtccagctaattattttattttatttttagtagagatgagtttctctatgttgcccaggctggtctcaaattcctgggttcaagcgatcctcctgcctcagcctcccaaagtgctgggattataggcatgagccaccatgcccagctggaccatttacttctcaccttctttaggtaactgaaagtgctattctcctaatcttcagatagagaactggtatccagcaccctctttgactcattaatgctgcatctgctacaggaggaatgaggctgaatttttatcagactagaagctattctagaagaggcaaaatccacccccaccatcaatctgtcttttgaactcaaagctatataaaaatccattctaatgccccaccaaagattttctccagtgagcagaaaacaaaaatcattatccttaaatcccagaggtttgaggcttgtgaatagcataaatcaatttatagctcgtagcattgttttactctaccactcttcattaccagagctccctataaagaaattaaatcttttttttttttttttttttttgagatggagtctcactcttgcccaggctggagtgcagtggcgcgatctcagctcactgcaagctccgcctcccaggttcacaccataggctgtctcagcctcccgagtagctgggactacaggcacccgctaccaagcctggctaatttttttgtatttttagtagagacggggtttcaccatgttagccaggatggtctcaatctcctgacctcatgatccacccgcctcggcctcccaaagtgctgggattacaggcatgagccaccgcgcccggccgaaattaaatctttttaagaaagtgaagaaactcttcataaaagaaactctccttttaataattcagccatttattttataaatctaggttttacatgtttatataaaaatacaccagatatactcaagtaggttatgcttcgaaactagcatggtagatacatcatagaattagatcccaagaacattgattttagtcagccttaaaatttttaaattttcataacagggtggttattaagtattcttatgccaaaaaacctctgtcaaacatgttaatcagtcttccattaggatacttactatctaaatgtagttacaaaaagaaacacttttcactgaatgacatttgaaagtctttcagagatttatatctctctattccgtgataaaatgttatcatgcccatctgatgggtttattataataaaataatccagaatagggggaacatggttttttacaggtttgtgagacttaagtatatcttcagaaatgagttatgtgcatttttcttagaagaattaggcttgttgtattaatgactataattctttatagtagaattccttaaaatagcattgtattaaaattattcaacactcatttgcgagtagaaaggaaatcttcccccatagatggacacttgagctcttgttggttttagcatctgaactgaaccagatgcctgcattactcatgagaaattaaaaaggatttctgggaggccatgagggcttggtggtgctgctgtagtcagcggctcccatgtcccatgtggctgcattgcagagttccttgggctgtctttgctctgaacaaaccccttgcagctgtgcccggcgcctttgtgacaacccaggcaaggtttcatgaaatggatctgatgttcttgtgcctgtgttattcattccaacatactggagctatgcccaggaaggtgaggggcagcaggttggcccacacaccccagctgtccgtttctactaatgtcactcaggatataaataaattgattcattcacttcctttcttatcaaaccagaatgttgccagaagatactaccagggctgcccagatcagttggaaaggccttagggacaaatctttaagaggtaaacgtctttgcatttaggtaatattttaaattaagtttttaattttatttttcttattcacttcagaccttggagggagaaaaataactttggttatatgttcataacatttgaggtttgagccttctttatttgtcccattttccagataggaattttttctttttactgtattctttttttctgagacaggttcttgctgtgttgcccaggctggtcttgaatcctgaactcttgagctcaagtgattctccctcctcagcctcctaagctgggattataggtatgtatcaccacacctgcctggcttagggccttctttattggcagaaaattcatgatgaacttttttttttttttttttttttttctgaactggaaaagctatgagtcataggatttcataaaaatgcggtggctcacacctgtaatcccagcactttgggagccgaggcaggcggatcacgaggtcaggagatcaagaccatcctggctaacatggtgaaacccatctctactaaaaatacaaaaaaactagccaggtgtgtggtggctggtgcctgtagtcccagctacttgggaggctgaggcaggagaatggcttgaaccagggaggcggagcttgcagtgagctgagatcatgccactgcactccatcctgggctacagagcaagactctgtctcaaaaaaaaaaaaaaaatgtgtatcccttaaccttcagacagctgatgagtggtagaagcactggcctggaagtacagattgccgcttaccacatcaggccttttgttgtttgtagaagcctagtttgtattgttagttggaagtcttttgccacccatagggtaacagcgctattgatcatcagtcaatcaactatttaccaagcagctctcatgtaaatatttataaggcaaaatgctgggtgccctgggtcatgtgaaaatttgtaagatgcgatctcagcacttaagagtgtagcagtgaaaataagcagtatatgcaagacaaagtccctccccatgtgcctccaaatgataaaagaaacaatgatttagatcgtttaggagggtctctccaccattcctctcaggtaacttatgcttccaaatgagcacgacatgtgaatctgctcttggcttcaatggttcttcattcctaggtgattctcatagtgcagtttaccttggcaaatgttgatcacaatgtctaaaaatacttgcattctctatggcctaaacacaagccagtcatgttagttgggtgctaacgaaagaacagaaggatggaagtataagtgtgtttgttggactccctgatagttgccgaactggcatgatgtattttacaggtgctttaagactttttagggtagttctgaatatattttatgtttgtgttgcttgttgactttaggactaacataataagacataacttcatttatttcataaatgccaagtgagtgtataaagacagtattatctgtagacatttggccaaaaaaagacagaatttccaggccaagccattaaagcaaaaataaagatgggttagctacagtggctggtatttcaaagtcccacaaaaaaaaggcggtgtcggggaagagctgggctgtagtcgtggtcatagaggcagtgagggaaaaatgcagtaacatcgttgttctgtatacctctcctgctcttatgaccccgtcactggatcaccaggcaggagttaggattgaagtgactctgtacccgaattatggcaggatgtaagggacaataggcaaatcttaaggtgaagagtctagaggagacccttctagactgggaccccagagtgccagctatagtctccatatgtaagtcaactagaaataagccctccctctcgtccacccttcagtccctcaggcattgaaagataactggctatctggaaacttggtgctaaatggagtggagaaggggaatctcccctggtaatttataaccacaagctggaccccttgtaagcttgggcatgaattcacattctggaggtagcctgaaaaacttcagactgagagtttaaggtggtcctaaggcacctagcagaatcaaatgcatgttttatctggaggaatcctcctccaacccaaacctcaaataattcccacaggtaaagttttgtgagatcagagtttaaaatcacaaaacaaataaagaaacatggcaccatgagcaaagccagcaaaataatagataacagtgttagactaagataattgaaattgccaaatagtgcaaaataacttttctcatatgtttagagaaattaaaagagagagtaaaccaagagattaaaattatgaccaagcagatttgaaatagaactaagtaactcttttggaattggaaaataataataattaaagtttaaaaatccatggatgggcctacctgcagatttgacccagttcattgaagagagctttaatgaactcaaagatggatttaaagaaatgatctgggcacttgtctttcgagtcgcctgcttagccctcttctaagtgtgctttccttcctgctctgaagctttttgataaactttccctcctgctctaaaacttgccttggtctcttcttctgccttatgcccctcagtcaaattctttcttctgaggaggcaataattgaggctgcggcagacctgtacagatacagattcactgccgctaacatattttggtgccatgtgacttggataccttccgccggtaacatactttgctgtgtgactcgaatacattccctacttgccatcaagcttcagatgatcctcagtgagggacaccatcctctcaatattcaagagtcacccttctacaaaggacccctagactgcccatcagtggaacaaacagaggcacaatcttgcccctgtctcccttgggcctggctggatcccactttcaccaacccacggagcctccctgccctgacagctagcaacaggccaaaacccacagaacagccaactaccacctgtcagtggaaagcagttacagaagactgaccttcatccattttccccaaagaattgggatcttggactcttgagtcaggaaaggttacagtaggtagtcagacatgagcagggcaagagagggctcctgccctaccccttcccaccacaaccaggaatgtcaggtgaccatcaggtgatgatcaggcagttgttgaaactgtctctctaaaataataatcagttgcagccagcaccagggaaaggcagtctccttatagataggaaaaacctgaaactagtgattagtagcttcctgataagatctcaggagttgggggagtgggcttgagcatgtgcactaagaggcaaaatggcggcctttaactggcatatgacctcctagggacatttggctggtaagggaaaaacgcttcaagtgagcatgcgtacaactccagtaaacacactgtgcatgctcatctcccaagtgctagcagaccactgcatctgcatatgtggacagcccactccaagggaaaaaccaggggagaagagatgcaagacgccagaagtatgccagcatataaaaccccaagtcagaaggtcaaacctcatacttgatctctcaagccacctgcttggccctcttccaagtgtactttccttccttttgttcctgctctaaagcttttatagatatataatatatattacatatattattttataatatgtattttttataatatatattatatataaaaaaaaattttttttgagacggagtcttgctctgtccccaggctggagtacagtggcacgatcttggctcgctgcaacctccacccactaggctcaagtgattctcctgcctcagcctcctgagtagctgggactacaggtgcgtgccaccatgctcggctgatttttatatttttagtagagacggggtgtcaccatgttggtcaggatgatctcgatctcttgacctcatgatctgcccgcctcagcctcccaaagtgctgggattacagacataagccactgcacttggccttctaaagttttttaataaacattcccttctgcccaaaaaataataataaattgaaaaataaatgattgggaatgcagcacagaaagaaaaagaggtggaaagccatttgagaaggcctaataaatatctaattggagctctggaaagaaaaaatgggacaacatttgaagagataatggctaaaaattttccacaactagtgaaagatacacatattgcagtgaatcacaagaaatccacacctagacacatcatactttagagcactaaggtcaaaagatgttaaagcagctggagggagtggaaggattaccagagcaattccagtctgattgacagctaacttctcagcagcaaagatggaaacaaaaatacagtgtaatgttgccattgaggaaaggaaataattaccaaaccataaatgtattctaagcaaaaatatctttcatgaatgaggatgaaacacattttccaacacataacacgcaaaagagtttgtcactagtagacctttgccaaggagtctaaagaatgtatttcagacagaggaaggtattataataccagaagaaaggtctgaaatgcaggaggaattgggggcaacataatgagcaacaaaatgatgataatgttcttgtgaggttaaaaagaaaatgaaaatgtccaaaccatcatatcatgtaactcaaggagagcagatgttcaaaattaaagtcatttaagttcatactgtacagtgaaaaggtaaagttattgatgaattttacctttatatagttaacatatacaattgttaaatgaataaagtatttaaaaaaatagaaaacttccaaagtagcagagagaaagtggaatgagatagagaataaatccacaaggaggaaaaggaaacatggaagaggtagaacaaatagaaagcacagcttaaaacagtacgaacaaataaaagtattggccctttccaaaatgtgagttgactcaatgttccagtgaaggtcaaagactgattgattcatgaatgcaacaaatatggaccaagcatcttctgtgtgttcagcactattctaggcactaggcacaagccgtggagcagtgagcaaaacagccaaaaatccccaataggagagacaaacaacagaccaaataagtaacacaaaccgtacatgagaatgtgggaaatgttctagagagaaaaaaaaaaacaacaacacagtgaaagaaggtagagaatggggaggttcgctattctaaataaagtagagaaagtggcctttgcggtgagaactgaagaagggggaataagctggcagatatggatggaagggaactccaggtggagggaacagcgggagctcatgcctggagggagggatgtggctgctgtgattgggaaattcaagtggagctgtcatgttgcacgagagagcagaggagagtgagaacagatgaggctgagagatgacaaggggccagatcatgcaggccctgggggccaaggagaggacttggcgcttgtcttctgagtgtagtggtagccatcaaggaattctgagcagaggatttcacaggatggctgtggctgctatatcaggcagggacaaggtgggaacagtggagggaagagaaaatggccaaccagaaatagttatattgtcagcctggatttttaaaaaatagacttttaggctattaaaacaagaaaatcttacataggcatatataaaggatcaaagaaaaaggttggaaaaagatatattggggaaataccaaccaaacgaaagctgatgtagctatatttatcagacaaaatagattttcaggcaaaaaagcataacaagaaataaagagggtcactacattatggctaaaggttcaccaagaaagtgctcaaccttttctcgtcaacttactttaactagtatatttaatgtttttttcatttaataaatacatatttatgaaaagtacattgggcaaaaaattaacagaaccataagaaaaatagataaatctagctttatattggaaggttttaatgtaactcagtaattgctagattgagcagtctgataataagtaatgtttctgataataagaacatttaagaggctgtgcatagtggttcacacccataaacccagcactttgggaggctaaggcaggagtatcactctagcccaggagtttgagaccagtctgggcaacaaagtgagaccgtctctccaaaaaaatcgaaaaattagctgggcgtggtgtgtgcctgtggttccagccacatgggaggctggcgcatccccatgcttgagcccaggaggtttaggctgcagtgagctgtgttcatgccactgcactccagcctgggcaacagagcaagaccctgtctcaaaaaaaaaaaaaaatcgaaattttaactacatcattaacaggcttgatctcataggcgtgtatacaacatcacactaaataactgcataatgcacattctttgcaatcttctatgggggagttgcagaaactacgtagtaggccttaaatcacatttcaaacactacattccttgaccataacgcaataacaaaaagatactggaaaagtcctcatatttttggaaattaagaaagagttaactaatttaaaaatcataattggcggggcacagtggttcacacctgtaacccctgcgctttgggaggccaagacgggtggatcacctgaggtcaggagttcgagaccagcctggccaacatgctgaaaccctgtctctactaaaaatacaaaaattagccgggtgtggtagtgggcacctgtaagcctagctactcgggaggctgaggcaggagaatggcttgaaactgagaggtggaggttgcagtgagccaagaccgcgccattgcactgcagcctgggtgacaagagtgaaaccctatcttaaaaaaaaaaatcataattttaaaatgttgtttaatattaaaaacttgacaaatgtaggtaaagtaatacctaaaggaaaatttatgcttacagtgagggaagaggaggggctgaaagttaatgtgccaagtatctggtttaagaagttaaaaaaagaaaaacaaaataagtcaaaagaaagtaaaaaccaaaaataataatagcaataataaagatatagaggaaaataaacatacagttgagaggaatgagttagggacattattatacatgcttcggagattaaacagattgtaggaagatactgtgaataactttatgatgacatgctgatatatttttaaaactttagtgggatgagtacaattttaatatttaacttacaaatatttactcaagaagaaatacaaaatccaaatattcctttaattattatggaaactgaatcaagaacaaaaatcttcccacaagttaattaccaggcttttgtgttttactggtgagtcctaccaaacattcaaggaacaaatatttcaatctacaaactattccagagtataagaaaattatataggatcagaagggaggaggcagatctgtcattattctcagataacatatttgattgtaaacccaaaaagaacgttcaaatagactattggctttatcagagaattttccaaaatcaattacatttctatatttctgcacaaacaggtagaacatgtgattactgaaaagatatgctttacagagcattaaagcacatgcctaggaataaatctaacaaaagatacgtaagacctgtgataaaatatgtatatatacacatatatataaccttaccaagagacgctttaagaatatatatatgtattctttatataaggttatatatatataggatatagaatatatatatggttttatagagtatatatatattctatatatatatattctatatcctatatatatataaccttatataaagaatatatatatataaaaccttaccaagagatgctttaagaaattaatggagagacctacatgttcgtggattaaaagttacagtttgtagcctggcctggtggttcacgcctgtaatcctagcactttgggagaccaagggggattgcccaagctcctaggagttcaagaccagcctgggcaacatggcaaacccccgtctctactaaaaatgcaaaaaattagctgggcgtggggtgcatgcctatagtcccagcttagtcgggagactgaggcacgagaatcgcttgaacccaggagatggaagctgcagtgagctgagatcacaccgctgcactccagcctggacaatagagcgagactctgtctccaaaaaaaaagaaaaaaaaaaaagttacagttttgtaaagataccagttctccctaaaattgatttgtatatttgagagggtattagttgtttatttttattttttgaaatttatatgaaagagagaagaacccttatactcctataaagaatggggatgtcagtagggggctgtgtgtgacttgtcttaaccagataacaaaaattaccatcaagctaacatgcttaagagaatgtgatattgacacaaaatagagaaacctaaaactggtctatatataggaaataacttacgaccaagacacattgcggttagaagaggaagggatagatttcaataataacgttaggacaatcagtttttgtgtaggaaaaaatggaattagatctgtgcttcgaactgtacacaacttcaggtcagattagagacttaaatatgaaaagcaaaagtgtaaatctttaagaatacattagaggaccagatcattatagtcacggtaaaaggaaagggcttgtaaaatccaatccagaaagtgcaaaccataaaggtaaaaactgataaatttgacctggttaaaattaagaacttctaagatgccatgaagatattgtgggagtttttttccctttgtttcttattcatcagagatagattctgaagataatgttatcctgagtttgctttgaaaatactccaggaaacaaatgtgaagagatgaaacaaatggtacgatgccgatcattatcaaagctagatgatgagaacatggaagtgtattatactgttttattttttatgtatgtttgaaattttttattttaaaaacctttgtcagggctgggtgcattggctcacacctgtaatcccagcactttgggtggccaaggagggaggatcatttgagtccaggagttccagagcagcctggacaacatagggaaaccttgtctctataaaaattttaaaaattatccaaacctggtggcacacgcctgtggtcccagctactcaggagactgaggtgagaggatcacttgagctcaggaggtcggggcttcagtaagctatgattatgccactgcactccagcctgggcaacagagttaagaccctgtctcaaaaaaaaaacaaatgtgttttttgtttttaatccatcctgtttttatggtgactgtcctggattttctaatattttttaaaaaccttatctgggccaggtgtggtggcttgtgcccataaacccagcactttggcaggctgaggcaggaggctcacttgagcccaggagttttagaccaggctgggcaatatagggagattccatctctgcaaaaaaatagagaaaaaattagctaggcatggtggcacatgcttgtggtcccaggtacttaggaggctgaggcaggaggatcgtttgagcccaggaggttggggctgcaagtaagccatgatcatgccactgcactccagcttgggtgacagagcaagacagtctcgaaaataaataaatacataaccttttctgtaaagatcacttgttaagtacatgtctaaatacaatctaatttttatcctgaatagcacttatcttaataaattacaaaacaatctctttaaaaaaataccaggcagggcgcagtggctaacacctgtaaagtcaacactttgggaggccagcgtgggaggatttcttgagcccaggagttcgagaccagcctgggcaacatggcaaaactctgtctctacaaaaaaatttaaaaactagcccaggcatggtggtacatgcctgtggtcccagctactcaggaggctgaggtgggaggattgcctgagcccctgaggttgaggctgtggtgagccatgattctgcctctgcacaatacagcctcggcgacagagcgaaaccctgtctcaaaaaaccatagaatgaagagacaagtcacaaactgggtgaagatgtttgtaatacataaaaaccaaaaagttagtatccagatatttaagcaaagaacttctaaaattcaataagcagtttcttagatatgacatcaaaagcataagcaacaaaagaagaaaatagacaaactgggcatcctcaaaaatttaaaatttcctgcttcaaaggacactatcaaggaagtaaaacaacaatccatgaaattgagaaaatatttacaaatcatgtatatgacaagggacttgtatctaaaatacatacagagcgcttacaattcaataataaaaaagacgactcaggtttaaagatgagcaaaggaactgagcagatgttttgccaatgaagatataccatgccaagaagcatataaaacgatcctcaatatcattagccactggggaaataaatcaaaaccacagtggtcagcagccaccagcttggaggatcacttgagccgaagagtttgagaccagcctgggcaacacaacgagaccccatctgcaccaaaaaaaagaaaaaggaaaaacacagcagtgtatcacttcatgcccaccagaatggctgtaatggaaaagagacattggaaccttcatgcactgttgggagggatgtaaaatggcgtgactgcttttggaaacagtttgacagttccttaaacagtttacgtgaagagttgccatatgacccagcaattaattccacttccgtatctatacccaagagaaatgaaaacatagttcaaatatttttacatcattgtttatagaagcattattaatagccaagaggtagaaacaacccaaatgtccacaactgatgaatggataaatgaaatgtggtctatacacacaatggaatattattcagccataaaaaaggagtagagtagtgatgcatgctacagcatagatgaccctttaaaacattatgttaagtgaaagaagccagtcccgaaggatcattgcatgattccatttatatgaaatgtccagaataggcaaatctatagagacagaaggtaaactagactaatagttgcctatagctgagggatgagagatgtagggggtggtggcgaagaagtatggggtttatttttggggtcatcaaaatgttctaaaattgactatgatgacggatgcacaactctgaatataatatactaaaagctattgagttgtacatgctaaaggaatgaattgtacaatatgtgaattacatctcaaaaaagctgttttttaaaaaatcaataacaattcaataggaaaataagcaaaaggcatatccacacatttcatataagaagaaacacttatgcacaatagatacttgaaaagatgctcaacctcatttctaatcaggaaagtgctaattaagccacagtggaataccattgaatactcatgtgattcacagaaattgtaaactgaggcaatactgctccacatgtagaggtgtggagaagtgaggatgctcatacatttccagagggagtgtaaattgtataatcactttggaaaataagatggcattagagagttgaagatccaagtgtttatggcccagcaattcccctcctaagtgtatacccaaagaaattctaccagtagtatactgagattgcatgtgtaatcacaggagcactacaaaattcaaagccacataaaattcaacagtatattatataggggcataaagatcataaacctgtttttttaaaagcaaacaagggaaggataaacacaaaattcaggatggtgagaatgggaaagaattgggagggtctagcagggatgcagggtaatggtaaagttccttttcttaaactagatggtgagcatataggtgtatattgttgggattgaggggttgaggagaaggcaaagtattatctgacactctgacattgagggaaaatttagaaaaactcaaaagcatacatggaagaattttttcatgcactttaaaaatgctgataatacactgtgtttctagaaaagatggacatatttagcattttttaatttgaaaagggaaagataaagtgtttttgtccaagaaaaaaaaggaaagagaacaacacagaaaagaaacagcagtagaattgggagtattttaggaaggtttccaacaaaagtggttaaaattaagagctttgtggccaggcgcagtggctcacacctgtaatcccagcactttgggaggccgaggtgggcagatcacgaggtcaggagatggagaccatcctggctaacacggtgaaaccccatctccactaaaaatacaaaaaaattagccgggtatggtgggtggtgggcacctgtagtcccagctactcgggaggctgaggcaggagaatggtgtgaacccgggaggcggagcttgcagtgagccgagatcgcgccactgcactccagcctgggcgacagagtgagactccatctcaaaaaaaaaaaaaaaaaaaaaaagagctttccacttagaggtgaacttcatttatttgggccaccacttctttattcttcagtgatgttagataaaccagacattgctgcctgtaagtaaaaccccatgctgtcatttcattcatttcatggttgcctttctctttttcagatcctgctcacactaaaatatgaaccacaaacacacagagaaacaacctgttcaccactcctgggtgcatgattgagggtgaagcatccaccagcacttcaaggggtccatagtatttttttttttgctgcctcaaagtccccaaagccttcgagcagaagtggcagtagatggttgccaatcagccaatgcagactttcactgggacaacaagaaagcagatcttctgggttttgatggaacttggcagtggggacattcagctgatgcattatataccccgtcagagcacacttgtatcttttaccttccctttgccccatgcccccaaactgcttaggtcttctctgtccctttactgctgctgcacagagatgatataaaagaggctctttggctatttgcattttgcttcctcttcttttccagattacagtatgaagctttattttctttgtacaagcttaaaatttcaacatcatcatccgccaaagttgttcctcccttttcggaggatctagggggaaagaggagcattcatcacaagtttcctagagagaggagacaaatcggtgtgccattgacaacatgagccagggtaaaggcaccctttggaattactgatttcaaagattaataaagtaattctattttt

SEQ ID NO: 490 - DNA, 41316 bp, Homo sapiens
gccaggcagaggggcaggggttgccgcctcgagcacaggccaagtttcagagcactagtgtgtatcagttctccgggattacaacggaatacctttgaggaacattggggaccgaaaggcgacctcggagaatgtggcctccagggggagcccaggtacatttgccgggtccggagccgacggggtatcctttttctggctggtgtgtgtgtggaggggcgtgcttcagtggttcaacacgctgtatctcccttagttaccggtttcatagtaaatgattaaagctcgtgctacggaaggcgtggggtggtggtggtgggggggaccacgcaataagccagggttcctgctttccagctcaaggaccgccaccaccccacgcgccttaaatttttttttttttttttttacccttttggtctctcctccttgatttctagttccgttgtgcacttagaggccgagaggatggctctggccttccgggtggaggtgaaatatgcatgtataatttggcatgactattgcgtcatcgtggaggtcgtcgtggttccccgagaggcctccacgtcttctcccagcatcggggcctttggacgcttccgggcgctgcgggcacttgcgcgaggagccctcggctccccaggcgactcccctcctcccctccgcggtcctcggctcctcctcctcctgcgcgcccctccgcgcggccctcgcagggagtggggctcgggtgcgccggcagggccgcgcggcggcagcaggcgggggcgcgtggcgcgggccgcgctcggggaggcgcctgggcccgccctcctccggggcgccgcgggaggggcccgggttggcgcggggcggggagagccgcctggcccctcccctccgccgccctccccaaagttgccgtctcccccggggccggccggtcttatgatccggcggatcctcctggggaggccgggccggggagagggcgcgggcgccgagtggcgggggcagcgggcgggcgcggcgaccggggccggggcggggatccgggcggcgaccgcggcggcggcagcgccccgggcccgccgccccctcccctcctgcgaggggagccgctgcatggggccgggggggcggccctgcggcgcggagcggcggcgacggcggcggaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcaggtaagcctcggaactgctgactaaggggccgctccccgggccgggaactttggagcaactttggcggagccccctcgccgcctccccagagcgcactcctctcccctcccccgccgcgccctctgccaggcggccggccccacccccgaagcttcgctcctggcaacccctcgcccgctgatccaccccctctcccacccgccccctacgcggctcctgctccccgcacttcctacccctcggcgccctgggccgtcctccttgaccttcccacatcccctttcctactgccccaaggccccgggggaaatattcgaggggaccgagcgagacgtggctacgggacttgggagaagggggtggacggctggggaccacatcacaccccggccctttgccggttcacagtgagctggccgcacgggaaaagggggtgacatctcgcggggagcgcccccacgcctctagctgggttgggagaggagggtccgggtggggagcgaaattgccccagagcccaggtcactgtgagcttctctccccgcccccacttctgtccttgcagtcagcgtcaccgtggggggcaagcagtacctcctaggactctatgacacggccggacaggtgagtgtcttggcctctggccgacgcccccctcctgttccccagttctttgtggctgcgaagggcctttggaaaccgaggtgtctaggtgggagggtgtgtctgcgacgggcttcccctggattaggtctttatttcttgtaacaagtcagcaaattaggaaaacaaacaaaacaaacagagccggataagccccccccatgtgaacccctgggctgtgaaagtttttgcctgtgtgggtcgttctgtgtggcgcctggtgtgtgggtcccaactcctgttgcaaagtggcagcagccaatcatgaagcgcccttatttttagttgcagatgaccaggtctcccccccacagcctctgtctggtccctcattggtgagtggtctgcctgcccaaggagcctgattggtgggaaatggcatcatctaatatgatgggaaggcatttggtcctggttatgtttattacaacatcattgcactctgggactccagtccctgaaaacgtaatttgtggtgttaccaaaggaccacagggaaaaaagaaaagaaacaacaaccatgtagccactccctggggtggggaggaagggttaggagtttagagtgaatcttggaggaggaggggttccccccggccctacttcagaagggccaggtgactttgtctgggttttctttgggagagattaattgtgcagaaagaagatgcacactttgccctgcagcctctggccagggtttgcacatcagaggtggccaggctgtgcttctaaagggccaaggtcttctctctgtctccctgtcccagcttcagcctcttcccaaacccacttttgctctggggataagttgtgtgtgatgaattttgtagaatccagcactatgattagagttgaagactctggcagaagtttccacatgtcatacagacttacatccttgagaacacaggagcagctgaaagtcttagagaatgtctttgggggaagtccagtagtagaatttccttatctgcaaaatggggtttaaaaaaataagatgatcccctggtgcagatattgtatggcaaatgtttagcattgaacctggcacacactaggtgctcaataaagggagtgatgtactttgaagcttgtctagatttggatttcagaactgtgattagagtttaggttggattctgaaacatgccttattgagggggagtgccttgatgtgacctctggtttctaaactgttagaggaacgtctgaagatagagaactgctggcagttcaaggtccctgagaccaccccctttcaccaaaatggcccaggtcagtacagccagttctcagctctcctgggcccccattggttgcctgccctgtagtcgttattccttctaccttcattggaggatgtggagggcaaggggcagagcttgctcaatcaactaagactgacttttaagtcgtattattgataaacaagaggttgaccttattggttgaaaagaggaagcttttaaaaaatcgcctctaatttgaacttctcactaccttcctttctcttatctcctttacttgtgaccatgataatttttgaccgcactccctgttcaacaggatgtgtgtagtcagagctgttctgagtatgtttaaaccctgctagtatttactgagttttttcctacatatggggccagaggcagacacatgcaaatattattttatttagtccataaaacaaccccatgagataggtggtatttcatctttgcggtgaggaaacaggctcagagaagctaggttgcttgcctgaggtcacacagctactgaggggtgttgctaggattgggacaggggtctgaatctgctccagtttgaagtagttatacacacaggacaccatgggaatgctgagatgccacggggttgattggattgtttgtgcatccatagttgtggtacctgtaatcttcacagccattctctgagtgggtgttggatggcacctctacagaggagagaacttagatccagagtcacttgaagttgaccccacttacaaaaccagggctttccatatatggccgtaattactctttttagtggaggatcataagatatagaccaagcaggatgaacatattagtaaggctcaaatactactgttttcacccaatgctggacaccattggtggggcctagatgtgtgttaggccccattggtgtttttcccagtgtctagacttttgtttttgcatcaaagctagtaatatttcatctcccagcatttgagggtttattactaataagcaacttagcaatgatgagaccaaatggcaagtgcctgctgtgtacctggtactatgtccaggtacttttgcacctggggagtgcaaaggaatgaatttaaaatggggatctaccacagctgatgtcagcaaagggagaaatgtctgtctcgggtctctgttcatgtgttacataggagatctctacattgcacttggtcattaagacctcaggcttctaggaatccatatcagatttgtcttacaataataacaatgataaataaacatgtaaataaaaagtaaataaaaaacattaagggtttatatatatatatatgtatccgtatacacatatacatatatatatatatatatatatgtgtatatatatatatatatatatatatatatatatatgtatatacatatatatatatacacaaatccttaagcctagtgggcagcagagaaaggtccatgggctttggaacaaaacaggcctgggctcagatctccaccttagctagtcatgtgattctagctaaattatttacctttgtgatctagtaaaaacgtgaataattagaatctgcattacaaggtcataggctggcttaaactctttaacatatttaaaagcagctgatactttgtgcatagtgggtgagtgacaaatagtacaggaaattattatattccactatggggagttttgtggggagaaaggttcacagagtggaagagaacagtatattgtgcctggagttgatagaaattccactagaatgccagatcctagaaccttttcaaccaaggtgtgcaacagctttgcgcattgtaattcccatagtccctattgtgggatccatggttccaagcccagtgctccctgccgtaaatgccctgttgtatcagatggttttctgtcttaagcagagcccgtatccccattgatagaagagaaatagcttagagttccatgcagaatttgacagacaagtagggtatgtaggcttcagttggttctactttcagagagttaagatggaatgaggcagctcatggcactacaggtcagttgccttctctccaaaatgttcactcatgcatgtgggcactcattgtatttgaataacagcaacagtgcctccctcagtttggaacctctagtccacttgctcactcatggtccctgccttaaccccagtcaagttcaaagccataggcatcatttgtccgactgacatattagggcatctaccagtcaaagggtgattgttgtagatgacctttggccttctagagcaggctgctttccacttgacctctgctgctattagcagacaaagagagagaatgggagagagagtgtattggacttcagtccccatcatgtgcactgcctggggacatcccagcacactcagagcaccactgccaaagggaacacttcccctctgttggccaagcccatgggtggtccaggagcagctgtcacattttgactgccaagcattttggagtggaagttgaccgaggcatcttccttctcactaggggccttgcgtgtgttttgggggtgaggggttggcttcctgcctgggcctctgtggagcttctcctttcttgcccagccttcaggacttcagtgtaggctctgcagcaaccccattgtctgctcaaggagggactggagagatgggattttccctcctgctactgcactgtttggagcgatgggaagtggaaagagctctccctctctgtccagacaggccagtggggagctgcctggcaagctgctctctagctgtgggctctaggctgatctcttaatccttggcaggaaggcagaacttgataccctggagagggaaggactgaagcccagtttattcaggtcccagaatatccacactcaggaggatgtgtgttgggggtgaatttgggatccctagagttccagatttagccactgtctcagtgtgtggaagtcaatttgtgtgctttgggatgtattgtttctatgtctgttaacttaaacacacaagttcagggaagcgtccatgacagctataaatatcttttactctggtgtcccttggtgttgctttttcaatgacaagtgagatttgttttacacttgatataacccagcagctgtggctgccctgcatgccctctgggtgcccacaaggcacttcccctacagaagggaatctccaccggaggcaggcttggcatgccccaccttctgcattttagcagaagggcctggcatgatgagaaaagggaaggagaaagggccatgggatcaccactcaccaggctcctcccacctccaggcaagtcatcctcacaacacccttcaaggtagacttctcccagatgaggaaattgggaacaagtgggcttatgggaaccagacagagatgtgattaggaaaaaggttttctactttggagaaggcctgcagggaacattagtagggtttaggaaatgccactcacaacatcagactctgggtccttgtagccccgtgttccatccttgctcagcccggtgagcagagcctgggaggagccccagggttccttccaggcatcagctgcaacaggtgagatgctggcactgagcatcctggtttcccttagtaacctactgtagatttgtcatgtgtgcattttgctaacctttttagaagctatttatatctctagcccacaccgcatcacacgggaatgctggtttcctcctctgcgttgggaaggtggatagcctttgttgactccaaagcctttgctgtgttcgctccaaagtctgaatgccctgtgttcccctccttgggactctgatgtgggtttgggttatgccagcttagactgtgggctggcaggcagggactttagggtgggggcagtccccaccagctctcgttggtctacaattatgcctcataatcgggcacataatctgtgccccatccccatcctggacctttgatctgtttggcttctccacttccatcatgattctcctgaggtttggtgacattcccacgctttgaacgacagcttccccgcaggtatctcaagcatgagtgttacaggtgtgctgagatgccaagctctcatctctgaggggccgggggagtgacagcctaagggggttgagcatgtattgtcagttgctgtgggtgctgtgatgtgaaaaaggtgggaagcattgctttaagcccctcggggtcagaggccccatggagaattgggcttttgcggttttgttgtgcagtttggggtttcaagagattagatctaatggtatgaaaacaaagccaacaaagtagctctccacgggggtgtccgtttccagaaagagcacatgtgttggcagctgtgggtgctacagaggcctcagacacaacagcaatgcttcagcaggagagggacgcagttacaaagaaacaagatggaagaccatgtgtggctcttaaaaattaaaattcctgattctcagctgtatttcctttctctctgacaggcttggctttgccctaatttggcacacttgggtcagagagcagctttccttgccctcagcaatttgtcattcctcttttggtttctgagcacagctgctttgcatgtacggaggctgggctgtctgagctctcaggggtcccccggctccctgggtagaacgctctcctgcccagtgccggccaggacctcctggatgcgttcttgctctcttcaagaacagtgtctttctctaccatgttgcagtgctcagcccagtgcctgctaccttgtaggcatgcaacaaatacatcttaaggggattcatggccaggcagggtggcatgttcttgtctgtaatctcagtactttgggaggccaaggctggaggatcatttgaggtcaggagttcaagacgagcctggacaacacaacaagacccccaattctactaaatttttttttttaattagccagatgtggtaatgcatgcctctgtagtcccagctactcaggaggctgaggtgggaggatcacttgagtgcaggaattcaaagctgcagtgagctataatacaaggcttcattgcactccagcctaggcattagagcgagaccgtgtttatttaaaaaaaaaaaaaaagaattgattctcatttgactgtcagcttgtttctgctaaaaggttaaccaaggactaaagtcatagctgctaaataatagcatcagcacaaccccttttccaggaaagcttcactaatacagtagaagtctttaaggttcaaaggagaaacaggcacataggtatggggcaggccatcagttttgtctttacacaggcccaggggccttagtgatcaccagtgggtctgtctgtcccccaacactctgtctcagactccggcctttgcatgtttcctgagacctcttgctcccagatcccctgaggaggagacaggttggcagtggaaagagtgtgggttttggagcctccagatgaacttcgaatcctagttctacctctttgtagctgtgagacatcggccagccggctcacttctgtgagcctctcttccttctgtgtgaagtgtggagataatttataccctgcagcatagctgtaaggattagaaatgatgtatgtcgttaccctgtagggcttggtgctgagagtgcgggcccaggctagctctgggggcttcacactggctcagttcggttggtgttgattcaatgcctggtgtgtgttcccaccttccacaggagaaggtgggggatcgggccacagaaaggtccactacacaactgggcaagttcatcgtgtgaaattgagtgctgcagggtcccacacaggaagaggtgacagggaggagctttttggaagatctaggcttgcaggaagagatgggggccagtagagtactggttgccagtgtggacccccacactggactcccagggcccaacttcagctctgccacttcccagcaaggggcttaaccttcggaaacctgtttccttatctgtcagatggagattatgatagtacctccttgtggggttgttagatatgttggagcttcccagctcccagataagggatttcctcagccctcagggcagctgggtagggcctgggacaagccatggctcaggttgtcctagcttgagcagtctcacctcaggcatgcagcagtggctcctctactccacccgatgtgtgctgaacacatcatctcattttctctgtgtgccatgaggtgaagatttgggaagcattgacctaaatgagttccagcaggcagaggggtgtggagagctcatattctgagtgggaagaatagtgtagggaggaacggcagagggggtgaccccaaagcgtctttttatggaccccagatccctgctatcagtgtcaacatgtggagcagggttgataactaaattatggagtttttcacctggtgactgacaacttggtaattaaagagatattaatctggtgctgtgttgctggttgattttaatagaaagaaaagaatgtggggaaaggggtctttattgctgtctctgttcctttttgagtgaatggtgagagcactgaagcagccgcctctccagatccctagattttcctgctctactcaggctcagggtagactgaggggcttaaaagtggcaggctcatcatcaaatgacatttttacagcacataaagcatgtcgcacctggtaccgccttgagttccctcacctgctctgtgagtaaaggaagccagtggtggctgtctcattttgcagatctggggaggttaaatgactcgctccaggccacacggttggtaaaaggcaaagccgagatcaccaggcaggctgtcggactttaagccctgggttcttgatgttaagtcactctccctaatcatctggcccatgttaaatgcctcttttatcacatgcactgttgttcagcgtttcatgtaaaaggtacattccaagcgtatcgcttttctagctagaagagatggtggaacattgtgtataggtggaacacgtagggacggctgctaaaacggctcctacaaagacttctgccccacgtgacgttacgggtgttttgtcactttgtccctaaaccaccatgcttcctcaaaaaggagcaggcccgaggtggcgctgatggccccattgctcaagtacgtgtggaagaagctcatgccatttgcctaaagctgtggccccttcccagaagagagggacagggaaatgctgtttggggggctgccaggcgggccagctttagcctgcaaatgacgggtgtcgtttgtgtcccatgggggctacctcaggcctttcctttctcccttcaaggattttcttattcaggggaagcctacctctgcaaaactgtttgtccctccttcatctgaatattctctaaatatggcgcaaaacttcctctgccacctgctgctcatattgtttgccctcttgggccatccccattgccaccacctctgcatgggctcccaaatcctgcctggctgcttcctgtggtggctggcaagcctagaagagaacattcatccagtcagtcaacatacatttcctgagcaccagatctgggccaggggcaggtgttagaagatctgtcaggcacaggcctggcccccagaggcacagtgttttgaagggtaggtcaaccatgagtggtgggagggcagtggggcctatttattgggggcacagaggaggaaggcttatccttccaaggaggtgaaatgctagtaagagttaagttgagtaaggttgtttccacgaaagttgttttttagctggagaaagtgatcagtttggattcttacacgtactagatgctcagcgaggccttgaatggtggcactggttctcaaagtgtgatcctcaaaccaacatggatttcctgggaacttgttagacatccaaattcttaggctctatcccaaatcctctgaatgaaaaactaagaaatctcttttataaaagcccttcaggtgattgtgacgcaggctaaactttcagagtcactgaattaatgactgtgcacttctgtacctgctctttgcaacccatctccaccccctgccccctccctccctaccacatccaccgctgtcttacatacacactgtccctggagtgcagagaacatgacttattttattcttttttttattttttcaatttttaaaaaaatgttgtgggtgtatagtaggcgtaaacatttgtggggcacatgaaatgtttagatacaggcatgcaatgtgaaataagcacatcatggagaatagggtatccatcccctcaagcagttactctttgtgctacaaacaatccaattacagtctttgagttatttttaaatgtacagttgcattattattgactatagtcaccctgttgtgccatcaaatagtgtcatgtctttttcgaacttttttttttttttgagacagagtctcgctctatcgcccaggctggagtgcagtggcacggtcttggctcactcaacctccacctcctgggttcaagcaattctcctgtctcagcctcccaagtagctgggactacaggtgcccgccaccatgcccagctaattttggtattttagtagagacagggtttcaccatattggccaggctggtcccgaacttctgaccttgtgatccgcccacttcagcctcccaaagtgctgggattacaggcgtgagccaccgtgcctggccctaactatttttttgtacccattaaccatccctacctcccgccaaacccccaactacacatcccagcctctggtacccatccttctactccctatgtccatgagttcaattgttttgatttttaagatcctacaaataagtgagaatacgtgatgtttgtctttctgttgctggcttattttacttaatcatctccagttctatccatgttgttgcaaatgacaggatctcattgtgtgtgtgtgttttttttttttaatttataaatttttaaacccccagccccacaaaacacacccccatataccctcatttctagttctttacacatggttgagattatccgtaattactggaatgaattgaatgattcagccatgggtgctccctatccagttcacctggtggagaagggccgcagtgctatcaggagaaaaaaaatggaagcagaattttttgtggggtgccttggctccattagtgtgctatgtggcctagggctgtgcgcccagtaggctctgcaggtatttcttgatgcggcctaaacaccaagctatttctctcccgcatattaaggggctcgatagacaggacgcctggacagggctctgttcattgtggctgaggttagcactcctctgggtggtgacagaccctgtccctgagaaggatggcagcttggtttgtgctaaattagttccaaagcatcagatgggcaatgacgtcctttctgtgttaacattccccaggcgggtcacaaggagtggctgaagggagaggaagggctgtgttactcaaacacccatcttgccagtaattacttctttcctggctgacctctgctttctgtgcaagtgttctcccctccctttattctcctgcgcctgctcttttacatttttttctttctttctttttttttttttttcaaatttgttccaatctagaaaacccatcctctttcaaatggcataatggttgggattataaatgagttggctcaaagtgtgccccctctaggagcagccactgagagagcatttaattttgagcatccagttcaattaaaattccatttaatccagcttacttttcacagagttgtcttccccagtgagctgattacctggaggtgtttccaccagcctccttggccctggaggaatggggaagggactggacacgaggagggacagagcaggcagatgggggctctgcttccttcggacagggacttcgtccaacaggcgagagctttgggtattcatccactgcagaaagtgagaagtccaactgaggctgaggcaccccatgacctcctcacctctgactccggccctctagtggtcgagtccctccttagaatttccactaagtgaattgtctccaggctgcactctagcatttggttttattcatgtgtaaatctttgctccccatgcagattgtaaactcttccccttgccgtccctgcaggactgcacgtagcacatagcactttgcacaagtgttgggggccccagtaggaactaggtgtgtgttaaatttaggggagtctggtggtaagattattatggaaagaacctttcccatcactttatatcatatccatattggctttcctatcagctcatttgagaggaaattctgacctgtctggacattattgagtggctttaaagcaggttataggtggcgatttgaatacattgaccatttaagcaaagtgggactcatttctggactcacagagctcattaagcagacaggctgccaggtctgtttggatgaaatactggctatgcgcatgtactgttctccagcaagtctagacctgtaggagtccttcactgggctttatgtcaggtgtgcttccagagtggcctgtggccctctgtgataagtcggtaggagggggacatggtgaggatgctgacctgctcacttgtgtcttgactgggagaccggaatgcctcctgttgtctgaacaagctagtatggaagtagcatctaggcaagctggtgttaagacgcaagtaattactcagagaaattgctggtgtgtcaaactgcttgatatgtaagtttcctcctctttcctttgttttattttttgaggcataattcagagaacactttcatcaccccagaacgaaaccccatacccaccgacagtcactccccaccattcctcctcccccgtctcctggcaaccactaatctgtctttctgtttctatggatttacctattctggacatttcatattaatggaatcctgcaatgtttgccctttgtgtctggcttctttcacttagcataacgttttctaaggttcatccatgttgtagaaggtatcaacattccattcctttttatggctctgtgatctttctctttccattttattcctgcccccgctctttttcagttgttcttccatggccattctttcccgggctctggggactattttcagggtttcaaggtacaaagtgaagttctgctagttgtgcacttgtggtgctgccttcgcccctggctcaggtagaggcgagggctgatctcttctctacccttctgatattctttttcttaaaaaatttttttaatttttttttttttgttccttttaatgcttgggtctggaccttccagtgttcttgttttctctgtgcctctgttcatatactctcccaccccaaccacaccctaatagctttatttatcaaacatataaatatccattaaacataagagtgaggtgaggaacacaaaattccatccgatcgggttcttcccccgtaggagtttacagtccagttggaagatgaatagagctggccagaatgcaagtagaaaatgggatgtgcatataaatcatgaaatgtgagtgaggagtgttagaaaggtgcccaactacccggctgtttgacctgagcttcccagataggcaaggtttctgtggggccgtttagattcagaaacaattttattggggctttcaaggaccatcaggtacatgggtctgatttatgttaactcgtaagagatcagcctataaatgaggttgccaaagagttaatctaccatgtagccccagtggaaaaatggacaagacataaaccaatagctcacaagagaagaaaaacaaatagccaatgaaaacacactctgtaaagacatgtgaataaaaactttgtttttcaacctatcaagttgaaaaggagaaaggaaagtaaatactctctgccccatttttgggaatgaaaactgaaacaaccagtttggaggttaatttgccaaagactctttggtttgcagtgatctgattttatgaatttatgcctagaaaacattcagtgtacccagagatttacataaaatgatattcttcacaatgttatttataatagtgataaattataaacacattgatgcatagtaaaaagggagttgctaaatcacagaatgatttatattagaataatcacagccattaaaaactgccttcaacaaatatttaaagaaatgtgaaaaggctaatgatgtgttaagtgtgaaaaagcaggaatcaaaaccatatatatatgtatagtatgattaaaactttaaagaaaatgcacatgtataatatgcagaggaaaaatcagaacaaaatagtcaaaatgttaaagtggttggttctaggtggtgaccatgaataattttagaaatttacttctttatactttattgtgttccctaatttttttaaaaaaactcatttttatcaaacttctatatgcagatggtttaaagagtcagcagttctggaaggagttattatgaagaaataaaatattcctctttacttctcctgcagaaaagacatttcccactaccctgagacaaccactttcaactctgctgtttattttgataacaaatattctctgttgaattcacatgatgactgatgaggcctgagctccctttcacacatatcttccacttcctatccacctttctgtaggagctatattgtaatttcagtttgaccactgatcagtgtttatatttttatgactattcacagctgagccatgtagtgtactatgattatattttttttcttgtaccactttctgtttctcaagtgaacaattatcttgttgcttctcttacttggttttcactgtatgtctcagctatttcatgcaaaattcaccctcccatgcagcaagtcatatcaagtattctgtcagtttcttcttttgcagccatccctcctgcaccttctaacctgctgtagctgggctggtgcctcttgcctgctgcacagctgttatcctgggatttcccttcaggtttattaggattctctttgcctctatctcttgtattagatccctgtttccaggatctcaggtcttactggtttatttcctcactttggtggaatgtatattttattagtttcctgagaaaagagtcattgtaggcaacttttgggatacctagtatgtttgaaaatgtttttattccttcataccggactgatactttgaaaatagattatattttttctccctttggaatttttaaggcattgtcccattgtctttcagcttctatttaagttgtttagaagtcccctgccaacctgatccctgatccattgtcaggaacccatttttcctctctgaaacttaggatctgccattttaacctcctgaaatttcacaatcataggctttggggtagggcctggctgggtacccacaatctggaaactcatatcttccagttctaacaaattttcctggattatttctttggtttatttagtttcagtcagtctcttttgttaccctggaacttccactattcagatgctggagttgctggaatgatcctctaattatcttacatttcctttctgtcttttttctttattttggggagaaatagaaacttcctcaagtttatcatctaccccttctattctgtttttgaaatgtgattctatttttaaagtgccttttcctgttgtctggatgttctttttttctttagcatcttctaagcggtttaggttttgttttgttttgtttgagacaggctctcactctgttgcccaggctggagtgcagtggtgtgatctaggctcactgcaacctccacctcccaggttcaagtgatcctcccacctcagcttcctgagtagttgggactatagctgcatgccaccacttctggctagttttttgtttgtttgtttctttggtttctttttgttgttgttgttgttgttgtttggtagagaggaagttttgccatgttgtccaagctggtcttgaactcctgtgctcaagtgatccacctgcctcggcctctcaaagttttggaattataggcatgagccactgtacctgtctagtttgttttttgatggtatatcatctctgatttctctgaggatattaatgatagtgtttcaaattttttgtctctctgtgtaatctctaattttgatctctttcaggtagttcctcaaatgtctatctgtgtttacaagagtggcattgagcacatgagaaagcatgtatgggcagggctggttgactctgagcttccctgttggtcagggtttctcagcttcagtactgttgacattgaaggctggattgtttgttgtgggggggctgtcttgtgcactgtaggttgtttagcagcatccccagccttttccccctagatgccagcagcatccctcctccattgatggcaaacagaaatgtctccagatattgccagatgttctcctggggcaacaccagtcctcacttaccccacccccagttgagaaccactgttgtagggtgatctgttggggtctttttattggggaacctgtagggttagtaggtattggtcttcccccttgggctagtcatataaaccaggaaagaatcttctactcttctgcccgagggattcatcctgggaggcgagtgaaagaagcagagtgttggaggggggtctcaattttctttgtaccgtggccttgtgtgcttcgactgggcctggtgtctcccattcgggaagcctagttctgcccttaccagagaataagtatcatctgcctttcaccaggattggggagcatttatcatgatagggaaggggaaaaggtattaaaaagcaaactcgttccaccctcttgcttgtggctccgcgttcagtccagctgcagaagcaggcgctcttctggttcccatagcttcagaccctcagggaggtctgctgtgcagtccggtgtttaactggcacctcattgctcgctccgaatttggctccgtgggcctgttaagtaagttccacttgtttttttgccttttagcttctaaattttgttattgttatttcttttcctatttcttttgtccttgtggctttatgttttttaaaacaattactgtacatgttagaggattttggagaggtcaaagataaatgcatacgttcagttggctgggacttaactgaagtcttctctttttttatagttagaaacataaatatgaagaacaaagttatagtggtggatattctgttcagggccaggctcctgatgaattaataaagaagttgcttggcatacaggctttgcagcaaagcgagttggatttctgggaggagatttctgtttcatctggatcctggggtcacgtgatcacgttttccttccatacgagagcatgggtttccagtggccaggatctgttgtgtccactagctccagcatccgctgtcttactgttggacagaggtagatagtcactaatattctcattatgcaatttctactttgctagactttgcgtagagtctgtatagaccatgacttttcagttaacatatttttcagataggccaaaacatactccattaggttatagctttctttagttacattgcagtcaccttgattagatttgggtgttttgaagtgtctcagtcatctgaatataaaccgtattacagatgactaataacaattacaaattgattttcattaacttaattttcaaaatgtagccctatctcaaatgcatagagtgtcctactatagaccccataaacacacacacacacacacacacacacacacacacacacacaaaacctgtatatagacatatatctctctaatatattagtatatatatgtatatacaggtatgtgtgtgtgcgcacgtttatatgtctgtgtgtgtgtgtatatatatatacacctttgatatatatgtgtgtgtatatatatatgtgtatatatgtacatatgtatatatacctttgatacaggtatcaaagacattggccaggcaggaagagtacggtgaggggagggtctggacagttttcctaagtgagtagctggtatgtgtgtatggtttggggtggcaagggggcccaggcaagacagagtattccaggccaagaaaagagcacagaaagagtcatgtgggagaagctggggtggatggggaggtgtgggagcagcctatgttcattttggctacagagtagtcgttcatcggagaagccattaaatctaaggtgggaagaggagtttgatgactgcatggccaaccttgaactctgagctacatagtttggacttctaaagggcacggtcttctgaagatgggtgccttgatggagagattaacagagaacatccagtaatacctatttttccatgtagccttttctgtttgtcaagggcagatgtattctctccactctgaatccctgtggcacttagcatcaatggctcttggctcttgtattcatctgtgcctacatttgaggcttccttggacccgtttatcccatttagccctaacaatgacattaagaggtaggtcatactgtctacccctccctctgcaccgcatttttttagtggatgaggaaatagggtcagagatagggaaatgacttgaacaagattacatacatggccagtgagaggccaccctggacctcgggccaggccctctgactccagatctgcattccactgttctcatgacatccccttgctgccagtgtctcactggttgcttaactaagccagtggctctttgaagggagactcacacgatttgattttccaggcagcacataacacaggcccaaacgatggagcacaggctctgacaagactcacttatcggcagcacagggtggggatgagaacagggacctagccggttcctatgcaatttcaccagactgtagggtctatacctctaagtttgaaactccctcatccccactgctgccagcccaactgctccagtgatagttttccaccacttcaccgagagcctgggctcagctgctgccctcactgccctggagaaagagaggaatgacaccacctgtcccgttgctgactctaaggcttttatgagaatacacaaaagagaatagatacttgaaaccactggaatgacagtttatctggtgattttcttataaagttctattgttactagtttcctcctctatctgtactgttgcttctctttgattttgtctcactggctcttgctttgcttcagaaatggcactcctccctagccaggtcctttagagtaggaaatcaagaagttgagctgctagattgtctgaacttcttggaacacagaggatgctagtgtagacatgtgtgcattattgtacagggagccactgaaacctgcctgctgtgtgcaaagtgggccgagaggactccgtggccacatcaaagcccatgtgcatttgactcttttcccttcccagcctttgattttttttgaaaaacgtatttgagatatatcagtttagctattttctcagtattttaataaaatacctgactttagtccttgcctgccatgtaaacctacacacttatttaaaccagcaaaatttctcagtgcgtttgtgctgaagttaatttcacattcagttctcattttctgcctatttattactctgccccaaatctgctgaaactgaatggaaaaggaacactattcggtggacatggttataaattagcagccagcacatgtgttaagtgcctttcataccttagctcatttcttttcccagtgtttaagaggaggctccattagtagtccattttataaataaaagaaacagaaaaggtaagtaacttgtgcccagggccacacagctaggaagcctgactcagagactcaggaggtctgtgtctgaaaccccatgatagactacctggttgaaacaaagaggggttgtgtgggagagggtcctacactcgtggttaggagaattgcattcctgcttcactcctacccacctctccgtgtgactctggacaggtggtgagcttctttgatcctatttcctcatcagtgaggtggcagctgacctatctcctaggctgatggtgaagagtcagtgggtagcctgggttgctgtgaaggcatgagcaggcactcttctgggctgtaaagttacataggctgtagtaatgtcatgaggctatttgttttgtgataggccgggaagagcccccacggggaaccgtctgtagtataaaagggccagagctggtgggaagaagataaagggaagtaatacagaataggcaggggaggggagggcatcaaacccgtgcaaggaggataagctgtgctcagtggtgatggatgcatattgtgaagaattgatgtcaacacatcaactcttggcctccagggacttcttgcagggtaattctgcaagaattttctgaattttcaaagaaatctaggtgagtgtgcatgtgtgcatacacacgcatgtgtgtctgggtacctgtaaggcaagatcatacctttgcacacttgtggacctgtgtgtatttctttcctctttttttctctttttcttaatggagacagggtctccctatgttgcccaggctggtctcaaactgggctcaagggatcctcctgccttggcttcccaaagtgctaggattataggcgtgggccaccacgcccagcccctgtgtgtattttttttaaattgaggtgaaatttacacgacataaatttaaccatttttaagtatataatcaggctggatgcagtagctcatgcctataatcctagcactttgggaggccaaggcaggaggattgcttgagctcaggagttcaagaccagcctaggcaacacagtgagacccccatctctacaaaaaataaaaaattggccagatgtggtagcacgtacctgtagtcccagctacttggaagactgaggcaggaagattgcttaagcccaggagtttgactctgtattgagccacgatcgcaccactgcacaccagcctgggtgacagaatgagatcctgtctcctgtctctaaaagaaaaattaaaaaataaagtatacaatccagtggcatttagtacattcactgtgttgtacaaccaccagctctgccagttccaaaacattttcatctcctcctcagaaattgtgtgtgtttttgaaagggcctgttctgtgcaagcatgtctgtgagggcatcctgatttcgcctgccgggaagccatcctcgtcctcagatggcagattgcactgtatgcgtttatttggccagcagagtggggctcaagtattcacattccacatgggtttgttggtcatggcttaactcctctgtgcactctggctgcctcatctggacatagaggaaggcagcactgcagccttcatctgagtgtagttaccagggtcttctctttgctgcttggctgcgtgttgcctttgtctattaaaaggatgtgtgtaagtatgtatgtcaactggggacttcagcctctgtaggccaagtgttgaaaagggtgagagggctgctctggtagaagtgtcagagctgggatgtctgtacacctccctctccatagctagtcctggagataagtaagagcagattctgggactgagctgtcgcatacaccctggtggtgataacagcaaacacagcaatgggctatgtagagggagccctgaataatctccatgagctgcagagatagggccagtgagtggcaaatccttttatagtgtggaggagaggaggtggggagcagctgcaggagaaggtggggagcagctgcagaaggagaaggtggagcaggagctacgttggacaagccagtgaatactttgctctgattggacaacccagatcatgtgcccaccaaaaaccagcgacttagtgggaggggcaggagtggggaatgaaactcaatgattggcttaatccaaccagggactctctatatagctaagtatggggccagggtccccaggggcatgtgtctgagtgtagaaggggtggtgggtcctgcactgaatcagagttttcgaaagaaggaggaagtaggagaagaatgctggatagacagtcaactgtattctccatacctagataagacaaatgtcaagacaatgcagaaaaagttgtggtgaaaagcagcaggaactaaaatgcttaaagcatcactcagtctgaggctctcctattaagagctcacattcagggaggtgggttggacccattggtgtgccacagaaaaatggccctgctcacaggaggcaatttgacatctggccgaaagtgacatcagcagcctgagaaattaacctgttactggagagaattcaggtatttgatccactttctcaagctttgtagctggtgaaggaggtgcagctagcactgtgcaagctacctgcacaatgactgcagctgacttttctcacttcaccttcccatgagctaccgtcattgattcagcgggaatgtaataagctgcgaccatgagccaggccttgagcaatagtcccctgccctcagggagtcctgatgcagaaggggaagatgcagatcagaagaggcaatcgtattacagtataaacaaacaggatgacaggagaagcttgtggtgccacagaagtgtggagcatggcaatgcttaagctgaactgggggttcagagaagatctgctggatgaagtgatttccagactcaagcctggaagatgagtaggagctcccaggtgaagaaatacggagagagagaagaaacagggaaactcactgggcaggtgactgctttagtgtgtgtatttgtgttaggggttgatcctgagaactttcaggtttctggcttgtgcaccctgattgagtggtgatatcttctagtgagatggtgaatacaggaggagttgcagttttgattgggaagaaatgaatttagttcagaaatgttgaatttgagatgcttctggttcagctaaaaggaggtacatagtaataagctagttctggaactcagaggcagagacctcctctgaccacctgcttgacatctcaagcttaacacgtcccaaactgtcctcttgagttctctccctatggtgcttctctaccctaccctcagttttcttcatccctctaaaagatgccatatcatctagatatatccagaatatatctagaatccaccatttctctagctgtcaactgctgtcccttagtctaagcttccatcttctctcagctgaattactataataacctctccccttataagcctgactgcctaattcattcttctcaaagtagcctggattatcgttttcaaattttgtgacttttttgcgggggtcgggggctcaccttttaatgactttccattgcaggtgggccctgcagaggggtccaagctgactccctctccagccccacctgtcacctggcctttccctgtggtcttcagtatgtcagggcttttctgccttgggacgtttgcatacattgtcttgttgtctgtctccttaagcggtccctcaggtctcaggttgaacatcacccctgcagagaggtctttcttgcctgcgcagactgaaactcatcttcctggttattctctctcccagaacctggctcttttccttcatagcacctgtcccaatttgcatttatagtcatttttgtcccaatttgttcaatgcctgatttgatacctcaattttatcagacccatctcccatttttataacaaatacttcctttttacttatcctcaaatgaaatctatagataatataacctccctatacatgtaattttaaatcagtataacatcctggcagtgatataaaggagaaataaaaaggaaagtaattcatcataaaactatttatttcagtgttaaattcctaaactcccaaggctgactactccagaaatcataatgaagtaatcaggcctgcacctattaggtaaaatgaccacgaatgcaacagttacaaatattggctaacatagttattttttattagtgactcagatactaacagcaatgtagccagtggcatgtggttttctgtgatggtaagtaaatcctgtgatgtttgttttttctttttcttcttttttttttttctttgagacagggtgtcgttctgtcacccaggctggagtgcagtggcatgatctcagctcactgcagcctcaatctcccaggctcaagtgatcttcccacctcagcctgccaagtagctgggactataggcacacaccatcacacctggctcattttttatttttgtagagatcgtgttttgccatgttgcccacactggtcttgaactcctggactcaagcaatccacctgtctcagcctcgcagagtgctgtgattacaggcataagccactgcacccagcctcctgtgatgtttcaaacaaaataaagttcaatctttctccttcaatgtggactgaaattaccttcctagaaaattcattaaagtctgagggccgtggctcatgcctataatcccaacattttagggggctgaggcaggataattgcttgagcccaggagttcgatactagcccaggcaacagagcaagacccctgtctctacaaaaaaaaaataaaataaaaaaatttctgactagctgggcatggtggcatatgcccgtagtatcaactactcgggaggctgaggtggaggctagagcccaggaggtcaaggctgtagcaatctgtgatcatgctactgcactccagcctgggtgacggagtaaaaccctgctcaaaaaagaaaaagtttaaaatatgcactaaagttatgccaaaaaactttatttttttatatatgcagcaggatcaggtcctagattcatgcgattataaaaggtgttccatggtgagcaggtctatgcaaacctaccttcaaaggccaagggagctgagaggctgaagaaagagactgacaaatccagtttctcagaaagaaatatttaatagagacttagaaacagaaacgatgtctaggtaggccaagagatggtggattctcacaaccaacctccagaaagtatcctttatatagcaagcttttagggtaaagacacaggaagctcatcatccctgacttcctttagaaactcatgaccacggggaggttgtgagggcttatctgtgctactggaccaccttgaattgtaggcgtcaaacattggtcatcatggcagttttacttcaagatggatcactcttgctatgcaacaggctgttttcccacaaaagagtttttcatgtttatgaatgtctagcagtacactcactagtcatgcgggcctggagctggttttcctcatacaggtcattgtggcaccacggctcccacccttaaatgctagcagagtttccccattcattttggcaattgacagcacctcccaaatgtccgaaatgccccccagacatagggtggtactgccctagctgagagccctgtgcctactcctctgctgtcctctacacagaatgagggcagggtctgtgttgtgttcactcgtctatacacagcactcagcacctacttgccagatatttgtggagtgaatgaatgttctatcaacatgaaatttgtgccaaaaagttaggaaaggagtataccacatggaaatgtgaccagacatttaccttctttcagcatgctttaggccagctgacctctgttttagtgcaagagacttgtaattatagctccagacaatatggaatttcagctctaaatcctttacaactggggaagtcacctcaccatgcacagaagaaatagcactggctccgaagttgtggtttgtctttttttggaaagtcaggcttgtctgccaaagagctcgaaacacttgaccagctctctcatttatcttaacatgtgtatttattctcccttcacagatggggaagtgaagcttgcctgagggctgtatttagctaagtcttgatcctctgccttgtggtggtcagcttagataaaatggaatcctaaaacttgatttttatcccgtagtgtgaacctcctcccacattaaatctgctagtagggctgctcacaagggtaagaagtgttagtttgagtgtttttcatcatgtgacgtggcggtcttctagttcagggccctgcttttagagatgaggaagtgccagttcgtcacaacacagttagataatgacaaggccagtcctctagctggtttctttatgctccaccagatgtaaattttctctccgtttcctccagccaacctaaacaggagttacaatcagtcaggtggccaaaaggaaagcacaatggaaaagaagcccaagatctagttctctagctcctaaataattggtatattaattaggaggctgacttattataaatcaaaacatatgaagatgacagtagctaaaagtaagaagctaaacctttaatttcaagaattcttttactaagcgctaatcaggccagtgacatataaataccatttcacaactgaactgaaaattaaaaaagaaaagaaaacaccagatgtttgcaaagtttttgaaaaacagtgacctcttaagaatttatagcacctaaaaaaacctttctcttccccaaaattttctttagtccaagagtgctgggaggtagtaggaagtggtaggcaaattcagtaaactcatcactggtgagttttgaaccaaacttaccaaagtgttttcaaaaaggacccaacccagcttccttgaaaaacagagttatttttaaagaggtaaaaactgatattttcatttcacaaagttaaatataaaatgaactcaaaagtgtcaaaatgactgcacaatagaaatgaggtttcaggccaggcgtggtggctcatgcctgtaatcccagcactttgggaggccaagggaggcggatcacagggtcaagagattgagaccctcctggctaacacggtgaacacccgtttctactaaaaatacaaaaaattagccagccatggtggcaggcacctgtaatcccagctactcaggaggcagaggcatgagaattgcttgaatccgggaggcagaggtggcagtgagccgagattgtgctattgcactctagtctgggctataagagtgagacttcatctcaaaaaataaaaaaaaaaaaagaaatgaggtttcataggctactctgaccaagcattaccatagacatgttgtgatatataagttagatgtaggagaaaacagttgcattctcagaagctggcttcatgacatgtgtcctctggacttctgtgtagcaccctttgaagggtggagggtttcaagagctcgatgcctgttttggacttctcgctagaaacagatgttgtagatgaagattactactgtgtgccttggaagtgacacagagaattgctactgcacagaccacaaagccaccacttttcagggatattcttacttagttgtcatatgttttatgtctctcttcacgtagtcagaagctgctttagatttgggaaggctggggcttatctgttaccccttgttctaggttgtttctcattctaggttgttacagaggaaaactctagtaggttttgataaatgactatttcttacatcaaagtactatcctgcattatttgggattgtaatacattcctatagtactttatggtcttcaaagcatttgtcactgataagtctcccgtttttcagacagagaaactaaggccctaaggaataagggactggactaaagtcgcattcctagcatgttggatacgttcaagttctctccattctgtaaggaccaactcaagtgcctcttccaagaggtcttttcttagtgtcccctcattactactttttatatttaccacattctaacttgtaatatcatgttcacatacatcttatctaccttaccatgaacttcctaagatcgaaagctgttatgcatttgtgtgtatctcctcacctatcagaattgttcttcttgggtgctaacctgatgcacgttcccacaccagcctgcagtttcctcttctaggctgtggcttggaggtctgcaaggcgctggagtggtgtccaggcacattgtgggcactgctgcacattcaagtgcattgccttatttttaacatatagatacttaatgagagagctttgtaaatgtttataaggtgttttacaaatagatgttatttgaatctcatccttccctcctttatttattgcagttagcactgttctgggcacatagtaggtgcttagtaatgtttgttaagcatttctatattcacttgctccagcttacacttttattccctcctattgttgtatatgactgtctttttatatgtttatatcttgaattcccaactaaactgcaagctccagagggctatagtctcaataaatctttgctgattgcttttaaataatacatgatagcataccagctaacaaagcatggcacaaggtaaatcgtccaatgtgagtgtttttatttaagaaatgttttggatatgtattttaaaatagacatacacatcccaaaaacatatattttaaacagagatcactaaggtaggagggaacacccaggtccacatgaaggggacaaagaatagtgcagaagtaaggctcatgggcactgctggctgagctgcacacagaaaggggtctccagctgatggccattggctacatttctctgtggcattggaagagcttttgtttcctctcagagcgcatttctttagttttttgtttgcagattcttatcaggtggtaagtgtgtgtttttttttttttttttttttttttttgagacagggtctcactctgtcacccaggcatgttcatggctcactgcaggcccaacctcttgagctcaactgatccacccacctgagcctcctgagtagctgggactgcaggcatgtgccaccatgcccagctaatttttgtatttttagtagagacaggatttcaccacattgggaagactggtcttgaactcctggactcaagcaatctccccacctcggcctcccaaagtgctgggattacaggtgtgagccaccgcacctggccatgtgtgatatttttaaagtaaggttgtcattatcacatatcgaggactcttcaacaagggacagcctgaacactaagctgccagaacacacttaaaaacttgatacttctggtacttagccaattggtaagaagctaaagagtctgccatgcagtccaacagccatgctgactaaactcaccagttctttcattgttttgatgttgaacagctgtctttaatacacttttctgtactcctgagaatgttctagttaccatgctgaaatgtttaaatacctacattttaaaattagaactaaaatataatgggtttgttaattaggaggacactggagagttggctgtgagaagttgtgactttgataagtcgatcttttaaaagtaagggcagttgctctacatttgacttctttgtgttctcaaatttaaaatatatggctgaagatgaaagattctgcacacctccacttattcattcccaaatcccacatttcatattaaattcacacaggatactatgtgatgcatatgaaccattttatatgatgcagggtacagtatgcacaggggataatttattttctaaatttgctattattagacttctaattactcagctggatagaagcagaaaggtctcattcttgtactaactgccgattttttttttttttttgagacggagtttagctctgttgcccaggctgtagtgcagtggtacaatctctgctcactgcagcctccacctcctgggttcaagtgattctcctgcctcagccttccgaatagctgggattacaggtgtgcaccaccacggccagataatttttgtatttttagtagagatggtgtttcaccacattggccaggctgatcttggactcctgacctcaagagtcccacctcggcctcccaaagtgctgggattacaggtgtgggccatcatgcccggccactaactgccaattatttagccagagatgacaggcagaaggaattcattttagattgttcagacttaagaagtaacatttctttccaaggaggtctaaacatatgtgtgttttattttttaatagccccagttcttcacattttaattaatcaaacaaaacctgcaatttaagaaatatctagaaatgattggtccaattgtcctcctttgtgctcacgtctctcatggaggaaagtcaggattcactgtggttatgaaaggaatctgtacaatatatttaccttctgtaaaatacttggattaatattgttaagcatctctagggaacatggcattcaattagtttttatttcttgtcatctctcactagagaaagagcgcacacttctgtttccctgaggaggtaaacttgcttgaaaagtaaaatttccattaaaatctctaatttggctttcttaaatataaatctatttttgttacattttaaatagtcttaaggctaagtgactaatgagtacagtaataatatatcattctcttttattcatctgaaaattatactgtctcgagagacctgagttttgtgtgttttgattttatttcttactaaaagacttctctgtgattggagggagctgcaaagctgaggcaagtgtgggactcaggggaccctgcgtggatttgcagaggaataagagacttggtttcccatgggatagagaatttatgtttaagcattgaaagagttcttcgatgtgcgaggtgttatgcggagtgctttagttgcactatttcatttattcctcataatcctaagggatagtatccccattcctatttctgtgaaaattggaaatctaaatatggatgaggagtgctttttaatgagaacaccccatttcccggccatgacaactgcatgtttgctcagaagtgtggagttgctgggtgggatgctaagatgacatactgtttcttttttttttttttcttttatggacttgcagtttgaaacaggcagtagagcccagaaagtacatataaggcactcaattgtactgtttaacacaagctgatttttaaaaagttaaattttcaagaagtcttcctctagtaactgtctgggggtataacgtgtttcatacccaccctatttgatctcttcattgtgaatttcttaacaccagggcactgctttaatcaaaaccatttagaggcgttcactttaaaaaataaaagttgcagaagattgggggtggcatttcccctgtcgtcatgtgatagcgaacacctgagaaatcttttaatgcccacagctctagattataggtgtgcccttcaaaagcatcacagaaaaacaaaagggttacccaccagtcaagggtttgggacattaacatgctttagttgaaagttatattatgaaaaatgtcagaaaaatgcatgaaaggaaaattgttccatgagggaaatactactgctgaaactccaagtggaagatgatgtttttaatattcccttagttccacatttgtgtagttctgtagtgaaacgagtcatttaagaggggaggtggcccaggctaaaaataaagtttctttgaaaccagatgagagtctagctatgccaaaaatggaatccggactctgttcactctcgagaatgtaaataagtagaattttgtgtcacataaaatagtctatgcaaaaaaggatattcactgccttttgtgatagagactaaaataaccatcaggagtatagctgttctggggactctgaagcaacagtgtaaaatgatatggtagtctaacgtattctgatttagaaagatgtccaagacaaagaaagtgcagaacaacaagtactgcatgatttcattttatgtacagatgtatgaatatgtgcagttactggtatattcatgcatagaaaaagaactggaagaataaacatgaaaatattaagtagagggaatgaaagttggagagtaaaggaggattttggtgggtttactgtgtatgtttctctttaaatcttcacacacacacacacacacacacacacacacacacacacacacaattaataaaactatagaaacaaggaaagcaaagcttgaaggtctcagtgaagctgtatagtggttaagagtatagactctggagtaaaaactgccaggatttgaatctcagctccttgacttactggctacacatccttacgcaagtaatttaacttctgtgcttcagtttactcaaatgaaagtcaggattaagggtacttgtgtcatattgttgttacaaggattaaataagtaatccatgagagagcatatagactagtgcctgacacatagtaaatatttagcatgtattaattattataaattataatacttaggcaatgtctagctatattcaattctttgtgcaaactttttagttaaaaatgtttttagtgacagcgttagtgatcataatgtatttttccaaagttttcattgtcattgttaatgatattgtcatttttttttacctcatgggtgttcagaacttcacaaagaagaataacaaaaacagagttatctgattttacttagagtgccatacattccactagtggagtactcctgaatttgcatctttgaccatgtaatctaatgtacatattactagtaaacaatagaaatgtaaatacataatgaggcttttctttgttcctcaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcaggtatgtctggtttgattttctgcattttagaataagctctttggtctgtcgtagaggctgctctcagacaaacagtcccaaagctgagcaaatgatgtaagtgtttaatctcagctgcaagttaatgagttctatcatatttttggaaaaaattgtgccaaaagaaagcaattattttcctggtttttaaaaattaagttcttttgtttaatctttttttggtatgtgggaattaagtgggattacatgctttgatttttctttaaagatttgtaatattatgggacattattgacctttcttaattagattgatctccgagatgaccccaaaactttagcaagactgaatgatatgaaagaaaaacctatatgtgtggaacaaggacagaaactagcaaaagaggtaatggaacactcacagaatttaagcatgaatgtaaaagatgctaagataacaatagaagctaattttattgtgtatttactgtgtgccaggtggagtgctttacatgcattatctcatttaatccttgcatgaactcagtgaggtaggtctgtttcccctgttacacagaagagacagtggaggctgggagatgtcagataattcgcccaagatcctgcaggtaataaatggcagagttgggtttcagtccaaagcctgactcctgggccgagactcttacacctttgctacattgccagtgatattttcctaaaaagtcacatatggaaaaaagcatcggaaacacgtgtcactactttcaacccttcttcattacttaaacagttgcactgtgccaaatcagctctgtcttaagactcattgagttagacagtggagccacctaggatgacagtttaaatttgtggttaaaaccaaaaaatgatgactaggtttgaaaagaaatgtgttgaaatttctccaatctttttatgaaaagaggatagaaaatacaaaaattctaaaaatatatgtaacagtgatgcatgcaataccttgtagcttatcttccttcgtgccccaaagataggtttactttttccccttttttcccatttggccttaacattattggattctattttttaaatgttgtgatttcaataggacttttgtggaaacagaatccatatatggtctttttttttttttttttttttgagacggagtcccactctgtggcccaggttggagtgcagtgacgggatctcagctcactgcaagctctgcctcccgtgttcatgccattctcctgcctcagcctcccaagtagctgggactacaggtgcctgccaccacacccggctattttttttttttttttttttttttcatttttagtggagatggggttttaccatgttagccaggatggtctcgacctcctggcctcatgatctgcccacctcatcctcccaaagtgctaggattacaggcatgagccaccgcgcccggcccatatatagtcttttaaaatgtagtatcaggaggcaaaagaaagcaagaaaactttctggaggacagtttttcctaaagcaaaaaataaatggctttactaacaaatcacttcagaaattccatgtattcagttttgtaatcttggggagagaaggaatttctaaatgtcataaagataaaagccataaatgaaaatattaatgatttcactgcataaaaacttaataccacatcaaatgccagaaataaaatgaaaagtcatataacctgagatggatggcagaaaaatgggttaacatccttagtatacaggaacctcttgcatatgagttaatcagaagcagccacagataccaatagaaaaatgggctaacaatgaaaaattcaccccccaaaatgcagattgccattgaagataggaaatatgttcaaacttattagtagtcaaatgtaagctcaatttgcacctatagaattggcaaaaaatgagaaattaattataatacccgtgtagtaaaatggacactctgttgtactattggtcattgaatcaaagcagtcttgacagtatgcaaaatccttaaaatcatggacacttttgatcaagcaattccatatgtaagagtttatcctaagcaaatcattaggatgttggtcaaagtgtacagtgttaggaggaatacattttttgagataacactgcacaacatggtaactacagttaataatggtggtgctgggcacggtggctcacacctgtaatccccgcaccttggaaggctgaggtgggtggatcgtttgagcccaggaattcgagaccagcctgggcaacatggtgaaaccccatctctaccaaaaaaaaaaaaaaaaaaaaaaaaaaaaaaaaaaaaattagctgagcatgatggtgcatacctgtagtcccagctacttggggggctgaggaaggaggatcacttgagcccaggaggtggaggttgcagtgagccgagatagtgccattgcactccagcctggatgacagagtgagaccctgtctcaaaataaatgaataaataaataatggtggactgcgtatttccaaattgctaaaagagtaaattttaaatgttctcaccacacaaaatgataagtatttaaggtgatagatgttaattatgttgatttaatcatttcactcgtgtgtgtgtgtgtatatgtatatatagagagaaaatattgctttgtaccttatataaaattataatttgtccatttataatatttaataataaaagtaaattattagggacgtacttagagctacaaagatgctgaattgtttataatggcaaaaattccctgcatctattaaaacttcatactatctgttaagatttcatatttattatgtagctaaagggaaaaaagtagttgcaaaacagtatgatctcatttctagactcatcagcatttggcacagttgcgtccttcctgaaactttcttcagttggactctcttggtttttctcccctctcattggactctgctccatctctttacctccttggtccctggttggagggccccagtgatgagcactcagctttgtggatgtcttcttctatagctacactccctaggcctaaatgagcttctgtcagtcttgtagcttgcacagtctacaaccaaagattcctggatttccatctccagcctggacctctttcctaaattctcaatttggttatccagctgtttactcaacaagtccatctacatggctgagtatctcaaaattaacatgtctaagatatgattcttcttttaccctccaagcctgtcctcccagttactcaggtcagaagccctcagctgggtgcagtggctcacacctgtaatcccagcactttgggagcccgaggcgggcagaattacctgaggttgggagttggagaccaccctgaccaacatggagaaaccccatctctactaatacaaaattagctgggtgtggtggcacatgcctgtaatcccagctagtcaggaatctgaggcagaaccgcttgaacccagaaggcagaggttgtgatgagccaagatcgaaccatagtactccagcctgggcaacaagagtgaaactgtctcaaaaaaaaaaaaaagccctgaagtcgtacttgaccttgctctttctcccataccacacatctagccttcggcacaacataccttcagaacatatccagaatccagacacttttttctaactcttccctctatcacctggttcagacctcctccatctctggcctgctttactggaatagcttccaactcacctttctgcttctgtctatgccccatggtcatctgttctcaacacagcagccagagtaagtcttaaaaatgtaagcgcaatcatgtcactgctctgctcagaatcctccagtgggtccccagctcagactaaacgccaaagtccgcacagtggcctacaagcctctgttccctctctgccttactcattgttccccaggcctcctggtctcctttgttgttccctcaaagttctacctgagaacctttgtacttttgttgttccctctgcctggaatgttcttccctatggacatgattcattctttcactcttttcaggtctctgctcaaataccacatcctcagtgtgatcttgttccttgactgctccaggcatgctcctgcatcaggatctatctgcctggagctcttcccctaggtatccctcactgctcaaacttccccattgagaagcctccccggacccccactaccattgtcctcagcactccccgcctccctcactctgctttttccccacagcatttgcaaccatctgctctgtattccctcccctgtgcctcttacccagcagatgtcagcacatgtggacgccacacagcagggactctgctctttcgttcagttcactgacatatccccaggacctaaacagtgcttgacatatagtagatacccagtaaatatgtggtgagtgaaataatttttcatagaaagtctggaaggacatatactagtattttaaaatcccctctggggttatgaacatggatgatgaatgtattctttttgcatagctgtattttataattttctttataatgatgtgtttatgtcatgccaattgtataaacatgatcttatatatttgtgattttttttctccctcccagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgc

SEQ ID NO: 491 - DNA, 68116 bp, Homo sapiens
aggagaagcgcgcttttttccctggcgggggatttggctagaaggctgggccggcagcggttgtgaggagttagctcgcggcattgcaggctctgagaggaggggacccggttcccgggtgagtgtccaggcatgccagcggaacggcccgcgggcagcggcggtgagtgaggaaaaccttttgggcgcgggtggcagcctgcggggctgaggtgggcaagcatggaggctgcggcggagtttcggggagggagccgaccccgggcagggactgaggaggaaaggagggttgggaaactgcaacggtgagtggaggacaccccggaatcgcacgtattagcatgccggtgaagatttcacataggcaactgcattttcccgagcatcccgagttgtaaactgtggtccaggcgacttgtagacattgtgaagacttacggtgtcttctgagaggtgatgctggcgtcccctcggtcttcagcttttgctccagtgcatctcgggtgggagaaaggctgtttcttgttggagttgagtagttggtaatttttttaaaactgcaatttgaaagctttctcccccgtcaggctcggaggctccagcaatggttgaacaactggacactgctgtgattaccccggccatgctagaagaggaagaacagcttgaagctgctggactagagagagagcggaagatgctggaaaaggtaatttaggcatcaggttcgtcgtcgtgaaagcctgtggtaacctcggctttaacccggaggtgtggtttgtgttctttgctttcctatttagtgggctttttaataactgaaagaaaacagctttattacttgtcttttttgtatgtttacagatattgcctttgagaatcctttcgcaagtgctttgaatggtgtgtttctatgagatgtagtcttggtagtcccatcacttttaaatgagcatttcagattgcttgtttagccatgaaaagtctttcaaagtccatagtgagttttttcgtttgtcatccttatttcctttaaaaattaccttaaatgtatgtctcatggcaaacaggaatcgctaaaacctgcagaagtaatgtactagactgagggcaggagaagttagcatcaatcaaaggctgggctggaatccaagtctaatgatttccttatactgtagtgctgttttccacctaagtgatcaacttgctgtttgtttttcttttggtttcatggcctgtgtattgctacataagattctttagctaaaaatgtgccgtactttttcaatgacaagttgctgtagttttcttgtagagagcattttgtaagttactaaaaacagtttttaacctgaaaaattcttgtttattctaaagccccaccctgctgcttgattcatatgcaagaaaaagaatgatcgttgactcttaagtactgcctagtacgtggttttcttgtgctttattaatttattaaactctaccgatattatgatataggttattttttgttattttcatttacaaatgaagaaactgagggagaagggcacatagtaagtgttgaagtcaaatttcaactcaggctgcctgcagaatttctgtccttaataatagtgaattaactcatgattataaaactacttaagttggaaaataatgcattccaaaaacgagtaatgaggccgttggttccctgttatgtcaacaataatttttttgtcagcattgttaatacttcttgaacatttattaggagtcatgcattgttttgaatgctttatatgtatttactcattgaatcctcaactattctgtaaagtagatgttcattattactattactgctattaaacttactagtttaattactagtataaacaattgctattattgaactacacaaccaaataggttttattagtcatcttattttacagatgaggaaactgaggcacatagaggttgtttgggtgccacagttggtaaatggcagagctaacattccagtgtaggccatgtggttctagaatgcacattttttaactaccatgctatagttccactccagtaatactccttccgttattactgatgatctctggttgactataaccagttaaggtaatatattaacaaattttctttaagtaacatcaatactttttgcttcagggtagatgtgaattaacagaattgagaggtctgacctgaaccaccttttctcattctttgaattttcatagtactttattacacagaatttaccatgaccaaataagtaatgataaatacttcatactactttttgattctttctcactttgtttcttgagggtgcatcacttgctgttttgtttttgtaggctttgcacctggcacatagtaggcaatcagtaagtgcttattgaatagctaacgatgataaaatggtattttataatatacaagattatatacatatactaaatatacttattagctatataaccagatgaattataaagtataaattctggggcaagtgcccagaatggaatcaactgaagaagtctaagagggatgtgataattttgtcttgagtaatgtatcttcagttttatcttgtttcttcatatacccattatgagtgttgggtagggaaatagcatttaaagaaagatatgcctgagatatgacaacagtacattttcagaaggtattattcattcaaggaagaaacacttcacatttaaaaaagataagtcaaatatgtagtattttatatatttgctgaggtcaaatgacctgctacttttaatgacatttttaagcttatgaacaaacattttgcagttagtcctaaatttaataattatgcatcatagaacctaaagagtaatttttaatccttccattaaaaaagtatatggctgttttcatggcctggcatggtggctcacgcttgtaatcccagcactttgggaggccgaggcgggtggatcacctgaggtcaggagttcgagaccagtttggccaacatggtgaaaccccgtctctactaaaaatataaaaattagccagatgtggtggcgcatacctgcagtcccaactactcaggaggctgaggcaggagaattgcttgaacccaggaggcagaggttgcagtgagccgagatggcatcactgcactccagcctgggtgacagagcaagattccgtctcaaaaaaaaaagtatgtagccgttttcaatcttaatataagtgtgtaatttgctaaaacattagtgttgtggtttcgtattacattgtcttgttatgtacagataaggaaagtttttgattattttttgcactggaccctcataaaaagtgattgcctagatgacactagaaaattctaagaaaagttttcagagtctctacctacttgagattaataaacatgtctttggaggccaaacaattaactatgcacaggtagagattccttttcttttgggagaatacagtctgtatgggcatgtatttagaagtacttaacagaggaagagctagcttaagttccttaatgagaagcatttggctttaggaaatcctaaggtttgtgaggaacctagaaaatgactttgacattcattggctacagttattttctttgacttttcacatgtatttccctttaaaagaagtcattgttagtctaggagatttgagtactgatagtgcctgtgaagtggaggagggggaatagttggagtcaggagatttcttggagaggtaaaaggatcatgatatgtgtaggctaaaatagaactcctcccaccccccaataaaaaatctgggattggtgttgggagagataatggggtagataatgaggaatttctgccctcggtgtccattggcatactctgtactgtagttacccagagttgtttcctgccaggcactcagtgcttttaatagatggagttgcaatttaccgtaatataatcatgaaattgataaataaagaaaaaacagtgataggaagatttgaaatacagaagaccaggtttaaggattaaccacttacatggtattattttaatattaattgtatattatttttttccatgatggcatcttaaagctttagtgatttttatttttatttttatttttttgagacagagtttcactcttgttgcccaggctagagtgcaatggcgcagtctcggctcactgcaacctctgcctccggggttcaagcaattctcctgcctcagcctcctgagtagttgggattacaggcatgtgccgccaagcctggctaattttgtatttttagtagagatggggtttctccatgttggtcaggctggtctcgaactcccaacctcaggtgatccgcccgtcttgacctcctaaagtgctgggattacaggcattagccaccatgcccagctgatttttttttttaggaaaaatttttccaggagcaccaggcaagtatttaggttttttttgcttgtttgtttgttttgagacggagtctccctctgtcacccaggctggagtgcagtggcgtgatcttggctcactgcgaccttcacctgccgggtttaagcgattcttctgcctcagcctcccaagtagctaggactacaggcgcgtgccaccacgcccagctaattttttttgtatttttagtaaagacggggtttcaacatattggccggcctggtctcaaactcctgacatcgtgatctgccttcctcgacctcccaaagtgccaggattacaggcgtgagccaccatgcctggctgtatttagttgttttaaaaatatgtgctggccaggcgcggtggctcatgcctgtaatcccagcactttgggaggctgaggcggggcagatcgcttgagcccaggggttaagaccagcctgggtaacagggtgaaaccccatctctacaaaaaattaaaaaactagccggcatggtggcacgcgcctatagtcctagctactcaagagggtgaggcaggaggattatcgcttgagcctgggaggcgcaggttgcattgagccgagatctcaccactgcactccagcctgggtgatagagcgagaccctgtctcagaaaaaagaaaaagtgctaattctgtacaggatttaaggtatcaactatatctaagttaaacccacgttattttaactgaacttaaattttaaaagttaaaaatttaagaatccatatattgtgtaagtaattttcatctccctgttttcatattcacctcagtagttgcgtattgtaaccacagtagtatactggtaatagtaaaagaaattctgtcctaaaagaactgaaaattgagttcaagatattaagaattatctgtgtaggtgggattatgggtgatttatatattttttgacatttagtttttctgtaatgagtatgcattacttttgttaggtccattcttagaatcttactgtagtcactgattttataatagaaatatattttgatgccgggtacggtggctcacacctataatcccagcactttgggaggctgaggcaggtggaccacgaggtcagttcaagagcagcctggccaagatggtgaaagcccgtctctactaaaaatacaaaaattagcggggtgtggtggcaggtgcctctagtcccagctatactggggaggctgaggcaggtaattgcttgaacccgggaggcggaggcagaggtgagccaggattgtgccactgcactccagcctgggcaacagagtgagactccatctcaaaaaagaaaaagaaatatattttgaaagaaagctatagtgatgatgtaatagctaggaaaatgtaaggcaatataaaatgatatcttagagatattgataagctggagcagcaaaactacccaagtgctagggcattatttagagtataaaaatgaattcatacccccatttcttttcttttttttttttgagatggagtctcgctctgttgcccaggctgaagtgcagtggcgcgatctcggctcactgcaagctctgccttccgggttcacgccattctcctgcctcagcctcccaagtagctgggactacaggcgcctgcaaccacacgcggctaattttttgtatttttagtagagacagggtttcaccgtgttagccaggacagtctcaatctcctgacctcgggatccgcccgcctcagcctcccaaagtgctgggattacaggcgtgagccaccgcgcccagcctcatatcccccatttcaaacacgctgtaaacaatgctcaattactttcctcttaagttgaaaccaccaattactggggaaaggggcagttagattttattggttgactttgtgtttttactaatccttgttgaaaagtagaggaattggtttagttgagaaaacaaaatactaaaaaatctgccactagactttttaagtcaagagtttgtataaaatgaaacatatctactatctaatctataaaatttagaatctttttaattctaaagttaacttaagtgtgatttttagtgctgttgctgaggccagtgttgcttaaagcaggaacttctacagtaattgacaaaacttgagtttttctgctctcatttatccatccttcagacccctcagatgtcatctatttcctgaaatctgacttctccagttttagtaattcttacaatttttcaggatttagatagtactgtacagtttactgctatgtatatgtctttaatacttgttgttttcagatattacactaatgtctcatctgtagtataaatcagactttctgtcttctaccagttacataatttatataattgttgcagtacatgtttgttgatttactaggctggattcatgttacagaattggtaatcttggttgggcatggtggcacatgcctgtaatcccagtactttgggaggacaaggcagacgaatctcttgagtttaggagttggagacctgccttagcaatatggtgaaaccctgtctttacaaaaaaaaaaaatacaaaaaattaacagggcatggtggcatctgcctagagtcccagctacttgggaggctgaggtgggagggtggtttgagcccgggatttggaggctgcagtaagccacaattgcaccaattacagcatgagaccatgccttaaaaaacggggtgggggtgttaatcttggctagatgtctgttttgattgttaggatgaattgtgttggtagtatttttctaaaatgttctatccaaatcaacttgtttattaatctcaaatagggagagactctgaaaacttgtcttagaattctctagtgtcacctaggcaatcactttttatgagggtcaagtgcaaaattaatcaaaaattttccttatctgtacataacaaggtaatataataacacggaaccacaacatcaatgttttagcaaattacacatacctttttttttttttccggacggagtctcactctgtcacccaggctggagtgcagtggtgccatctcagctcactgcaacctccgcttcccgggtttaagcaattctcctgcctcagcctcctgagtagctgggactacaggcatgcgccaccacgtcctgctaatttttatagttttagtagagatggggtttcaccattttggccaggatggtctcaaactcctgacctcaggtgatccaccctcctcggcctcccaaagtgctgggattacaggcgtgagccaccgtgcctggccccaatttttttttttttttttttggtacggagttttgctcttgtttggagtgcagtggcatgatctcggctcactgcagcctctgcctcccccgggttcaagcgattctcctgcctcagcctcccaagtagctgggattacaggcatgcaccaccacgcctggctaattttgtatttttagtagagatggggtttctccatgttggtccggctggtctcgaacccccgacctcaggtgatccgcctgctttggcctcccaaagtgctgggattacaggtgtgagtcaccgcacccggccttcaattgttttttaaatggaccttccaactcagtagtgccagaaaccatgtgttcaatatttgaaattataatattttgatatacgaattgcatctatcagattgcctgttaaacccaaaaactattttttttttaacagttatttgttccagtttttggtttgaaagtgtttggtttaaaaaatgttattttagccatttttattaaactttatgccaaaaaaattaaggtatgtcagaaagtgttcataattatggaaattttctctttggataggctcgcatgtcttgggatagagagtcgacagaaattcggtaccgtagacttcaacatttgcttgaaaaaagcaatatatactccaaatttttattgacgaaaatggaacagcaacaattagaggtatgtatatgtaactgactacaagtgaaagcttaaaaaaatttaaaaatagctttattgaagtgtatattatatacagtaaaatggacagattttaagtgtacggtttgctgagttttgactagtaaatatatagatctgtgtaaccaccagcacaatcaagatacagtgcacttccatgaactccaaaaaattgtcttgtgctgacagtaatccccatggctggtgtccagcaactactgatttgctttctgtcactatagaccagtattgttttttcctagaaaattgtataaatgaaatcatggtattgtgctagtgagtaaatagttggtcttcatcaccatttcctggtatacaactcttgaaatccttggaatcttcaaagtaatagtgtttttttttttgtttttttttttttaatgctaatgatcaatggctagctgcccttaggtagcttcaggatgggagcctaagaaagacaaaacctggattagagggttgggatttagcctcaccctcaactttgaggaaaagagactgaaagttaacttgttcaccagtggtcacgattgaatcaatcacgtctatgttatgaggtcttcattaaaaacccaaaagggctgggtgtggctcacatctgtaatcccagcactttggggagcctaggtgggtggattgcttgagcccagaagtttgagaccaggctgggtaatatggcaaaaccctatctctaatagaaaaattagctaggtaaggtggcatgtgcctctagtcccagctacttgggaggctgaggcaggaggttggcttgagccaaggagattgaggctgcagtgaactgtgatggcaccactgcattctagcctgggtgacagagcaagaccctgtctcaaaaataaaacaggctgggcgcagtggctcacgcctgtaatcccagcactttgggaggccaaggcagacagatcacttgagcccaggagttcgacaccagcctgagtaacatagtgaaaacccgtctctaccaaaaatataaaaattagccggtcatggtggtgtgtgcctgtaagcccagctactcagaaggctgaggcaggaggatcgcttgaacccaggaggcggaggttgcagtgagccgagattgcacccctggactccagcctggatgacagagtgagaccctgcctcaaaaataaataaataaaaaaaaccccaaaaggggacagggtttggagaacttctggatagctgaacacatggaggttcctggagaggatggcgcatccagaaaaggcatggaagctctgcgcttctttctccataccttgttctatacatctctttctctggtgttcctctgaatatgttgtaatctttctttctttctttcttttttttggagacagagtcttactctgttgcccaggctggtgtgcagtgcaccatctcagctcactgcaacctctgactcctgggttcaagcagccctcccacctcggcctcccgagtagctgggactacaggagcacaccattatgtctgtcttatttttgtattttttgtagagacagttttgccatgttgccgaggcttgtctggaactcctgggctcaagtgatctgcttaccctggcctcccaaagtgctgggattacaggggtgagccactgcgcctggactgtcatattctttataataaaccaataaactttaatgtttctttgagttctgtaagctcctctagcaaattagtcaaacccaaagaggggcttgtgggaaccctgatttatagctattcagtaagaagcacaggtaaggcgacttgggccttgcgattggcatctggaactggtagttaaaagtcttggggactgaaccctcaacctatggggtatggtgctttcaccccgtagatagtgtcagaattgaattacaatagaggacacccagctggtgtcactgcagaaatgcttgtttggtgtatagggaaaacccccacacattgggtcacagaagtcttttgtgttgattgttgagtgtgtagggagaaactgagtttgtttttttctcaatattcttgcacatatgcactctttgtcttgttacttttgctcagtgtatttttgagattcattcatgtcatgtttttctgtaggttattttttttattcctgagaaggattccattaagaaatgtcgttattggggtgtaattgacatacactaaactgcacatatttaaaatgtacaattccctaagtttgatatatggatatacttgtgaagacataacaatcatgatagtggacatacccactgattccaaaaaattctttctgcttatttataattcttctcgcccgtccctaccccatgttctatccacagatagccaattgatctgttttctgttattataggttcatttgcattttctgttggtgatgggttcttttagctttcatatgtctgaatgtcttcacttaccttcatttttgaaatacgtttttactgggtaaagaattttttttctttagtactttatttcttggagtactttaaagatgtttcactgtctcctagcttatgttgtttctgaaaagtgaaagtcctgataatgtctatatgtctgtaagcaatttgactgcctccctcaatcccattacctttcagacctgtctccagatgtgtttcctgtcttgggcttttgcccttgctattttatgcctggaaccttcttcctctaaataactgcatggcttaacttcatcttcaagccctgacttaaatggtttctagatgagacctgccctcacaattttaagaaagttgctaacacacctgattctctttaccttgttctgttcttcccattgcacttttcatctgatatacatcatttattgtatttattgtttgtctttccactagactgttatgaagatttaaaaacttgtgcaaattgagagaatacagtaagtcccggtgtccccatcacccacatttaaaaattatcaatttaaattttgctgtatttgtcaaatctcctttttcctttgtttgaaacccttttattacttttttatggtaaagtaaaacaaatggaaaaacaaatattcaacttaatgagttacacagcatctacccctttcatcacctcttggaaatggtttgaatttttggtgtctttaaaaaatttgtaagagtatgtctagaatagcttttagtctaggaataagttgatcccttttctgagcactctacttgatgccctttatattaagaggactttctactttggctgagagaatgtgaggtataccttattatgcctgaccccttggaacatgagaggttccacctgcttctttctggtgactcttctcctggccttggttaccatgcacttaccagtactcagcctgagagagagataacagctgcctttgtgcagctttgtcctctctggtacttgaccctgggaatgctactgctcttaagttttggattctgtctcctcaacacaaagagactgttgggctctgtttggatttttctccattatttgtactttaaaattgtatcaggcagtaagctgggcagtcagaagattaaccttgtttccgttttgtcagtgtttacagtccgttactgcatgttgtctgaaaaccattgtttaataaattttatctggattttagttgtttaaggcaggaggctaaatctgtcccattagtccataaaggcttgaagtacaagttcctccctggtttttaattatgatagaccttagtttctcattgtaaacataagttatttgagaattgatatgcgttttttttttaaatgttgcactttccacttgtgacataagaaaaaattgtcttacaggaacagaagaagaaagaaaaattggagagaaaaaaggagtctttaaaagttaaaaaggtaatatagccagccggaatattttttatgtcatttaaatattgaagaaatacttttgtattcttctgacttttttgatcatctgtttaattttaagtttctttagtgataaacctaactttgttacaagcaatgcagaaacatgtaaaatctgttcctcactatttaagaaatggagaaagagccaaagtatggtccactttagtttcttattctatggattattttggacgttggcaaaatttgactttcttaattggaaagaatctgcaaatttaaacttcaaggcattttgtaagtggccaccttctttgaaacctgtaatgaagttttgctagtgaaaagagaaataatttattgaatacatactgtgggtcaggtgtgctatcatgtcttctcttactctattttttttttcttttttgagacggggactcgctctgtcacccaggctggagtgcagtggcgcaatctcggctcactgcaagctctgcctcccgggttcacgccattctcctgtctcagcctcccgagtagctgggactacaggcgcccgccaccatgcctggctaattttttgtattttcagtagagacagagttttactgtgttagccacgatggtctccatctcctgaccttgtgatctgcccacctcggcctcccaaagtgctcagattacaggcatgagccaccacgcccagcctgttttcccttactctcacaacagttctttttaggtagaggtacttttttcccccattttacataaataggctgatgcaaggagataaagaacaatcatattcaaggattctatatttgtgaattcgcctactcacttacatttatttgtaaccccagagtcaagattcctgacaccgtcatggtcatttttggatatgcttatgttcagagcagcaaagaattttagtcctccaatacatatgttccaagctcagctcaaacatgggttgctgttctttgttttctgctaccatatgtatgtcaagcatatatccttttcatggtctttatttagcaccataacttttgcgtttttttgtgctttttcatggtgattttgctgttaaaatggcccccaactattgtaccaaagtgctgtctagtgtttctaagtacaaaaaggctgtgccatatggagaaagtatgtcttgggtaagcttcattgaggcatgaggtacagtgctgttggccctgagttcgatatttatttatttattttattttattttattttatttttttgagacagagtcttgctctgtcgcccaggctggagtgcagtggtgcaatcttagctcactgctacctccacctcctgggttcaagcaattcttctgcctcagcctcccgagtagctgggactacaggtgcgcgccaccatgcctggctaatttttgtatttttagtagagacagggtttcaccatattgggtgggctggtttcgaattcctgacctcatgatccacccgcctcagcctcccaaagtgctaggattacaggcgagagccactgcacccagctggccctgagttcaatattaatcaacatatatattaaataagatatctttaaaaacagaaacacaaataaaacagggttgtgtatcgtttggttgaaaatgtcataaccagagtcagagacccaagcttgtatttttcctaggggcaataagtcaatagtcatagtgattttatcgaaccacaagtactgcagataatgagagctgactctaatttgctgaaaattacggatttgaacccaggattagtttaagagcttctacttagcttctgtgctaaactgccttttatttatttattttttttttgagacggagtctcgttctgtcacccaggctgggatgcagtggcgtgatttcggctcactgcaacctctgtctcctgggttgaagcaattctctgcctcagcctcccaagtagctgggattacaagcacctgccagcacacccggctaatttttgtatttttagaagagacagggtttcaccatcttggccaggctggtcttgaactcctgatcttgtgatccacttgccttggccacccaaagtgctgagattaagtccagttatttgattcttagactagttaatggtgatgttaaaatgcctgataaagtattttgcagactgttttgcaacaaaacccattatttaaaactggtaatactgctaggtgtggtggctcacgcctataatcccaacactttgggaggctgaggcagatggattccttgaggcaaggagttcgagaccagcctggtcaacatgatgagaccctgtctctgctaaaaatacaaaaaattagctgggcgtggtggtgtgtgcctgtagtcccagctgcttgggaggttgaggcacgagtattacttgaaccacggtaggcagaggttgcagtgggccaagattgcatcaccgcactctagtctgggccacagagggagactctgttcctaaataaataaataaataaatacataaaactggtaatactgagtcactgagagagagagtattaaaaaataaaaatgggccaggcacggtggctcacgcctgcaatcccagcactttgggaggccaaggtgggccgatcatctgaggtcaagagctggagaccaacctggccaacatggtgaaacccagtctctactaaaaatacaaaaattagccaggcatgatggcgggtacctgtaatcccagctactcgggaggctgacacaggagaattgcttgaacctaggaggccgaggttgcagtgagctgagatcatgctactggactccagcctgggtgacagagcaagactctgtctcaaaaaaaaaaacaaaaaaacaaaaaaaaaaccctctgatccttgactcacttgctaatttcagagacttacctagggcttttcagatttttattttcatagagacagagcttcactatgttgcccaggctggtctcgaaccccttggcttaagctatcccccacacccacacccataccttggcctctgaaagtgctgggattacaggcatgagctagcacaactggccttacctaggggttttgaagaacatgtttttatttatatgacaattttactggcttagtcatttattccctgctctttaacctgttaatttaatatatccttcactttattccacctaactttttataccagggttttgatttttttcccctctgcttttttcataagggcgtcaactattttgaaacttaaaaaatttttttagaggtgatgtctcagtagcccaggctagagtccagtagcaccatagtagctcactacagctttgaactcctggggtcaagccatcttcccacctcagcctcctgagtagctgagactacaggtgcacaccaccatgctcagctaattttcgcattttttatagaggtggggatcttgctttgttgcccaagctggtcttgtactcctggcttcaagcaatcctactacctagtcctcctaaagtgctgggattataggtgtgagccactgcacctggccagaaactgtttcttaacatctcatttctcttaccttcctcactaataattttccattagtattctcttttatttctgctttgggttatatttaatgtatgaatttcattcacaatgaatattccttcaataccctacctattgaagggtattccttcaataccctaccctacaaaaatacctatttttgtatttttagtagagacagggtttcaccatgttagccaggatggtcgtgatctcctgacctcatgatctgcccgcctctgcctcccaaagtgctgggattacaggcttgagccaccgcgcccggccaagatgtacatggtatttctaaataaaaatgccaactatgggctgggtgcagtggctcaacgcctgtaatcccagcacttggggaggcctaggcgggcggatcacctgaggtcagaaattcaagactagctggccaacgtggtgaaaccccatctctactaaaaatacaaaaattagccgggcgtggtggcaggtgcctgtaatccccactactctggaggctgaagcaggggaatctcttgaacctggcaggcggaggttgcaatgagccgagattgtaccagtgcacactatcctgggcgacaagagtgaaactccgtctccaaaaaacaaacaaacgaaatgccaactatgtttaattttgaaatttctcttctaaatggaaaaaaatggacagaagtagagcccttgggaaaaagcagagattatgaacaagttatagtagggaaatacagaaaaatattacatgtaggtaagtataatagtgaaaaattgtggatgtggctcaattgcaggaaacatattttttctcaagttaatcagtgccttttaacgtataatactatgaaggtccttaataaaatcaatattctgaatccttgttttgtagggtaaaaattcaattgatgcaagtgaagagaagccaggtaaatatccttattctagttttgaagaatatgcgtttatatttctattttaattgctatcaaaaataaaatttttttttatagttatgaggaaaaaaagaggaagagaagatgaatcatacaatatttcagaggtcatgtcaaaagaggtaaaaataaaagggagagggcacctaacatttgatgttgagtaaaatgtaggttttaaaccaccttaaatctgtaaagattgaatattcaatatcacatgaaatatgttttgaatttaatattatatatcatttataggtgaagctgccaaaatgtttgaagctatctaccaacctacagtagacttgagactaatctgaaactaatgtcatctgaccttcatagacttttttttttttttgagatggagctctgtggtccatgctgccttgcagtgtcactatatctgctcactgcaacctccacctcgcgggttcaagcgattctcctgtctcagcctcccaagtagctgggataacaggtgccaaccaccacgcctggccaatttttgtattttcagtagagatggggtttcaccatgttggccaggctggtcttgaactcctgacttaaggtgatccgcccgcctcggtctcctaaaatgccacattacaggcgtgagccattgcgcccatcctcacttaagtggcaaataggcttacacctttaggttgttctggttttcttttctttctttcgtttccttcctttctagcttccttcttttttttcttcttttctttttttgaggcagggtatcactctgtgactcaagctggagtgcagtggcacaatcatggctcactgcagcctcgacctcatgggctcaagtgatcctcctacctcagccccctgagtagctgggactacaggtgtgtgacaccatgcacagctggctaatttttaaattttttgtagcaatgagatgtcatatgttgcctaggctgctcttgaactcctgggttcaaatgatctttttgcttcagcctcccaaactgctgagagtacaagtgtgagccagtgtgcccagctttttgttggttttcttttcttttttttttttttttgatgagacggagatttacccttgctgcccaggctggaatgcaatggtgcgatctaggcttaccgcatcctccgcttcccaggttcaagcaattctcctgcctcagcctcctgagtagctgggattacaggcatgtgccaccacacccggctaattttgtatttttagtggagatggggtttcagtgtgttgcccaggctgatcttgaactcctgacctcaggggatccacccgccttggcctccaaaagtgctgggattacaggcgtgagccactgcacccggcctttgctggttttcttatttgggttattacagataacagtaatagctttgactctacctattatcttgtgcttgttaagtacctagtggacttgtatagcattttgcaaggaactgtggaaacaacaggcatgggcatagagcttaaaattacatatatgttgcggagagttggggggaaagggtagggtagtaaagacactgtctgaccagagcagataagtatttcagggaaaaagatggtaccagctctttgttaaacgagtctgagcctggcctagtcagaaattgtcactataatttaactttttgtaacccctaaccttgtcttaagaactttattcttgttttttgttgaagacttttacgaaactgaaatcatatgctcttttctaaaaccagcttctttttttcatttctcactttttacttaaaaatatgaatgaattagagcatcttcagttctgacaaaccagttccttagcatgtttttaatgtgtcacattcttcctttttttttcttggagacagtcttgctctgtccctcaggctggagtgcagtggcgcgatctcggctcactgctacaagctccacctcccatattcaagcgattcttatgtctcagcttctgagaagctgggattacaggtacctatttgtatttttagtagagacagggttttgccatgttggccaggatggtcttgaactactgacctcaggtgatcctcacgcctttatctcccaaagtgctgcgattacaggcatgaggcaccactcctggccacattcttatatttaaaaaaaaaagcacaactctattgtctactgttgttcttttacctgaagttcaaactctagctcttcagaagaaaaatttacataatagttttccttttctctagggatgcaatgatagtttttcactgaaaaataatcgtcagggggccgggagcagtggctcacgcctgtaatcccagcattttgggaggctgaggcgggtggatcccgtgaggccaggagttcgaaacctgtctggccaacatggtgaaaccccgtctctactaaaaatataaaaattagctgggaatggtggcttgcgcctgtagtcctagctactcaggaggctgaggcaggagaatcacgaacctgggaggcagaggttgcagtgagctgagatgatgccactgcactccagcctgggcagcagagcaagactctgtctcaaaaaaaacaaagttagggtccactgaaattcattatggtatctattcaacttgcagtttaaaacacttttaggctgggcgtggtggctcatacctgtaaaccccggcgctttgggaggccaaggtgggaggatcacctgatgtcaagagttcgaggccagcctgaccagcatggagaaaccccatctctactaaaaatacaaaattagctgggcttggtggcacatgcctgtaattccagctacttgggcaggctgaggcaggagaattgcttgaaccccggaggcggaggttgcagtgagctgagatggcaccattgcactccagcctgggcaacaagagtgaaattccatctcaaaaaagaaaaaccacttttaatatgccatactgaagtttagccagtcatacagctgtttatttaatttgttaaatggttgtggaatatcggttttgggcaaactttgtcataggtggatgaaatccattagtaaagaaaggtaaatgctgtcttcaccttagcctgcatacagagagagatataggagtaagtagtcaatgaaattgaatttttttttttttgagacagtgtttctattaccctggctcgaatgcagctggcacaatctcagctcactgcagcctcaacctcccagactcaagtgatcctcgtatctcacactccccagtagcagggactacatgcctgtgccaccaggcctggctgatttttgtattttttgtagagatggggttttgtcatgttgtctaggctggcctcgaatttttgggctcctgcctcggcctcccagagtactgggattacaggtctgagccactgtgtccggttgggaattggatgtttatacaccatattagaggggctcttcactctggcatgcagttcctgaaccttttcatctatgaaaaggaaatgatatctgtgttgtgacttgaaggataaaagttaaattatttaaaggtgggattaatagggaaagagtaaagtacaggtaagatagtgggggaggtgttttaggaagaaataatagcattgaacaaatatccagggtcaagagagactggcagtttcaaaaaacttgaagtaaattatatttgcctccaatttgtatataagtgaaaagagtgatgaaggaaggatgaagctgtcgatgtaagcatggtcaggagtttaaggctgccataagtaaagtaggaagctattgaaagattttaagcaaatttccattttggtaaatcacttggctagtttattcagagatctgtgggcatagtagtttttctttctttctttttcttttctttttttttttttaagacagagtttcactgtgtggcccaggctggagtgcagtggtgatctcggctcactgcaacctccgtctcccagttcaagcaattctttcacctcagctccctgagtagtccagcgcctgggactacaggcacgtgccaccacgcctggctgtttttgtattttttcatagagaggtggtttcaccatcttggccaggctggtctcaaactcctgacccgaagtgatctgcttgcctctgccttccaaagtgctgggattacaggtgtgagccaccatgcctggtcccataccagttattctttcatttactgttacttctttcttctgtatatttactgaatttcctgctctcttttcctcttcgcctaactaaattctttccattgtttcattctcaccttacttgctgaagaatctctaaatctgtgaatgcatttggaggggtataacccaattgagtgttctgccactgtggaccctgctcctccaagttatcccttctgtttcttcaccttttccttcctcactgggtctttgcctttcaattatagatacattgtgttttcctgtctgcagaacaaaaatttttgatccagtctttctagattgccctgttttttattctttatttccaaggttttttttgagacacagttttgctcttgttgcccaggctggagtgcaatggcgccatctcggctcattgcaacctccggctcccaggttcaagcgattctcctgcctcagccttccgagtagctaggattacaggcatgtgccaccacgcctggcaaattttgtatttttagtagagacggggtttctccatgttggtcaggctggtctcgaactcccgatctcaggtgatccacccaccttggcccccaaagtgctgagattacaggcatgagccactgcaccggcctatttccaagctttttaagagtaggctggactggacatgatgcctgacacctgttatcccagcactttgggaggccagggtgagaggatcacttaagcccaggagtttaagactagtttgggcaacatggcgaaatcctgtctctacaaaaagaaatacagaaatagccaggtgtggtggtgcatgactttggtcccagctacacaggaggctgaggtgagaggatcacctgagcctggggaggtgaaggctgcagtgaggtgagattgcgccactgcactgcagcatgggcaagagaatgaaaccctggttttttttttttttttttttttggagagagagtctcgctctgtcgccaggctggaatgcagtgctgcgatcttgactcactgcaacctccgcctcccgggttcaagtgattctcctgcctcagcatcctgagtagctgggactacaggcacacgtcaccacgcccagctaatttttgtatttttagtagagatggagtttcaccattttggcctggatggtctagatctcttgaccttgtgatccatctgccttggcctcccaaagggctgggattacaggcgtgagccaccgcgcctggcccttttttttttttttttaaagagtagcctgtgcatatttccttacacattatgcagttgagcagttttacgcctaccagttgaatttattggtatctttgaaattgatacctagcacaaagcaaacaatttatcttttcctctcttccgaatcttgctcttttgttttctctttttttggtgttaatatcagaaccagtatctactgtgtcatctaaaacaatttaggaggttatctgaatttccttatatatctagatttttatcgatttctgtgagtcatttcatttgctgctactctggtgtttatgcccttactgtgccctatttatagtagtttcttaattgatttttataatcctagtctagctctcattgtcaagagtaccagattggtttttctgaaactcaaatataattactcataacctccattactttttatggtttcacaaggaattgcattttcttgtagaaaaatttgagaataaacaaaatacaaggaaatcacctgaaaagctgtcacacagataatcactaacattttggtatatgtatgttctttttctttgtattacggaaaatctcaaaaattacaaatgtttagaggatagtaaattgaatgtccacctttatcactttttttttttttgagatagagtttcactcttgttgcccaggctggagtgcagtggcatgatcttggctcacagcaacatccgcctctcaggttcaagcgattctcctgcctcatcctcccgagtagctgggattacaggcatgtgccatcatgctcggctaatttttagttttatcagagatggggtttctccatgttggtcaggctggtcttgaactcctgacctcaggtgacccgcccgcctcggcctcccaaagtgctgggattagaggcataagccaccacgcccagccaatcgctttttaattctgggatattttaacaaaaagctcagcaagactttttttttttcttaaggtggagtctcgcactgtcacctgggctggagtgcagtggcatgatctcggctcactacaacctttgcctcttgggttcaagtgagtctcctgtctcagcctcccaagtagctgggattacaagtgcccaccaccacgcccagctaattttttgtatttttagtagagacagggtttcaccatgttggccaggctggtctcaaactcctgaccttgtgatttgcctgacttggcctcccaaagtgctgggattacaggcttgagccaccatgcccggccaagactattttttagaaccataaccacaatacagttaccacacttttgaaagtcgatgggaattccttaatatttaaatttctcaataggctaatttttatttttagggatgggggcttgctgtattgacgagactggagtgcagtggctattcctgagtattgtcatagtgactacacctcaaacacctgggctcacatgatcctcctgcctcagtgtcccgagtagtagtgcagggactataggcacttaccgctgtgatctgcttagctcatacattttaaaaaaatagttggttcaaatcaggatccgaaaaagttacataaattgtgtttgattaatgcgtatcttgggtctcttttagatctagagtgtctctcatcttttttaagaaacattatttgttgaagaaaatgagtaattctgtataattccccacattctagactttactgattgtatccccatgatttctctgcctcttgtgtttcctgttaactatagtaactataagttaaatacggaagtttgtgattaaggtgtttttttatttttttttttatttttatttttttttgggagacaagatctttctctgttgcccagggtggagtgcagtggtgccatctcggctcattgaacctctgattgctgggctcaagcaatcctcccacctcatcctcctgagtagctgggactacaggcgtgtaccaccaagcccagccaacatttatattttttgtagagatgggatctcaccatgttgcccatgcttgatttttaataagaatacttcattggtggtatttatagattttgatttatttccaaattgttctttcaaaagtttcattttatctagtcattttacaggacagcttttatcagttcctggtataaaatccttttagcctcagccttataatatgaatatctatacatacataatacttcatacacacacgatatacatatattcccatgtatatatatgtgtgtgtgtcagccacttacatgtcctgttactcttctatgaatcttaaatttgatattgctgttttgaatctacttcatcccctatgccttctatattctctctgcttgaaatctaccctcactatcttgaatgatgaagcctggtgacaactttttagataattttatgtaagataattatttgctaagtcatccagtgacatactcgggtattgtttgtctccctaccagcagcatctagtaggtacttcaaaatcagagcactttattctgtatttttaattttttctgtctttgcctcttacccaggaatgcaaactcagatgtctatccacagaggcctaaagtgggctgtaacatggtttggcaaactttttctgtaaatagccagatagtaaatatttttagcttttgagtagttttgtgggcaactactcaaccctgtactctgctgttgttgcttgaaagcagccatagacaaaccgtaaacaagtgaggctgactttgttccaatttatcccatttctttgcttttaaaaaaatacctgtgtattcgcttagctggagttggtctacaggctgtagtttgctgaccccaggactagaggtttgttgccatgtgtgaatttgtacttaatctactcagattaaaagaaagaaaagctggaaaatcactgtatttgatgaaatatcccattgtataagtgttcccaaattagcctagaatgttatgaaatattatgagccagtaatgtctataggcttatttctgcctgaaggctactagttttatcttgagaatctcatcctcatttcctggcaaaatgagcacagaataaatgcttgttgaataaataaataaatgaacttcatacattattaatttgtttttgttttctcaaactactaggaaattttgtctgtggctaaaaaaaataaaaaggagaatgaggtaagaaatttataatgtaagattaagtttagaagtcatatttactcctcagttactagtcctttttctttaatcagcagtatacgttcttctcactattatcctgtttctttgctttaaaaaaaaatacctatgtattcacttcttccatatccaacattcttcttttttatgtatcaactttagttagttgttttattgcatgattcttgatgtataaatgttaatttatgggtctagcaatgttgcttttaacttgtgaatctggcagtgatacaagtgctcgtaaccatgtggatataaaccgtgaatcatcttatggaagctgtgagggatgccttaatcttgcttcagaccttaaagattttttaagtttcttaaaagttctgtttgagaaggcttgatttccgagccacctcttcacttagcccatttcatgtagagaggttccttgttatctgactttttattgttcaagtacttaaaattacaaggttgcctagggaagcaaaataatcatgacatgaaaatattcatgaatggatatgaacttcaggtagttaatttacatattaaagatttttaggcctttgggaaattaatgttatgtttataaaatgagagataatctatttggtcatataattttgtccaaaatttatattgtaaaagtgtcttggtttttattctttgttaagttattaaggactggtttatgggtgcagtttagttggatttttaaagatttagttagataaacatttagttggatttttaagataaagtctagatgtaatcttctgtaatttactatgggattttggcttcattttataacttacagtcagtaagaaatagttgttaagtatggtattttaatgaatttcgacacttgcatacacttgtgtaaccaccatccaaatcaaggtatagaacatttccattgtaaagggatctcttctatgtctttccacccccaaacccagaggaggccactttttacaccttttataggatggcttattatttcctttccactcaacatgtctgtgatactcatttatgttgttgagcatattagtaaccggtttcttcttattgactagtattctgttgaatgaatgttacaattttctcatccatccccttattgatgggcatttgggttgtttgcagtttgtgacttttatgagtaaggttgctatgataatttgcacacaagtccatgtgtagacatgttttcatactttctgcctgtgtacctgggaatggtattgttgtgttacgtggcaaatgtgtgttcataagaaagtacagattttcccccccaaagtaaacacatcattttattctctcgccagcaatgtttgaaaactccagcttacattattgtcagcatttgatagtctttttaatttcagccattttattagatgagaaatggtaacttgtgtggtttttaacttgcattttcctaattactactgaagtagagtatatttttatgttctttgataactatgttttctttctttttttttcttttttgagatggagtgtcactctgtcgcccaggctggagtgcaatggcacgatctcggctcactgtaaactctgcctcccaggttcaagcgattctcctgcctcagcctcccaagtagctgggacaacaggctcatgccaccatgttcagctaatttttgtatttttagtagagacagtgtgtcaccattttggccaggatggttttgatcacttgacctcatgatctgcctgccttggcctcccaaaatgctgggattacaggcgtgagccaccatgcccggcctgtatgttttcttttgtaaagtatctgttaatatcttttgcccgtcttatttatgcgtactgtattttctgtgtaacagtttaataaattattgagtatcacaatattagaagtttggaagagagatacaattctaatgatcttttcaaaagtatgtgcctgattttaatttgtaagggttattctcagatttttatattttattttattttattttattttattttttgagatggagtcttctgtcacccaggctggagtgcagtggctgtgttcatggctcactgcagccttgacttcctgggtttaagtgatcctcagcctcccgagtagctgggatacaggcagttgcgtgcaaccacacccagctaattttttgtatttttagtagacacagggtttcgccatgttgtccagggttgtcttggatacctggactcaggtgatcctcctgcctcagcttcccaaagtgctgtgattgtaggattagccactgtggcagcctgttatttttttttttagtagcttttcatttgtagagggatggcgatgtctccagttttttaatccaggtgtgatcttagtcttctatacttaatgattataggactcagtagattttgttagttgcattttctgataaatggtggcatacagcagcattttgtataacacatcttattaaactttttttctctacaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttagggtaatgaattggaatttttaatacaagatactggttttatttctatagtagcctaatgatttgaggtaccacaacttgagtcatttctatcatgtttcactattatacatttgtatgtggatacttgctttctgatttctttaccctgaatttttagaagtagaaattaccttgttaatggcttccagcacttttatggctttgataaaggactttccagtgttgttataatttatggtgtgaatatatcagctttaacataattctcatctttgggtgtgattttttaaagagaagaaataaaatattgtaatcctgtagttgtttatatccaagtttaaatacagtatctattattttgtccagatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatgtaagacatgcttccttatgttaaaattataattttacatgttttcttatgctttgttgtagtaggaattaaattgtagaactcttataattatattggtttctgtataaatattttgtctgatttgacttactcaatctgcacaataccctaatttaaatttatatagtataggttttggaaatccctgacatctttcctaaaatattcctgaatgattttcagtgcattggtaatttgattcgactgagacagacttaggtagagattttattaaaaattctgcttgttcttcacttgatctttgccaaaaggctaagaagagagttttctgttttttctgtacttgttaccttctgcaatttttttttttttttttttttttgaaatggagtctctgttacccaggctggagggcagtgatgcagtcttggttcactgcaatctctgcctcccatgatgaagcaattcttgtgcctgagccaccggagtagctgggattacaagcatgtgccaccatgcccagctaattttatgtttttagtagagacgatgtcttgccatgttggccaggctggtcttgaactcctggcctgaagagatctgcccactttggcctctcaaagtactgggattatagacgtgagccactgtacctcccgggcccagcccttctgcacatttttgccttatgagaaatatatatattctagacgtagtatcaccatctgtctcattttatatatttatatatatattatttatttatttattttgaaatggagtctgtctctgtcaccatgctggagtgtagtagctgggactacaggcgcacaccacaaggccaggctaattttttgtattttggtagagacaggatttcaccatgttggccaagatggcctctatctcctgaccttgtgatccgcccaccttggcctcccacagtggtgggattacaggtgtgagccactgcgcccagcctatatgtgttttatgtatttgtaggttttttgttggggggggggttgtgtttgtgtgtgtgtgtgtgtgtgtgtgtgtgtgtgtgtgtgtgtgtatgacagagtttcactgttgttgcccaggctggagtgcaatggcacgatctcggctcagtgcaacctccgcctcccgggttcaagcgattctcctgtctcagcctcccaggtagctgggattacgggcgtgcgccaccacgcctggctaattttgtatttttagtagtgacggggtttctccatgttggtcaggctggtctggaactcccgacctcaggtggtctgcccgcctcagcttcccaaagtgctggggattacaggtatgagccatcccacctggcccgtctatttgtttttatgcctttttttttgtcttcagacaggatgttgctctgttgctcaggctggagtgcagtggcgtcattctggctcactgtggccttcacctcccaggctcatgtgagcctgctatctcacacgcctgagtagctcatgtgaacctcccatctcactccactgggtgagtagctggcactacgggtgcgtaccaccacaccagctaatttttgtattttttgtagagatgggatttctccatgttgctcaggttgatctcgaactactggactttagagatcggcttgccttggcttcccaaagtgttgagattataggtgtgagccattgtgctgggcctgactttgtttttttgtttgtttttttttcattttctcccataatagttcaatgatttgttagaattgcttggcttattttgctatagaaaaatagaaataaaattttttaaaattatattttttccctcagaatgatttatattttctaaatagtcaatatttacattttgttcttaagtctgataaaaatcaatataaaatttttcagatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacaggtacaaatgatcttcattggtttctttgtaatacataaaacatgcttttcttcatttatatcactttctcaccatctgggagcatttgtctaatttttttttgttgtcgaaataatagattatattgtgcatatacctgtagaagctggaaacttttattaacagaatgattgggatgaaggccatcatttgtaacaatataattaaagcttatggcagtttaacctatggcttagaatcatccagaaatagacctaatctcggaatgtattacagatatatttgtgacaggtactttgaatatatggaatttacttatcgtattttaatcaaataagagtatttgaagacaagttatttttagagtatcttattggactatttggtagcattttcgtttctattttcttgatgttctagctacttatttaaataatttccagttagcataacagaattgaaagattgaccttttttctttcatgccttctgttttcatttattggtgttttgaacttcttcctcactgctctacctcattcatttataattcttgactgctttttttttcctttctctggccatgtgagaaccctcttagtgcagtccccttaggtttatcttgcttgcttggaaataggaaagtatttaatggtttcaacataaaatcaaaacacataagtcataaatagaataattatgacttgcataattatgaccagtattgtcaggttttatgtgtctgctggtaaaactttggaatatgatttgcagaaatctcagttcaggagtttagcaaagtttatgaatgtgtacagcattaaaaagtatttaaaccaggccgggcatgaaggcttatgccagtaattccagcacttgggagtctgaggtgggcagatcccttgaggccaggagttccagaccagcctggccaacatgacgaaaccctgtctccactaaaaatacaaaaattaggccggacgcggtggctcacgcctgtaatcccagcactttgggaggccgaggcgggtggatcatgaggtcaggatatcgagaccatcctggctaacaaggtgaaaccccgtctctactaaaaattacaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggccgacagagcgagactccgtctcaaaaaaaaaaaaaaaaaaaaaaaaaaatacaaaaattagctgggtgtgatggtgcacatgtttaatggcacaaggattgcttaaacccaggaggtggaggttgcagtgagctgtgattgcgccactgcactctagcctgtgctacagtgagagtctgtctcaaaaagaaaaaaaaatttaaaccagtagtccccaaccttttggcaccaggaaccggttttgtggaagacaagttttccatggaccatgggtgggggatggtttcagaatgattcaaatgcattataattattgtgcactttatttttattattataaaattgtcatatataatgaaataatagggctggccgtagtggctcacccctgtaatcccagcactttgggaagcttaggcgggcagatcacttgaggtgaggagtttgagaccatcctggccaagatggtggccaacatggtgaaaccacatctctacaaaaatacaaaaattacctgggcatagtggcctagctccttgggaggctgaggcaggataattgcttgaacccgggaggcggatgttgcagtgagccgagatcatgccgcttggttggctgggcaaccaagtgagactgtgtctcaaaataataataattttacaactcaacataacgtagaatcagtggtagccctgagcttgttttccatctagggatgatgggagacagtgacaaatcatccaccattagatttttataaggagcgcacaacccagacaacccagatcccttggatgtgcagttcacaatagtgttcatgctcctatgagaatataatgtctcctgatctgacgggaggcagagctcaggccataatgtgagcagtggggagtggctgtaaatacagatgaagcttcccttttctgtaaatacagacgaggcttccctcgctcacagctgcttacctcctgctgtgtggcctggttcctaacatgccatggacccctacaggtctgtgacctgggggttggggacccctgatttaaagcatttctttacagtaaaagtaatatataccaattttttttaaagggtagtgtacaggaagatgtaaaagcacctgtaattctacctgagaactactacttttttctttttttttttttttttgaggcagagtcttgctctgttgcccaggctggagttcagtggcgcgatcttagctcactgcaagctccacctcccaggttcacaccattctcctgcctcagcctgccgagtagttgggactacaggtgcccacaaccatgcccggctaatttttttgtatttctagtagagatggggtttctctgtgttagccaggatggtctcgatctcctgccctcgtgatccgcccgcctcagcctcccagagaactactacttttatactaaataattatagctaacatgtaggtataatttacacatatgatcatactatacattcaatttttttttttttggtccgagacagggtctcactttgtcacccaggctggagtcctgtggcacgatctcagctcactgtagcctgaatctcctgggctcaagtgattctcctacctctgtctcctgagtagccgggactacaggcgtccgtcatcacacctgactgattcttgtatttttttgtaggaacagggtgtctcaagccatccaactgtctaggcctcccaaagtgctgggagtacaggtgtgagccaccacttccagcctgcattcacttttgcaacttgtgttttctactcagtagtataacatgaagacccttcctgtaatgaaatagttaagcttccttgtccatttcctttgccagtggctagaaacttttgactttttccatttaagtgagcttatattatcatttcaaggatcttagcttactctggtaacggagtgtgaggttccagggcttttgttgctgagtgcgagtggaagtgactgagttcacttgctaatttggctttcagattcctcatcatttatttccttgttttcttttctctcacatacccattataaaagtatatatatatatatatatatatatatatatatatatatatatatacacacacacacacacacacacatttttttttttttttttttgagacagtctcactctgtcacccaggctggagtgcagtggcacgatctcggcttactgcaacctgtctcccgggctcaagcaattctcctgcctcgcctcctgagtagctgggattacaggcatgtgccactacgtccagctaatttttgtatttttagtagagacggggtttcaccaagttggccaggctggtctcaaactcctgacctcaggtaatgcgtctgcctcggcctcccaaagtgctgggattacaggcctgagccactgcgcccggccaaggatattttatatttttatctggatttttagatagctgtcttacagtgagagataattcaggttttttggtttaacatattgccaggaaaataaatcctttcttggttattttaataaagaagatacagtactataaacttttttcattcttttgggatgtataaagcaaaatgcaaaacgttctctatactctttcctcaatttgtcagtcccattttttaaggatagttatatttttcagattgttatttatatttccagaaatacttcatatttctgtatgttaatataaattagattaattataaattttcctgattaagatatatgagaaatcacagatattaaaatgagaaagttaaaacaatttccttgataactttatgaaagtgagtgggtgactttctgtgaaaatataaattgcttaaataagggaaaattctagtgctatttgatgtttcagcacatatggaactaataaaagctcaatttttagtagtctagtgtaacattaatatcaaaacttgggaaaatattagaaaagaaagctacaactgcgttgactaaggtgtgaatagggaaatcttaaattcaaaataggtggagttcaaactttattgcatattttagtaggtctcttccaggaacagaaatatctatcagttttaggaatccttgtaagtggatcaaatgaaaacatgatcatttcagtagttactgaaattacatttgataaaattcaacatccatccctcataatagaggttttatttttagaattcttgttagaaaaattgtgagatcattgtttaaaaatctttttcctcaattcgttttctagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaaggtgggtaagccagttatttaatgatttaacctcaaaaatctgtgctgttagttaaaattactttcttttcagtgactgaattaaaatgccaaatatttggcaagttctttgtggtgtatattgtatgttctactcctgccacaaattatgtgagagcagattaagaaaagattatttaaaacttacttgcattgattaaaggaagactgctgaatgcaactttaagataatatttttataataaggttcttttatgtgttacctttgtaaaacattttaagatggatttttcttactatatcctcattaaacaaccagggacaatagagttgttaaattatttcctatctcacataaaagaaaacctaggtgtaaagttgttacaagataagactagttagttagcaccagagccaaagttaaaaccaaggtctcccaatgtaaacacagtgttttaattctggaaactgtttgaatcttagcttatataataaaatcagacataaaagtagttttcagaaagtaattagtagcttcagaatggaggaggaggtaatgttgacataatttaaaactgattacaacggaaatataacttgggcaaaaaataatttatacttgttttggcatcagtgaaggaagtaagctaattgggtgtggaaaaataattttaaattttgggaatttatttcaaatctggttaccgaatggtggctcaaggcaggctaccttattgtgactctgggcgcttttattgaaagacaagaattccaggtcctgtgcagacatactgagttacagtgtcaaggtaggagttgagaatctgagttttttgaacatgcttctggtgatccaagtttgggaacttctagtctactgcataaatgttactagcattttccagaattgggtataatgttacctattctatattattaatctgcatgctcatacttaattgctcattgtaatatatatattttcaacattgggaaggaataagcatgtatattattgtcaagttatgtatatgttgaattttaaaatatttattgtagtgggccatacttagactgatggagaaaaatcatatggctttggttttcagagatagttctcacttttgtaatgtaaaattataaatatataccttaatcttatttttgatttttatactactgtacaattgttaatctatttataaatcagaaaagtgttccctttaagctcacagttcttgatggttcaaaaatgcaaccaatttatctttgttgttggaatgtgttctcttccattataaattttaaaaattgcacctaaggatttgatgcaacaataccacgtttcattatcagattattactgtaaatgataaatcatgtatcatgttgacataattgaatttatgtgatggttaacttaaacatttttctcttccagctttgagtcttggtttgacatcactagtctttctgaaactgctgaagatattattgctaaagaaagagaacagaatgtattgcatatgctgcaccaggttttccatgttttcttattctgcttaaccataggctcgatagagtataaaaggaactctggagatcacctgtctaaccctttgtagtagagatttgaaaaatgaagatcctcctacatttaaatgactcctttgtcctttcttctcccagaggtcacatggttttatgacagaactcaagtgcttacctaagttttgtccttttcagatagtatactcattttacccctaatggttactgataagtttgtcaagcacaaaacagaagtatgtggtttttatggaatgcttgccaataatacttttataatttacatccttgcatggctgctgtctaatctatttttattgcttcctgtaattcctaccccatcctacctatctttaatttagagaaacattatctttcaagggtaatctagtcatatgggcctgaaaagcttctcagttgtggtttagcaattttattcaaagtctttatcgttttttctgatattaaagtttatacatgttcatgagaaaaacgtgaagcaggagagaagtgaaaagtaaaaatatcacttcctcttaaaattgtatttcctagcagtgcatgtggaatgattatgttgtgttatatgacaatccaaactcttttctgtctttgtgtaaacacgtgtgttttatctatattttatgaagaaaaggactttaaaaataaaattgttccttaagatagtcttttaaacagttatcagaaaattattttccttttactacatgtagatttaaatcagtttttaatagctgcttattatcccattgtcttgttctactataattaataatatctatctcttcctcttttcaaaattttcaacaatataaacaaggttgtagtatctgtatttaaaactacacctttgcccatttctggctatttccttaggaaagaattcctagaatgtatgtgtcagagtttacagatgagggcttctttgaaggcaaattgccctccagaaaagatttatatgatatacgtccatatgaaaatacttatttactcaagcttcataccaattttgaggttagaagtccttttcagtgttgcagagattaaaaaggatgattattgctgaattgagatgtttattgactattggtagttccttgtggccatattccaacatgtgttggaatatttatttattaatggtttataataactatatgttaaaaataagttaatgttgcaaataatttctttcccctcactttttgggataaactttgtttatggtatctttgtgtgtgttcatgtgcacaagcgtgtgtgtttatatttaaaattttctttttttcccactgtgactctgggcaatgacagaaatttcaatgcaccaatagttatagaagcttttaaatgtcccagtctgaattattggagtaaatgacttatttaggaagagatgtgtttggatatcacatcctcatcagtagtgtatacatccatatagtgtagcaaaggattaagtttctgttcttaggaaatttaattagagtcaagacaatgaatatttatagaatttgtcacttacacgttacctcacagtgtatacaggtagatagatattccttagaaatgatcatctgccttttgattgaacatttgtagtaattgtcatagttgataattccataagagggctcactggaattgttttactatagataacttcagatttccattaatattaagatatgataatgaacttttattatatccaaattcaacagttttatcaaaaataggggcagttttgaatgttctagcaataagaatattctctgtaatactgtgcttaaatttgagtttatattacttttacgctttgtcctaattatgttttaatgcattactacaggaaaaagttttcattcaaaatgaattcagattaggtggagatagttttaaatcgctagtatattttcttaactattttctatatgaaagaattcctttcctttttttatgcaatgtttacataaaccttgcatagtaaaaaaaattttttttactttccgtttaaagttctctaagcttgctacttttctatttccaccccatattgaaggccaaaagcagtataacctttacaaattaattatttaaaattttttattttaaaattatgcgtacacggtaagatatttttaaatgttataaacatttagaaattaaaaagtaagaagtaaaaatttctgttttccttctgcacttcctttcttatctccaaagtataactaatagtttttttgttttgttttttttttttgtttgtttttgtttttttttttgtttttttggttttttttttttgagacagagtctcactctgttgcccaggcctggagtgcagtgagcgtctgcctcccaggttcaagcgattttcctgccttagcctcctgagcagctgggattacaggcgtgtgccaccacacctggctaatttttttgtatttttagtggagacgaggtttcaccatgttggccaggctggtcttaaactcctgacctcaagtgatctgcccgccttggcctcccaaagtgctgggattacaggtgtgagccactgcacctggccaacagatttttttttttttttttagagacaatgtcctactatgacatccaggcaggagagtagtggtgccatcgttggttattgggttgttatctgcagcctccaactcatactcctgggttcaagtgatcctcctgcctcagccttctgagttgctggaaccaaaggtgcatgccaccaggtccagctaatttttggtagatgggtcttgtataagtcttgtttttgtctgctttgaaagcttgtatactaggaaaaacatatataaataccttttttatacatgtgtttcagcggtatagtgtgcctcttcttccacatatttgccatttcagttaacatcaaactatagcatttgtcagtgcatgtggtagaaaaatatctggttatttcatgttttccttacagacatggacatgttttttttaattttatttatttatttttatttttttgagacagaatcttgctctattgcccaggctggagtgccgtggtgcaatctcggctcactgcaagctgcacctcccgggttcacgctattctcctgcctcagcctcccgagtagctgggactacaggcgcctgccactacgcctggctaattttttctattttttagtagagacggagtttcactgtgttagccgggatggtctcgatctcctgacctcgtgatccgcctgccttggcctcccaaagtgctgggattacaggcgtgagccaccgcgcccggccggacatgttttaacatgtttatgaaacatttacatatttttcctgattgcctgtcggcatatttgtttttgggttggtagataccaacactggtaatgtgtttactatctttggtaatagtctgtctatgattagctctatacctgttgggtatttaagtccagagtcctgaaaatgagctttattatatatgattactatatgtaaaccattgtcagtatttaatggcaggggtataaagagtatacaattatttgtttattattattagtagtagtagtagtattttttttgagtcaacgtctctgtcgcccaggctagggtgcagtggcaagatcttggctcactgcaacctctgtctcccaagttcaagccattctcctgcctcagccttccgagtagctgggattctgtaatcccgccaccacgcctgactaaatttttttgtttttttagtagagacgggatttcaccatgttggccaggctagtctcaaacttctgacctcaggtgatctgctcgcctcggcttcccaaactgctgggattacaggtgtgagctactgcgtccgacctagagtatacaatgattttaatctagtatttgtgctcttttagtgacccgaatattttaatgcataattattgtctgttgcttctgtgttctctttataaatgtgataatcatttgtaaccaccccagctaatgaaagagaataattttaagcctgaaactttagaacttatagaaggaaacttgtatgtctgcatccctaggtcagctggctttttactgagtcttaaaacctcattctattaaaaaatttttaatttttaaaaaaacttttagttttttgggtacatagtagatgtatatatttatgaggtatatgttttgatattgatacagaaatgcaatgcataataatcatatcatggagaatggggtatccatcccttcaagcatttgttaccctttgtgttacaaatgatccagttatacacttttgtgtgtgtgtgtgtgtggagacagagtcttgctctgtcacccaggctggagtgcagtggcacaatcctggttcactgcaacctctgccttccaggttcaaacaattctcctgcctcagcctcttgagtagctgggattacaggtacccgccagcacacccagctaatttttgtatttttagtggagatggggtttcaccatgttcaccaggctggtctcaaactcttgacccaggtgattcacccgtcttggcctcccaaagtgctgtgattacaagtgtgagccaccgcacctggcctctagttatactcttctttatattttaaaatgtaaaagttaaattattattgactgtagtcaccctgttgtgctaccaaatattaggtcttattatttctactttttgtactcattatttcaaatatttttaatttttattcatttttattatttccccttttgtatggtgctgataacatctcattctaaaagttgtgggctataactgaaacttcaaccctaagaaatacaaatgctacctttatatttttacttttaaaattatttgagatagattcttacagtttttaaaagaaaataaattctgaaatgctgcggacaactgtgagtttatcatttggtctggtctgggaaaatctcaagatattttcaccttttgagatttggcattatttatataggaagtcaaaagataaggtaaaggagtatatggggacagtattccttgaaaaacaagaatgtttaatactcatatttttctgttcatgttttaattttagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgaggtatagtggttttgaaatgtactgtaaatgaaacttgacatataaaatttctcttttttccctttttttttgagagaaggtgtcgctctgtcacccaggctgtggtgcagtggcacaatcactgctcactgcagcctttacctgcctggctaaattttttgtatttttttgtagagactggcatttcgccatgtttcccaggttggtctcagactcctgggcttaagcagtccacccaccttggcctcccaaagtgctgggattccaggttttagcaattgtgcctggcctaaattccagttttaaggtccccttgttcatttttaggacttgggtgaatttctaactggggtataaggcataaggcttagtggcaaaagttgtttcctagtatctggagtcctgctaaaatgttaagtgataatctttgtattaattgctttacagtcatctggaatacttactaaaaatttaggccaggcacggtggctcatgcctgttatcccagcactttgagaggccgaggcgggtggatcacctgaggtcgggaatttgagaccagtctgaccaacatggagaaaaccctgtctctactaaaaacacaaaattagctaggcgtggtggcgcatgcctgtaatcctagctactcaggaaggctgaggcaggagaatcacttgaacccgggagacggaggttgtggtgagccaagattgtgcctttgcactccagcctgggcagcaagagcgaaactccgtctcaaaaaaaataaataaaaaaaaaatgtatatttccgtacagattaactctaatcatgctttctggagatgaacttggaaatgcatttttaacaagcacacaggtaggtatttgagaatccctgtactaaggacttggcaactagactaatctccagatatacagattgagcatccaaaatctgagttgctccaaaatttgaaactttgagtgctgatatgaaactgaaaggaaatgcttattggagcatttgtattttcccgttagggatgttctacctgtacagtttccttacagaaggttattgataaccaaaaagattaataatcaatttgatgatgattattcatcacccaccatattataggagatagaggtgggatgttattatcatgtaactgaaggagacccttaagttttgtttaactttccaggttttttattgtacactataaacctacgtattttcttttcaaaatatttattgtgatgcatttttaaacaataggaccaccagactcttctccccccgacttttttttttttttttttttttttgagacagagtctcgctgtgttgcccaggctggagtgtagtggcatgatcttggcttactgcaagctccgcctcccgggttcatgccattctcctgcctcagcctcccgagtagctgggactacagtcgcccgccaccacgcttggctaattttttctatttttgagtagagacggggtttcaccatggtagccaggatggtctcgatcttctgaccttgtgatctgcccgcctcggcctccgaaagtgctgggtttacaggcgtgagccaccgtacccggcctcttctccctttttaataattaattataattaaaggaagggtctagccgtttacaaatttacattatttgtctgttaatgagcaatttcataatgagcagtttcatgcagtgttacaccagtctgaagaaatatcctctgtactgcaaatttccggagccatatttcaactttaaggtattaaatccttttgtgtaagttcaaagtagttttatacacccttcatttttacctattgagatatgaaggcccttcctcttactttcagatattgttgtccatgttaaaattaaactaatttcccacaacatttgtatttgtctatagattgtcattttgtacataaaatatgccttattttgtttacatttagaacctaaggacatagctttataaactgaatttcttttaattcgttcccttttagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaaggtttgaattcaaaagtgaatttaagtattctttaaactgtgaccattttttgcatttcccatatatgcattatttgttttggtagagctgttgtggaagtgaatatccctgtagaatctgaagttaatctgaagctgcagaatataatgatgctacttcgtaaatgttgtaatcatccatatttgattgaatatcctatagaccctgttacacaagaatttaaggtgaatactgtttaattctaatttactgttttgatttccattacttttatattggtggaaagtgttactttttttgattataattattaaaaataagtatggtgctatttgtcatgaagattgtaatccttcagtaagctgagacagtcttctttccgaaatttcagagaaccttatcagggttagaaaaatggtcactttctatgagcaactagttttttaaatttttttattttttatagagacagggtcttgctatgtttctcaggctggtctcaaacttcctggtttctcaggcaatcctgcctcagcttcccagagtgctaggattacaggcaagagccaccacgcttggcctctatgcaacttatatttttatttacatattttatgtgaacaactaagaattctaaatttagtaattgatttgtactctgcatgtttacttgttatattttagagagagtggtcatcttttcactatttcttttatcattaatatttggcttatcaaaatcagcctggttgctcattgcttaaagatcaacaggtagccatagaataaaaccagttttgatttggaggttttcaaattaagtaaatgaagttgctttcttgggtagttgatagaatgatagcataatatcaatagaaataaattcttagtaaccctcaatcacagttgtttcaaggtagtttacaataggcttttccactcctggcaatattgacattttgggccagataattctttcttaggaggtaatgttctgtgcacttaggacatttagcagcatccctgtcttctacccattagatgccactagtattcacttccctcagttatgacaactaaaaagtttgctgccgctgccaaatataccctggggataggtggagggcaaaattgtccccatttgagaggcactgctttacatctttattagagtaagaaggaagacaaaactttcccactcaaatgaaagtagctctctcatgagggaatttcaccagaaggtgaaaaagtctttgtccacaatatttagattacttatcagctcctgtattttctcttaatttctggtaagaattctagcagtagtttacatatacatttagttggaaataactcacttataaagaataagcctgagtatgtacccattaagtttgacataattgttttctttcacaatgactttgagagaggagtgttgaggttagatcaaagttatatttgtactttgtttttgtgaaattgctggttttacattctagagtatgtctttgagtaataactatcttctgattttacaaagattgaataacaggtcagtttttaagttttttaagtgacttggctttgaaaattgaactttccaaatggcttttgttttaacaaagcaaataacagttttctctctattttttcttcctttgcccctccttaagatcgatgaagaattggtaacaaattctgggaagttcttgattttggatcgaatgctgccagaactaaaaaaaagaggtcacaaggtggtacttttgattggaattttggattgttcaattatttttttatcaatcattagaaatattaagatatgtttaatttcaggtgctgcttttttcacaaatgacaagcatgttggacattttgatggattactgccatctcagagatttcaacttcagcaggcttgatgggtccatgtcttactcagagagagaaaaaaacgtaagactacttatgtcatacataccaaactattcttttataattcctatcttgatttctgaagtaatattccaaatagacccacaaattgataaaaagatagaaatgaccagaaaccctgtggttttatcaaaaacaaacattttgatttagtactaagaagtcttaatttttgattcacaaatatatatatcttctggcacaatcttattaataatatcctacttaaccatcactgtaagaatattgggatagcaggaaattttttgcctttttgccctgtcctcaactttctattatgaaaatatcaactatatggcaaagttgaaaaaaaaaaagcaactgtaaatccgcctacaatctgctgttaacatttgactatacctttttaaaaacacatttcctgtaatagcagccttgctgtatccattcagcatttaatcctggttttttggtgcatttaaaaataaaatatagatgatactacccttttccgtaatgacttcagcatattttatcttttggggtaaaatttacacatactgaagcaaataatgtatacatttgctgaatctttctgacaaatgcatatgtaaatttatacctaacccctattaagatatagaatgttaccatcagcccagaaagtttcctgtgcccccttctagtcaattctcccctgcacccaccccatgtgtttagacaactacaattttttcatcattttttgatattagcttttcttatttaaacattgttgtgatacatggtttttaacaaaattaagatctctttaatataggtgcttggacgataaagctaacagcacaggttttgttaacataattgttttatagatctgaatgatttgtttggcctcctttgtttaagtctttaatagttgtaattgaaaacatttttctccttcagtcttgttggttaatttattttaatctgttgtatttacatcctttttgcttttagatgcacagcttcaacacggatccagaggtgtttatcttcttagtgagtacacgagctggtggcctgggcattaatctgactgcagcagatacagttatcatttatgatagtgattgggtaagttggaagtatagcaaggaatatgctgattatatttccattttgaatttttttttttttttgaaatggagtctcactctgttgcccaggctggagtgcagtggcacgatctcggctcactgcaaccttcacctcctgggttcaagtgattctcttgcctcagccccctgagtagctgtgactataggtgtacaccacaatgcctggctaatttttgtgtttttagtagagacggggttttgccatgttggccaggctctcttgaatcctgacctcaggtgatccgcccacctcggcctcccaaagtgctggcattacaggcttgagccaccacacccagcctccattctgaatttttttttttttttttttttgagaaggagttttgctcttgttgcccaggctgggattaagtgctgggattaccagcatgagccaccgcgcccggccattctgaatttttaatttttaatggtacatgttacaaatttacttatctattttgaaaagatacccattttcagctaagagttatttcttcataaagttttttgcaagtaaaaattgaaaatttttttttacttttgtttttagtgacagggtctcactatcacccaggcttgagtgcagtggcaccatcacggctcagtagccttgaccttttggattcaagtgatcctcccacctcattctctcaagtagctgggtctatgggtgtgctaccatgcccacaaaaaatgtaaaaattagtgagaccacgtctcactgtttgcccacgctggtcttgtatcctcatatgatcctcctgccttggcttcccaaaatgctgagattataggagtgagtcatcgtgcccatcctgaaatgttttctttagggtatttaaacttttttgttaatattgtcaaggatctgtggaatgataattttgtctatgaagccactctggaagtttaaattaagacaccactatttaaaagttcctggctagatcattcatgttgactttatccacatgagtttatgttaattttaacctaataccgttaaatattatttttctttttaactttaagaacccccagtcggatcttcaggcccaggatagatgtcatagaattggtcagacaaagccagttgttgtttatcgccttgttacagcaaatactatcgatcagaaaattgtggaaagagcagctgctaaaaggaaactggaaaagttgatcatccataaaagtaaataacacttatgtagtgctttattgtttaaattgtgcattgtgtgttgtggattttgtttttattttgtttataaaatattacagcctgggccgagttctgtgtctcacacctgtaatcctagtactttgggatgccaaggtgagtggatcacgaggtcaggagttcgagaccaggctggccaagatggtgaaaccgcgtctctactaacaatacaaaaattagctgggctcggtggcgggcgcctgtaatcccagctactcaggaagctgaggcaggagaatcgcttgaacccgggaggaggaggttgcagtgagccgagatcgtgccactgcactctagcctgggtaacagaacaagactctgtctcaaaaaaaaaaatattaacagcctgatatgacaggatttaaataagcagtggggaatttgggagcctaaactaagttggtcaccatagacataaaagaaagaatgttagcgagtatgtagatatgtagatgaagagcagatgggcagagaaaaggggtcaaggataactacatgttcctgataagagattggcttgctaaaagttttaagataaatattttgcaagttccatgtattaaaatattaagtgtatttaagtgttataaaaaatctatttatttattgaacccactgtttcacagaatatttcactgcagaatgccctttttatagttttggacacttttttttcctttttcatttccttatcataaccagatgggtctcaacaatgctttttaatctagaaaaaattctgaggaggtggggaactgacataggtgaaaaagttttgttcctgagattccttagagaagttatacttctatccattcaccataaaattttctttgaataaatggcttgatagctacctgaagaaatgttgaaaatcatttatgtaaatcatcaagccctagagaaatgggaacatgataatgttaatgtgaaaagtaatgttggaaatcactaataatttattttatactccttttccacttgtaaatactttctctgggttttgaggtaagagtgtattaaggtttagacaaaattaatttggtgaaacatttagattgtaattggaacttgcattggggaaaaagcataatttttttttaagagaccatttaacttttttacccaggttgttctcgaacacctggactcaagtgatcctcctgccttagcctcttcaagtgttgggcttataggtgtgagccactgtgctcagccctattttcgattttttagtagattaattttgtagaaaattttgaagggatttttttaaatgctgacatttttcagttgagttattacatacatacagcaaaatgcacagatcttaaatgtacaggttaatgaagtttgaccagatttatgtactcctatgtaactatcatcgagatcaaggtagcattttcatcatccaagaaattttctttgttcaccctttccagtaattcctatgctccccttaccatcactaggaagcatccagtattctgatttttgtcacactgatgagtcttttttctgtttagctattttgttgaatatattttttcaacacagagtcatctgtgttgtttttagtagaatttttttcttttaattggtgaatagtttgttttttccattctcctgttggtcgacatttaaattatttctagattctggttattatgaataagttggtcctgtacaagtctttgtggacataatgcattttttggtccttgatcttagggagggtgcgtgtttaactactggaaactaccagccttttccaaagtggacatatcattttccagtcctaccagcgaagcctgagagcttcatttgcttttattttttatcaacacttttttttgccgtccttcttaatgcaagccattgtgattggtttgtaatatgttgtattgtagttttaaaaggaattttaatgtttttaatttctcattttttttagatcatttcaaaggtggtcagtctggattaaatctgtctaagaatttcttagatcctaaggaattaatggaattattaaaatctagagattatgaaaggtgagtttttaattttagaaagatttaatttgtagctttgaattattcacatagacttgaatattttgttttctatagggaaataaaaggatcaagagagaaggtcattagtgataaagatctagagttgttgttagatcgaagtgatcttattggtaagtattatgcttttttttaatggaagcttcgaaacatacacttaattagcataatgtaatgaaccccttgtgcaattcattcagccacatgtatccaatcttgttttattgtcatttttcttcttagagtattaaaatcaaatctcagacatgacattttgcccataaatgtcattatctttaacttcttccataattcagatattttctgtaaactggtaaataacacttgtaaatgaatatattcaagttcctgtcttagttaagaataccagtgctttgttctcatatttttcgtcataccaggaggcacatcgtatctggatttcttatttccagtgagctaagattaatcaagataatgttataaagtgtcttgtcagccttcatcctttacttaacacgatgatttattttattttattttatttttttggagacagagtcttgccctgtcgcccaggctggagtgcgctgacacgatctcagctcactgcaacctcagcctcctgggttcaagggattctcctgcctcagcctccctagtagctagtattacagtcgcctgccaccacacctggctaatttttgtatctttagtagagacagggtttcgccatgttggccaggctggtcttgaactcctgatttcaggtgttgtgcccaccccagcctcccaaagcactgggattacaggcatgagccactgcaccaagcctaacgtggtgatttttagtatcccttgaaagtggctgataagaaccattattaacttaatcattgcaaaatggtgatttttcttgttctgtcattcttttattagctgggttatttaagaactttcccttacagtttccctgagatagaagagagccaggatatattgcttcttttttttttttttatcagtttttagaataccaccttatgatctgatgcctacagtgatgaccatgaattattttgaaaacaaaaataatattttgtacttcataatttcctaattattttacaacatattactgtcgtctaggctattgattatttgtctgttgcatctgtatggtggagatactgtataatctttttttcccaactgtattccgtgacattttggtcttttgaaattggtgatggcagtaacattcatatcacggatacaggcagaaactagaaaccccagtctttgtttttaacaaaaaagggtcttgctttgtattcctggctagaatgcaggagtgcgactatagctcattgcagcctaaaagtcctgggctcaagggatcctccagcctcagcctttggagtaagctgggattataggcatgagccattgtgcctcagtttttgttttttttgagacccaattgttaaacatttacctgcgtggcactggctacagtgtcatgatatcttattttcaaatatgttgttcattttaaaattcaattctgtgtcttattgaatcaaaataaaatatattggttggaagtttttttttttttttttttaatcagatgtattttccaaacattttcttctactctggcctgtctcttcacttacttacttagtatcttctgaagagcaaaagttttaaattttaatgaatttcaattttaacaaatttttttctgttcactcatgatttttatgtcatctgtaactactctttgcctaattcaaggtgttgatattttcttttaatagttttatagtttttgctcttacatttagatctatgatctattttcaatgaattttcatctttttgcatgtcaatattaatttgttaaaaagatgatcctttttctattggatggccttgtcatccttgatgcaaataatttgatcataaatataaggatttatttctgtattctcaattctgtcccattgatctctgtggtattcctatgccagtatcgcactgatttaattaaggtagctttatgggaagtgtactttctctagttttgttctttttcaaaattgttttagatattctggattatttgcatgtttatttgagttttaactttgaaatagtttagggagaaatatgagacatacagcatcatggtcaaatctaaactatattaaaaaacaacattatgtgaggcatgtaaggactgtttaacatctgataatataattcatatcaattaaataatggagaactagatgatcacctaattagataccaaaaaccaacttgccataatatcgtaatcatcttcataatttttttttatttgagacaaagtctcgttctgtcaccgaggctggagttcagtggtgtgatcatggctcactgcagctttaacctgctgggctcaatcaatccccacacctcagcctcccaagttgctgggactgcaggtgtgattactatgtcctgctaattttgttttgtgtattttgtagagacaggggtttgccatgttgctcaagctggtctcacactcctgggctcaagtgatctgtctgcctcatcctcctaaagtgctggcattatcgaaactgcttttatttgcaagtggtctggtttgattatcttcataggaagtccaagggaatccagaatcttttaaaatagaatttaagaagattgcttattaataatatgtgtaacagcaataattgtttaataatgaaggtttttacaacagctacaaaattaacatgcctacaattaaagtttaacaatttttaacatgtttatataaggacagaattatgaaacattgaaggacgttaatagaaagactgagtaaacatgcagatttagctgtatttgtggatatgaatggttactacaaagtgtaagtcagtggtccccaaaactaacttatattcttgaatttttcttctaattaaaatcccagaatgatggctgggtgtggtggctcatgcctataatcctatcactttgggaggctgaggcaggtggattgcctgagctcaggagttagagaccagcctgggcaacacggtgaaaccctgtctctactaaaatagaaaaaattagcggggcatggaggcatgtgcctataatcccagctactcagaaggctgaggcaggagaattgctagaacctggcaggtggaggttgcagtgaatggagattgtgccactgcactccagcctgggtgacagagcgagactctgtctcttaaaaaaaaaaaaaaaaatcccagaatgactttttgtaaaacagactgttgttaaaatttatatgagagagtaataaagggccagaaccaagacagttttgaagcacaagatattctataccaggtataaagtcttattaaaaatttaaaagtcataataatcaagatggtagaattagcacatggtgtgatatattggctagaagtacaatatggtgaatctagaaagacaactttcacgaaaagctaataaatgtgaaatggaacttcaaacaactgataggaaattcctattaatcaatagatgatctggggaaatagtaattaataggggaaaaattaacttagattctcctctcctcacactgcacttacaaacttcagataaattaacaatccacgtgttcaaaacctaaatattaaaggtagaattttaacctaaaaagacaagaaaatatatttatgattttagaattagaattctttataatacagaaatcacaaattatatgataggtttcatagattttaattacattaataggaaagactactataagacagatgacaccataaagagataagagacaaaccacaaataatatttgcaacatataacaggaagtgtttaggatatgcaagtaaataaaagttgataatgaaaacggataatataagagcaggctattaccaagagagaaagaaatgtctgatgaacagacaaggatgattagaaatcagtaatacaaatgaaaatcagatttcatttcacagctgtcatgttgataaaaatttaggagactacatattgtcattgattcaaaatgtttctcaaggtaagctttttgtggtgtgttttcagctattaaacgaatcgtgattgggcctctttttaaaacgtttctgacaacatgattcaaattgatattatttattgctctttgacttgtttatcttaccttaaattcagcaaaagcgattttgactagcaaactgatgctttagattgtatgctcccaagagtctgattctagttgttgtattaagaatagtgtacctttttgctttcactgctattaaatcttggtgattaaggaagagagtgccctgtattactgtgagttttataattttggacagatgactcacttctcataacatcatattggatgtttcttttacgatttcttcttcttatacttctaaaatgtacctgttttaatgtttttcccttagatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatgatctcattaaattatttcttcaggaatagcttaggtgcaataatagcaaaagacttggctgtcggtaggatttggttattttgttttcttggtttcattcactagtactataggagtgtgtcatatagagatttcaagtggacattgtgttagcacaagagaagtttctgaatgaaactttagggtcttgagaaacgactagaaattggaaatggtagtgtatcatgcaaaacaagacagaccctgaaaatttatagtagtgggttaactagaaccaaatataagagaataggccttaggaatatgtaagtaatgcacaatctgtaatagaacagcataaaggccaaaagaggcacaatttagaccctgtgtgaaaggatatcagacaatgaggaagagaaatcctgaatgtaccctggagaggggacatactccataagccatacatttctgtgttagtgtttatttcatggaaaaatattgctgttgccatgtatattcaaatgcagatcagatgatctgttaaggataatggaaccgtcacttaagaaaaacttaattttttttccctgtgtcctattggcacaggtcttttcttttaaatttttattttaatcgttttgaggtacaggtgggttttggttacatggataagttctttggtggtgaagaaaaacttcagatagaacatttggttaaataaaagactatagagcaggtttatttgttttttaagtcaaaatgttaacccattacataagcatgctgacctaggcttgcttgaaactcgtgatcttgtccttagtgacccagtctttcctgttacattgtcctaaatgactggtttcatagttttactctgtcattgcacgtctcatatctcctccctctcactttgctccctattgccctgagaaaatagacgcagtcagaaaagaatctttaaaagttgtcaccgttgcatctgtaaacctagcatctgtgcccatctgtccccatctgccctttattatatactgcggatatattgtttgtcgtagcttgagccaattgcaatgtctcatttcttttataacaaagctccttgaaaaagagttctattatagcaaaactccttgcctgtattcattgtttttagtttgttctgttttttctgaacccattccaatcagatattcatttccattggagctggtatttttaaggtctcgtgacgtcagtgacctcattttacttgatctattagcagcatttcatacagttgttgactcttctccattaaaacatttactttatttggcttctaggaaacatattttcctgctttttcttcctatttctctgactcttttctcagtttcctttgctgtttccttttctatcctctaaacattgaaatatcctaagcctagtttgggattcccttgatggtcttcatttctttaatgggaactgtgctggtgactcaaatttatatctccagccagaacctttctcctgaattccagattcacatatccgactgtttactaggtgcttgataactatatctgtacttttcatcttgtttaatccaaatttacttcttttgcattttccttagttcaataaatgacaactttattcttccagttatttaaaccaaaaatcttagagtcattcttctcttccttccctcatatttcatgtctgattctaaaggaaatcttgttgcctgtactttttctttctttcctttttttcccctttttttgagtctcgcactgtcgcccaggctggagtgcagtagtgcaatctcagctgactgcaatctctgtgtcccgggttcaagcgattctcctacctcagcctcctgagcagctggggttacaggtgcatgccaccatgcctggctaatttttatatttttagtagagactgggtttcaccatgttggtaaggctggtctccaactcctgaccttgtgatctgcccgccttggcctcccaaagtgctgggattgcaggcgtgagccaccacatctggctttttttttttttttttttataaacagtttcacttcgtcacctgggctgaagtacagtggtgtgatcttggctcactgcaacatctgccccccgggtttaagtgattctcattccttggcctcccgagtagctgggactagaagtgtgcgccaccacacctggctaattttcttatttttagtagaaacgtggtttcaccatgttggccaggctggtctcgaactcctcacctcaactgatcatctgcctcggactaagtgctgggattacaggcctgagccaatgcgcccagcctactttctataaaagtcgtcatgtctctgcccccaccccccgccaccccccacatagtctgtttcatttgattttccccttagtttagtgttttattttgatgtttcttcagatgccttgggatcatttactgttcctcatatttaagagcaaatgcttaaaaattcttagaaataccttcttgaaaagcctgcattcctaccacctctcaccacttcaacatgaaataatgatcccttacatctttttagtgtagttatataacttttgattggctcaataattacttttattatggctgtgtaagtattattaaagctttagataagccatggaatatgctgtgattttattttcattcttgtgcagctttttttttctccctgaagttaatacttaactgttttttacctaccagtaatttatatctaatcactctggaaatataagcccctcagtatattaaaacagatctcatgattcagtaataaacctccccctccaaatatatcccatcacctctactccctggaacattcttctagtttggactgtagaactgattccatctggaaccttcctttaccatactcctgggtattcctgttggctgtttcatgttttggaattactgtttactgtgtcttgtgtctccccccccccccctttttttttcctttaagacagagtttcactcttgttgcccaggctggagtgcaatggcttgatctcggctcactgcaacctctgtctcccaggtttaaactattctcctgcctcagcctcctgagtagctagaattacaagcgcccaccaccatgcccagctaatttttgtatttttagtagggacagggtttcaccatgttggccacgctggtctcgaactcctgacctcaggtgatccaccctcctcggcctcccaaagtgttggtactacaggtgtgagccactgcgcctggctggatctaactttttttcctccttggtttactcgctcactttgatggattatgttgtcttgtgttttcccaagaaaagaattcaagggaaatgaattttttgagaactcgcatatctggctgtatttttgttggattcttatatttgatggatagttctggtttgggattttagagtaggaattattatcttctcagaatttcgaaagttgttgtgttgtctcagaacttccagtgttgtgggagagaaaattaatggttccttttttttttttttttttttgagacagggtctcattctgtcacctaggcatgaatacagctcactgcagccttgacctcccgggctcaagtgatcctcctgcctcagccaccaatttagtttggaccacagccatgcaccaaatgccctgctaaatttttaattttttgtggagacagggtctcaccatgttgcccaggctggtcctgaactcctgggctccagcaattccccccggcttggcctcccaaagggctgggattacaggtgtgagctcctgcacctggcccgaatgctgctttgatttccagtctgttgaaggtggggggaaccagccttttgttaatgtgagcttccagtgtttctttgtcttttgtattctaaattaataacacagtgatgtgtcttggtatgggtcttttttttttttctttttttttttcatttttaaagagactcctgctatgttgcacagacttgtgaattcctggtttcaagttatctttccccctatgtcactcaagtaatgtggactacactcatgtgacaccatgcccatctttatgttgtgtatcttatttttgttttgttttactcttgaatcagctcagtctgaaaatctgtcttttaattcatggggattttttagaatgatttcttggagggttttgtcttttgaatgtgtggtcccttctctgcctagaatttttttgtttgaatgagacatggtcttgctgttgtccaggttggagagcagtggtgcaactatagctcactacattcttgaatttctgggctcaagccatcttcccatctcagctttcagaatatcttggctacaggcatgtgacactatgcccagataatttaaaaaaaaaaaaaaaatttcttgagacagggtcttgctatgttgcccaggctcgtcttgaattcctgttctcagagggtcctcctatgtttgcttcccaaagcattggtattatatgtatgagccaccaccactagcacttctgcctagaactcgtaacaaaatttctttcccccatctgcatagtcttgtttcattaaatgattcttccctttttaaagtttagtctgtcttttattttgatgcttcttcaaatgccttgggatcatttactgttcctcaaatttaagagctagaagaaatctctctaagctccatgcatgagggttctcaacaggtggattttactccagtgtgatttcactagaccatttatttgagggtcacccaattgtcagtatatgtatatgagagagaatatgtacatatatatctgagagaaattctctaatcacttgtcctgtgtgagtatatgtactttgccagttttcttttggggtgaggaggagggacagtgtattagagattttactgttcaaaatgtagacttcctcagttttcagtaaaatactctaccctgtctatatgtggattcccctattccagactgattcacccttttcagtgagttagtcgtgacatttcttacactgtgagggggagtggtaattactttacagggaggtatggggccatggtgtttgactcttctttcaaccacttctgggttttttagtgaaaacctctatctaacactgatactttcatttctgttgtctattgagtcagttaacactgatccatttatttttcagttcccaaaatcttgctttgccattgcttctattttattgtctgggggtgtttaacacctgtttcattttttacagtcatttagtttccagattttagtaagggacagaggggaatagatggactcatttcatgatgtagaaacaaatactccctgtcttgtcttacatgaaaaattattcttaaactaggccttatctttgagaacctgatcaaagtataaaaaatactttttggctttatttctttagtgagtcactattccatattttgaaggtgttaagaggtatggtaaaggtggtacttgaacatttccaagcaaacgtgtgatgaaatctttcatcaatgtcttagcaatggtatatgatttttttagtcttagcaattttagataagttttttttttgtcttgtttttttgagacggagtcttgctctgtcgcctaggctacagtgtagtggcgtgatctcggctcactgcagcctctgcctccgagcggggtccagcgattctcctgcatcagcctcctgggtagttgggattacaggtgcatgccaccacacccaactgatttttgtatttttagtagagacagggtttcaccatcttggcctgactggtcccgaactgatctcaggtgatctgcccacctcggcctcccaaagtgctgggattacaagcgtgagccactgcgtggcctgaggtaagattttataagaagcctacaaagccctaatttttacattaagaacattaagtgcttctgatagttttaagttccgtagtctttatttcaaagaattatttcattctgaatttctatttaaattagtctagaatatgtttataaatttatttacatttggttgaaatgtattcttaaaacttattccacagtttccagtttgaggataaatgaggtctaaagacagtatgaacttgttaataatttttcctattgtcctttttagaaatcttacatatcctttagcctaattatagattggccctgcaagcatgtcactgtatcttttatgtcttcctgagtcttagcactttaaattcttctatatccttcactgtctttcttacagcaccctaaaagagtagcatgtgaactgttgctcttctctaaggtattttaggacatttttaaaataatatatgagtggttgtcatgctaaatactgtctaccacaactcatacaattaaagtggtcaaagaaaggtctctttcatttcttttttcattttaaaaagaaatgttatttgtaaaacagtatagtcataacacagatatggcagttttttagtttttttttttctttttcttcactgtgtcatccaggcagtagcgtgattataattcactgcagcctccaactcctgggcttgagggatcctctcactgagccttctgagcagctgggactgcaaacgtgtgccagtactcctggctaatttttaaatttttttgtagaattgaggtgtttttttaaatttttttaaagccttgtttgcaaactgttgcaacttctggcggctgcaacttctggcctcaagcaatcttcctgtcttggcctcccaatagcataagctaccgcacccagcccacaattttctttcagtacaatataaacatcttgcaagcgctagcttgatttacactttttgtctgtatccacctctttttttttttttttttttttttttttttgagatggagtttcgctcttactgcccaggctggagtgcagtggtgcgatcttggctcattgcaacttccacctcccaggttcaagcgattctcctgcctccatcttccgagtaggtggcattacaggcatgtgccaccacgcccggcgagttttgtatttttagtagagatgaggtttctccatgttggtcaggctagtctcgaactcctgacctcaggtgatccacccaccttggcctcccaaagtgctgggattacaggcatgagccactgcgcccagtatatatccaccactttaccatccacattagcatttcattagcttctctttgcccttttagttaataaccccatctcagggtgattcactttcataatccgtattaccatggattaattctgcatagcaaaaactatgataggtgtgttaagtaatgaagtttggggaatgttaataagatgatttctcttactgtagatgaaatacatcgtaagagaatccctcgtgagaccagatcagttacatgtatatcttgcctctcttaagtctctaccatttattactgtacttgagttaggatttggaagtgccactgaacactaaaattattctgtctgggtatttgaatggtgtgagacaaaaatccattttaatgttttatcaagttgagatgtctcacatgagtagttagtgctgagaatcagacacaggcacatttgggagcatggcgtggcaagaagctttgctttttcctgttcctattgtactcaaacttgtttctacatttttcattgatttctcttcgtactagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctagtggatcatgtggccgagatcgcgtcactgcactccagtctagcaacagagcgataccttgtttcttacttaaaaaaaaaaaaagacctcatttgttaactgttaaacagaaaacaagaaattccctatacctgtatgcattatagagcaaataagagcatcaaaaacaatcttagaaatctttcagagaaaggtcacctacaaaggaacattgatcagataatagatttttttttttttctcagatggagttctgctcttgtcgcccagactggagtgcaatggcacgatgttggctcactgcaatctccgcttcccaggttcaagcagttctccagccttagcctcccaagtagctgggattacaggctcccactaccattcccagaatttttgtattttaattagtagagacggggtttcgccatgttggccaggctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctctttttgcccaagtcacacttgtgtcatttcttatactgtaaacatgtggttccaattctgaggtattttcccggtttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaagacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagatccttttcagggaatatgtgagatcaaaatttttatactggcactatgatgttatttgccttttcctcatattcacaagtgaacagtggagttttacagaagctatataatgtcatgacatcactgatgggtaatagaatgtgtgcttgtatattccgaaactttcagttccaatttcttcgatcaatgtaatcctcataagtaaaagttatttgaggacctcagacatttttaaaaatgtaaagggggtggggtcaggctcagtggctcatgcctgtaatcccagcattttggaaggccgaggcgaacggatcacttgaggccaggagtttgaaactagtctggtcaacatggtgaaaccccgtctccactaaaacaaaaagttttctggatgtggtggcacacatacctgtaatcccagctactttggtggctgaggcatgagaatcacttgaacccagaagacaggttgcagtgagccaagattgtgcccctgcattctagcctgggtgacagtgagactgtctcaaaaaataaaggtgtacagggattgtatatttgacaacttggtatgtaggatgtgctacctctaatgttccatgctgttacttagttttcactcactactatattttggagatttgttcatattgctctgtgtacatttaattcttcagtgtgtatccaccacatttaacttattcacttacagaactatgcaagaatttctctggtaaatttcactaagtacttatgtacttttcagaacgattgtgagtttacacccctaccagcaggactgagttgagtacccatttcctcacatccttgccagtacttcatttgcctaatttttgccattctcataatgtggcaattgttcaattttgcatttcttccattttatttttttgcatctctgcttttcttttggttagctttgccagttctgcctattatattaatctcccagaatcagcttttagttttgttaaatctctgacatgtttcgttgattcctgctttcatcttaaacatttcttcgttgttaatttgtgtttgctataaaataagcaacatcttaaatgcttgatttgctttcgatgtttattctgtaataagatatttaaagatataattttttccctaaatgctttattagacttttctcataagttttgactggtactgttttcattgttatttaattttgtgttttttaacttctttcatgatttccttttaactgaaggttttcttagatatttagtttgctggtatattcttttaaaattgtatcattgctttctttctatattggattattgtcagagaacatgatttgcatgatattaactttttggagtatattgttgcatctttgtggcctagtacatagttaatttagtgaatgcttccagttgtacttgaaaagaatgtatattttctgattattgagggtaaatttctctatatatgttttcctgtttaataaatatgtagctatgtgctta

SEQ ID NO: 492 - DNA, 3274 bp, Homo sapiens
actaataaaggaagacacggacagatgaacttaaaagagaagctttagctgccaaagattgggaaagggaaaggacaaaaaagacccctgggctacacggcgtaggtgcagggtttcctactgctgttcttttatgctgggagctgtggctgtaaccaactaggaaataacgtatgcagcagctatggctgtcagagagttgtgcttcccaagacaaaggcaagtcctgtttctttttcttttttggggagtgtccttggcaggttctgggtttggacgttattcggtgactgaggaaacagagaaaggatcctttgtggtcaatctggcaaaggatctgggactagcagagggggagctggctgcaaggggaaccagggtggtttccgatgataacaaacaatacctgctcctggattcacataccgggaatttgctcacaaatgagaaactggaccgagagaagctgtgtggccctaaagagccctgtatgctgtatttccaaattttaatggatgatccctttcagatttaccgggctgagctgagagtcagggatataaatgatcacgcgccagtatttcaggacaaagaaacagtcttaaaaatatcagaaaatacagctgaagggacagcatttagactagaaagagcacaggatccagatggaggacttaacggtatccaaaactacacgatcagccccaactcttttttccatattaacattagtggcggtgatgaaggcatgatatatccagagctagtgttggacaaagcactggatcgggaggagcagggagagctcagcttaaccctcacagcgctggatggtgggtctccatccaggtctgggacctctactgtacgcatcgttgtcttggacgtcaatgacaatgccccacagtttgcccaggctctgtatgagacccaggctccagaaaacagccccattgggttccttattgttaaggtatgggcagaagatgtagactctggagtcaacgcggaagtatcctattcattttttgatgcctcagaaaatattcgaacaacctttcaaatcaatcctttttctggggaaatctttctcagagaattgcttgattatgagttagtaaattcttacaaaataaatatacaggcaatggacggtggaggcctttctgcaagatgtagggttttagtggaagtattggacaccaatgacaatccccctgaactgatcgtatcatcattttccaactctgttgctgagaattctcctgagacgccgctggctgtttttaagattaatgacagagactctggagaaaatggaaagatggtttgctacattcaagagaatctgccattcctactaaaaccttctgtggagaatttttacatcctaattacagaaggcgcgctggacagagagatcagagccgagtacaacatcactatcaccgtcactgacttggggacacccaggctgaaaaccgagcacaacataacggtcctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaagacccgcacctgcccctcgcctccctggtctccatcaacgcggacaacggccacctgttcgccctcaggtcgctggactacgaggccctgcaggctttcgagttccgcgtgggcgccacagaccgcggctcccccgcgctgagcagagaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggggaggtgcgcaccgccaggctgctgagcgagcgcgacgcagccaagcacaggctcgtggtgcttgtcaaggacaatggcgagcctcctcgctcggccaccgccacgctgcacttgctcctggtggacggcttctcccagccctacctgcctctcccggaggcggccccggcccaggcccaggccgaggccgacttgctcaccgtctacctggtggtggcgttggcctcggtgtcttcgctcttcctcctctcggtgctcctgttcgtggcggtgcggctgtgcaggaggagcagggcggcctcggtgggtcgctgctcggtgcccgagggtccttttccagggcatctggtggacgtgaggggcgctgagaccctgtcccagagctaccagtatgaggtgtgtctgacgggaggccccgggaccagtgagttcaagttcttgaaaccagttatttcggatattcaggcacagggccctgggaggaagggtgaagaaaattccaccttccgaaatagctttggatttaatattcagtaaagtctgtttttagtttcatatacttttggtgtgttacatagccatgtttctattagtttacttttaaatctcaaatttaagttattatgcaacttcaagcattattttcaagtagtatacccctgtggttttacaatgtttcatcatttttttgcattaataacaactgggtttaatttaatgagtatttttttctaaatgatagtgttaaggttttaattctttccaactgcccaaggaattaattactattatatctcattacagaaatctgaggttttgattcatttcagagcttgcatctcatgattctaatcacttctgtctatagtgtacttgctctatttaagaaggcatatctacatttccaaactcattctaacattctatatattcgtgtttgaaaaccatgtcatttatttctacatcatgtatttaaaaagaaatatttctctactactatgctcatgacaaaatgaaacaaagcatattgtgagcaatactgaacatcaataatacccttagtttatatacttattattttatctttaagcatgctacttttacttggccaatattttcttatgttaacttttgctgatgtataaaacagactatgccttataattgaaataaaattataatctgcctgaaaatgaataaaaataaaacattttgaaatgtgtg

SEQ ID NO: 493 - DNA, 25171 bp, Homo sapiens
agagcgcgaacccaaacacagatcgccgctggggtccaagcgcccttcaactccgcccgctagtgcccaagattaccgggaaggaattcaacgaatcagtggtgaggtgccgccgccatgcctactacgggcggaaatttgagagaaagcttcgcaccggtaggaaaactgaggagcaaccgagcacgattggaaaggttgacgatagtggttaagtggctcggccttgccctcagttaaaatggcaattttagttgcttcactgatacggaatcggcgaggcgccaaggaggcttcctgcgtggggccgcagagcgagtcgggaaacgattttaaactgaagaggcggcggagggccgaattcccttttctcaacggcttgatttcagagctgggctggtctctgacaggctcagctggagagggacgggttgggacgcactgtccttttgcccttccccctccgcgagcagaagctgactccgcaggagcgagggtcgcagagctgggtgagcggaaatgtccctcccagagtgaagtcgcagggcccgccccgcgtctgagggagcggaggtcttcctgggtgcgtttgtgtctcttgtgaacccacttgtggagcgagagggaatttgggagggccaggggttagtctggcctctgtcttagctgtcattttggcggttttttttttttttcttcaggggatttcagtctccacatagttttggagccggacttttgaagaatgattcgtgaatccggaatgggtgacagcgtcatcacggcattttattggtaaagatgctttgtattggtcccggacctgctttaactttgtatttgccctgttgtgtggtcattatcttacaatacttgcgtgttgaggtgtgtttaaacactacgtgcttaacactggctaagtattggcattggggcggttggatttaggtattggtggcaatgtagaaaagtgatcaagtcagagccccttcacggactaatcacaagagaaacaacaaagctttacttgtgtgctgtgaaccacaactgcaagtggaattgtcaagagaactagccctgccaagctcaggaaaacttctgaggagatggcacatggaaaatggataagatttactgagacaaacgggagtagagaagtgtttttaattggcgataaggtgaataaaaaggcagggagaacagtagagtgatcatctgtctagagtagggggtgcatgtttgggtatagggctgtcatttaacctcttaaagaattgtctactggaactttcttcactcccatccccccaccccccaatgttgtatacaaaaccttagaggaagtgtatgcagaatgttggattttggaaaggctaatgtcgatggatcttggggaagaactgaagtagtagaaaatgaacctggataggatcagataataagatcaaatacagtagtgccttgaaagccagacaggaattctgatttgacttcatatagatgtgtgggaactgttatgggatctcaagcaaggtaatgataaaagtggtgacaatgaaagactgatgatggattagggaaaggggctaagattgggaacaagataagtagctataattgagaatgaaagtgaagcccacatctaagaggacaagtgtatatctttttaagaaatatgtcagaggccaggtgtggtggcttatgcctgtaatccagcactttgggaggccaaggcaggcggatcacctgaggtcaggagttcaagaccagcctggccaacatggagaaaccccatctctaccaaaaaatacaaaaattagccaggcgtgttggtgcatacctgtagtcccagctactggggaggctgaggcaggagaatcacttgaacctgggaggtggaggttgcagtgagccaagattgcaccactgcactccagcctgggagacagagtgagactctgtcttcaaaaaagaaatatgtgagaatttgatgataaagttaacaaagttaactttttagatgtaaaggtgatgttgaaggaagagtaaaagatgatgaaagtttttttagtggggaaagaaaatgaaaaggaagaatggaattattactgagcaaaacagagtacagtagttggcaaagaaagattgaataagatgtgaagcgatgattagttttgaacttaatgagtttgacggaggttggaaatgcaggactgggttgcagctgtaatggtctgaagacagagatttaggagtcatatagaatgattattttcctatgtagaatgaatgattttcagaatctggggccacctactattggaacatgaggaaaaaaaaagaatcagtaaataaattggaactataaaaagtaaggaggagaaaagcccctaaaaaatggaatgtcagaggaaacaaggtcccagaaagtttagaggagtaaggatgaacaaacttgatgaacaaagtatttggccatggttttggcaaaaacaatgatcttcgaaagtacagtttctttgtagtgatagatggaagaaagagattgctgaagatttctagtaaaatatttattagtaactggaggcaataggtgtagacgacgtttccaggagattggtctcagaaggaatgagacgaattggatttaaacacaaatttttaatgttagaaatactagaatatgcttggcagtgaaagaaaaggatcctgtataggagtgattaaagatgatagagatgtgaagtacagcctggttgtggtggtgcacgcttgtagtcctagctactcgagaggctgaggtgggaggatcgcctgagcccagcaggtggaggctgcagtgatatcaggccactgcactccagcctggacaacagagtgagaccctgtctcaaaaaaaaaaaaaaaaaaaaaaaaggctgaagtacacaaaggagatggtgtccaggggagatacaagtaagaggacctctttgcttccgattggaaggaagagtattgggacagtaatatattgagccaaggtatattaataacctctggattattgtgctgggcaaaaattacacattcttgagtgtgagatgagaaggtaaaataagtataaatcatttgctaatctttaattcgtggattgggctattttacgttaacattaaatacacaattgacatgttttttcaaaaccatccctcttagtgctgatagtctttttctcacctacatttattgctagactttttaaagtcacctagactttaaaatctttttgggattcatagcatttctcttttaaggagtcaaattcagcagggcttatgttgcctcataattgatccctgtttaaaaggcaacgtgaaagaagtagctaagtgcactcattgcagagttagactgtctggattcaaatcctgactcttccactctaacttgttgactttggcaagttacttaacttgtctgatttcctatttgttagctgggagcatgatctacttcatggggttgtttgaagattaaatgagaaaatatttataaagggcttagaagagtacctgaaacatgatgaatgctcaataagtgttagcaattattgtaccaagtaacaaatttgaaggaaacattctgtctaagtaggattgattaaaattccctttgaaataggtaattcaatatgcatttaaagctaggatgctttagaatagctgctatttaaattgtgtggtgtctggtgtagagtcatgtattcactacagtcaagatacagttccatcaccacaaggaattcttgtgttgcctttttatagtcacatttatgtccctcccaccctcttccctttccctgatctctgtcagccactcatctgttttcattcctttaactttgtcattttaaaaatgttaaatgtatgaaattttatatgtgacctttttggattggctttaacatccaagttgttgcatgtatcaataatttgtttcttttcattgctgagtactattacatggtgtggatgtaccacagtttatttatcattcacccactgagttgttttcaatttttggctattatgaataaagctactatgaacatttctaaaaataaataaataaattgtgtggtatatgaacttgctctggacattatttgagctttaaggacaaataatgctacatgtttagtttatgtatttatttatttattaattagagagggtctcactcttgctcagactaaagtgcagtggtgtgatcatagctcactgcagcctcaaactcctgggctcaagcactcctcctgcctcagcctctggagtggctacgactaccatcatgccaggctaattccttttttttttttgaaagatggggtcttgctgtgttgtccatgctaggactacatgtttaatttgtggagttttgtgcaagatataaatggtgtcctagtctaacatattgaaatagaagttacaggttaaatctgaagtctgaaatgccccataacgtgaatctttttgagcactgacatgatgctggaaggaaatgttcactggagcattttggatttcagatttttggattaaggatgcttgaccagtgtgatacaaatattcccaaatttgagaaaatctgaaattcaaaaacacttttgatcccaagcattttgggtaagggatgctcaacctgtgctattttaaatataatactatttaaatatgggccgagtgcggtggctcacacctgtaatcccaacactttgggaggctggtggatcacctgaggtcaggagttcaagaccagcctggccaacatggtgaaacactgtctctactaaaaatacaaaaaaaaaaacaaacaaaaaattagccaggcatggtagcgggcagctgtaatctcagctactcaggagactgagtcaagagaattgctggagcccaggaggcagaggttgcagtgagccgagatcgcgccattgcactccagcccaggccaacaacagtgagactccatctcaaaaaataaaataaaataaaataagtaaatatagtaatataactttttattcgtaaaaaacttttcaaaagggtaattgtgtagtagttgagactaataacttttgttgttgttgttgagatggagtcttgctctgtctcacccaggctggagtgcagtggtgtgctcttggctcactgaagcctccacctcccgggttcaagcgattctcctctcagcctcctgagtagctgggactacaggtgtgtgccaccatacccagctaatttttgtttttctagtagagacggagtttcaccatgttggtcaggctggtctcaaacttctgactgcaggtgatccacttttcctcggcctcccaaagtgctgggattacaggcgtgagccactacgcccagctgagactaatcataactttgaaatgataattccttttaatgaaaattgtattttaattttgtgtttctttttttcttgagagggtcttgctgtgtcacccaggctggaattcggtggcatgatcacatctcactgcagccttgacctcctgggctcatgcagtcctacttcagcctcctgagtagctgggaccacaggtgtgcactaccacacctggctagttattttttattttttgtagagatggagtctcacagcgttgcccaggctggtctcagacatctgagctcaagtgatccacctgcttcagcctcccaaagtgttgggattacagtcatgagctaccatgcccggccctaatttggaagttctatgaaatacttccgtttaattgaaccaatacttgtttaacaattaaaggacactcagccttgtatttgggtaattatacaagagaaatataaagcatggtttcagtgacagtagcttagttttactgagggtacaagaaatacacactgaaaaatggtacaaggaagtatatgaacaggggctaaaatgagtggtacagactgggtgattgaggaaagctatgtgtgctggtatatctccaaggattttgtagaacattcttgagggattttttcagacttatttagagatgagagctcattcagcacacacacacacatgcatactctgcttccaggaatgagccactgataacagataacagataaaaatgtatgccataggtatttcaggaccaaaaggttaaaaacaccctagtttgaaaggagatcaaatttctagcatggtcttaaaggaggtgagatgggaaaaggacgcttaagataggaaatgcagttgagaagcaaacacatgaagataagaatatgtttatgtcccaggttggagaggagaattaggaaaataaagagaagctgaattagaaagaccttaaacccagcagaagagtttaggatttgtcttgttactgtaaaggtttttgcatagataaaataaagtgctatttttggaagaatggattactctggatacggagaactcttagttgtggctaaggaattagctttgtgaagggatgacagattttttttttaacatttttaaaaaatttattttattttttaaattatactttaagttctagggtacatgtgcaaaatgtgcaggtttgttacataggtatacatgtgccatgttggtttgctgcagccatcaactcatcatttacattaggtatttctcctaatgctatccctcccccagccactgacccctcgacaggccccggtatgtgatattccccgccctgtgtccaattgttctcattgatcaattcccacctatgagtgagaacatgcggcgtttggtgttctgtccttgtgatagtttgctgagaatgatggtttccagcttcatccatgtccctgcaaaggatatgaacttattcttttttatggctgcatggcattccatggtatatatgtgccacattttcttaatccagtctatcattgtggacatttgggttggttccaagtctttgctattgtgaatagtgccgcaataaacatatgtgtgcatgtgtctttataatagcatgatttataatcctttgggtatatacccagtaacgggatcgctgggtcaaatggtatttctagttctagatccttgaggaattgccacactgtcttccacaatggttgaactagtttacactcccaccaacagtgtaaaagcattcctatttctccacatcctctccagcatctgttgtttcctgactttttaatgatcgccattctaactggtgtgagatggtatctcattgtggttttgatttgcatttctctgatgaccagtgatgaagagcattttttcatgtgtttgttggcttcataaatgtcttcttttgaaaagtgtctgttcatatcctttgcccactttttgatggggttgtttgtttttttcttgtaaatttgtttaagtcctttttagattctggatattatccctttgtctgatgggtagattgcaaaaattttctcccattctgtagattgcctgttcactctgatggtagtttcttttgctgtgcagacagtatttatttatttatttttttgctttcttttttttctgagacggagtctcgctctgtcacccaggctagagtgcaggggcacgattttggctcactgcaacctctgcctccttgggttcagcgattctcctgcctcagcctcccaagtggctgagagtataggcgcacatcaccatgcctggctaatttttgtatttttagtagaaatggtgtttcaccatattggccaggctgggctcgaactcctgaccttgtgatccacccgcctcagcatcccaaagtgctgagattacaggcgtgagccactgcgcccggcctggtcttcagtttaattagatcccatttgtctattttggcttttgttgccattgcttttggtgttttagtcatgaagtccttgcccatgcctgtgtcctgattgatagtgcctcggttttcttctagggtttttatggttttaggtctaacatttacatctttaatccatcttgaattaatttttgtataaggtgtaaggaagggatccagtttcagctttctacataaggctagccagttttcccagcaccatttattaaatagggaatctttgtcccgtttcttgtttttgtcaggtttgtcaaagatcagatggttgtagatgtgtggtgttatttctgaggcctctgttctgttccattggtctatatctctgttttggtaccagtaccatgctgttttggttactgtggccttgtagtatagtttaaagcgaggtggcatgatgcctccagctttgttctttttgcttaggattgtcttggcaatgtgggctcttttttgtttccgtatgaactttaaagtagttttttccaattctgtgaagaaagtcattggtagcttgatggggatggcactgaatctataaattaccttgggcagtatggccattttcacgatattgattcttcctatccatgagcatggaatgttcttccatttgtttgtgtcctcttttattttgttgagcagtggtttgtagttctccttgaagagatccttcacatcccttgtaagttggattgctaggtattttattctctttgtagcaattgtgagtgggagttcactcatgattttgctctctgtctgttattggtgtataggaatgcttgtgatttttgcacattgattttgtatcctgagactttgctgaagttgcttaacagcttaaggagattttgggctgagacaatggggttttctaaatatacagtcatgtcatctgcaaacagggacaatttgacttcctcttttcctaattgaataccctttatttctttctcttgcctgattgccctggccagaacttccaacagtatattgaataggagtggtgagagagggcatccctgtcttgtgccagttttcaaagggaatgcttccagtttttgcccattcagtatgatattggcggtgggtttgtcataaatagcttttattattttgagatatgttccatcaatatctagtttatggagagtttttagcatgaaggcctattgaattttgttgaaggccttttctgcatctattgagataatcatgtggtttttgttgttgtttctgtttatgtgatgaattacatttattgatttgcgtatgttgaaccagcctcgcatcctaggaacgaagctgacttggtcatggtggataagctttttgatgtgctgctggattcagtttgccagtattttattgaggatttttgcatccatgttcatcagggatattggtccaaaattctctttttttgttgtgtctctgccaggctttggcatcaggatgatgctggcctcataaaatgagttagggaggattctctctttttctgttgattggaatagtttcagaaggaatggtaccagctcctctttgtacatctggtagaatttggctgtgaatccatctggtcgtagcctttttttggttggtaggctattaattattgcctcagtttcagagcctgttattgttctattcagtgattcgacttcttcctggtttagtcttgggagggtgtatgtgtccaggaatttatccatttcttctagattttctagtttatttgcatagaggtgtttatagtattctctgatggtagtttgtatttctgtgggatcactggtgatattccctttagcattttttattgcatctatgtgcttcttctctcttttcttctttattagtcttgctaacggtctatcaactttattgatcttttcaaaaaaccagctcctggattcattgatttttttgaagagtttttttgtgtttctatctccttcagttttgctctgatctttgttatttcttgccttctgctagcttttgaatttgtttgctcttgcttctctagttcttttaattgtgatgttagggtgtcagttgtatatctttcctgctttctcttgtgggcatttagtgctataaattttcctctacacactgctttaaatgtgtcccagagattctggtacattgtgtctttgttctcattggtttcaaagaacgtctttatttctgccttcattttattatttaaccagtagtcattcaggagcaggttgttcagtttccatgtagttgggcggttttgaatgagtttcttaatcctgagttctaatttgattgtactgtggtctgagagacagtttgttgtgatatctgttcttttacatttgctgaagagtgctttgcttccaattatgtggtcaattttagaataagtgggatgtggtggtgagaagaatgtatattctgttgatttggggtggagagttatgtagatgtctattaggtccacttggtgcagagctgagtttaagtcctggatatccttgttaaccttctgtctcgttgatctgtctaatattgacagtggggtgtgaaagtctcccattattattgtgtgggagtctaagtctctttctaggtctctaaggacctgctttatgaatctgggtgctcctgtattgggtgcatatatatacatatatatggtagttagctcttcttgttgaattgatctctttaccgttatgtagtggccttccttatctcttttgatctttgttggtttaaagtctgttttatcagagattaggattgcaacccctgcttttttttgctttccatttgcttggtagatcttcctctatctcccttattttgagcgtatgtgtgtctctgcatgtgagatgggtctcctgaatacagcacactgatgggtcttgactgtttatccaatttgccggtctgtgtcttttaatgggggtatttagtccatttacatttaaggttaatattgttaggtgtgactctgatcctgacattatgatgttagctggttattttgcccgttagttgatgcagtttcttcctagcattgatgatctttacaatttcgcgtgtttttgcagtggctggtactgattgttcctttccatgtttagtgcttccttcaggagctcttgtaaggcaggcctcgtggtgacaaaatctcttagcatttgcttgtctgtaaaggattttatttctccttcacttatgaagcttagtttggctggatatgaaattctgggttgaaaattcttttctttaagaatgttgaatattggcccccactgtcttctggcttgtagagtttctgccgagagatccgctgttagcctgatgggcttccctttgtgggtaacccgacctttctctctggctgcccttaacattttttccttcatttcaaccttggtgaatctgacaattacgtgtcttggggttgctcttcttgaggagtatctttgtggtgttctgtgtatttcctgaatttgaatgttggcctgccttgctaggttggggaagttctcctggataatatcctgcagagtgttttccaacttggttccattctccccgtcactttcaggtacaccaatcaaacgtacatttggtattttcacatagtcccatatttcttggagcctttgttcgtttctttttactcttttttctctaactttgtcttctcgctttatttcgttaatttgatcttcagtcactgatatcctttcttccacttgattgaattggctattgaagcttgtgcatgcatcatgaagttcttgtgccatggttttcagctccatcaggtcatttaagttcttctctacactgtttattctagttagccattcatctaaccttttttcaagatttttagcttccttgcgatgggttacaacatgctcctttagctctgagaagtttgttattaccgaccttctgaagcctacttctgtcaactcatcaaagccattctccatccagctttgttccgttgctggcgaggggctgtgatcctttggagaagaggccctctggtttttagaattatcagcttttctgctctggtttctccccatttttgtggttttatctacctttggtgtttgatgttggtgacctacagatggggttttggtgtggatgtcctttttgttgatgttgatgctattcctttctgtttgttagttttccttctgtcagtcaggtccctagactacaggtctgttggagtttgctggaggtccactccagactctgtttgcctgggtatcaccagcagaggctgcagaacagcaaacattgctgcctgatccttcctctggaagcttcgtcccatagtggcacctgcctgtgtgaggtgtcagtcggcccctactgggaggtgtctcccaattaggctacacgggggtcagggacccacttgaggaggcagtctgtctgttcttagtgctcaaatgccatgctgggagaaccactgctctcttcagagctgtcagacagggatgtttaagtctgcagacgtttctgctgccttttgttcagctatgccctgcccacagaggtggagtctatagaggcagtaggccttgctgagctgtggtgggcttcgcccagtttgagcttcatggccactttgtttacctactcaagcctcagcaatggcggacgcccctccccaccacgaggctgctgtctcgcaggtcaatctcaggctgctgggctagcagtgagcaaggctctatgggtgtgggacccaccaagccaggcacgggagagaatctcctagtctgccggttgccagggccatatggaaaagtgcaatatttgggtgggagtgtcccattttcccaggtacagtctgtcatggcttcccttggctaggaaagggaaatccctggaccccttgcgcttcccaggtggggcaatgccccaccctgttttggctcaccctccatgggctgcacccactgtccagccagtcccagtgagatgaaccagttacctcagttggaaatgcagaaatcacctgtcttctgcatcgatcatgctgggagctgcagaccggagctgttcctattcagccatcttggaactggattagacagattcttgacagaaaaattcagtagaatgtgcttaatgactatgtgttaaagaatgaaggtgggggactacatgaatttaagttaacttagcaaattgacaggaatttgaaaatggatcagttagctttttgaaggaggaaaagaagttgaatttagttttgaacatatactgtttttgaggtatctgtaagatatacataaaagtgggctatagccaatgaggaatataggacttggtttaaaagtcaaaactggggatagggaggggaaaagacagaaagagaaaggattcctttagagtgaggaatcagtgaaactgtaagcatgaattaactttttagtgcttagaattctggttttgtttcttcttatgcagacagaccatggattcttacagtgcaccagagtcaactcctagtgcatcctcaagacctgaagattactttataggtgccactcctctgcagaaacgattagaatcggtcaggaagcagagttcatttatcctgactccacctcgaaggaaaattccccagtgttcgcagttgcaggtatgctttttgtgtccctttgtgttagtcaataattgagaatatctgtgaacaaaacatttcaatttttgtaactatagtattcttagtatcttcttaacccctcagctaataaaataaatgagaaagaaacaatttcataacgatcagtgctacctctttatgtcttttatttgttttttatatttgtatttatgtatttatttatttattttgagacagagtcttgctctgtcacctaggctggagtgcagtggcgcgatcttggctcactgcaagctctgcctcctggcggccattctcctgcctcagcctccccagtagctgggactacaggcgcccgctaccatgcccagctaatcttttgtattttttagtagagacggggtttcaccatgttagccaggatggtctcgatctcctgaccttgtgatctgcccgcctcagcctccccaagtgttgggattacaggcatgagtcaccgcgcccggcctgtttatttatttttaaagtaattttcaaacatgcaacccatatatacgaggagtttttatgtattttaacctcctttaatctgaatcatgtccacggtattttttttttaacttttattttaagttaaggggtatatgtgcaggatgtgcaggtttgttttctaggtaaacgtgcgtcatgggggttggttgtacagattatttcatcacccagatgttaagcctaatatccattagttatttttcctgcttctctccttcctcccaccctccacccccgacaggcctaagcgtgtgttgttcccctctatgtttccatgtgttctcatcatttagctcccacttataagtgagaacatgtggtatttggttttctgttcctttgcttgttggctaaggataatggcctccagctccatccatgtccctgcaaaggatatgatctcattcatttttatggctgcataatattccatggtgtatatgtaccacattttctttatccagtctgtcattgatgggcatttaggttgattccatgtctttgctattgtgaatagtgctgcagtgagtgtatgcatgcatgtgtctttatggtagactgatttatattcctttgggtatatacccagtaaggagattggtgtgtcaaataatatttctgtctctaggtctttgaggaattgccacacagtcttccacaatggttgaactaattcacactcctaccaacaatgtataagcattcctttttctccacaacctcaccagcatctgtttttttttgactttttatttttctccacaacctcaccagcatctgttgtttttttactttgtaataatagccattctgactgatgtgagatagcatctcattgtggttttgatttgcatttctctaatgatcagtgatgttgaacttttcttcatatgattgttggcctcatgtatgtcttcttttgagaagtgtctgcttatgtcctttgctgactttttaatggggttgttttttttttgttgttgttttgttttttttttttagagagtgtctcactctgtcacccagccaggctggagtgcagtggcatgatcttggctaactgcaacttctgccttccagattcaagcgattcttctgcctcagcctcctgagtagctgggattacaggcatccaccaccatgcctggctaattttttttgtatttttagtagagacagtggttcaccctgttgtccaggctggtctggaactcttgacctcaggtgatcaaccctccccaccctctcaaagtgctgggagtcttgctctatcacccaggctggagtgcaatggtacgatcttggctcactgcaacctccgcctcctgggttcaagcgattctcctgcctcagcctccggagtagctggcactacaggtgcccgccaccacgcccagctaatttttttgtattgttagtagagaccgggtttcaccatgttggccaggctggtctcgaactcctgacctcaggtgatccacccgcctcggcctcccaaagtgttgggattacaggtgtgagccaccacgcctgacctggcccattttttttcttgtaaatttgtttaagttccttattggtgctggatagtagacctttgtcagatgcatggtttgcaaaaattttctcccattctgtaggttttctgtttactctgttgatagtttcttttgctgtgcagaagccctttagtttaattagatcccatttgttaatttttgctttcattgcaattgcttttggcgtctttgtcatgaaatctttgcctgtacctatgtcctgaatggtattgcctaggttgtcgtccagggtttttatagttttgtgttttacatttaagtctttaatccaccttgagttaatttttatatatagtatatggtataaatgaagtgtttttgtttttaatcgtacctgtggttctaatagagcatggcaaaaaatattcccaaatatctttttttttttttttttaagactagtctagcacagtagtgacaaagggggaagggggaaagagtagaacagggagttggaaacaaggagtttgatctataactgattgtgaacaatcaactgagataactcactacctttggaccagcccccaagtatctttttatttaatctattgaattgggcatggtttcataaagtagatttgctgccaattttttttttttttaaggcagagtctcgctctgccacccaggctggagtgcagtggcgtgatctcggctcactgcaacctctgccttccagattcaagcaattttcctgcctcagcctcctgagtagctgggattacaggtgcacaccaccatgcctggcttatttatttttgtatttttagtagagatggggttttaccatgttggctaggctggtctcaaactcctgaccttgtgatccgcctgcctcagcctcccaaagtgctgggattacagtcgtcagccactgtgcctggcccaaacaattttttaaattaagactaatcaaattagatactttaggaatggttactacttttgaaatctatagtttgaggtttctaaaagtgaaacataaattttatgttaaatatttattgaacacttattctagatagcattgttctagagagaactaaatagacaaaatcactgctgtcatccagcttatacaccagtagggaagacagataataaaaatacaaaaaaattgcagacaagaatataatgttgggtagtaataagtgctgtgaagaaaagtaaagccagatgaggtgatacaaagttggagtgggtgcaggtgctactttagatcgagtggcctcttggattacatttgggtagagaactgatgaagtgaaggaacttgccatgtgaacacttgggagaagagcattctaaagagaaggtacagcaaaggtaaaggtctgttcaaggatctgcaaaaagtcctgcaaactcatttggttggagtgcaaaaatcaggtactcaataatatatttgtattagatgttttaaatgctatgattaaattcttattgtttcctaattcttaaacttcttttgtcttgatttttttttataggaagatgttgaccctcaaaaggttgcattccttctgcataaacagtggactttatatagtttaactcccttatataaattctcctatagtaatctcaaagagtattctagacttctcaatgcttttattgttgctgaaaagcaaaaaggacttgctgtggaagtgggagaagacttcaacatcaaagtgattttttctactctcctaggaatgaaaggaacacaaagggacccggaagcatttcttgtccaggtataatacataaacagttcttgcttcctaggggaaaagtattatgtcttgtttgactaaactataataattagatataatcaacttaaaaaattttttcctatatatataggtagtttgtgtacaaaatcatgtttatttttaaaaactgaggaaatacataaaaataccaaaaaagttaaaaattatagtttaacattttggtatatatgtttggttatctgtatctatatagtcttgaaattgggatcatattgcccatacttttacattatgatatttttactaatattgtagacaattacttatatcattaggaattctgtatttttgtggtttttactgggattaaatttctataagtagaattttagtataaaaatatatatcattaaattttgtgatacttcatgccaggttactctcagaaatgtaacattttaaggctgggtgcagtggctcatgcctgtaatcccagcactttgggaggctacggcgggcagatcacctgagcctaggagtttgagaccatcctgggcaacatgacaagatgccatttctacaaaaaatacaataaataaataaataaatctggtttcttaagatagttctgttgctcttatatactacttacaggaaggaatataaaatgttgcgtttattttattttattttatttttttgagacagggtctcattttgtcacccaggctggagtacagtggcacgatcttggttgactgcaacctctgtctcctgggctcaagtgatccttccaccttagccttccaagtagctgggactgcaggtgcatgccaccacactcgggtaaattttgtattttttgtagacagggtctcgccatgttgcccaggttggtcttgaactcctgggctcaagtgatccacccaccttggcctcccaaagtgctgggattacaggcatgaaccaccacactcagcctcagatttattttgtttattattcatgcctgctgcttctgtttcttttgagctaactaatcttaataatggataaggaaattaagttctcaagcagttgaaaaggactgactttttgtttgtatagattagagtcagtaaaccatggcccataggccaaatctgatctgctgcttgtttttgtaaataaggttttattggaacatagccccttttatttgcttatatattgtctgtggctgcttttgtgctgcaacagcagagttgagaagttgcaacagagcccatattgccagcaaagtctgaaatgcttactaactggccctttacagaaaaaatttgctgacccctgatataggtcatggtattggcaaagatctcaagatgttctgggattagggttagcctaaataacagtgaattaaacaagatagtggtatactgtctttttttaaaaaaaaagtgcatggatgtaagctgtccgaggctggtatgatgcttgatgaaatcattaataatctaggctctttcttctccttagtgcatggttttcatcttagaagttaccttattgtctaacataagatgtctccagcagctctaaacattatattcaagttccaggcaggaagtaggaagaagatgggaaggacaaacagaacctgatgcagagtaaatcttgctgagacccagtaacttctctttacatcttagttggaagggaggctagaaaagacttttttttcagtgagtactctgccaacttaactaaagagactttttttttttttttttgagacagcttctctgtcaccaggttggagtgcagtggtactgtcttggctcactgcaacctctacctcctgggttcaagtagtcctccctcctcagccccccaagtagctaggactataggcatgtgccaccgtgccaggctagttttatatttttatagagacagggtttcaccgtgttgcccaggctggtctcaaactcctgagctcgtgatccacccgcattggcctcccaaagtcctgagattgcaggcatgagccatctcgcccagccataaagggactgttttattgtgggaggaaaaatggatactcaagagacaattagcagtttttgtcaagtgaagcacttgatgcacagagaagttttgtgacttgcatattatcagtcaagcatctacccttgtgaggattagaaatgacctcttgaattcctggtatagtgttctaatagttttcaaattaaatttcgtttcttgatagggttacaagactcttaggtcatgaaagtgtgataaagttaatatatctaagcttccagctatttgagagtctttcataatttcttgaacaaggagaaatatgttaaaagaactgtgtaaatgatcatttctgaaggggtatgatacaaagctatgatattaaccttggtctgcttaatgctttaacagagttctttgagtatccggaaggcatgtttgtcatgtaacttaaaatttagtttgaggggttaggcaatcagctaaaaatataataaaatatcctaaatgttctgaatggattgtccaatgagccaaatcaaaagagattaaaatgttagtaggaataaatttacagcctcagtataagttgggagagatttacctataaagcaaacatgaatatacagggctagtttatataaagctgtcaactaaaaaccagaaaactgcaatctgagattacattaataggagtataatctagttaaaggtggtggttagtcttgcaatgagacctttttcccccttccttccccgaatcagagctttttaaagtaattatattcacttatgaatgattcctatgcagaataatttcagggaagagtgactagaatagtgagagaatgtgaatgtatgtcataggtgaatggttgaagaaactggaaatattgaacttagtactatgtatgatggggaccatcaaatatttgaaggacttttcctgtagaagagagatcagatgtgattatattctgcatgcccaaaaggaagaaagcaggaccagtgggtagaaactgtagggtctaacatataaaagaacattttaagttgatagtgctgccttaggaaatattgaagccttcctcaatgaaagaattcaaacatgttagattttgtgacctttcacagttctttctaaagttgaggggttttttttgtttgtttgtttcagggtactacacctggttatgccatattggtagctcttattttgcagtttggttacaccaagattttgccatatatcatgtttccactgtataagaatattgggggccgggcctggtagctcacgcctataatcctagtactttgggtggccgaggtgggcagatcacctgaggtcagaggttggagaccagcctgaccaatacagtgaaaccccatccctactaaaaatacaaaaattagctgggcatggtggtgcatgcctgtaatcccagctacttgggaggctgaggccggagaatcacttgaacccaggaggtggaggttgcagtgagctgagatcacgccaccgcactccagcctgggcgacagagtgagactccatctcaaaaaaaaaaaaggccaattattttgataagccctgttaatcattagggagactattccctctatgtttttttttgcaagtattacattggctcgtcttatttttaatgaactaattttgagaagatggaatttagaagtaaatgtacttttgaatttaaggagcctgtttactttctttgtagattgtgtcaaaatctcaattgccatctgagaatagagaaggtaaagtgctgtggactggctggttctgctgtgtatttggagacagtcttctggagactgtttcagaagatttcacctgtctgcccttattccttgcaaatggagcagagtctaacacagcaataattggaacttggtttcagaaaacctttgactgttatttcagtcctttagcaatcaatgcatttaatctttcctggatggctgccatgtggactgcatgcaaaatggaccattatgtggctactactgaatttctttggtctgtaccctgtagccctcaaagtctggacatttctttcgcaatacatccagaggatgcaaaagctctatgggacagtgtccacaaaacacctggggaggttacccaggaagaagttgacctattcatggattgcctttattcacatttccatagacatttcaaaattcatttatcagccacaagattagttcgtgtttcaacatctgtagcttcagcacatactgatggaaaaataaaggttagtttgaacaatctagttaagtaatttttccttgttttatggttttaaaaatgtatgatgattgtattgtccactcaattgaagaaacacacttgaatgtattcaagacaatagagagcttttattttatggtttatggtttattgcagtctttagccttctagatatagccttataatggaaggacactatatgctgtgtgcttcagcttttggtaataatgtgaattattattttgtagtaactttgaaactttcagaattgttccttgtgaaattttgaaataattatcagagtaatagagaattttgtgttagacaaaattatagccagaaacacagaactaagatgtcatctttatgttccaggcttttctgtcctcattgggaaagaaataatagagacattgttttattctctacagagtgatttctgataagaagtatcagaaataggccaggcatggtggctcacgcctgtaatcccagcactttgggaggccgaggcgggcggatcatgaggtcaggagattgagaccatgctggctaacacggtgaaaccccgtctccactaaaaatacaaaaaattagccaggcgtggtggtgggcatctgtagtcccagctactgggggaggctgaggcaggagaatggtgtgaacccgagaggcggagcttgtagtgagccgagatcgcgccactgcactccagcctgggtgacagagcgagactccgtctcaaaagaaaaaaaaaaagtatcagaaataaactgagaattggctcctaaaatatattaaaatacacagccacaatgtacattcagtaaatgtttcctgtgatcttgttactgtgctaagagtttaacagacttaaattctaatctttagagcaaccctgtagttaggtgttttttctgtgtgtgctttttgtttttttttttgagacagaatctcaccccatcacccaggctggagtgcagtggtgctatctcagctaactacaacctctgcctcctaggctcaagcgattctcgtgcctcagcctcctgagtagctgggactacaagcatgagccactacacctggctaatttttgtaattttactttttttactatttttatctttatttatttatttattttgagacggagtcttactctgtcacccaggctggggtgcagtggtgcaatctcaactcactgcaacttccgcctcctgggtttaagtgattctcctgcctcagtctcccgagtagctgggactacaggtgcctgccaccatgcccagctatttttgtatttttagtagagatgaggtttcaccatgttggccaggctggtcttgaactcctgacctcaaatgatccacttgccttggcctcctaaagtgttgggattacaggcatgagccaccatgcctggctagttagatttttttttttttccttcgagatggagtcttgttttgttgcctagactggtgtgcagtggtgtgatcttggcttactgcagcctccgcctcctgggttcaagcaattctcctgcctcagcctcccgagtagctgggattacaggctccaccaccatacttggctaatttttgtatttttagtagagatggggtttcaccatgttggccaggctggtctcaaactcctgacctagtgatccacccacctcggcctcccaaagtgctgggattataggcatgagccaccgtgcctggacagttaggtgtttttatccacattttattttaaaacaaggaaactgaggccaagataggtttaaatgacaagcaagatagattatcaagaggaagaatcaagatttgaactcttacctcgtagatccaataagtcaatactctataagcactatattcatgtttttcaaactggaggtcacagtgcaacagtaggttgggaaataattttgatgagaccagcattaaaaaacaaaaagggaaagaaatagaaaatgtaaaaatgaggggttttttgttttagagagagtctcattctttcacccaggctggaatgcagtagtgtgattatagctcactataacctttaactcttgggctcaagtgatcctcctgcctcagccttgtgagtagctgggactataggtgtataccattacacctggctgttttttacattttaaaatttttttgtagagatgaggtctccctttgttgcccaggctggtcttgaactgctgggctcaagtgatcctcctgcctcggcctctcaaagtgctgggattatagggataaatcactgtgcctggccaaaaatgagtgtattgcatgtggtaagcttcatgaattaaatctagaagttaaaccaatataacattgattattcaaatatcaatctgctttgttataattaatactattctaattttaaatgtctccttctttttctttttgcagattctgtgtcataaataccttattggagtgttagcatatttgacagaactggcaatttttcaaattgagtgaagccttatgtggactataagttatagattatatactcttattgataacttgcctaattgctatgctgaaagagactgcaggagaaataggcatctatctctgcatctgttttccccaccatgcctttggagttgccaagatggaagccaagaaggatctagaagaacaaagaatatggtagtagatgagccacagccaggtgcccatgtactaatcatgataacctgacatgccattctcaaaatgctgagttgttaatttcttgtcatctttaaatatatatatataggctgggcttggtggctcacacctgtaattccagcactttgggaggctgaggtgggtggatcatttgaggccaggaattcaagaccagcctggccaacatggtgaaaccccttctctactgaaaatacaataattagctgggcgtggtggcacatgcctatgatcccagctactggggaggctgaggcaggagaatcgttttaacccagaagacaggctgcagtgagccaagactgcaccactgcactccagcctgggcaacaaagtgagactctgcctcaaaaaataaaaaagaaataaaataaataaatacagcgtttattatgtttaaactcttaggattcaaatgagatgtatctaatggatatttctgatttgggtctttaaaacctttaatctcttttaagcattttagacttgcattcagaaagaattctgtcttctaaagacattttcctagcatttcactgcggagaactggcaatcaaaatcccctcaaaagggaactaaagattaatatacacatttttttagtcattaatatgcttctgttttaaatacagttcaactcctgttgcaatgttgaattaaatgtttattttaaaatgaa

SEQ ID NO: 494 - DNA, 18785 bp, Homo sapiens
ggtgtgatctcggctcactgaaacctctgcctcctaggttcaagcgattttcccatgtcagcctccccagtagctgggattacaggcgcacggcaccacgcccggctaatttttctattttatggtagaaacgggatatcaccatgttggccaggctggtgtcaaactgctgacctcaaatgatccgccctcctcggcctcccaaagtgctgggattacaggtgtgagccaaggtgcccgacctgatgtgcttgtaagaatttaaatgaagagggtcagtcagcttaggagacgaggttagatgtaaggatttcagacttgtcagtatacaggtggtgattgatgccgtaggaatgactggtattacccagggagctggtgcaaagtaggagccttggggaacatgttaaggggatgtgagagtaagcccacaaagactcagaagtggccagggagtaaggggaaaatgggatagaatagagcaaaagccacgggaggcattccttgaattccttggactcagatatgttaggggacaggaaacacattgaagacaactgaagagacttcagtgtgctgctgagttcttagcagagtagacagctgatttcaccactattccagaccctaaagatttctcctgaaattgcactgttatgcaatttttttccttctctattgccccacctctggggcctacactctttaccttctctgatttatctgacccatccgcatatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgccgcgggccgggctcgcactcgagattctcgcccgtgggattccagtcctgagctgaacgagagataagtctttgtcaccccccagtctttactgtttcgagaaaccctaagattttttaaaaaaaagcccaagacgtcaagtcggggaactccaacattggggtgtccagaaacactggggtttcaggcgctctgtaaatgcgtccgaggtccgcggttctgcccgcaagcccagaccccggcctcacttccgccccgcgccccgcgccccggcctcacttccgccccgcgccccgcgccccgcgccccgcgcgcctccgcccgcccctgctccggccttgcgcctgcgcacagtgggatgcgcggggaggtggtgcgcggggaggtggagggcgaggggcggggctacctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggtgagtggccggcgggagccgcgcagagtccgaggcgcctgctgcttcggcaggagcgccgagggccggacttgtgtaggagaggggcgtatgtggaggaagccggtcaggccaagccgcgaggagccgcgggatccctggaaccctgcggctcccgcgttccctgacctggtgctacagccccaccctctcctctcccgatgtgcgcactccgtccctcgtgcttggattggctcccggggtagagccatcgcgtggcctgcctctcccattggttggcgtagggaggtgttctcctccggggcccctgattggccggctccgggaggcgccatcggtaatgcctgcggcaggggcggaactgctaggtggtctgagcccggctttgggctggggtcgggctgtcacacaatggctagaagtcgtgacttcgtctccttcgtgccgcatggttttcaacgcccttgacccgccggttccttttgtttgggaagcatggggtcgcatccagtccttcggatttggggaaatagaagggctacagcggcgtccctaggccgttctggaggtcgcctgtccagccctcggctgctgcgagttgtggcacccaccttgacctttgctcagaccagcaggtgtaggaacgtgtgggaggagagggcactgcctcctcgcgtggccttgccaaacagggtcatgaggctcccctgctcgtaggtggttcccgtattacccgcaggcttgtgatgtccacgctctccgcctttctattgtaggttccttcaatggtgccttagctgctgttcctgtccaggacctgggctccactgtcatcaaagaagtcttgaagagggccactgtggctccggaagatgtgtctgaggtcatctttggacatgtcttggcagcaggtaagtctcagtgattccaggagaagtcaggcttattagaaacagcccataaacacacacacacacacacactctcacacactcacacactctctcactcactcaagttcttgcctccttgcttttgctcagagttccctctgttatgattcctcctgttggcccccttcttccagccctgtcagtagcttctatccagcttgagactcagcttcttggccaggcagggtggctcccgcctgtaatcccagcactttgggaggcggaggaggaaggatcacttgagtccagaagtttgagactagcctgggcaacaaagcaagaccccgtctctacaaaaaataaaatagccaggtatgatggcctgtgcctcccagctactggagaggctgaggtgggaggatcacttgagcccaggagtttgagactgcagtgattgtgtcactgcactccgtcatgggtgacagagtgagaccccttctctaaacaaacaaaaagacttagcttcattaatatgctttttgtgaatgaacttagaccactgacctacaccacctacactgccttttcttttccttttttttttttttttttttttttttttgagacggagtctctctctgtggcccaggctggagtgcagtggcgtgatctcggctcactgcaagctccgtctcccggtttcacgccattctcctgcctcagcctcccgagtagctgggactacaggcggcccactgccttttcattcttacgaagcagggccggccgggcccggtggctcacgcctgtaatcccagcactctgggaggccgaggtgggcggatcatgaggtcaggagatcaagaccatcctggctgacacggtgaaaccccgtttctactaaaaatacaaaaaattagccgggtgtggtggcgggcgcctgtattcccagctacttgggaggctgagacaggagaatggcgtgaacccgggaggcggagcttgcagtgagctgagattgtgccactgcactccattcagcctgggcaacagagtgagactccttttaaaaagaagaagaagaagcagcagcagggccagcctgacgcataggaaagtatgcctgctcctccttactacctcaaagtgtcactcattcaacaaaaatgtattcagttcctcctatgtgccccatactgtgcttagtgctgggagtatggttccaacaatacaggtaagttccctgccctcttagggctcagttctgagcttggaaaataggtgccacatcatgccccttgcaaatggggcatatcactccccagaggaatatagctgagtcctgagagtgcccccatcttctgattctttgggtttgaacactcgtaattaattaattaattattattattattatttaaagagacagggtctcactctgttgtccaggctggaatgcagtggtgtaatcaatcgtagcccactataacctcaaactcctgggctccacggtatcctcccacctcagcctctggagtagctgggattacaggagcaggccaccacacctggctaattttttaaatttttttgtagaagtggagtctgtctgttgcctgggcgtgagtgcaatggctgttcacaggcacaatcatggtgcaccatgcccttgaacttctgagctagctgggactaccggtgcatgtctactaagtttaaggcttttaaagcactgtgctaaatgctttcctttcattacctcatttaatcttcctcacaagtctgttatatcctattatcttcattttacaaatgaataaatgagagtttaagaggttaaatgacttaccagggtcacagtttgaagtggagctagcacttgaacttagatctgtcctattccttgagccagataccttctacaatcatgtaacaaatgtttattgagcacctactttgtgccaggcactattttagcagctggagataagcaatgttcatatcagatagaaattctcattctcatgaagctcgtagtatgctaaatgctagcattattaattgtgttagcacctcatttctttctttttctttttttgagatggagtcccactctgttgcccaggctggagtgcagtgacgcaatcttggctcactgcaacctctgcctcccgggttccagtgattcttctgcctcagcctcccaagtgactgggattacaggtgcctgccactgtgcccagctaatttttgtatttttagtagagatggggtttcaacatgttggccaggctggtctcgaacttctgacctcaagttatccacccgcctcggcctcccaaagtgctgggattacaggcatgagccaccatgcccagccctgtacctcatttcttctttttcttttttttgagatggagtctcactctgtcgcccaggctggtggagtgcagccgtacaatctcggctcactgcaacctctgtctcaggttcaagcaattctcctgcctcaacctcctgagtagctgggattacaggcgtgcaccaccatgcccagctaatttttgtatttttagtagagagggggggtttcaccatattgtccaggctggtctcaaactcctgacctcaagtaatgcgcccccctcccccggcctcccaaagtgctgggattacaggtgtgagccactgctcacagcctgaggcaccgcactgggcctgtctttttaatatgtatatgatcctgcatatgttttcagtctcaagtaaccttacccgtttttagtttccagcctaatcccagattgataacattgtgatgaatataatctctaagtttttatcagcgacttatttgctagttcttccccacaaactctccaaggaagggtggtaggtttgagtatatctgaaactgggaatagagtaaccactttataaacatttaccattgactctgataacagacaatggcgattgagaatatttgaaacttttaactccattctcttctgtgctactttaagtaaattatgtatttcttcccaactaaaggaagtcccatagttgaattatgaaaagatatttgtgtttcagtactcagaatgagaaaaaaaggtatttgtgaattctgagtttgtatatattttgttatataaccatttaagcatagtgtaatgaatactaagcaagaacagaactgcttattatcaaaggttttcctttttaagtaaccctttttcttctcaagtgtcttaagccatgatcttgggagcaaatggccctagttagaaacactgataatgcctaggttatatcctgtgtttattagacataggtttgataatgcttatttaagcacccccccgcacttttttttttttgagacggagtttcgcccttgttgcccaggctggagtgtaatggtgtgatctcagctcaccgcaacctccgcttcccaggttcaagcaattctcctgcctcagcctccctagtaactaggattacactcatgcgccaccacgcctagctaattttgtatttttagtacagacagagtttctccatgttggtcaggctggtctcaaactcccgacctcaggtgatctgccctccttggcctcccaaagtgctgggattacaggcatgagccaccgcgcccaactatttaagccatatcaaaagatgaggatgacacttctttcttaatgtattaatgacttatttatggaggagaaagcttatatctatgaaatacctacagagcagcacaaggcagtatatattcaagggctagactgtgacaggtggagagtgtatacaggcctttttgcctccagtgggcacttacttgacctgtaggctttcagaagtggcaggtaacccaactggcaattttccacacactttcactgtgacattttgtctttctccttgattgctaagagtcctctgtgttcctctttctaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggtaaggcctctctgatgaggtggctttcactgacctcacactgagaaactcatgtctatgccagaacagagtaaacagatgcatagcagagctggaaccaaacagtgaacaaataaacagaaatgacaaccttgatccctacttgaatgtgaagtattcttcagtttgggtgggaaatccgggttgataagaagtttatcaaccagtgtgattggaaccgaatatactttttctaaactattaatgaagcatgtaatattttctgaattaaattcatattagttgcttgatgtccttggttttaaatttctttcccattgtgagtaaaaggcaaaaaacagatgttgccacttaccttcctgcacatgacaaggagatcctggggaccagactttttgaccttttcagggtatagaacatgtaaaagaggaccaccaagtggtgcccttctccagtaggtttgccaggcatgatttgtttcaccaagttccatacctcaaactggcatagtggttgaaagaaaaactataccccctgcttcctactgatgcagctcaggggctgaggtgcagattccctagatagaagctgattcagcccagccattgctgaggttcaggaggaggcaggctaaaggtaacaaaaataatcggagtgattttgatgggatgatactgacatctgtgtagtactttaccaggtgcttttgtacatgtgttcacaacagccccatatagggtagatgataccattcccagtttacaggtaaggaaactgaggaccagagccagcattcaaatacaactcttccgactctaagtccaatcaatgactctttccattctaatatacctgctgttgagttggtgagagttaagactggccgctactcagaaatccctccccatcatttagttagcctgattattctcactgtagacattatgtcatccattgaaataggtaacacattgttagctttacttaagcccttagaggatttcttcatttaacagataattaattgcctcgatggaaagaataaatggaattcttaaggaaacaggacacagaatgggtaggtttgagggagaattgaaaatgggtaggtaggagagtaatcgttcccaacaataggaaagatgaagtctgctaattccaggggtctttagaccttggcctggctgaggacctagaactggggagaagggctgcaaaggggcctagatgaagacttaggaaatactagatagttttgagttgtattctggggagaagactaattgcaactaagcctaaatccatttttatttctgacttctaggctcctcacttggcttacttgagaacaggagtaaagataggtgagatgccactgactgacagtatactctgtgatggtcttacagatgcatttcacaactgtcatatgggtattacaggtaaggcagacatggctgaaactgtattagctttaaaaaggttaaaaagaccatatactaatctgcttcttaggtgctttcgtccttatggccagagactgtcttaaggatttttatatctcttctttgattaactgaagtgaagtaagtattctcttctttgtgaactcttgattatcagagaatgttagaagtgggaagtacctcagagttcttctggatcaacccctcattttaccaaatgaagaaacagggcccacaaatagtgcttctgtggcagaggtagtgacagagataaaccagttgtttttttggtacctagctgtactttttgtactacacaattgggttattggtcattcatgctgaagggtcctgtggtctaagtttaatggcaaagcaactgggaaatcaaaagcactcttgtctttagtatacatgtaaaacttaagaaacagaatagacattttagagttaaagaatcaaaccctgagaagttaagcaccttgctcaaatgcatgcagcaatggctctggttttatgtaacacataaatatgtgaaaaaggtaatggggaaaagtacaagattccaagagggaactgtgtgcatgaatgctaggaaggaaggaagggcttagggatatgggaagcaatgagaagctcaaggcatcttgaccacttctcgacttacagccacaacagagaaggctataaaaacacaggcagacaatggaagacactgtgtgaccaactgcctcaaccataactagaggtggtcattaaaaattcagatcccgagccctttccaaggtgtactgtggattgaatggtactcttccagcctccagaactgtaagaaaataaattgctcttctttagaaaaaaagaaaagaaaaaaggctcaggtcatgatggagtaattgacaaagattagatttcctactataaacaagcataaaacttgtgaaaatatataaagccactgttttatgtatgtcaggttttgactaatactcatgtaagactgagatccttgagagaagggaaaaccccactgtcactgtctctacccagggcacttcccaaactgtgttatggagaggcagagcctaagctggaaacagtggtctcagtgatctgaagaagcagagaatttggggcttctgagatggctggagtttgtggggcagaataagggggagaagaaaaaaagagctccagaaatctgcaaaaggttccccttaagtctttgatcaaatactaagcttgtagataacagcttacaaggcctagtagaaaagagctgcaaaggagaggtgaactggagattttatagattactaggagataaaagttctggacaagcgagtggaaaccttactgaactccttggacactccattgacatctcagaaagaccacagtttaggggtagggccaaagccatagagtaaaagctactctagacccaaactaataagcttaaaaacaagcctcaaaaggatcaaggtgatttgccagtattttgactgcttgtggaaacaaaactcaatatattctctaaagataataaaatctctatgtccagttatgtagcaactataatgttcagcatgcaatgagaactttctagatacacaaagaattaggaaaatatagcttacaaccagggtggaaaaaaaccacaacagtcaacagaccctgcaatactagaattatcagatgaggatcttaaaggctctattttacatatgtttaaagatacaaaggaaaatataatcttcatagaggaatagatgtggacatctcaggagtaaaaggaaaaaatataaacaagaaccaaatagaaattctagaacttgcaaagtacacaatctgaaattaagaattcactgggatggggccgggcatggtggctcgcacctgtaatcccagcaccttgggaggctgaggtgggaggatcacttgaggctgggggtttgagactaggctgagcaacatagttagacctcatctctaaaaaaaaagaaaaaaaaattctgaatggccttaacagcatcttggagacagaagaaaaagggtcaggaagtttgaagatagatcatatacacgacctgaagaacacagagaaaaataatgaagaataaatgaacaggccaggcacggtagctcacgcttgtaatcccagcactttgggaggccaagccgggtagatcatctgaggtcaggagttcaagaccagcctggccaacatggggaaaccctgtctctactaaaaatacaaaaatgagctggatgtggtggcccatgcctgtaatcccaactacttgggaggctgaggcagaagaatagcttgaacccaggaggtggaggttgcagcaagctgagatcacaccattgcgctccagcctgggtaacaaacaaaactctgtctcaaaaaattaaattaaattaaattaaattaaaaaataggccaggtgtggtggctcatgcctgtaatcccagcactttgggaggtcaatgcaggcagatcacctgaggtcgggagtttgagacccacatgaccaacatggagaaactccatctctactaaaaatacaaaattagccaggctggtggcgcatgcctgtaatcccagctactcgggaggctgaggcaggagaatcgcttgaacctgggaggcggaggttgcgttgagctgagatcacgccattgcactccagcctgagcaacaagaatgaaactccgtctcaaaaaaataaaatataaatgaacagagccttggtggtctgcaggacaaaataaataggactagcatgcatggaataggaatctcatacataaggaagagagagaatggggcagaaaaaaactgaagaaaatttccacatttggtgtgaaaagaagttcaaagaccaagatagacaagggaaaaattacaccttagcaaattgtagcaaaaagttaaaaaaagatcatgccactgcactccagtctgggcaacagagtgagactctgtctcaaaaaaaaaaaaaacaagagtgaaagtgaagagccatttttagatgaaggaaaatgaattgcctgcacacctacactacaagaaatactaaaggagccaggcatggtggtatgtgcctgtagtcccacctactcaagagctgaggcaagagattgcttgagtccaagagtttgagtctagcctgggcaatgctatcatagtctactatgattgcacctgtgagtatctactgcattccagtctggttaacatagtgacacaacaacaacaacaacaacaaaagaatagcttccagccgggcgcggtggctcacgcctgtaatcctagcactttgggaggccgaggcgggcggatcatgaggtcaggagattgagaccatcctggctaacacggtgaaaccccatctctactaaaactacaaaaaattagccaggtgttgcagcaggtgcctgtagtcccagctactctggaggccaagggaggagacttgcttgaacctaagaggcggaggttgcagtaagctgagatattgcaccattgcactccagcctgggcaacaagaatgaaactccatctctaaataaataaataaatagtgtaaataaatactgtataaaatgcaaagcactcagaatagccaaaacaattttgaagtcagaaaatagcacttacatgctctgattttaacattacctataaagctgttgtaaacaagacaatgtggttttggcataaggacagagaaagagaacagagttcagaaatagacccagacttatgcttgttttcaacaaaggcatcaatggaatgaaatggagaaattaaagtcttttcaacaaatggtgctggaataacagattactcacatgggaaagatgaacctagatccctacctcacaccctatataaaagctaatttgagataaatcgtggatttaaaaataaaagcaaaaaatgtaaagcttctagaagtatatataagagaatagcttttacagggtgcagtggcaggtgcctatagtcccagctactagggaggctgtggtgggaggatcacttgaggccagcagtttgaggttgtatagtatactatggttgattttgcctgttagtagctgctgcactccagcctggtcaacatagtgagacatcatccaacaaaaaaaaaaaaaaagaaagaaaaacagcttgataagtaaagacaagacatagaaagcaaagcaataacttttttgtgtgtgtgtgtggagacgggtctcactctggcacccagattggagtgcagtggctcaatcttggctcactgcaacccccacctcagcctcctgagtagctgggaccacaggtactcaccaccatgcctggctaattttttgtattttttgtagaaatggggtttcaccatgttgcccaggctggcctcaaactcctgagctcaagggatcctcccacctcagcctcccaaagtgctgggattacaggtgtgacccaccaaacctggccaattctcacatttgtagaagagagttacaaatacggaaagggagaagaatgtagcttgtggtgttaggttgcattttggagaactcaaaatgcagtatgaactcaaggtgttaccatgagtgtgtgtgtatatgtaaaattataaataatacatatggaagtttctactgaacagacctagaaacaatgacaaaccagtaacaacaagcagtcctgacacccagatcttctaaatacatttatccactaaaaggaactaaggttgtttggagaaatggccctttccaaggctagggaaaaaatgctaaaaaattaaggacatgctcagggacatgttgaaagcacacaggaggcagcctacggggcttccactttcctgtagtggaattttgaacaatttgagcatcagagtcagtaatgatagtaatgggttgtaactgcccaaattttgaacaatttcagcgtgcaaataagttatgatagtaatgggttgtaactgcctaaattttgaacaatttcagcgtgcaaataagtaatgatagtaatgggttataactgcccaagtattgaaaaatttcagcatcaaagtaagtaatgagagtaatgagttataacttattcaataaaatgaaaatgtatgagtccatcctgatataaataactgaataaatgggagaaaaggaaaaggttttctttgtggtaaaatgccaattaatatcttaccaatagaaggaatgttggagttagaaagtcatgaatgaatgctaaaactagtgggtgaaaatatgatggggaagaagatatttggataatccaaaaagaacctctgataaattattgattacttataaatgaaaaaatggtacctttaaaagctagaaacctggtgaataccaaaccattttaaccaagtgatcaaagataacatcacctgggataaactgattgtcatttgtgtcctaataagactcactgagaaaaatcatactatcattcagtggtatacctgccttttggcagaatcttaatctaattctgaggaaacatcagacaaatcaaaattgatgacccttaacaaaagaactcgcccatgttcttcaaaaatatcaagcttaagaagcatagtctgaagaactgttacagacaaaagcaaactagagagattgatagttgtacaatgcatgcttctttattggctcaaataaaggagctagaaggacattactgaaatataggtgaaatttgaatgtggaccaaggattagataatagtgtttgattcatgttaaatttcctgatttttgttttgttttgtgagacagggtcacccaggctggagtgcagaggcacaatcatggctcactgcagccttgaactcctaggctcaagtgatccttctgcctcagcctcccaagcagctaggactactagctacatggcacacacaccatgcccggctaaatttatttttaatggagacagggtctcgctgtgcccaggctggtctcaaactcctgggctcaagtgatcctcccacctcggcctcccaaaatgctgggattacaggtgtgagccgccacacttggcccaatttcttgagttttataactgtgcttatgtaagaaagtggccttgttttggggaagtatacactgaaattaaaatttaagagtaagaaggcattgtatctccaactttctctcagatggttcagaaagaaaatattaaagcaaatggagggaaaatataaatggtgactctgggtgaaggaaatttctgtaagtttacaattatatagaaagggaaggagagaagtatgactcctgagagtcactgcaacatttccaaaccaactgccagtggcaggcagggccaccccacacagagcattgcacaggccaccatgagcctgctagcatatgtggtcagtcagtgcttggtcaaatgtggacgacttgagctatcaaatgccagttcatgaaaatgttagttttttgctgtttttctcctttcccagctgaaaatgtagccaaaaaatggcaagtgagtagagaagatcaggacaaggttgcagttctgtcccagaacaggacagagaatgcacagaaagctggccattttgacaaagagattgtaccagttttggtgtcaactagaaaaggtgagtatatcatagtggtttaaacatcaacctatttataggtaagagtaacatctaaaagagtaatacataggaatctttagaaattatatcttagttatgtttttcaggttgcaaatatatgtcctggatacatgaatgtggggagggggtatgctgggtttacaggacacggtaacatgggacctatgtcagcactcaagcactcttggttccagagcgtccatgaccactgtgcacacacagcaggtttcatgagaagctggagcactggctcatggttgttaggaggcaccagctgacctgtttcctgtataggctcaacctcctcagaagtggacacccattacttctcgctgtttctgtgtgatctccatttcacatttctaaagggtggatcttttggggtcactcgctattttctaatacagaatgctcccgtcaagctcccttattgataactgatatctcttatgtcctgccagcagtgcacgattggctttgagactgcctgatccactcactcgtaaccagccaagtactatgacccaaactatagcagaatttggcacaaacaggtccctggtagctactttcctcaggaaggcctatggatttggaaaacacaggtgtctcataaggacatactcataaattgttttcatgtacaataattcttgtgtgtactttcctcctgttgtcatcaaagtggtcacatattaaaacttttctgctaaatatgaatcctcatgtttaatggcagagaacccaccattcccagcacacttacttctgtctctggactaatcttgagtaattggttttcctttgcttaggtcttattgaagttaaaacagatgagtttcctcgccatgggagcaacatagaagccatgtccaagctaaagccttactttcttactgatggaacgggaacagtcaccccagccaatgcttcaggttagattttctgaaggacatctgggggaatactatgttctataatgtctaccgagtgaatatttttctctttatttatatacaaaagtactattttttgggacagggactcactctgccagccaggttcgtgtgcagcaatatgatcattgctcacttgcagcctcaaactcctgggctcaagtgagccccctgccttaacctcccaagtagctgggggactacaggcatgagccaccacacccaactcaatatttatgtacaaaattattcttaaaacagtttaaggaaacatgtcatttctctgtatttgatcattgacttaacctatactgaaagaattaatttggtttcttgacatcccaactagacatacaaatgaagaagtaaattagggaacttcagtttatctacctttgtatttttccagtaccagaaactcccaatacctccttgtgaagcccaggcttattcttccatttcctgtcagagatctcccctccccaactgctgtaatcctttttttttctttttgagacggagcctcactctgtcgcccaggctggagtgcagtggtgcaatcttggctcactgcaatctccgcctcccaggttcaagcaattctcctgtctcagcctcctgagtggctgggactacaggcgcacaccaccacaccggctgatttttctattttaagtagagatggctttcaccctattggtcaggctggtctcaaactcctgacctcaggtgattcaccctcctccacctcccaaagtgctgggattacaggcgtgagccaccacgcccagccccgactactgtaatcctaccactttctctagttggaaagttttgtggtcaatatattgccaaacataatttctatgtaaagtctgttgaattatagtaaatgccttagccaacaggtaaaatcatttaactcatgtcttcaggtggtaaagaagccacagatatgtaactgaggttaataagcatggtagaaattaagtcactcatattttacaggaataaatgatggtgctgcagctgtcgttcttatgaagaagtcagaagctgataaacgtgggcttacacctttagcacggatagtttcctggtcccaagtgggtgtggagccttccattatgggaataggaccaattccagccataaagcaagctgtgagtataaccctattcccttttatgaaatttgtcttcctgttagccttaagtgagcttattcatgtagttagctctagtctttccctaccagaagagtaaccaagagcatttatttctatttttgagataaggtcttgctctgttgtccaggctggagtgcagtggcaccatcatagctcactgcagcctcaaaactcctaggctcaaatattcctcctgccttagcctcccattacctcgaactacaggtgcaccaagccttcttcatttcgtagagacaaggtctatgtcgcccaggctggttttgaactcctgagttcaattgatcctcttgccttaggctccccaagtgttgagatttcaggtgtgagccactacccccagccactgagagcatttggatcacatgctttctaggggaactgattctgttacattagccttaggtacacataacagatgctactggttcaaaattttaagacaatttagaatttctaagggatcttttagatcacacccttaaccttttggatggaatggatgtcactaaggcaaaaatgtgtgagaatgtcactgtattaacctaagaacaaaccaaagtagcagttaccagtatcatgcagcatatatttatgttgacaaagaatggtttaactttagcctttccacccaagtttagacctcttttctatgaatctttcctctaggttacaaaagcaggttggtcactggaagatgttgacatatttgaaatcaatgaagcctttgcagctgtctctgctgcaatagttaaagaacttggattaaacccagagaaggtaaagatgcacaagtaaccctgagagcttaccagtgaatttcacaatccaattttaagatagtatcttctaggtgttggccatgtgggtaatagttaaagaaatactagttactaggactgagttcattacttcccaaggtttaaaaaaaaaaaaaaaaaaaaaaaaagacattggcttacttggcataaaaggaacgaggtaagataggcagggatgaattttcacaaaggtgtaaatttattcctaagcagttaaaatgaaaatttgagtttgaaagggtagcatgctgatacattaagaggaaaaagacaagtttaagattttaaactgtgtccacagaagaataaacaatctaaatcttttctcccccgttaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcaaggtacaagacaattgcatttaacattgttataaataaaaggaacatcagatcaatcattaagggctccagagtgaacagcatcttcataacttccatgtttatcatctttactttctg

SEQ ID NO: 495 - DNA, 61235 bp, Homo sapiens
cccggcgcccgcgcacactcctggagtgaagagccgacctgtttcactgtcctgactcaccaccatcttggtagtgtgcaagactctgggacggcatgagaaaggcagaaagggagcaaaggagctggtggggtgtcacagggcctatgtatgaggcagatgtgagttctgcatccagttttgcaatttatccatttacctgcctgagacttggaaacacctactttatagtcctgattcaagtgttggcggatggaagggaggagactcctgaccctcagaatggtaatgctgaaattttttgggtgcgctgttatggccttttctttgatcttacaatattgctttctcctgaaagaatattaaacataagttttaggaaacctttggacaattccaaacatatccaaaaatagaataactaccttagcaagctttaacagttactatacattttgacaatcttgatttgtctatatctctaaacacttcttcccttcctaggcatatttggaagcaaatctcagacatcatatcatttcatctgtatatatatatttttaaacacggtctcactgtcacccaggctggagttcagtggcgtgatcatagcttactgcagcctcacacccctgggctcaagcagtcctgcctcagcttcccaagtggttaggaatacaggcacaggcaactatgcctggcttacaattatttaagcacatatttctaaaaaagaattattattaaaaagaaaaaaaattgaccacagtgtttcacatgtccgtgtgaagagactaccaaacaggctttgtgtgagcaacacagctgtttatttcacctgggtgcaagcgggccgagtccgaaaagggagtcagcaaagggtggtgggattatcattggttcttataggttttgggataggcggtggagttaagagcaatattttgggggcaggggttggatctcacaaagtacattctcaagggtggggagaattacaaagaaccttcttaagggtgggggagattactgatcaacaaagtacattgatcagttagggtggggcagaaacaaatcacaatggtggaatgttatcagttaaggctattttcacttctgtggatcttcagttgcttcaggccatctggatgtatatgtgcaggtcactggggatatgatggcttagcttaggctcagaggcctgacattcctgtcttcttatattaataagaaaaataaaacaaaatagtggtaaagtgttggggcagcgaaaatttttgggggtggtatggagagataataggcgatgtttctcagggctgcttcgagcgagattaggggcggcgtgggaacccacagtgggagagattcaactgaagaaagatttgggggtaaggggtgatattgtggggttgttagaaggagcatttgtcgtatagaattattggagatggcctggatgcagttttgtatgaattgagaaactaaatgaaagacacaaggtccgaataaaagaaggagaaaaataggtattaaaggactaagaattgggagtacccaggacatccaattagagagtgtccaagggggttcaacgttgttgtctgcttggttggagagtttttgggctctatctctatccttaagtttttttatgttgtcatataccaggccagattgatttaggtaaaaacaacactcttcatttaaaaatatacaaagtcctcctttttcagcagtgagtaagtcgaggcttcagtgattttcaaggaaagagaggaggtgggaaggccaaactgaggaattatgtctgacagaagggaagaaatgaccgcggtggccttcttagaccctgtgggaaaggcctctacccacccagtgaaatgtctacccaaaccaagaggtattttagtttcctgacttgaagcatgtgagtaaagtcaatttgccagtcctcggcggggcaaatccccgagcttgatgtgtagggaagggagggggcctgaacaatccctgcagggtagtagaatagcagatggaacattgagaagtgatttccttgaggatagatttccacgatggaaaggaaatgagaggttctaagagacgggttagcagcttgtaacctacatggaagtggttatgaaatgacgacagaatagaatgggcctgtgaggctggaaggagatattttccttggtccaagaaccatttgccttgtgtgggaagagattgataggcggaagtttcagtgggggagtaggtgggagtgaccagatgagaaggagaaaaactgccatgaaggatagaagttagaatgctagctgctttttagctaccttatcagcataagcgttgccttgagcagtgagatctgatgccttgtgatggctgttgcagtgagactccacttcctttggaagtacggccttgctcagaggcctgacacacagtatcattgtctcacctttaaaaaatagtaattgcgtaatattagtcagtgttcaaatatcctgtggtctcaataactacttattttcctactgttcatttgttaaaatcagaatcaaaatgaaatttatacattgtcattggttgatgtgtcttttaggacaagtcaaagacttttaagaccaggaacacaccagtaattgaaaaattttgtttatcattaattgcagcaagagggatgctatggtttgaatatgtcccccaaaaagcatatgttggaaacttaatgcccaatgtaacagtgttgggagatggggcctaatgggagggctccaccctcatgaatggattaatgccaattatgaaagggcttaaggcttcgatttctatctgttgctctttcactcttgcactctcctgcacatttaccttcctccattggataacaacacaaagcccccataagatgtggagcccttgatcttggaattttcagcttccagaactataagaaataaatctctgtctttattaattacccaatctcagttattctgttatagcagcccaagatggactaagacgggggaacgcacaccatgggaaaccatgagaagactcaattaggaggtgttaggatctggggcttgattggatgatttggaaaatggagctggggtgctgagcggttctattatcagagatgttcaaaccagagtgacttcatcttgagtagggactgagtaaaatgagttggagacctgctgggctgcattcccaggaggttaggcattcttagtcacaggatgagataggaggtcagcacaagattcaagtcacaaagacccagctgataaaacaggatacggtaaagaagccaaaaccaagatagagacaaaagtgacttcttgctaattataatatattcacatgctatctcctttactgcttattgtatgctaatttaacacactagcatgctaaaggacacccccaccagtgcagtgaaagtttacaaatgccatggcaacacctggaaactaccctatatggttgaaaagaaagaggaactctttattctggggaattcttgcccttttccccagaaaactcatgaataattcaccccttgtttggcatataatcaagaaataaccataaaaatagccaaccagcagccctcagggctgctctgtatatgcagtagccattcttttattcctttactttcttaataaacttgctttcactttactccatggacttgcccccagtcctttcttgagtgagatccaaaaattgactcttggggtctggatcagaacccctttccagtaaaattagatttttttttttgagacatagtctcactctgcctaggagaccagcctgggcaacatgatgaaaccctgcctctacaaaaaattttaaaattagctaggcatggtggcacacacctatcgccccagttactcaggagactgcggtgggaggatcacctgagccaggaaggtcgagtctgcagtgagccctgatggtgccactgcactccagcctgagtgacagagtgagacctcgtctcaaaaaaaataagataatgggtgatacagctagccataaaatgtctttaaacaatggggttggtgcgactgaagttccatactcctgtttccctggacctgataaattttacatacattgccaggcacagtggctcaggcctgtaatcccagtacttgggaggccgaggcgcacgcatcacaaggtcaggaaatcgagaccatccaggctaacatgctgaaaccccatctctactaaaaatacaaaaaattagctgggtgtggtggcgggcgcctatagtcccaggaggctgaggcaggagaatggtgtgaacccgggaggcggagcttgcagtgagccgagattgtgccactgcactccagcctgggtgacagagtgagactctgtctctaaaaaaaaaagaaaaaaaaaaaatttgcatacctgatatagctcaggctactcagctattttcctttcctcaggtctaattgttaaagcagcagcagtccctcttcgtggccaaggaaaggaatgtttggtgttttgtgggtagctcagtgacctttttttggtctgtgcttaaacaaaattaaatatctttttttcttttgcaatttattttatttatgtatctcccaacctgccctgcctctttgtctctttttcccttgtgacttacttgccgaagaaaccatgtgtttatgggttttgctgctgattacaaacccatacactgccctttttttttttttttttttttttgagacagggtcttgccctgttgcccaggctagagtgcagtggcaccatcttggctcactgcaacctctaccacctgggctcaagcgattctcccaccttagccacccaagtagctgggaccaccatggcctgcctttttttttttaaatagagatggagtctcactatgttgctcaggctgttctcaaatttttggtctcaagtgatcctcccaccttggcctcccaaagttctaggaatacaggcatgagccactgtgccctgccagggtgtactttaatatatatctgtgtcctgtgtgttctctgtaaattagtagttacagctagaggactggacacttttaagtttaaattcttccagcaagactataaaaaaggtgttttatcttcataatttattttaaaaattagatatgggtaaaagaacagacatagaaagattattgccatttaacataacccttgcaaataacagatggtaaattggtaccaacataattataaacaaaaagcaaaactctggcactaagatggcatggtagtattgatactggtgagctagggaagatctccaaacgctggtgggaccctgaccctggctggtgtccaggcccttgataccatctcgggaaggaattcaacaagtcagaaaatagtgaaagtggctgggagcggtggctcaggcctgtaaacccagcactttgggaggccgagtgtatccatttcaatatcaaaagtaagaaataaaataccccatacaaaaattgattagcaagctcaattatcttgtggtggcttccttataataaaaataaaataataataataataaaaaagtggatacatgtttttctcagcatctattccttcttctggtaatggtacctcagtttctcttcaggggaccagaaagaccccattgcacacagtcttgggactactacttgaggtactcaaaacattcccaccagaggtgtgcctgtgtccaaagccaaaggtattcaaaacattcccaccagaggtgtgcctgtgtccaaagccaaaaggtattgaagctgattaattctaatagaagaaccctaaggaaagttctagaccccaaactactctgggtattgtcttctccagggcctcattcttcatcttttcctttgactctatgagttaccacacattttgtttgcaaaccaagaaccctaacttagagccctgtattatctttatctttccttctttgagtcttgcttagttttttttttttgttttgtttttttgtttttttgttttttttggagacagagtatcactctgttgcccaggctggagtacagtggcatgatctcagctcactgcaacttctgcctcctgggatcaagcaattctcctgcctcagcctcccgagtacctgggaccacaggcatgtgccaccatgaccagctaatttttgtatttttagtagagactgggtttcaccatgttgcccagggtggtcttgaactcctgatctcaagtgatccacccacctcagcctcccaaagtgctgaaattataggcatgagccactgtgcccagccttgcttaggttttctaactgttgccattcccacctccaactcctaaagagaattatagacaaggcaatacttgcaagttcagatagtagactgtccatgtctgggaggccattacacagaggcaagaaccatagccagcaagttgtttaggccagcaagcttaaaaagcaagggccagacctctgtatgaggaaagggctagagtaagaggcctatgataaaattctgaaacaaggacttttgaagtctagttatctaaaaaacacagggctcaaatgtaagaacaaacagaatcataactatcatcaggttgctttgcacaagcataaaaactaatgatgtatgatattattttcgacttactaaaaatcaaaataaaaaagactaatgatgtatatacctggttttatttttggagttttaagttttggttactgtgctggagggatagtaggatatgcttaagtcaccagcccctccataaaagtctcagatcctaaaactcaaaggggcttccctgggcagagacatatcccaaattcactgccagagagagaaagtgagagcgagggaactcctatgtagtacccaatgggaaatgcttaggaagcctgtgcctggcctctctgaactcccttgatgcatatctttttcccactgcttttgctctgtaacctttgctgtaataagccttaccacgaatattacttgctattccatcttgtgagtctttctacctaatcactgaacttgggtcatgggaccgccgaaacagaaggcatgggaggagttcagggagtacaggatagaggaggacctggtgagcctagggccttggaagaagctgatcaggaaaacaaaatatattgattacaacaaaatcaagttgtaataattgtgggacaggaaaaaaaaactatactcagtttttgtgattttgtaggaaaatgggcactccattatactaacttgggaaaataagtaagtccagttttttggaactacaatctgtcaacataaacccaaagccttaaaatgtacatgaaccttgacccagcaattccacttctaaatctaacctagagaaataataatgtatagctcaagattttaattacaaaaatattcatcacaatgttattttataaatttataaatcagaaacaatttcagtgtccaacactgcattaaataaatcatggtatattaatttagtggcattttaacaaccattaaaaatgacttataaatttttatatgtgtataagttacatgcagaataccagcctggccaatatggtgaaaccctgtctctactgaaaatacaaaaaattagctgggcgtggtggcaggcacctgtagtcccagctactcgggaggctgaggcaggagaatcccttgaacctgggaggcagaggttgcagtgagctgagattgcaccactgcactccagcctggatgatagagtgagactctgtttcagaaaaaaagaataatatacaaggaaccaaaaagtggttgattcctgagaggagaacagggaacagagtgactagggaacaaagatgggagagaagttattcttattgcataagtaacttttgtattttaaagttgtgtgctgttgtcttgtaatacttattcaaaaagtaaatatatgttttagaattcaatgaaaaataaagtgctcaacatagaatgttaaaattggattacgaaacagtaaagtgttatcacattattatttatgtattttttaaagtacataaataggaagatatggatcaaaatgttttgcttggctatatttcctgttaaacatatgttattttggtaataagaaaaaaagatagctgagcatggcggcacgcacctgtggtcccagctactcgggaggctgaggtgggaggattgcttgagcccaggtggttgaggccacagtgagccatgactgtaccactgcactcaagcctgggtgacagagcaagaccccatctttaaaaaaagtaccaaataggccaggagcggtagctcatgcctgtaatcccagcgctttgggataccgaggaggggaggatcacttgagtctaggagttcaagaccagcttgggcaacatgatgaaaccctgtctctacaaaaaatacaaaaagtattcagtcatggtggtgcacacctgtaatcctagctactgaggaggttgaggcaggaggatcatttgagtcagggagttcgaagctgcagtgagccatgatcacaccactgcactccagcctgggtgacagcgcaagaccctgtctcaaaaacaacaacaacaacaacaacaaaacccacgaattttaaaaaataataaataaaaatttacaaagaaaaaatagagaagtagaaaacgaaaatctcctcagttcttagcagctaccaatccagagccagcagtcttggtgtgattggccactacctcttcctcttctagggaacagggggatgtccagaaacaaactaaagaacttcttataggtcagagggaggtggagtttcagtagcttctatgcagggttggctttatgggtatgtgacctatgcagtcacacaggaccctgtagttggtttaatgctctgttgtcacagctttgaaattcttaataattttgaataaagaacttcacattttcattttgcattgggcgctgcaaattatgaagccggtcctacttctatgtccaaggctgatcgcttctctaccactgttagtattaccaaactgtccatttgaaattccatgaaaaagtttttcactgccagtgtttaaaatccaaatgtctgcttgaactttgtgatctaaatgtattatttcaatcaataaactataagctaggcatggtggctcacacctgtaatcccagcactttgggagccagagaagggaggatcacttgagccaaggagtttaagagcagcctgggcaacatgatgagaccctgtgtctacagacaacaacaacaacaacacaaagttattttttgagacagtcttgcccgttgcccagggcggagtgcagtggcacgatctcagctcactgcaacctctgcttcctaggttgaagtgattttcctgcctcagcctcccaaatagctgggattacagatccgcaccaccatgcctagctattttttttgtgttttgtaggagagagagagtttcgtcatgttggccaagctggtctccaactgctggcctcaagtgatccacctcccctggcctcacaaaatgctgggattacaggcatgaaccaccacacctggtgtacaattttttttttttgttaatttagccaggcatggtggcatgtacttgtagtccagctactcaggacgctgaggtgggagaatcgcttgaactcaggaggttgaggctgtagtgagccatgatcatgtcactgtactctagcctagatgacaaactaagaccctgtttcaaaaaaaaaagtatgagtgtattgtctcagatatgactaggggagtgagagaagcgccacaagctagggacttcagtttccctaaatggggactagatgtccctgctgggaagagggaagaagatgcaaaaacaaaacagagtaggcacaaagattctctccagtgaaatcacaattctaggatttgctctttagcttcaatgaacatagtcaaacaaaactgtgcctggaagtaattttgcccaatagtgtaaaggcaaaaacctctgctttgccaggcctgagactctaaaaaaatacagctgactttactttaaaaaggaatttaagtcctagaaggtttgtggatgtattcccaatcgtatagtgcctgatttgcaactacttctggggtaaatccctgggttatccattcctggttaccagttcctctcagttccaagagtactcattcccagctctcccattaaatcctcagacaagaaactgaggtggtgtcctgggtgatggctcccacttaattgcagtatctctccctcactgccccctttccttctctctttctttgtccctcttatgtatatctctttctccataatgcctttctctctttctctcctcatttccaatttttgcttaatgatcttagaaaaatatgttttctttcccttccgtcattttgtttgtaaatgctggattacctcaatgatggttaagctcgagaatggtgaaatttataccagggaaaagagaagataagcttatatgtttgtcctaaagaatcagtatctaaagcacaaaaagcatccttgggaatctcctacaaattattttcccatactttttccttcattttaatgtttcttctaaaataaaaaagtattcaaactttcaacaagaattttcattctattttcttatttcttattgtggcattaatttttaaatattaaataattttttaaagacaattttttgggagttgtaggttcacagcaaaactgagcagaaagtacacatttcacacataccccctgcatgcatagcctcccttactatcaatatcccccaccagaatgtgtcatttgttataaaggatgaaccggccttgacacatcataatcgaagtccataggttacattagggttcactcttggtgttgtatagtctgtggatttggaaacatgtttaatgacatgtatccatcattacagcatcatacagaatattttccctgtcctaaatatttaccctccccactaatacctggcagctactgatcttttcattgtctccatagttttgtctttttgagaatattatgtagttgaaatcatacagtatgaagccttttcagattggcttctttcagttagtaatatgtatttaagtttcttctgtcttttcatggcttgttagcgcatttctttttagtcctaaatatattccattgtctggatgtatctcagtttattcactcattgaaggacatcttggttgcttccaagttttggcaattataaatacgtttgctatcgatgtatgcaggtttttgtgtagacttaagttttccactccgttaggtaaataccaaggagtgacatgctgtattgtatgttaaaagtatagtaataaactatacttagtttagtaagaaactgccaaactgtcttccaaagtggctgtaccattttgcattcccaccagcaataaattagagttcctgctgctccccatcctcattagcatttgatgttgtcagtgtttttggttttggtcattctaataggtgtaaagaggtatttgactatcgttttaatttgcatttctctgatgatgtatgatgtggagcatcttttcatgtggttattttccatctgtatatcatctttgatgagatgtctgttaaggtctttggcccatttttaatcaaacttttatatattaaacaacttttatatatttttaaatgaattttcaactttaatatacaaagttgtttgcttactgtggagttttaagatttctttgtatattttggataatacctctttatcagatacatcttttgcaaatattttctgtggcttctcattctcttgaaaatttaagtgattttcaacttttttttttttttaatgagcctatacccagtttttgcatttaaggttttcaccaatgctcacctcaacaccaatgacaatttataatattctttcaatgggaaaacatagtcctctctgcaaatggttgacttctaaacaaactgttggaatatgattcatttgcaccaataagagaccactattacagaacaagtttagcaggagggtgggaataagtctgatggcaaaagtctaaagagggttaagtttgacaatgagaaaagacagactagacagcagagtaagaccctgtctccaaataaataaataaatagcagtaatccaggctactaaaatggcaagttttaagtgagtgaacatattttccagttatgttctaaaattttgaattcctcattaatttccccatactccagatccttagaaccctctagtgtccgtatgaggaattggtttaggtgaaccaagtaaaatgcttttaatttttacattcatgtttttaatatatatatatatatatatatatatatatacacacacacatatacatacacatatatatacacatatatatacatatacatatatatacacacatatacgtgtgtatatatatatgctggatgtagtgactcatgcctgtactcctagcacttcaggaggctgagatcggtggattgcttgagcccaggagtttgacaccagcttgggcaacatggcgaaatcctgtctctacaaaaaatacaaaaattagctgggcatggtggtgcatgcctgtagtcccagctactggggaggctgaggtgggggatcacttgagcagtgagccgtgatcatgtcactgcactccagcctaggcaacaaggcaagacccagtctcaaaatgtatacatatattatcaaatacaaaaaacctttagaagtgtgcttgtctgacttccaatttaagacaacagactaagcacatgcatctgcctcccccttcttaggatctgagtgacatgacaggaaagtggtacaagcaataattttgtggcaacactgaaaagaaagaaggaccagtggtccagaaactgcaatacctccaggaaagaaggaccagtggttcagaaactgtattaaaaactctagaaaacagaaagtagatggattcatactaattggtttacctataatttccacaatatacccgcggtgaaatgaagtttggagatgtgaagtactcgagagattccaagaacaaaacagagcattacagagggagggagtggcctatgaagcagcagctcaagaacagccgtgtgtcacttaacagggataggttctgagaaatgtgtcactaggcgatttcctcactgtgtgaacatacagtgtacttacataaacttagatggtatagcctattgctcctaagcaatacaatatgttactgtattgatactgtaagcagtggtaaatatttgtctatctaaacatatgtaaacgtagaaaaggtacagtaaaaatatggcataaaagataaaaaatggtacacccatatagggtacttaacttgaatggagtttgtgggactggaagttgctctgggcaagtcagtgagtgagtggtcagtgaacatgaaggccaggggcattagtgtacactactatggactttataaacactgtacacttaggctatgctaaaaatatttttcttgttttaataatcaattaaccttagcttactgtaactttttaaatttataaacttttaattttatataactttttgactcacaatatcacttagcttaaaacatacgttggccagaacaagcctataatcccaacattttggggggctgaggtgggatgatcccttgagcccaggagttcaagaccagcctgagcaacatagtgagacctcgtctctacaaaaagtaaaaaaattagctgagtgcggtggtgcatgcctgtagtcccaggtacttgggagcctgagttgggaggatcccttgagcttgggaggcagaggttgcagtgagccaagattgtgccactgccctccagtctgggtgacagaatgagaccctgtttcaaaacaaaaaccaaaaaacacattcacacacattatacagctgtacgaaaatattttttctttatatccttgctctaaaagctttcctctaatttttttttttttaacttttaaagacacaaacccatacattagccccagccatgtaggggctattgatcaggatcatcaatatcactgtcttcacttccacatcttgtctcactggaaggtgttcaggggcaataacacacatggagctgtcatatcctacagtaacagtgccttctggaactcctcctgaagggcatgcctgaggctgttttacagttaactttctaaagtaggggtacactctaaaataacaagtatagtatagtaaatacataaaccaggaacagtcatttataattatccagtattatgtactgtacataattgtaagtgctagacttttataggactggcagcacaggtttgtttacaaacagcatcactacaaacaagtgagtaatatgttgtgctagggcattacaaggctatcatgccactgggagataggaatttttcggctccattataagcttatgggaccactatcatatttgcagtttgtcagtgacaaaaacgtctttatgtggcacataactgtagctgattagatcactggctatcacacttcagggcaaagactttcttcccccaggtgcagagaacaaatggttgaagcatttcctctggttgcagtcctgcaaactgctttccaaagacagtactgagcctcagatgatgtagacctcctcaaagtcctgaagagtagaaaaatgctcctcccctacagaataattttttttggaaattgtgaggcccctgtcatcctacaacgacactaacaggacacttgtcagtcacaagaccaactgtgagcaggcaatcagccctgcattccgggcaaggctttggtgtaagcagctcttcacaactgccgccgtgtccacgcctgccacttaacctcatcgactctacagggctaagctgtccctgaagaggtgtaatgttatggctgggcctatgacttaccactgatctgacgcaggggttacagacagtcagcaggtctatgactattaatggattgtatctttccatagagagctgaaaagccaaggataaaatgctcaccttataatttacttttggaaaactcaacatcttaccttttcacctttttggattgcaacataaacatcacagaatttctgatattaaatttattttggaatgtatgtgtattattttttacttggcaaggggtataaattcagaaaatgttcaatttagttttttaaaaactggtttaacagtttgtctgaagcagattagtggcccatgatcttcattaatcttttgagcaataaatgtttaaattgttcaatctgtgtcaaaaccaatctggcccattgctttatttctttttttaaacaaagtttaaggccaggagcagtggctcatgcctgtaatcccaaagcttgggaggccgaggcaggcggatcacttgaggccagaagttggagaccagcctggccaacatggtgaaatcccgtctctactactaaaaatacaaaaattagccaggcgtggtggtgcatgcccgtaatctcagctactcggaggctgaggcgcgagaattgcttgagcccaggaggcagaggttgcagtgagctgagatcgagccactgcactccagcctgggtaacagagcaagactctgtcccaaatttagatgttaaaatgccaattgcggagtcacatctgattcacttaacttgattatgcttccactaaataaaaacaacagtctcagagtaataacagtaccaaatgtgaaaataaattgagtaaaaaaaccccaaacatagtgaaggagaaaatcagcaagtaaaataaagatgatgatgataatagtaacaacaaaaagtatttacattttgttgttgttttggaggcagggtctttctctgtcacccaggctggagtgtagtggcatgatcatggctctctgcagcctcaatcttctgggctcaagtgatcctccagcctcagtcttataaagtgctgggattacaggcatgagcctaaattagtgcctggcctaaattttctaatgtgacatgactcaagaattccacttctaggagtttatatagtggagaatacaagaagcaacataattatgtggttatttccatgttattttgtattcttctacagaatacaaaggaattagcaatatttttctgtaaaatgccagagagtatatgttttaggcattgcaaaaacatgacctgttggaaatactcaactctgcagttgcagcatgaaagcagccatggaaaataagttaacgagtgagcatggatgtgttcaaagaaaactttacttatggacaatagatttcacagttttataccattttcacatgtcatcaaataatcttttgattttccaaccatttaaaaatgtaggctggctgcagtggctcatgactgtaatcccagcatcttgggaggacgaggtgggcagattgtttgagctgaggagtttgagaccagtctgggcaacgtggcaaaacgccactgtttaaatgaggggaagtccaaatgttagattctggacttggctcttcctctacttagctgccaaccatgataaacacgttaaaccttaaaaaaaaaaagcaaaccatttttctatttagagcatgttaaatcttactttttcccataaagtcttccttgattcattagttgtcctttactttttttttttttttttttttttcttgagacggagtctcgctctgttgcccaggctggagtgcagtggcacgatctcggctcactgcaagctccgcctcccgggttcaggccattctcctgcctcagcctcccgagtagctgggactacaggcacccgccaccacgcccggctaattttttgtatttttagtagagacggggtttcactgtgttagccaggatggtctcgatctcctgaccttgtgatccgcccgcctctgcctcccaaagtgctgggattataggcgtgagccaccacacccggcctgtccttttaaacaaactgaaatttatacaatctatattggtctgctcaggctgccgtaacaaaataccagactaggtggtttaaacaaagaagtttattttctcacagttctggaggttagaagtctgagatgaggatatcaccagcatggttaggttctggtgaggactctctggcttacagctggctgctttctcaccatgtcttcacatggcccaaagagacagaacaagctctctggtgtcttttcttgtaaggacaataatcccatcacgaagtccccaacctcttcacctcattcaaacacacttaccttccaaaaggcccatctcccaataccaccacgttggaggttagggcttcaacatacgagttttaaggtggcacagtcagtctattaacttcctgtccatatattagttatgtattaggcattatgtattacctaatacatagctaatctgtattagtcagggttttccagagaaacaaacacatacacacatcctgagagagataagagagagagactcatatagaaggagctccaaaatatttttttttgtgtgtgtgtgagacggtttcactcttgttgcccaggcttggagtgcaatggcacgatgtcggctcactgcaacctctgtctgccgggttcaaacaattttcctacctcagcctcccaagtagctgggattacaggtatgtgctaccacgcctggatacttttgtatttttagtagagatggggtttcaccatgttgatcaggctggtcttgaactcctgacctcaggtgatccacccaccttggcctcccaaggtgctgggattacaggtgtgagccagcatgcctggcctccagaatattttaagggagtacagaaccactatggtgagtataagctgggcatagtgatgcaagcctgtagtgtcagatacttggaaggaggaggtgaaggatcacttgagtccaggagttcaaggtgcactccaacctgggaggcagagtgagaccctgtcaaacaaacaccaccaccaaaaagccccaaacagaacagttagtatatgccatcttttttttttaagtgtatgtgtatgtatatttgaatactcatatggtatctatcattagaaagatacacaaaaaactggaaaatgtggtagtggaacagacttaattttcattgcatgcctttgtattttttgaattagaaaaaaaaaagtcctgtgtgtatactttttctttaaaaatttttaaaaaaggattttgttactacataggatactcttacaaattaagaagaaagtcaaacatccaaacagaaaaatgggcaaaggaaaagaaaaatcaattcactaaagaaatacaaccaactatcaaacgtggaaaagtacataacccatctctgataaaaatacatgtatataacagtaacaaacaatcatttcctctttatcaaagtggcgaacatttcaaagccttatcacttctgatattgccaacagtgtggaaaactttaaatggtgcaagtataaagcttgagatagggcaatttggcagtatccatgaaaactaagcagggtgcttagtgttactaaatgatacattacttgaggatacaggagtagtatatatcatagtgacctaaagcataggctctgggattagatggccatttcctagctttgagacactgacaaatttcttaaatttatggccttagttttttcatttataaaatagagattaaaagaattacttcatagagtcttgtgagaattaagtagttttacacatcttataaattaataaaggatatctgaactaaggaacttataataaaaacagtgattaaatttaaaatgtctttgttcatttacatggtatatatcaccctctacaaaaaaaaatgacacttgtctttcaatctgtcaagcttagctaaaaaattcacgtatctcttttctatatcacatattgacatgatataggatgcaagatataaatatcaatttaatagacattattaaataattttacacttagtagaatcttggataaatggttaaaattatagattgacattaagtgtgggcacaggaatattctgtgtataccaatgggtttaacagaagatgtgtttgcactgatttctggtcatcaacttgctttccgtgaatctttaaatacccaattccaaatcttccagctcctggagaagggctgtttctttctgaattttctccaactagaaaagtttgaaacaatgaagttattatgaaataattactggatatgtaaccaaaataatacagaaaaaatggtatttctgacaatttattatgttcactagtaaacacagattttaaaatacaggttagaaacaaattctaatttgttatctggtatgaatcgagggtgaaaagaacagacactgtcttactgcatccctttgggccccaaaaattttcaattctatattcgggcttaaacatgttgacaggaggagggaaaaggcaaacagggcagtacaacttgagagaatcttatatttgtctaatataacaaattgctattattttcagcagtaataacatagtatgcctcttaggaatattgactttttcattcacatgatcaataccatatctcttctatttaagagtaaagctatttaaaagtaaaaacattaaaaagaatatggcatatggttttcaaaataagtttttaaactccatgtgctcttttacctgactaaatacttgtttataataaaagggggaaggctggtggtcaccacaagcctaaatgaaaaatgcagaaagtacctgatttttttctagctgttttccagttgctgcttgttctttcagttgttcgattgctttcagtttctgcaaacatcaaatatgagtcaagagcatggaagaaaagtcacttcaaatgcaaatttccttattaagaatgtgaaactcaagtaaggagattaattatcttagatttgtatcaacaatggtctgttaaaatgctaggataaattgttttttaaagttaaatgcaaaattgtaaatgttaaaaacatgagatttggcaaaatattattctcaggcttttaattaatgttatcgtgtatgcatgtgtatatataaatgtatcagtaatggcacatttcaatgccccattggacctgggtgatgtttctggctttgagagaaatctcaatgagagcattctgaaagattgttggtccaaagtcctgcccgataaaaagtgaatgaaagagaaacctcataatgcagctgtgaagggctctagagacctttttttatccccagggccaccccagcacactggctgcaatatcacaaatcaatacacttcttttttgtctctgtctcttcatcttcaaaactaggataaatatctgcccctaattatcacaaggtatctaatgaaatactgagtataaaagtattgagtgaccaggtgcagtggctcacacctgtaatcccagcactttgggaggctgagacaggcagatcatgaggtcaggagattgaaaccatcctggctaacacggtgaaaccccgtctctactaaaaatacaaaaaattagccaggtgtggtggcaggcgcctgtagtcccagctactcgggaggctgaggcaggagaatggcctgaacccgggaggcggagcttgcagtgagccgagatcgcgccactgcattccaacctggtcgacagagcaagactctgtctcaaaaaaaaaaattaaattaaattaaaaagtgttcagtggccaggcgaggaggctcacaaatcccagcattttgggaggtcgaggcgggtggattacctgagggcaggagtttgagaccagcctggccaacatggtgaaaccctgtctctactaaaaatataaaaattagccaggcgtggtggcgcacacctgtagtcccagctactcgggaggctgaggcaggagaatcgcttgaacctgggaggcggaggttgcagtgagccaaggttgtggcactgtactccggcctgggcaacagggcaagactccgtctcaaaaaaaaaaagtgttcagtatatttctatgctgatgcacactgaattttattactccaaaaatcaaagtactaagagtcttcagacatttatgaatagaactaaaatcaataccattcctaagtgaacagtgcttcatagtgagaaaacaacaatgagaactgctgataccaacttcttagatacctgtctttaggcatctaagtactctcttacttatataattttcatgtatacctttcaatatgcacatctgtttttaagtctctcaccttctttaggttcttgatttttttgtctatctcagggtccccagaaattgactgagagacagtgtttcgtggtgtgctctgtggggcaggagtaggtgccaaatctggactcttgtcacttcttgcttcctgcaggaaatatttttttaaattcaattttaaaagccaaaaacattacagtatttaaatcaacatagctttggcatatgaaatacagaaactaaatatgtgattttatctacattttatataaagaatctgaattaaaggtctcatgaagtatgctacatactcccatgttagaaataaaatgaccttatcagagtaaaccaggaagtttctgtaccagccaacaagcattccaaacttttgcatattctgagatgtgccagtagatagatggtttgaacatatgagagggcttttctatttaaggtgtttaaagtttcactcttacaaggctctctccaaaactataaagaatatgtatgatcaagtacctgtaatggattatgctacaagaataagaatcctacagatattaatttataatcagatcaattcagctctgcaacaaagtaccacaaaacttttttccccttaaagggatgccataatgcttccaatatgatcagacctctgataacttttcttgtccctcctcactgattctgaatcacttttatttccgctaaggtgctgtatactcttgcccctggcctttgtgtacagcagtctcccttaaccatggtttcagtaaccaagcgtcaactgcagcccaaaaatattacatggaaaatcccagaaataaacaattcataagttttaagctgtgtgatgaaatctctcagcatcctgcctagaacgagaatcattcttttatccagtgtatccacagtgtattcgctccccacctatttttcactagtagctgtgttggttatcagatcgactgtcacagtatcaacagtagttgtgtttaagtaacccttattttacttaataatggtcccaaagtgcagagtagtgatgctggcaattcggatatgccaaagagaagccgtaaagtgctccctttaagtgaaaaggtgaaagttcttaataaggaataaaaaatattgtatgctgatttgctatgatttacagtaagattaaacctatccatgaacttgggaagaagaaaaaagagattagtgctagttttgcagttgcgccttgaactgcaagttatagccgtggtcattcaacttaccacacaagcattgtaccatctcacattgtcgcaaaaagggtgaatacaacaccattagatattttgagagaccatattcacatatcttttattacagtatattattataattgctctattttcttatgagttactgttaatctcttactgtgtatcacagtctctatagggttcggtactatctgtggtttcaggcatagctctgcccctccaggataaagggagactactatatattgttccttgtgcctagaacaccttcccccacaagtcacctggctgaaccctacttatcctttaagtcttctggaaaatctccccaccttaagactggatagtcgcacctttcccaggctctcataatgcccagtatttttccctacggtaacaccatattctaccattccccattagaactgagcctctagcataatacttgcttcgttgcacaggctaaataaataaaaaataaaggaatgactcttcctttataattatgacaagatatatattttggtaagaggggaaaaaattatgtaagtatttattggctccaacgtagggtttctacttcttatagaatttccagtggaatatatatataatgctccaggtctccataaccttttactcagagttctgggtaggatactctgaacttttaaagcatcctcagatcctcagggaacatagaatagggtatcacttctagatattcaactctaaaagtctgcctaagagtttttagaaaatacagaattgaagtcaatttttctctttttttttttttttggagacagagtctaggctggagtgcagtggcacgattccagctcattgcaacctccacctcccgggttcaagcgattttcctgcctcagcctcccaagtagatgggattacagttacaggcacctgctaccacacccagctaattttgtatttttagtagagatggggtttcaccatgttagacaggctgatctcgaactccagacctcaggtgatccacccacctcggcctcccaaagtgctgggattacaggtgtgagccactgcatccagccaatttttctttttaaagtcatgttggtttcactttttggtactatttaataaacaattatttaccttctacatgaaaacaaattactgggcactttgagaattcgaaagaaaatattaagtttctcctcttaaggagcctgtaagttctggtaataggcagttttatatttttcacaatataaaattaaagtagaagagtaaataaaagaagaggggatattctgcctatcaaaattcacttttgatatcagattttaaaaatataaaattttagttgtttgtaatgagctaagaatatagctctctaggaagaaaggttaatcttatcatgtgaaaaaccattaaaattaagtgatatataaaatttatttttccccacaaactaaccaagaacaagttgaaatgtctgcattattatacttaaattctagccattctctagaaaggacgtatatatggtaagattaaattcttatgtttcaactcttttttggtaaagtcaacaaacttataaaattatcaccagtttacaaaaatactagttagattacatatatctgactgctctatctttgactatttacttcagagtcaggactaagaaggtctggataaggtgagattctgtcaagggccatttagctttgttccatcacacagccacaacttttactaacttcagccagtcgtccccaaaatacatactgaatagtttatcttgcaagttgaaaacctttgctattactggaaaaacaactcaaaaagcaattccacaatgagggattactggtatcacctttggtatcatctttagtaaaaaacgtgtgtaggtgcttgatgactgtattggctcttttaaaaaaaactgacaggtataaacatataactgagagttgtaaatttataactgatcagcccagctgatcacactattaccatgagctataaagagttacacatttataacagagttacaaataactattatttataataataatttcattatattaattaaatgtgaaattatcacataatttatattataaaatgtataaactaatagaatttgtatattatttatataattaatacaattataatttagtatattaattaatggttataattattaataattataatcatatgtaattatgtaagtaattatttatataataagtataaaggaatcttagtccagtatcaccaatggtcatattaaaaatatcttttgataaagtggaagaaactttgcttataaaaatagaattctaagttgagtgcgtttcagagaggccctaaaactcaaagggcatcttagttatcaagttgttaaggatactactaatgagttgtaatatccagggccagtagaggtccctacttgtactgatgaagggacaagacttgcttttatacaaatctaatatcaaatgcatggaatagatcatttttacttggaataacctaaagctgaccaattaagatacttctggggatgaaacatattaactacaaatgaacagaatggtttttctaaaagtccagattttagcagaatatggttgcataatacaattctataccttaaaatagtaactgcctcccaaaacacataaccagcctagacctgtcaaaattcaagaattatcagcaagactatactgatatagcaaccagctgttaaaaatctgccctttctaggatgggcacagtggctcacgcctgtaatccaagcactttgggaggctgaggtggaaagactgcttgagctcaggagtttgcgactagcctgggcaacatggcaaaactcggtctcaaaaaaaaaaaccaagccaaaaccaaaccaaaaaaacctactcccatttcctgcttgaaaaacatagcgataacctatctttacaaaaataaaaaaattagttgggaatggtggtgtacatgtacagtcctagttacttgggaagctgaggcaggattagttgagctcagggtctggggttgcagtgagccgtgatcatgcctctgcactccagcctagataacagagtgagacagagtgtctcaaaagaaacaaaaacaaaacatccaaaaaccctaccccactgctacagtctgacatattggtgtttccctcaaattcatagtttgggacctaatacccaatgtaatagtattaaaaggtggggcatttggaaaatgattaagtcatgaggattccacactcaagaatgagattagtagctttataaaagagaccaaagagagctccactgccccttccaccatgggaggacacacagaaagaaggtgccatctatgatgaacgggttctcaccagataccaaatctgccagcgccccagcttctagaactgtgagcaataaatttgtttatgaattacctagtataaggtagcagcctgaatggattgagacatgtactctacctgaattgcaaaaatgtgatcaccataacttcactaaccagacatccccagcccagccaatcacattatcaccatgagctatacaatatcacaatttgtcaattatttacactggtgtggcttttcaactacgtaatcaagtaagaaactattttggaaatatcccattatttgggtacttctggtatttcgattcccagttaaataatttcatatagtactataatactgagtgcccaaatggctttctagtcatgtaatttccagcttctcttagtaaatacatgcttcaaggaaagcaaactacaccacttcacacaagtgccaccaaaagggtctacagcaagtaacatgcttacataataccattagtgtctcaggttatgatgtcaagtccagtttcttttgtcacccatcatatagacaggattacttagaaattcataggcaaagacaaaagaaagatattctgcctatttaagtctaactccaactacattttataacgtaagagccaaggttttttgtgctttttttctttttttttcgagtcatggtcttgctctgttactcaggctgaagtggtacaatcacagctcactgcagcctcaacctcccaagctcaagtgatcctaccatctcagcttcccaagcagctgggactacggggtacacgccattgtgcccagcaaaaaatttttcatagagatgggggtctcactatgttgcccaggctggtctcgaactgggctcaagcaattctcccacgttggcctcccaaagtgctgggttacaggcatgagccaccacacctggtcacagtcaagtatttaggaccacaattctttaaactttaaggcttaaagctaacttaactgcctttttttttggagatggagtctctctctgtcgcacaggctggaaggctagagtgcagtgatgcgatcatggctcactgcaacctccacctcccaggttcaagtaattctcctgcctcagcctcctgagtagctgagattataagccatggccaactaatttttgaatttttagtagagacagggtttcaccacgttggccagtctggtcttgaacttctaacctcaagtgatccactcgcctcagcctcccaaagtgctgggattacgggcgtgagccactgcgcccggccataactgactatttgttttgttatgagattagtgccccaaatacctgctttgcagctttcttagcttcatgcttcctttgatttttaagagctgtttttgataatggcttatcgtttcctgattgtggtttcatattctgaggtggttcctcttcatgctatggaaaatgtaaaataattttgaaatggagtccatgttgtaaacacctacaacaacaaattatacacttctgctaatataggataaacttattttatcaaatttaagatcattagcaaagattattttgaaactcattggtagtggcacactccaactgtcaggatggatttaattagggtcttcctattagttcctatatctttcaatcatatcagagctggcaaaattcactttagttttgttcaaacagaatttttcttagcactactacagacacatgattcttatgaaaactagataccaacaacagcttcttctgaggcctttttggttctaactattgtcaacagaaacccagttgcctcgcttgttttcttcacacaaagaattacttgctagatctttacttgtaaaatcagaaattagaagattaaaaataaaagcaaatgaaaaaacaagaatagattataagaaaataaatgaaatagaaaggagtaattaactagataattacaaatctgggattgacatatgaagagaccaaaaaaaaattacatggcttgtcagattacacaatgaagacaatcatttccaacatcagatattcatgtaaccatgtaacaactatattccacaatagaaaagatggtgaattatagattcaatgtatctccagaacagttttagacaacatacagtataagtgatggcactacaactctctatcagattcaggtacttactgatttctatctatattgctattattttaatgttaactgtctcttagactgtaccataactcagcacatcaaaagtaccagctctccatgaagtttcttgagtactaggtctcagatccgcattttacttataagttctatatggaaatgagcagagctcaaacacttaagatgcagagtaataaataagaaaccataaagtgaccttatcttagcaaatgcattaactatttcaggtcatcaaagttctgggtatgttcatattctacttgaaacaaactgaatattatgagaacccacatttgtagaacagcagacaaatttggagtgcaaggctctttcatttcatttttatccatgttgcataaaatgctacttaagttatacaatatttgctgaacatttgttttatacataatatgaaaattctttcaatagtgggctcttctgtagtagtttactttggccgaaaagtttctgctcagaactttgatgaaaaatgatacaagaagaaaagataagttacaagtctcttccacgcttatgagcatcatgtagccactgagagcctttcacttgagacgaaaaaaatccacacaactactataaatcatgagttttttctggttttggtactatgtgctcattacgcataatttcattctcattaataaactttgtttattcagttatatcaattattatgggactgtttttgatgaacacattttaatttctcagctcactgcaacctcctccttctgggctcaagtgaatttcccacctcaacactcccgagttgctgggatcacaggcagacaccaccatgcccaactatttgttttgcatttttagtagtgatggggtctcaccatgttgccctggctggtctcaaactcctgagctcaggcgatccacccgcctcggtctcccaaagtgctgagattacagatcgaaacccccacaccggaccaacgaacgcattttaaaaggtgaaggtttttttggaaagctaataaatattctttaagtataatttatatataaatttttacttataaaaaacttttttctgtgagggacgaaccccaacaccttttttcccctactgctgtgtaactctcctcctttgtgaagttatctactacactgtctttgtttctagtaatttcttgacagtattttctttgtaatttagctcatttctggaattagatacacgtaaacatttctaattactgggcatatagctacttcaactaaaatgatttgacaggaccacacaatcatcacgccacataaaaaagcaacaatttagtagaaatcttaaatgttaacaaaaaaatcctggccgggtacagtggctcatgcctgtaattccagcactttgggaggccaaggcgggtggatcacctaaggtcgggagttccagaccagcctggccaacagggcaaaaccccatctctactaaaaataaaaaaattagctggacgtggtggcaggcactgtaatcccagctactcaaaaggctgaggcaggagaattgcttgaacccgggaggtggaggttgcagtgagcagagatcgcgccactgcactccagcctcgatgacagagtgagactctgtctcaaaaaaatcctgattttaagttcttacctaatttcatcaccattttcaaagtattattttctgtatcaatttctccccctcaccaaaataaacctactacttttatggatcaaagaattgtgccatcatgcacagattcagaaagcaggatgggttggagttacttttgtttttatctgaggtaaggaaaattccaatacagaaataggaaaaatctgaagtctactatatactttctttttaaatctaaataaatatgataaatacaaataaatatcatgttatgtctttatataattttacataaataaaacaatactggttaaatagaacatttcgatggaaattaagaagtttcagaccagtcatacgttttgtttagtccaagagaaaggttgtttttttttttttttttgagacggagtctcactctgttgctcaggctggagtgcagtggtgcgatctcggctcactgcaacctccacctcccgggttcaagtgagtctcctgcctcagcttcccgagtagccgggactacgggcatgcgccaccatgcccagctaatttttgttatttttagtagggacggggtttcagcatgttagccagtctggtctcaaactcctgacctcaagtgatcctcccgcctcggcctcccgaagtgctgggattacggatgtgaaccaccactcctggcccaaaataaacttttttctataaaagtagtaaaactttacttaccaatttggaattggtgattggtttatttcttaaagctgggggtctataagctgttgcaactttaggttcctcattgggtacttcacttggaactgcttggtaagttattgtttttgctggaaatattccatccaaaaatggctgccaagaaacctgccataattctgcatttgatggcacatcatacttgtgcaagatagagccagtataatgccaaattttgtatccattattaacccgtaacctgggagcacatgtagctgttaaaatatgctcaccatccgggcaccaagcaaaatatgtagaatcagaagccaccggtttagaaataagtttgtagtttttcacatcccacacttccatttgtcccctcagatttccaaatccagctaatactaatatatgtccatgagggctatagtaggctgcattacgaggaccagttccaaagtcaaatacaggatcacatttcaagttgaaaattgtcgctttggcaggcataaaaccatatacagcacaaaactcagtagaactagaattccaaactacatcataaatggggccattttttgctagaaaaagaatataaagcccaaattagcaataaagaactatataaatatttgttagcaaaagttaccatcatatagtactcacaaacacatcaaacagataaaaaaatttcaaggaatgttaacattaaaatactcttacattatatactagggggattaatgtataatcataaatttatttaagaacccctattgaatcttaatttcttttaaacattttggtaatatggccttatagtaatagtttgttactattaataaatttgtttttggaaggggtaatacgtgcagatggtaatcaaaatacaaactaatttatttatttatttgtttatttatttatttatagaaatgggatcttactttgtggcccaggctggagtgcagtggcatgatcacagcttactgctgcctcgacttcctgggctaaagggatcctcctgccttggcattccaaagtgctaggattataggcatgagccactgggccctatatttttaaaaatgccacataagaccaggtgcgatggctcacgcctgtaatcccaggactttgggaggccaaggtgggcagatcacctgaggtcaggagtttgagaccagcctggccaacatgatgaaaccccacctctactaaaactagaaaaattagttgggcacagtggcatgcacctgtaatcccagctactcaggaggctgaggcaggagaagcgcttgaacctgggaggcagaggttgcagtgagccaagatcgtgccactgcactccagcctcggtgacaaagcgagactccatctcaaaaaaaaagccacaaacacaggtcattttacacaaaggcaaccctctgttatatttcttggatatcctttcagaatttttttttgtttttgagatggagtttcactcttgttgcccggtctggagtttagtggcacggtctcggctcaatgcaacctctgcctcccaggttcaaacaagtctcctgcctcagcctcctgagtagctgggattacaggcatgagccaccacgccgggctaattttgtatttttagtagagatggggtttcgccatgttggtcaggctggttttgaactcctaacgtcaggtgatccacctgcctcagcctcccaaagtgctgggattgattacaggcatgagccaccgtgcccagcctctgtcagcagtttttgatgatgcaggcttccccctcactatccttcaactatactgtgtagtttcatatttttatcttcatcagcctactaagtgaaaatgtctatcttgttttcatttgtattttttaaattataagttaagcatcttttactgtaagtaattttatttctttttctatgggctgattttttttcttcttctttttttttttaaagagatggtctcattttgtcaccaagactgcagtacagccgtaggatcttagcttgctgcagcctcaaatttctcggctcatacaatcctcccacctcagcctcctagatagttgggattatatgcatgagccactgcaccggctctgaggactaatttttactatcctatgcctattttatttttctccaattattggtcttttacttggcttacttgatatattaagaaaatttgaccttcctcatacttatcacttgactatttaaaaaacatattttccccaactttttgttcattttgcttaatttatggactcttttcttctctcattgtaataatccattattcttctctagtcaaattcattattttttccccttagtacttctatcttgtttaaaaagtctttttctactcttaagattagaaaaaaaattctcccatatattcttctaattcctctgcagtcttatgtataagtttttgacccaaccagaatttattttgtgaagaagataataaccttttgtttcgaatggctagccagttatcccaaaccacatattaaatgatcaatattttctcctccattgattcaaatgctgactttattatatattaatgtctacaaaagtatggatctacttctggactctgttctcttccactgatttatcagttttaccagtatatccatataccacaaccaaactgtcttaattacaattggcttactttttttttttttgtgacagagtctcaccctgtcagcgggctggagtgcggtggcacgatcttggctcattgcaacctcccactcctgggttcaagcaattctcatgcctcagcctcccgagtagctaggattacaggcatgtaccaccacacccaactaatttttgtatttttagtaaagatggggtttcaccatgttagccaggatggtcttgatctcctgacctcatgatctgcccgcctcaacctcccaaagtgctgggtacattttaatatctggtagtgtcagaactccagataacttcccctgccctgctcttcttttacacaagtttccaaaatattcttgtgtgttcatttttcaacaccaaccttacagccagtttatttagttaaaaaaaaaaaatcagttagcatttaaatttagttttagactgacaagagagaaatgacatctttataaaaataattcttcttagtaaaggtcatagtttgtctctctgaagagttttaaagttttcttctcattggccctatatatttgttcttattatttttgctatatatggaatctttcatttttttaaagtagctgttatagtgtgacttcatctacatgagcagagatgattttgttttctttcaaaactgtatatattttacttctgctgattatagtgactaggtatttcagaatgttattaaaataaagtgaaaaggggagccatccttgttttttctctgacttcaatggaaatagtttttttaaaacatagattaccctacttacacatgttcaattcaaaatgagaaaattaggacgctatcagtattttaaaactattattttaaagttttagttcattaaaacaacagatgaagtggtaacattcttggatattattattttgagacagggtctcgctctttcacccaggctgaagtacagtgacatgatcatagctcactgcagccttgaacttctgggctcaagtgatcctcctgcctcagtctcctgaggagctgggactacaggcatacgccaccatgcctggctaactttttctattttttgtagaggtagggtctcactatgttgatcaggctggtcttgaactcctgagttcaaatgatcctcccatctcagactcccaaaatgtgttggaattactggcacgagccaccatgcctggcctcttgcatattactaacaattctaaagacagtattaagcaatttgccgtcataattagctaagtaagttccaaaagagctactacaatggaattaccttactcaggaagttcacttctaaaacgatggcgtaactcaaataactaattgtattctgccaaaataaggtatgttggaggatgatttttaagtttcttaattaagaaaaattttatcttaaaggttattaaggcatatgaattctatcttttgatcaagaatttagattatatcatctttatggcatagtattttttactatcattgtttctaatcaaaggaagactgctggaatactcacgtaattgcactacagcactttctccatttgttgcaatgtagtgtagagtttgttctccatagtaggaagctcctgtcttgtcaacatctgtgctagctattaccaacacagcagtagctataacagtaaaaactttaattagatttaaaacacaaatgggcattgattcttctgttatacacataggaatatagcctaaattaacaactgataaacaaagggagggataaaatatacttaacataccttttttattccacagcattgtaactttatctgccttaaagaaacttttattagctaaagctgcatgaggtccagcaaagttggggtactgatataatctaacaaatgaaggtgcacctttacttcctggaacatagacagccacctaagatacatagacataaatcattacttaattttttgaagaataaaaactgagatggacatgtttttacaatcacaaaaaactaggaaaaggtttaaacacataatattacacataaacaaaaacagcaattaccttgtatggttggggtccaggtgataatacaaaatcattaattttttgcaaatgcaatttatttgcaattgtgtctaaaaaaaagagtaaattaaatcagattgatgagagaacctaaaaggaacatgttaaactctgaatacattatcaaagatcactataactacacaccaatactactcactgtagtctcctcctggtgagatacagtaacacagtggaaaaagcatggggtaggagcaagacaaatgtaggcttcaatttctactcagtcatttacttgcagtgtgagcttaggcaagtaatgggattataccacccaactctcagtaattggttttaagagaagagtgccaggcacatggtaggtatttgataaatgtcagttatcctctcttcaatcgctgaaataaagtggtcttagagcctattagaaggaaaagatcaaccttggcctgctactgcagaatgtggatatggaaattctgtaacttaatgtgataaacagatgcatgataatgatgatcacaaccacagtaacaatggctgatattaagagcttactctattccaggcagtctgagccatgctattattaataaaactgccactctagttaattagatcaagagctaatatactttctttgttcaatttcagagatcaatggcttttcaaaagcagcacaccaaactgtcaaagtggtgatccctcttcatttgacatgctcacaaagaggagaataagacaagaaagcaagctaacccagaaacagtgaggtgacagtgcgcctcaaacacaggaaaataaaatgcataactatactgattggatgctgctcaaaatcagcctacatgccatctttggtacgtgtgaacaaagttaccaattcctattctaactatgatatactcaaaactgtacaatcagtaatgggatgctctaaagacaaaagaactgcaaaccctttttaaaaaattattttcagtaacagtgttactttttggtattaagattgtaagaataccttgtggataatgtggaacaaaccaaatgaatacttatgtgaatgtgatattctcaaattatcatccctggtattccagagtaacaagattcttggtggtgacagaaggcaatacaaataagatagaagttaaataaaaaccttgtagtcttcaatttaaataaaactatacgtataaaactttaatttaaataaaattatgattgttacatcttttaaatagaaaaaaaaggcctagaaacaatgatcaatgcaacagcaaataagaatctctagaacctaaatacctttttttttgctagactcagccaatttttcaagaaaccctattaccttttaatgtttccttcaatgagatcaagagctaatactttttctttgttcaatttcagagatcaatagctattcaaaagtagcacaccaaaaaggcgacagggtttcctgaaaaattagccagttctaggtgtaatggttagaaatgtacaaattaatcctagaatgacttgtcttaccatatagcaaagaagtcactaaggattaattgatcaaagatgagacaatttgagcatcaataagaaaaataactacaatggactgaaacacataccttttaaatccacagctcattaagaatgggactaaaaaggccaggcgtggtggctcacgcctgtaatgccagcactttgggagggtgaggcaggtggatcacctgaggtcgggagctcgagaccagcctgaccaacatggcgaaaccccatctctactaaaaatacaaaattggccgggcatgttggcacatgcctgtaatctcagctactcaggaggctgaggcaggagaatcgcttgaacctgggaggcagaggttgcggtaagccgagatcgcaccattgcactccagcccgggcaacaacagcgaaactccatctcaaaaaaaaaaaaaaaaaaaaaaaagaatggaactaaaaaacagcctgggcaacataatgagatcctgtctctacaaataatcaaaaattagccgggcatggtggtgcaagcctgtagtcccagctacttgggaggctgaggcaggagaattgcttgagcccaggaagtcgagattgcagtgagccatgattgcactcagcttggacaaaagaatgaggcccactctcgaaaaacaagaatggggaaaaagctaattggttacaatgaaggttgctagaggtggaatacattatattaaaactgataagagcaagaatatttatcccgccttttctatataaatgcagcactaggtaaccaaatagtagaaggggaaatttttctttatagaagcagtacagctgaaaaataagtgagggagaaaaaaccagagtatcaacaatttgcaaccactgatgaaataatgcatccaggcatgaaacattaatgtcagctaagcctacaaaattaaagacaaccagacattatgtgcttcttgataaaagaagtgaacatcaccttataatgtagtcttacccttactcacctaaaaaagaacctgaagctgaaactctagagccaacttgcaatttataggggacagatgaacatgttaaattataccatgggatacaaaagcaaaattcaaactatgggaaaacgtgaaagacaaataaccttgtttcttaaacaataaattatgaagaataaaataacagatagagtgggaacttataggaccaaaagaaacataaaagatatatcaatcaaccacaatgtgcagtaccttatttggatcccgagttttaaaaaaaattgtaacatttgcaattagtagaaatttgaacacatatttaataatttgtgataatggttttgtggctaagtttaaaaaatgaaaggccccaatcttcagaaatctactctgaaatatttacaattacatatttaacaagtatataaaagtataaccatatctgggatttgctttcacttagtaagagatggtagctggagagatgtatggatgagataagattggccacaagctgatggttactagaactaggtgtctgaagtttaaaattctacacgataaaatatctaaaaaatttgtgtcacagaatttcaatagcaattaaattcaggaaaagatattcaaatgtcttaatagcaattaccagataataaaaagttattgtaaaagaaaacctttgtgttacagattttcactgaattcagacttataaagaattatgcaaatgtatgtaagagtaattattgattaatagattaacagtatttaggaaaaccctatgatgtcataaaagttaatggaaactgtatacgattacagtaagtaataaaattatgtcataaatctttccatactaaaattgttgttttcaaagaagtgaacttcattgttaacattgcgggcacaaagagtttcatcttctgaccaggatggacacctatgtcaatgaaaaaaaaaaaaagtataaaaaatattcagacagaatgtaacatcacattaacatgttaaagtaatttatgatattggttaccatttaaggaaaaacacttataaacacttataaatatgatattaagtcagttactaatagttttagtcaatatatgttaatagaaaaggccaggtgcggtggctcacacctgcaatcccagcactttgggaggccaaggcaggtggatcacctgaggtcaggagttcaagaccagcctggccaacatggtgaaaccccatctctactaaaaatacaaaaattagccaggcatggtggcacgtgcctgtagtcccagctacttgggaggctgaggcaggtgaaattgcttgaacctagaaggcagaggttgccgtgagccaagatcaggccattgcactccagcctgggtgacagagcgagactccctctcaaacaaacaaaaaaaagaaaacattgttcctttccacttaatactaaaggaaagaaggatcaagtttttgctctattacattcctacatacaaaatccttaaaaatgtagatttttgtctgataagttattttttaaatcaatatcaggaaaacaaatattatacagtgatgacattaaaaatactatgtaaaaaattagtattttaagccatttatttaccaattttgcatttttttctggatgaaagatttcaaacatgtcccagttttcacatcataaagttgtaggttgggtatcccagctgtgccatctttagaagctgcaataaaatttctttttttcagtaattgccttgtaacatttgtaaagggattatttttcttatttattaagtttgatatggattactatcaaatgggttaaatcatgaaagcttgcctctgtgttaccaaaataaataaataaataaatgaaaggttacataacccactcatgattctcaactgattctcagtatctctttcatttacttggaaaaattagattcatgagagttcatacctcttgaaagaacaaaaactcaggaggtttgtaagccaataatgacctattatcatttacttattcaaaaatatcaacattattagaaaatgtttcttaaaataagcccctataactattttattacatgaaacacagttatatgaaatgttcatataatgtattatcattaagtatctctttaaatattttggaaaatggcacaacattttcgactctaccatacacatcccttagatgttttgtctactgtacttcctttcacataataattatttaaaagtcttgattttaaaagtcattattattcttaatcttcagaaatctctatccagcagttatttacttcctgaattttcccttgagctttttcttttcctttagctcataatggctctttacattaacttaccatataccttgaaattactttcaatacattgtttatttggagagtacaagattcactgtagatcataaatattcacaaacactatttactatcataaagactaattactttcttatgaggttataaactttataactttttcccccccactaaacgtaattgatcgtgtcagagtatttttacactgagaaaatacttactagtgtaaggctgccacgttgccaggacagtatttttgggtgagaattcaaggcaaactgccttcaggaggtcgaaggagtgcagtagtcccttgttagtgacactgataatatttactctggtttcaaaagaaattatttcagcaatgaaatactgttttatagtagtcaacactaaccaaaacattcatacctcttttcaaatacagatcactccaaaatgttgactttttttttttttgagatggagtctcgctgtctcccaggttggagtgcagtggcgcaatctcggctcactgcaagctccacctccccggttcatgccattctcctgcctcagcctcccaagtagctgggactacaggtgcccgccaccacgcccggctaattttttgtatttttagtagagatggggtttcaccgtgttagccaggatggtcttgatctcctgacctcgtgatccgcccgccttggcctcccaaagtgctgggattacaggcgtgagccaccatgcccagcccaaaatgttcatttttcataaaaatcaactttaagttggttctagaaaatatgcgggaaataccttaacttcaaaaaaaaagggccaggtgcagtcgctcacacctgtaatcccagcactttgggaggtcgaggtgggtggatcacctgaggtcgggagttcgagaccagcctggccaacatggagaacctctgtctctactaacactacaaaaattagccgggcgtggcagtgggcacctgtaatcccagctactcgggaggcagaggctgcagtgggctgagatcgtgccactgcactccaggctgggtgacagagtgagactccatctcaaaaaaaaaaaaatgtatattttaccaaaaggctcctatataaggctagtgctgggaaatgatataaaatagaagacacatggatgattccaccttcagctgaaaaggaaaaaaatgcctttaagtgaacacaaaactaatctatagagaagctgaggtctatcaaaccaaaggaaaggcagaggtgctagagaaaatggcaaaagtatacttttgttttattttttatttgagatggagtctcactctgtcacccaggctggagtgtagtggcacagtcttggctcacagcaacctccacctcctgggtttaagtgattctcctgcctaagcctcccgagtagctgggactacaggcgcatgccaccacgcctggctaatttttgtatttttggtagagacggggtttcaccatgttggccaggctggccttgaactcctgacctcaggtgatccacccaccctggccttccaaagtgctgggattacaggtatgagccaccgtgtccggcccgcaaaagtatacttttaaatttgaataaatgggccaggtgcagtggctcacacctgtaatcccagcatgttgggaggctgaggtgggaggactgcttgagcccaggagttcaaaaccagcccgggcaacatagcaagatcccatctcaattaaaaaaaaaattttttttaaataaatagaagctatagcagctagggaaatcagtaaggagacatttgatgtctactacaatctcaagagcaatctctaaaagatatgattctaagaattattatggtacaatgacaaaaatgacaataattgtatgataaaagcagttccattttgggatgttttctatgtacctaaccactttatgtacattttctcatttaatccttacaacaatcttacaaatgtcatcatttctgttttacaagtgctgaaatttaggcttagaaaaataaaatgatttgacgatttgctcaagatcatactattgataaatgccacagccaagctttgaaatcagtttggcctgacttactgttatgtactaaacactctggggtgtttaacaaaaaaaaaaaaaaaaaaaagactctccatcttattccagaagttgctgtaagtaactttgttctactcaggtttgaggaagataactgaggttaagataagcagtcactgaaaagaatgaaaaattaccacatagtatttaaacacacacacctaacatggaaatctttacaacttgctgcaaataacctattttagaattacaagacgctttcttgttttcttcttgttgctgttgttaacctttatttttttctttgctttgcaactggagcctactcagaattgatggtctttaagagttattcttagtttaatgaaggatgtttattttaattaagaaaaaacatatttaaggaagaatcagtaacggtttctgacttagttaaccagaaactgaacaaagaccacaatcaatacatgaaatctagttctcttgccccagaacaataagtaccattgtggtcacagcactttaatgaaataaatgctagaacttaatatagaagatatctattaaaatcatggacatgacatatggggacatactaaaaagattcagagttgaatcccatagaaggttaagtgtggatatgagtgaactattaacaataactgccaaggtaaaaacagacttattcaacaaactctaagctagaagaacaaggaatacttcaaaaacaaacaaacaaaaaaagacaatgaaaagaagtatagtatagcccattaggtagtaaatttctattgattcattactcaaatactacaaactaaaatatggattaaaaaataaaatttaagtacccacaataggttacacaaaaaaagagtaagaaattttgagatcacatcctactttttgaggctgagattaaaactgttaacattgtagataagactcattataattatattattaatgatttgagagtagtagattcaggctgggtgaggtggctcatgcctgtaatcctagcactttgggaggctgaataaagcgggtggatcacttgaggtcaggagttagagaccagcctgaccaacatggtgaaacaccatctctactaaaaatacaaaaattaaccagatgtggtgttgtctgcctgtagtctcagctactggggaggctgaggcaggcgaatcgcttgaacctgggaggcggaggttgctgtgagctgagatcacgccactctgggtgacagagtgagaccctgtctcaaaaaaaaaaaaaaaaaaaagggctgggcatagtggctaacacctataatcacaacacttcgggaggccgaggcaggaggactgcttggggccaggagtttgagcctaacctgatcaacataacaagaccctgtctctattaaaattgaaaaaagaaaaagaataaaagaccaattttttttaattataaaagctaattctgccagctacttatagtcataaaaggtgaatcaactaattcaacatgttctctttagtagtcaatttttaaaaagcaagtattaatgggtagtttaaacacttctgaatacattaccattgtaaagaacaatgtttaaaatttacttttcaaactaatgcatgcagtttctcccctttgaaaaacctaacagtattatatgtggtttagaacaatgtagataactttaagccaagcaacaaatatttgggcatttgcatggtctatgaaataaaatgttgtagtaactcttgaaaaattaaaaaggactggttttcttaataaaatataagcatttaatcaacataattttttgtgcaagaccaattttgtaaactggtattttatgtaacatatattatactaaacgttcttttgaataacatacacttttatatacataagactaataataataactgcaggcagttgttagtaatttaacagcaaaggtaaaaaagtatctacatctaggattaaatgagtaaagagaattattttctcagtgttactgcagatttaggaaactccaaccaataacttagagcactgtttaaaacaactcaacttctttagcattaaattatatttttcatatattaatttttaattctaagtaactagataaacaagtcatggcatatacatagaaatgaacaactttgaaggtattttgtgtaacgagaggtaatatctcactacatcatgacattaaaagacggattttattaatgacactcaaatatctgttattcaaataatgccagttgtgtttatattcgtgacacacaaaatatgttatgtaaatgaacactaacttttctccattgccccaggcaaacaaggtcccatccttactaaagatacagactttgcaattcttcccagattccctgaaaatgacaaaaaaaaaaggtttaaatgaataagcattaatacttttcaaaaaaatctgattataaagtcaaccatttcactatcaatttaataactaagaacttgcacaaatttcagaaaattccaaaatgctttcatctgccaaaatactttaaaatgcaatgctatcactgtaaagtaagctggaaaatgatttcatactaacagatggattttaagaaaaaaatagagcccttttgggtgaataagtttgtgtggtaggccttccatcaatttctcatgtgtagagatagaaagtataacaaaaataagaggctcttcacctaactacttgggaatattctatcaagtattcaaaactctaagtactgtatctccgaagtgaagatgtttactatgaatacatcacccagtgataatgaatacccaaatagaaacttgtatctgtgcacatgtagatgtacattagtgtagtcacaacatgagatgagaacttcctggctaaaaaataatttgaattgctaaataacaacaaaagcattgagaactgactgatacatcccttacactatctttgcattaattcatctgcacaaatgaagatgacatttgtgcttctgcaatcacacaataatgacagcttacactcagtttatagataataaaacatttttaaaatctctttctcatggtgcaatggctcacacctgtaatcccagcagtttgggaggccgaggcaggcggatcacctgaggttgggagttcgagaccagctgggcaacatggcgaaaccctgtctctaataaaaattcaaaaattagccaggtgtggtggtggcgcctgtagtcccagctactcaggacgctgagacaggagaattgcttcaatccaggaggcagaggttgcagtgaacccctgcgccactgtccagcctgggcgaaagagtgagactccaccacacaaaaaaataaaaataaaaaaaatctttcccacataaacagctatgatcaagatgttccccatcctatactaccctacacttatgcaactcatttctgaaccttacggcagaattttacaattatctttattaaattccacccaggttttggcctatcatttcagcctactgaggcctacttaaatcttgattttctcttttaaaacattagtcagtccttacattacatacggaagtatgtaatatataaattataaaactgttactaggctatcatctaaattatttataagactgttcagtgagctctgaacaagatcctgtggctcaccaacagtccttccctcaaattaaaactaactcattaatcagctgactttactgaccttaaccaatgacaattctgtcatcatcatgcaacccaaagactttctcatttctcagatattttgccaaaattatgtttacagttctattattctaatgtgtattctattattctgtctggaaattctacccagaaaggaaacgagataagcttgaaacaatttgttcttaggaagctcattttgacttaataaacacccccttatcgcaatgattataaacttactaaactacagaatccagaattcgattattttcttggtcttggcaattgggaaattttgcctctttccttctggtataattttttgaatgaaaaatttcaaacatacacaaaaaatagagaaaaagtatgataatccacctatgcactcatcatcaagcttaagtaactattaactcagagccaattttatctattccccacttttatctttcatgccacaacattccaacgcaaaaactagatgtcattatcatattgctctatacttgattatgcatctctaaccagtgagtatatttttttaaaaacataatcaccaccatgccacttcatctcacaaaattaacttcttaatatcatttaatacccaatacttggattggatatctgggttttttaacagctccccaggtcattctattgtgcagccacatttgagaactactcatgtaaaagactgactaaattctgagtttgaagtttttttaactttcgtagaagatatgtacagcacagttcctactgtataataactcaccaggagacacataaatatctctctgttctactcttagtgatactgagattgtactggattcagtcatgtgcctccttgtatctacctaactcttcctgctgccacgcctcaactattcaatgaagagacctcatctcctaacgccactggttgtctttgaatctgcagagttaagggccatacttccacatggcttccaccatgcactgcggcagcacatggaggagctctggcactcagattcaacccaaacaggctaagaggctgtagtaaacttcttaccctgtctccacacaacagactgttctgaagtacaaatgttccatacagcctttctggagacaaaaattttgcacacatgaccaagcaagttggctatattttgtggatttgtggtcacctcagtatatcccatcatacttgctttaactccttccctgtctcatttccctttctcccctactcctgcagccttgggactgcataccctaatgaagtgtagcacataactttgccatagttttttttttgttttttgttttttaaatagatatggggttttgccatactgcccaggctcatcctgaactcctgggctcaagtgatccacccaccttggcctcccaaagcgctgggattacaggcatgagccaccgcgcccagccagactgggttttctagagtagtgcttctcaaacattaatgtgcatacatggccgggtgtggtggctcacacctgtaatcccagcactttgggaggccaaggagggtgaatcacctgaggtcagaagttcgagaccagcctggccaacatggtgaaaccacgtctctactaaaaataaaaaaatttagccaggtgtggtagcaggtgcctataatcccagctacttgggaggctgaggcaggagaatcgcttgaacccaggaagcagaggttgcagtgagccgagattgtaccattgcactccagcctgggcaacaagagtgaaactccatctcaaaaaaaataaataaataagtaaataaataaataatgtgcatacaggccaggcatggtggctgaggcctgtaatcccagcactttgggaggccaaggcggttggatctcttgagcccaggagttggagagcagcctgggcaacatagtgagacccccatctctacaaaacatacaaaaattagccaggcatggtggcatgcgcctatagtcccagctacttgggatactgaggcaggagtattgtttgagcctgggagattgaggctacagtgggccatgattacaccactccattctagcctgggcagcagagcaagactctggaaaaaaaaaagtgcatataaatcatctgaagatctagctaaaatacagattctgattcagtaagttgggtagggcctgagatgcatttctgtactggctcaggagtgatgccaatatagttggtcttggttgggcccatgcttcctgtagcaaggttctagagaactgggcctaataaaaattggtcagtagagtcagatgacaacagcctgattataaagttccccattaacagtcatcaaacagttcagctaaaggtttcagcatcttttgatgatcatctgcctagatcagtggttcttaaaggggggtccccagatttgcagcatcagtatcactggggaatttgttaaaaatgcaaattattgggccctaccgctgatctaatgaatccgaacatttggaaagagagctgcaatctggattttaacgagcttttcagatgattctgatgcttggtaaagtttgagaaccagtggcctagatccatttcttgaggattacaaaatggtaattgtctgatccagcatccattctccatttattaactggaattcgtctataaaattctttttctcatcaaccacttggttactctgagaaacagtttgtataagaaaggcaagataaatgcttgactccttccctttatttatcaattttcaaagtaatgagtgaggactccatcaaccaccaatgctgaccagttaggtttaaacggaggggggatttttcgggggagcatttatatacttgacatgctttatctttctattcataattcttaatgttcccatcttaggttggtgtgaatctcttcaagttgcttcctacgaccctttaacaaaatctcattagtcttttatagctttgctttctggcacaaaagttgctacctcaacttgtacattttctgtcccagacctagagttgaccacttctccaaggaagtggttccttttagtgaagaattgtatttagagatcacaatctgtgaggatggggtattcactgctactgtgttatcactgcttccaggccttttcattggccagaactaggaaatgcaaatgttttatgaaaggaaatcatgagttcatactgatataggcaagtctatcttttcactctaatgctgaaaaatcttggtgcctaacaacattaatacaattaatttactctatcctatagtagattcaaatgacaatatcaactttcagttaaaaagaaaactattaggccaggcatggtggctcacgtctgtaatcccagcactttgggaggatgagacaggtggatcacctgaggtcaggagtttgagactagcctggccaacacggtgaaactctgtcactactacaaatacaaaaaaattagccaggcatggtggcaggcacctgtaatcccacctacttgggaggctgaggcaggagaatcgcttgaacctggggggcagaggttgcattaagccgagattgcaccactgcactctagcctgggcaacaagggcaaaactcagtctcaaaaaaaaagaattttgcaggtcttcacatggttatgccaccaacctgatataaagctagaatcacttattttagtttcccaattttttttttttttttttttgagacggagtctcatctttttgcccaggctggagtgcaatgccctgattttggctcactgcaacctccacctccgggtttcaagcgattctgctgcatcagcctcccgagtagagtagctgggattacaggcgcctgcccccacacccggctaatttttgtatttttagccgagatggggttttgccatgttggccaggctggtcttgaactcctgacctcaggtgatctggcctgccttggcctcccatagtgctgggattacaggcgtgagccaccgggcccagcttttaatttaatttttaaatttaaaacaattatatggtccaaagtcaaaactataccaaagctctttcacagatgtgtcccctgcatcctgtaactctctcccccgcattctgtaactctctccccctatagataagcatttttaactagtttttggtttacttgtccattgtttctttggggaaaaaaaaattaatctagctagctatatactatgtgcatatatatgtcctccctttttaatatctttttcattatgatttcactaagattactggccatgatttggctatcaaatttgcaagtttttctcattccttaagatacaactcttgtaaaataaaggcttgtattcaattacactagtgtctacactttttcttagtattgttccccctaccttataaataggcttaagttactattttcagatctgaagatcattttccttgatagagaatatgtattcttttcatcttcggtaaatattatacaataaaaatgagttcatctgttcttttcctttcttgttcaaaatacaccaccaacaaaaccattttagattgtactgtatgttccctataacattacttaacaaaataaatcataccttggaaacactgtgctttctgtaaaatgtggtggtccattcaccatgtacagtccttctgatcctcggactaaagaagtaaaataaaaagaaccacaattactttgttaataaagactcagttaacacaaatgtgttttttaaaaaagcagctttagtcaaaatattaatgaaatcattaaatatttcattgaactatagaatattagcaacaaaagggcatattttcttactctgttacataaaatcatataattgctgagaaatacgtaactttttaaataaaactcgaaactttgtcaccactgaaagaaaggcagctgtcttgtggtaaagaggacatgaattcagagcctgacctaagtttataactgcctgtggaaccttggatacgttaccacctctgaatctgtgacctaatctgtaaaatggaaatatcagaacacaggatagctgtatgctttatataaagtaataaaaaaagtatatgtttaaagtttttagaaatataaggcaatattaatatattcacaatttatcaaactaagagaacaagtggaatgagacatattcatttattaaggccccaatgacagtaatagcctaaaaaattaagtggaaacaaagttcaagattaaataatcatctacagaactagactatacttcttatttctatgtttaaatttatttatttttttgagacagggtcttgctgtcacccaggctggagtacagtggcatgatcaaggctcactgcaacttcaaactcctggacttaagtgatgctcctggctcagtttcccaagtagctgggactacaggcatgtgccaccctgcttggctattttttttttttgtagagacagagtctcactgttgcccaggctgatctctaactcctgggctaaggcaatcctccctcctcagcctcacaaagtgctgagattacaggtgtgagccaccgcacctagcctagactatacttttttaaatggttgaattaaatgcttctaaagctgaaccaaataaatagattcatttagtcaacaaatgcttagtgggaaaaaaacgaacaaactacctcctaggccctgtgttgaacattggcgaaataataggaaagaaaatcagccttgtctctgacctcattgaactttgcaaacagtaatcaaataattggccaaatatacggaatcatatacctgtgtttagtccttcaaaggaaaggtatatggtaccactgagggtataaaagagagttttaacctaaaaatggaaggttagggaaagcatccttaagtgttttgtatactgagatgtaaaggatcaatggcagttaacaagcaaggagaacagttaacaagtgcaaaaaccccatggaaagaaaaacgacagagcgtcaaggggatggaaagaaggcctgtgtggctagaggatgatgaagctggaaaacaaaatagggctcaggctaggcgtggtggctcacacctgtaatcccagtactttgggaggccgaggcaggcagatggcttgagcccaggaattcaagaccagcctgggcaacatagggagatgctgtctctacaaaaattagctgggcacggtggcacatgcctgtagtcccagctattcgcacggctgaggcaggaggatcacctggacttgggaagtcaaggccacagtgaaccatgatcatgtcacccaccaccaagccatgttaagttttatatttcttgtagagacgaggtttcactacattgcctaggctggtcttaaactcctcagctcaagcaatccaatctgcttccctcagccttccaaagtgctgggattacagctgtaagccacctggcccaaactgacattttgtacttctaagatgccttgctagatttaattagtttttctattaaataaatttaataaaagcatatacagtttaatttactcctgataagctgtgatacaaagtttattagaaaaaaacacaaaatcaggtccataacagaacataaactgttttaaactaataaaagcaaaaataaatagggactaaaaaacttctcaatactgaaacaatttttttctacatgtaactttctaacaaggaatcctttttagttacaagtatctgtgaaactaaatacaatgcgtagttagcttaatatagtgtattctgagtttgtgtgattccctgtttttagtgatttccctcttcaatcaaatgggattggcaatatgttctagcagaaagaaaaatctagaatgcaagcagttcttttaagacaacaaataaacgccagtttcacacagtagctgtgtgaaatacattaaacatctacataatcttttccaagcttactagcctttttagacattcatatactatttattgctctaggcctgagttagagagagaaaaacacagggcttcaataaacaaggatcccatggcaggggtgtagtcatctttaaaatacgatacttttcccaactcttacattcactgaactatgtattagtttaggaaaatcactcaattttgaataaattatctctgtgacttcaactggtcaagcagattagacaatgtgaatttcacgtaatggacattgctgttttatgtgcctagcaaccagctcctcttctttaggaggcgctcattttcttttgaggagtatcgaggagtgggaagataatttagtcctgactacatgattaaaagttgactgatacaaaggtgagccaagcaaagtcaaaggcagctagccttgagatttttgctgagactactggcaaaaatgtgttctttcctttggagctgggcatttggttgaatgtcagtttaaagatgaatttaatctggaggaaagcaagaacctacagatgaagaaaaacagatttctggccaggcatggtggctcacacctgtaatcccagcactttgggaggcagaggcgtgtggctcacccgaggacaggcgttcaagaccaacctgaccaacttggtgaaaccccaactctactaaaaatacaaaattagctgggcgtggtggtgcacgcctgtaatcccagctactcaggaggctgaggcagaagaattgcttgcacttgggaggtggaggttgcagcgagccaagatcgcgccattgcactccagcctgggcaacaagagcgaaactatctcaaaaaaaaaaaaaaagaaagaaagaaagaaagaaaaacagatttctgaagccatgtgagtatctggatctagcagtactgaggcttttaggttatacgagtttaaaaaaaaaaatccctttttcacctgctttggcttgtcactcccaattaagagttggggttaacaaaatttactggctaatctgcaaattattcacagctctaaaatcccacgagtctaaatttaacaaaagattttggaagtaaaataatctattgttgaatgaaatatgtacactgagaatgtttaaaagattaaacagtttgttctagtgaaagaaaaatggaccacagagttgaacaatctgaataagtataatcctaatcctgccaatttgcagtgtgaatcggaccacttaatctctctgggcctctaagaatatgagaatatgaagagtagactgaacagacaacatttaagctcttacaaagtccctgattttaagcactgtaagacaattgtcatccttggttaatttactataaagtggctatccttcattaatttaaaaggatagtctaaacagacaaatctaatctagatctcttgtatgcacagttcaaaatagggtttgcgctcttatgaggctctaatgcccccactgatctgacaggaggggaagctcaagtggtaatgcttgcccagtaccagtccggcccagggggttggggacccctgatttagagtatctattgtctaccaggcactgcactagtactgagaagacagatatgaataagaccctgtcgctgacattgaaggactcacagtctagcaggggagaaaggcaagtgaatgtctaattatcctacttagtaagtgaaataaaatttcaaatatatttcaggtacaaaaatagcccaggaagtgactgactctatctgggtagagtgacgaaaggcttcacagagcaatgatatctaaaatgaattttaatttcaacagatgaaaaagagtttgccaaatcaacaagaggcataggatagtactagactgaagaaacaggttgttcaaagggactcagaagcagttcagtattgatggagcaccaaataagatgggatggcaaggaaataaatgagtctcaagagcaattcaaagattataaatggttacataactatgctacataggatggaatctaccctgtaagcagagaggaactacctactgtaggcatttttaaaggaggggttatttatcagattttagaatgtaattttttcattagagttcaaataagcatttagtattaaaaattgtgaataacaagctacctttacaaacctaaaaaaaaatttattatgtaactttgccttttaaacagtctttgcctggtatattatctagaagattatactcggcgtttgataaatgatgactaaactgcagaagacagactgagcatcagtgggcatggcgcttaataacaaagattttaaaatgtaaaaatagaaatgtagactggcaaaaagtgcaaaaatgttttaaggttcctttcgcgggggggaagggagggaatagcctccctccttaaatgcagacaacctttctcttaatgactttttccttctatatagttatcagaacttaaccaaaaccttcttttccttcccgactctcttttccttacgtaatactcatatgcagactcttagccacaccctagtaaagcaacttccccagcattttccaatctaagtttattatctcctccaacactacagtctttagcttcaaaatttcaagagtcctctaatgttctatttctaatatgctcataaccatttcaaaatcaaatgttgctagaatatctctatcatgctcactgctacaccctctcccaaccacaccttcatcatttgaaacctgcattacagctccactctccctattcagtcctacaaacctcattaaggcaggaaggccagaatctggaattacttaagtccaggtgtatttaaagtgcgtgatcattctagaggactaactcatgtttgtctttgttcttattgtagacctaaatgacttcacaagggcccgtgtaacaccagtattgcagacccatgtgtcacaaattcaactagcacattgtttttctcccccttcttctatttctgtagaagatgaatccgcaggcaagaatgatggatgggtgaaagggagggggaatacgaaagcccagaggcggagacttcacttccgattgccacgctatatcaagaaagccaacagtctggcctttccgcaagccacaagaaaaggcagatcagactccccggctcctcgggtagttctcaaaggcaaagacaaaaataagaaactagtctgaagaaagagagtccctcgcttcttcagaactcacctgtcaagagcggcgtggacggcgccatgttgtcccggaaagagaaaccgctcgggtgagagttcaccagggccgaacccggcccctacacgtctcctcatgcgtggagacagcgaattggtgtttccggagccatcagcctcggggccaattcacttccggttacggagtgacgcggaaaaggcgcccaaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcggtaaggaaagagcgggcgcccctctgcgttccgcagccggagctgagtccgggtccctggggccgcgtcgcgttttctcccggatccggccgaccgtgggctggtgccgtggaggggtaggggcccgagtctgcgaaccgccagactgtgggggctcgggaacggaaggggagacctgtgaggtgagggggccggcgaccggcgtgcaggcgtgggagcctggggtccgagtggtttctctgcatctgaaatggtggattttcgcttttgcagagaaatgcccccgaagagaaggcgtctgtaggaccctggttattggctctcttcatttttgttgtctgtggttctggtaagtggcttgggggctcccatcaggtagagtcttgggttgaaaggatttgggatgacgtggtgaccggtcagtagtgagtcctacctgcgtagttctcaacccacctgccgaggactccacataattctgtttcgtctgaaccaaattacttgttccacatatgcacagagggtggtgctccagaaacttctcccagcttaatttgtactcacaggagatcaaaaaggaggtcaggtcttggtaatgatccagttggaataaatgttaagaccggacaaaacctaacgaaatgagaatttagaatgttttgtaactccattatcagtctttgcaaagaaaattataaatatgtactatagatgttagaacttgatttaacatataccagaatctaatgtcttaatgtcaaaattgagtatattttataaaataaagcttgtgcaaagaattgattcactatagaggaaattacctgattggcattttaatgtgtgagtcaaatgtttttaggttaataaaagaaacgtttgatacatggtttaaaaaaaaagtgtcggggtagcctgctgtcccctaagagtaacagacacttgcctttgcaaatagattacaaaaaaaaggtctttcctctcttcatttatcattttaatatgcaagctgttaatattgaagtagatgtttgttttccacattctaaaattactgagatttctgtttaacgtttcactttgcctttcttcttcacttaccaattggaagctttcctgataaatggatgagagccaagcagtttatataacctgaagatgattgaatttcagctttgtgagaatgaggaaacatgcatgtgttacaggccaggccttaaaaggatgcttataaaccaaaataattctatgctggaaaaacctgttggctttggtgctttaagttctttgtaaaatgattacttatctgcaagttctcttggatacttagacataaagttcagcgaagctaagataaaaaaataactcagggatatttcattgttttatttattcagacaggcctgtcttcacttcttattatactgaagttatgtaccatttgcaaatgtaagagtacctttggattcttcagctaccttaataaatatttgttagacaccagacctattttattcaaagcttattttaatatttgctctttctttttacagcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatatttgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttaactctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgc

SEQ ID NO: 496 - DNA, 28316 bp, Homo sapiens
gggccggggccgcggtgtcctgggtggcggggctccgggaatgtgactcagccaccgcggccccgcgatccgctcccgggccagcgcctcagtcggtgccgaggagggcggcgccgagacgggcgcgtcagcctgggaggagcgggaaaagggtcgcagcgcctgaggcccggccgccgcccgagtggatgagcgagcgagcgacttgtgaaacacgccgcggcccggtcaccaaccaggaccgggatcacgtggctcccagggctgggtgaagaagccgcccggaccgagcgcgccggagaggaggggcgcctggggacagaaggcgacgtcccctgaagtttgtgtcagccagggcccgccccctcgcgcttatgtaataggggcgcgctgccattggcccgcgcgaccagccagggcgcaggcgtgcgagcggggtgggggccagaaggaggcagccgcagaaaggcacatgggcggggctgcgaggagcaggcggggcgggggcgccgaggagagcggcgcggcgtgcgcgggcacgaggcgtagtggtctcccctaaggctgaggcggcggcgggcgcgcggcggcggcgggcgtgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccgggtgagcggcagcgggggcggtgctgacgccgcgggacgcccgggaaacggggcgggggccggccagcggggggcggtggggaccgtgggactcgccgcgggtcgcgaggggtcgcggggggcggcagggcccggcccggggcgggccgcgggaaggggatgagttcgggcgcctgccaggccctgcaggtggccgggtcgcaggccagccgcggaagcggagcggtaaccttacccccggcgacagccgccggtcagctgccagagtgtggcgctcccggtggacgcaggggccgggtttcgggcagtctcggcctccaggaggcgcgtcttggtccagggtccgtgaggactggctagatgggggctgcgtggcctttggtggcagggaggaggagggggtctccgaggcgggagaggcgggtttgggaaggaaggtgcgccaggctgaagctggggtcggagaagtgttgggtggagacctcactgtgggtgcgttcctcctctcctctccccaaaacgatggtgttaaaagctagggtcaggatgtggagcgctgcctgggcctcttcctttccgatggttatggagaatgagcctacttcctggacccaaaatccttttcttctgttactcatttatgttggttttaaaaggagctttggggcagagcttacttgttgcctcctacgagagcgcctcattttagaactcgtttcttccactacttccctctttgcagccccctcggaaaaccacactgagagttgcattaaaaaccagcatgtaggtatttgtaagtgactttttccctccagtttgtcgcatttaatcaaggagcggttgtagctgcctacgattttgtagaaaattgtgttggcttgagagcaagtcctaagttgagctgtccaaaagcaggtggttggttcgtttgaatttctgctttcagaaaggaaatcgatggggcgtgttgtcagaagttaggggcctacctcatgcatttagcttattttattccatttcctttacctggtgttaagttttctgtcttcagaataagaacaagtgactactgtctttattaagtctcttcggtctttttggttgctgtttggtgacaatggaaaatgggttgaatctattgtgtaatgttatattttagggaaagtcctaagtgcaaaagttaaaaataattttgtgtgtctaatgacattgctttgtacgagtcacaacatggaaatatcaaaatagctagtaacttctagaaagcaaaggaacttctgaaattagtggcttaccatttttgaagattttttttaacataaaacaagatttcccacaaaatcagtgtattaagatacataaaatacattgtgtcgaagagttaagatgtgtgagaagactggctattttgttacaaggtcctgatagtaagacattgagacaaaaaaccttgcaaaacattggtatacataaaggctgatcacgtgactactgtcgtccaaataatacataagtatccaaacctgtttccatgggaataggtttgtaagcttgcggtaacatcggacttaaatacacttttaaaaaaaatgtgccatttggcttagaattaataattttttttaaagcaaaaatggaagcttagtcttcaaggactgataacagctggtaatatttaccattgtttggtgggaatggggttctcatattaggctagcacgctaaacattttcaattacgaaaatgtattaggctcgtgtgctaccctaatataaaaaccccatatttcctcagttgaaatagtcagctgactatcctgaaaagcattgaccctcttttatattttatctgactttcagttcatttttttaatgctagtgggaacttctccaatcagtgtatttttttagtttccttttttggggaacaggaggagctcagtaatttttatgaaatgctttgacctcatatccattaactaattatggtcctagtcagaagaagctagcacccttccctggtgaagttgatacaaatccattgtatgttcctgtcctgcaatgatttacattcagttacagtactagtcaaaactatatatatatgaattctacttaggatccaattttgatatatttaaaaagcaattgagactcatgatagactttatgagcaggtttaacttgtgtggtcgaataaaagcctttaatttaaatggaaaagtaaaagtaacttttttcagtgacttgatttttttttttgttttaatccatttgggttcacgtcagatcatcggtaacaaaaagtggtatctttcagctttgtaaaagaaccctcttaaccaagttcattccctcaaatgggaactaacgtctagagagcaaagaaacttctggaattagtggcttgctgataatctcattttataatttgttcagcaatccagcaagaccaactttttaaaaaaattaataacagtagttttatgaaaactaagtaagaaaacagtttccacctatttctgaggtctcctttagaaggagtaacagacagcttttatttctcttaaagttataaaaatcacaatcgcaagtcacaatgaatactgggaagggaaattacttttgcagagtgatcaagtaaatgatagcgggggctaaacttttttagtaaacttgtgaagattacatacagtaaagtgcataaatcttgagtgtacaattcaatgaatttttataagtaaacacacttgattcaagaacattttcaggaccccataagtccccttcatgtcctgtcttcccagtcattacccataacccccaaggtgacccctttcactatagattagctttgcctgttttgaactttaaataatgtatattccccacaactggcttctttcctttaacattgagatacaaccaagttgttacttgtaacaattttttgtttgtgtgtttgtttatttatttttgagaccagagtctcactgtcgcccaggctgcagtgcagtggtgccatcacgcgtcactgcaacctctgcctcccggattcaagcaattctccacctcagcctcccaagtagctggaattacaggtgcctaccaccatgcctgcctaattttttttttttttttttttttttgtatttttagtagagacagggtttcaccatcttggccaggctggtcttgaactcctgacctcatgatccacccgccttggctttccaaagtgctgggattacaggcgtgagccaccgcgcctggccacaattttttaaatgctgggtagtattccgttgtataaatactataaaaatatgtatacaagttgtgcatccgtgttactattgatgggcattcagattttttccagttttggaatgggcactcagaacattttgtacatgtcttggtgtacataacatttgcatttctattgggtatataccaagagtggaattgctggctcatagaataaacagctaccaactagttttccacagggttgtgtcaattgatacttttgtagcatttatatgtgggaattttaatacctataaatttttatttgccagatatttctataaaacttaaggcttcaattctaagaacgttcttatgctttgattactctgtattagagtaaataagccactctaatgcttcaccttctgtttttagatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtagggtaaggggaattgaattgaaagatacagctctcccgtgggcagttttggcttgaatagattaaaattttgaaaccatggcaaaatagatgctttacatgaaatagtaggtttgagagctgattattttaggtatctattttcattcaccctttaaacaaatattttttgaatggctcctgtggccaggcaaaaatctctaggtgctgggaaaacagagtgaacaaaacaaaattgctttcctcatataaaataaagatgtcttcataagggcatataatacacttcactagcacatcatataactctacactcttagagctatataatatgctagtaagtatacctctagttatataattggttttttcttcactaaatttataattaggatgtctgtaaaaccatatagagtataatcacgttgagagcttttcctagaattaatgtgttgtattagatttgaagaactgtaataataacagctacttttgagtgcttaccatatgccacacatagagccaggtgttttacatgtattcacctatttaatccacataacaaccctataagataaagtacttttattgttctcattttacagaagagtaaactgactaatggaaattaaacaatttgtgtggggtctcccagctggttagtagaagagctggaatctgaactcaggcagttcagctccagagtccaccctctggaccactactgtactgcctctcaaagaagtacttctgaaattccaaatcagagcctcttgcctgtttgtttaagctcattacccttgaagttagtgagtggcagtaccaaaggaaaccatagtggagttagtacactacatatacactcaaaataatgaaattgagcagcttgtgattgtttggaaagaggcagggtgcaaattttaatcaactagtaatgaagaaataccttaatctaaatgtggtagagtagttacatatatttaaaaactcaaaaccacagacttttatttcatattttgtgtaatttaatgggttaagaataaataattgaaggttcttgccaagggaagtcagtatagtatagtatttgagaggtcacatatctagtactaagttaaaataaggtcttgggcaaattaaactctgggttttagtttccttatcaggtaaaatgatgctagtaggagctaaagattactttgaaggttctgtgggaattaaggtaacatgcttaatataataagggttcagtaaatgttacctattgtttgctgttaatcagataagcagaatacattctatgtgacctacctttctttataggtgaaatgtgggaacgttaggaatttctttaccacaaagtccctcttcatatgccagtcactaagttgtaggaatttaaaggtgtttttgggataattgtctatactgagaaggttcaggattctaaaaagtaacacatttttattttataaataaagtctagctctcttttgcacaattttttgttagacacaaatgccagaccctaagaccttcaagcagcactttgagagcaagcatcctaagactccacttcctccagaattagctgatgttcaggcataaggttgtttacaggtaactcacctctttttctattggtttgttaataacagggttgtatacaagaccaaaactgtcttcacttattgtgaaattaatttctgccttctgagattttattgcttcccctttttaagttaatgtgtaactgaaaagtccctttttctcagactatttcctttcaatgcctttgaaacatccaaatttttactactgtagccaaaaatggggagatgagtacatgctagccatctctgatcaaagaatggaaggaacttatcagtttaaagaaaatagtgattacaaagttatttgagagtttccctctaaaaacaatgtacaccaatgttcctgagcacctctttacaattagtttacttatagtacttagcagaggttcttttttttctcccccaacctatccccttagcaaagcttctgagtattaaaatatagggcaaaatgtagatgtagatatgtgctatataaatttgtttataaatttgttggttgaaagttatcactttacacattacatttggttggattttttccccctaaatagtggagttggtggtgggtgtgttgtgtgtttcagaattctttctttttaaaataaattcttcagagttctgtatataaagtcgagttgacaagtttaccagatattatcttcatagtgtttcttcttagttatttgaaatgcatgtaagttgcatttgtgcaatggtaacattcattgaaaattttgcttatgttttataggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacaggataaatggttttagaaattctgttctaactttccacattatttgccttataaaaatctaatgaattcatcagctagaattgcaagtgcaattcttatatccctttctctgctcagtggcaggttcctcagttaaactagagcagactgattcattaaaattgtgcatacgattttatgggcagctgatgatctaggtgaaaaatgacttatctgctgccttagtatattgcggttatgtgtcattgtacccctctgatcatttcctgtgtttgagttggaatatttaaaattgcagtatgacctggctctaactgccagtcaggtgtaccctgtagataactgatagcttcctaaaagcggttggattgtcagtgagcccttgtgaaaggttaggttctaatgtatatgccgtaatgaaataatcattaagcctattgtttaatgcaaaatatggaacaaatgtgaactggtaaaggtcgatcttgatactatattctttgaaaattcttgaagttctttaatttgaaattgaaacattaatttttgaggtttttggaagttactatttggccatttttacaaatggattttgcattaacaggaagattggaatgacttgtggctggattaattcccagaaccctctccctcctttcttttctaagtgagttgttgattttaggagtttgctttgtgctgttacctaaaatcagagactggtgtacagtatgacttccatctgaacttgaaaagtattaaaatgggtcaatattcacattcttttagatctcaggatgggaaaatgggtttgttcagatggatatggtaaatcttacccaattaaggaaggctaattttagagttcttctaatttgcttgtgtcaactcttaacttgtaaaactgctgttaactcggtttaaatttttaaattaatataatagaaagaacactaaaatacttactggtaactgcttagagccatttatctgatcctgtggattacagaatgcattccctcttctgctgtagcttatcattgctttgttttgtagctctgcatattttgcccaccttgtcttccctgtaagtttaagacgtttccaaggaaaagcttcagggctgatagtttcttagcaattcctattcttatgcccttactttaaaatagtccttttattttgtgtattttatttcctaagtttcagatgtaatatctgttgtttcctaacatgtcgattaccagaacgttagaattttacctaatttcttgtggatattgcagaagttctggttaaatcacaacttaaaagtttttaaaagtgctttgagcatatgtatatgtttagtgacaaatcatataaaaccattcacaagttttggttttttttttttcgtttgttttagtgactaattcaggatgaaagtttttttgttcttgtatttaacccttttttataagcagctgaagacaccatatttaacactatatctcagtgatagggaaatagctgcattgatcttacatgagcataatcatccttatacttcatgaggggattattagtacaatccccattttactgtgtttgagttaaaaaccaaacatccctgtaatttaatttgaagattctttaacagattgcagcaaagttcattataaaactgttatggtgtcttcaaagacttgataaaataacactgagagagaattggtccatttgtatgctgtatttctattacttgccaaaaggaatggggttaagattaaacttgtttccattctcttcacatggatattcatccccatgtttaactgacacactgggggctcagttgtgtgctgtaatgtcttattaaagaagatattaaagaaaactaaactagtctaatttcttctacattttaagaggtttttatattcccacttttttttttctcctttctgagcttagaattggctcttaagtataggttggtagatttgagggtagcaagagatttctttcatttctcgttttccctgcagtctttccctttttgaggtctgtagaatacttgggtggaaaaaaacttgtcattttgaaaccttactgtatagaataagtgtgaattgttggaaagggggaagtgattggctattaacataaaaatacaattatgaaaaatacttaggtcagttaattgaattggatgggtaagtccttgatgatattgtaagatttgaagttttagttttatattaaagatactatataggtaattaatgacatcataattcaaacctgagatgcagcataagatagaatttatcaacattactattttacctaggaaaacccatgtttttaattttcattaatatatgtaatgtggccaggtgcagtggctcacgcctgtaatcgcagcactttgggaggctgaggtggatggatcacttgaggtcaggagttcgagaccagcctggccaacatggcaagaccccatctctactaaaaatacaaaaattagcggggcctagtagcacatgcttataatcccagctactcaggaagctcaggcaggagaatggcttgaacccgggaggcggaggttacagtgagccaagatcttaccattgcacttcagcctgggcaacagagcgagactcactctctctctctctctctctctctctctctctccatatatatatatatataatatactgtacctatttttaaatgtggataaaggcctttttctataacacagtgatcaaacacagtccaaactataactgaaatactatatttaaaccacccagtctgaattaattcatttgtactagatttctggttttttggaaagtgtttggtttagttttggtcagagtacttttttggtcatgtactttttaacagtatatggcaatgaagatcaacaccagggagttgtgtttactgtgacttcacattctgaaatagtttaggctaccttaattttatttattgtaaaagtttcagaaaaatcttaagagccttcagtttgtaggtttaatgaaaacatctgtctacttaacaaagaaaatagacttttttaaataaaagttcaacctgtcatttttaattgtagattgccatgttaaattgaaaatattttttattttaaatgttgttttgataagttttttttactgaggtatccttcttttttttttttttgaatagccattttttagcttctattctttgaataccgtatggctccaaatttaaaatctgcacattcggagacagactttggtcatttctttatattcacatgggaatatcttcagtatgaagtaattgttaattctgtcattaactaatattatttgagggttgtagggaggaagaatatctttatcccagatctttctaggatgaactctttgagaagtttaagtcactaaggtatttattgaaaatcatatatgtgaagttgcattgtgagctgtaaagtattatataaaagcaatgtattatacaaagaaatatagcaaagttccctaatctttggaaattcagatgcattctggagataatacatatatttatttacataattttaggctatatggccaagtgcttggtgtgttttatagacaataacttaatgaggtatatgtacatgtgtgcgtttatgtgtatataggatggctttgggttgaagagggcagtctgtgcctggaagtatggggagtcagctgagggaggagtaggaaggaatagggaaatcaaggtgtgggtggctgattgagcaaaagtacataaagtttctttgagagaaagtgagtaggcaagcccgagcacaaggcttgtgaatgagagcctttgatcccgtggatgagagtggggagaatcgttagaatgggaccagattgtgcaatgcgtgcacactgcagaaaattgttcaaattactcctgacactggggactctttcagggtttgggaacgggagtgacatgatgaaagtatgtcaggaagatttatattaatgaaatactgtgtcgatactggtttgatggagatcttcttacaacctcttgtatgtttctctatttaacagtttactatcataatacaacttttggttattctaggttattatgaatatagattaatgggcaagaattttgctgtgctctaatgcagtgatactactaatgcccaaaaagctgtatttagggatgtttgtccctgcactaaataaccccagactatagtgtggctatacacgacatttcttgtcttctacttcactataaaagtaacacattttgaaatatatctcatatataaaaatgtgaagactgtggtaaggttggattttacaaattgaccagtacaaaacattttgaggaatagtatccatgtctgtctctctctctctctctcattcttaccacatagatttttttaaattaatgcatgtttttgaattttgtagtcacttttttcatattatgtctttgtactctgccatttcatttaacaacataacaggtgggtttttcgtgttataaactgtgctaagtggaatttttgtggctgcataatgatccattgggtagattacctgtagttttttttaaccattttcctgttgtaggacatttaggttttctcttatttgtgcagaaggcttcatttctacatttagaattacacatcataaaactttaaagctcttctgaaaagtgtacaatactttattaaaatagcaaatgagagagaaccagagttgcagaccgtatagtatataggaccaggcaatacttgaccaatgatgttttgcatgttactgcattacctttgtttgaatactagcactttttcctgaatttggtaggttaacccttgtatatttccttgatttctagtggagcaggaatattttaactgcatttgttagccagatacagttactattttgtgaattgtccattgcccatttatttgttggggccttctgactatattcaatctgctatccacagtaaacttggaacaactgagagttgccaggaaacaccagataactagagttatgaaacctgtaacttattttacacagagaacaaaattgtaggctctgtctgaaccacttgctggaagccttaactatcagataaagtataaatccacagtttgcatttaaggcatattttttattcaagactattgaaatatgttttttattgttacctgactactatgaagaaatagtatttttattagattaagtcagtttagtaagttacagtaacaaaataacctttcatgtttgggatctgtcttttattaggttctattatttaatatttatgtatgcggattttcatagtaacaaaatagactgtatttaagccttgctttgaatagccaggaacatttctgatagcaacagagtttcttacttaaataggatagaaaatggccaaacataagaatttaaagctgtagtcgaatgacccagtgagaaaaatggaaaacacctaagttcaaatctggctctgctttttcctttctcattttggacaggttacttcacctttctgagttgcattatctttagtcaccttataaaatgcaggaactggccaggtgtggtggcacatacctgtaatcccagcactttgggaggccgaggcgggtggatcacgaggtcaggagttcaagaccagcctggccaagatggtgaaacccagtctctactaaaaatacaaaaattagccaggtgtggtggcaggcgcctgtaatcccagctacttgggaggctgaggcagagaattccttgaacctgggaggcagaggttgcagtgagctgagatcgtgccactacgctccagcctgggcaacagagtgagactctgtctcaaaaaaaaaaaaaaaaaaatacagaaactaatacctccctcaaatgattgttttaagttaacaagcaaatgaaataatgagtataaacaccacctgtgcaatcataaatgctcaatagctgttagctttcttcccactgtcttcctatccctcctccctctactgaaattaacacagtgtgtctttacacatacccttctcacatttgcccatttctgcttgtgctttttcgtaggactaaaatgctctctcttctcccccactcaaccctggtctcttgctgtggaaatgctacttactcttcagggctcaactcgaatgctgatttttttttttttttccatgaacctcagcacttaaatgtactaatgtgggaaaaggaatatacagtaataaatatgaaagaagactacaaactataaaaaaatagtgtcaggagactaaattttagaagggcaaaaagttcctgaaaaatagtaaaggaagtttatttacttgttttcagttaagtagtaataacaaggaatgagtgttagcactccctgagcaactcctattcatttgctgtgtattttgtaaaactctcattgtgaaaatgaacccaatatgatgaaatactaaaaggacatatgatttcactggatttttacttggctttgatgaattatgactcagaaggctataggaatttgcagaatttgacattaagtctgaaccagtgtcagtctaggaaagtgatacggacaggaagctatccagaagactggagataagtaatttgtgtcttgattttctaaaaagcacaaaagacaatattgaaaatgcagaattgtaagtgtacccttggtctctaggtaaataagtacgttatctttttactgtgactctcctttttcctcaattaggccttggactaatttcatgtgtagttttatttctagtctttttcccttgtcacgtttgttttctttgcgacaagagaaattcttctaaaacacagttcaagtcacaaccctctcctctgaagcacttaggtgctctccctggcccaccagatgaacacatactcctgggttgtaattgacaggtcctccacagtctgaccccagcatgtgcttccagccagccccttctgccatacttgttcccatcctcttgctgagtgaattacttgctgttctttgagtaaccctcactatgcctttcttgccttcacacaatctttctgcatcttaactgaggtgccctctttttcttcttctattcttttgtgccctctctctaatgctggccaatctgataggatcactccttgtaaccctcaaagtcactgggcgtgacctttcatctttttatcattttactgttctactatccttgggaacaagagtagtcttatttttatgtctacttgaatgtttatgacagcatgaaactattgtctttaaatgtagcattccccaaattgcaacaaactattctcattgctttatagattactttttaataaactgttttttggatttacttttttagattactgaagccgtaagaggagggctcgtataagcattgctgtatatgtagaaccctttatagtttacaaagtattttttcttttttgaattgcgtataaaaatatgcttgaggaaatcaagagacagcttgatgatacatctcaattttagcaaggcaaagtaatttatggtaattttgatagcaggatggtctacaggcggtagtacattttggtggacctttaacttattttgaatttctgcactcagatgtttaatagatgtgtgttaacctgttgagtttcatatcctgccaactttaagtgtgtgcgtaatatgtgtgttaccagtttacagataacacaaagtagggagggaaagctaatgcagaattacaattcagaaagatttcaggctgaaaggctaaagtaaaaccaagaagcagtttaaatgcaataaatgttaaatccatttagaacttataaaaattacattttacaagtacaaaatacgggcagcagcctgtcttggcattttttcaggttaagagccaatgtattagtttattaaagtcttattatgaatcaagcatgacttctttgctttaaaatataggaatgcaattattagtttaggagaacacatgttaatcacacatttttatttattgagagccagttttcttgtgaagttgatgttttgttccgcatgtctctgtctttgctgtatataagtgaaacattgcttgtctacattccacacaatgcagggaggaggtcagggacggtgagtcgactgtaaactgtaaaccacgtttactaaggaggcatttggaaagttgctgtgatgtcttgttgagagcacgtctgaaagccatggatggaagttaatctcactgtaagaaacctcattacaacatctagatctatccagtatcacaatggcttgctttatggcatgagcaccccttccctaaaattcatcgtaaagggagtatctgattatgtctgggaagggcagcagggttttctatcatttgacaggagatcagataggctctgagatccttctcattcagcaatcctcttgcattaagtaatgcagtgctgggagcccgtaagatagttacgttctttgagcatgttttgtcaaatggaaaaaacctactgttatatttacttatttgaacatacaaactgtttgatctacttgtctttgtctttctcagatgcttataaatttaaacggagagaatattgagtcagaataggtgtcaggatatcttcatcacacttggatttgagatacatttctgactatagagaatgcttatattcgatgttttaataggctcctagatgtcaaacttagtttagaaatacttctttttaatcacctggaaagtggtactgcaatattactataggttaggtcggcatcattcttcatcagtggactctacaacttaaatcataaagttctgtcagtaaaaaaaaaatctttactatcaatgtaaatatccatcaattatatgcacatacttccattgtaattataaagcagtcacaggatgagatgaaaaacattctaatattttctttttgcattctagtggatcaacttacattaccacctgggacacacacacctcactttaaaccattgctctttgtcgtagaacctgtcataaaaaccttgtttttaagctaaaaggttttttagcagctcacagatacatagatctttataagtcaattaaagcaaatgaaatgtagtaagggtccatgctgtgtaaaaaaatactctgcacagcatgtaaaaagtgtaccctttctgcactcagatggttaatagatgtgtgttaacctgttgagtttcatatcctgccagctttaaagtactgaaaaagcacactggtaaagggcacatggcaacatattttgaacacagcatatgtagtttggaacatgatactgagactgagaagtcaggactggagtgatttgtataaaggtgaagtcttaggaacatacctttaaggctgtatgtagtgaaaagaataaacaaaccaaagttaaaacattggaaagccctcactaagggataggtagagaaggagctaggagaagtaactgaaagaatagtcagaagaggtagtaggagcaccagggtcatataggttctcagacatgagaagagtttgggtttgaggctgggttgtcagggtcatgaactaccatccgttcactgagtgcctgctttgtaccagtgtgtggattaaatacattctcaacaatggtagtcagcatcccaaatgcttccctaaggtcaagagagtatggtttggggaaaataggagtggaagctgaggggcaaggaaggagcagatacagacccctgacttgaatcaagtagtgtcacacagggaatggccatatatatggggtcaacgcttccttccaagaggcctaaggcactgattaccaatcgataaacctattgtttagcagacatgctcacagcttaaaatgtactgtgatggtgttaattttttttaggcacaataagctcaatttatatttaaaacattgacataagatacttaaaaatcattatgccatatttacatataacatcttaacctatgatcatcagtgttgtaaccctaagtgattctattacatgtttacatattatacagtcatgccttgcttacccatggagatatgttttgagaaatgcatttttaggcagttttgtcattgtatgaacatcatagaatgtcttacataaacgtagatggtatagcctactgcagactgaggctatattgctcttgggccacaaacctgtacagactgttattgtactgaatgctgtaggcagttgtaacacaatgctaagtatttttgtatctaaatacaaaaacaggtacagtaaaaatacagtgtagaccagaagcggtggctcacccctgtaagcctaacactttgggaggccgaggcaggcggatcaccttaggtcaggggttcgtgaccagcctggtcaacatggcgaaaccccatctctactaaaaatacaaaaaaaattagccgggtgtggtggcgggtgcctgtagactcaaatacttgggagtctgagcggggagaattgcttgaacccaggagtcggaggttgcagtgagctgagattgcaccactgcactccagcctgggtgacagagcgggactctgtctcaagaaaaaaaaaatgcagtgtaaaaaatacaaaatgttagacctgtattgggcacataccatgagtgaagcttgcagaactgggtatttgctctgggtgaatctgagtggtgagtgaatgtgaaggcccaggacattcctgtataccactgtagactttataaacactgtacacttagggtacaaatatttttctttaatagtaaattaaccttagcttactgtaactttttcttgaagttgtgtaagtttgggtttttttgtgtgtgttttttttgctggttttttttttttttttttgaggcagagtctcgctgtgttggccaggctggagtacagtggtacgatctcaactcactgcaacctccatctcccgggttcaagcgattctcctgcctcagcctccccagtagctgggcttgcaggtgctcaccaccatgcctggctaattgttgtatttttagtagagatggagttttaccatgttagccaggctagtcttgaactgacctcagtgatcaattcccttggcctcccaaaatgctgggatttcaagcatgagccacaatgcccaggcttaacttttttacttaataaactttttatttttactttttgactcttgtaataaaacacaaacacattgtacagacagctatacaaaaatatttatatctttattctctgttttttttctatttttaacattttttatttatttttaaacttttttgttaaaactaagacacaagcacacattagcatagacgtacagagagtcaggatcatcagtatcactgtcttcgtgtcccactggagggactccaggggaaataacaaacacagagctgtcatctgtgataacttaaatgatgccttctttcgtaataccttctgaagaacctccctgaggctattttacagttaacactttttttaataaggagatgagtacactctaaaataatgaaaagtatatagtatagtaagtacataaaccagtaacaattgtttattgtcattatcaagtattacatactgtatataactgcacgtgctgtgcttttatgactggcagctgaatagatttgttaatacctgcatcaccacaaacgccagtaacacattgcactacaatattacaaagactgcaatatcactagattataggaatttttcagctccattataatcttatgggactaccattctgtatgtagtctatcattgaccaaaatatcattatgcagtttatgactcattatgtataaaatgtaactttatatataaattttataaaatgcacgtaaacatgaagtaatatttaaaaaataatttataaaattacaaaataaagttataaattatgttaatatatataaatgcactggattttattggtagcatgaaaatagaactcaccttgagccacttacgcactgttggttgaacaggaaaataatactgaacttgtgataacctttctgatcaacagtttaaaccccgagatccattttattcttttcagtcaaaaaaagtgatcgtggttattttcttgggagaattcctagacatgaactgtctgggttaaaagtatgcacaaaagcttctacactggtagaagtaggttggaaggccaggtgtctgtgggaaaggtttttgtatggggaagtgatagaggagccattcagaagctgtcattcagtttgtcggcaagtggctaaagcctccgaggcctaggtttcttagctttaaagcagtatcttctcccatctcacagcactgtgaggaggacttttttttttttaagtttggaaaagtacttttgtaaagtgtaaaaccctttgaggtgtggtgcagtagttcttcaaggaggtgtgccatgcactgatgtgtggcttctagctatggaaagaagttatctttttttttttcttttttttgagacggagtctctttctgtcacccgggctgcagtgcagtggctcgatctcggctcactgcaagctctgcctcccaggttcacatcattctcctgcctcagcctcctgagtagctgggactacaggcacctgccaccacgcctggcaaattttttttttttttttttttttttttttgagacggagtctcgctctgtcgcccaggctggagtgcagtgacgcaatcttggctcgctgcaagctccgtctcccgggttcacaccattctcctgcctcagcctcccaagtagctgggactacaggcacccgccatcacgcctggcttattttttgtacatttagtagagacggggtttcaccgtgttagccaggatggtctcaatctcctgacctcgtaatccacccgcctcagcctcccaaagtgctgggattacaggcatgagccaccgcgcccggcccacgcctggctaatttttttgtatttttaatagagacggggtttcactgtgttagccagatggtcttgatctcctgaactcgtgatccgcccgccttagcctcccaaggaaagaagttacctaatgatcattttaaattactgaagtgtatagacttataagaatgggttcaaggttatctctataagaattaattcagtagcatttcagtgtactttcttgagaggggaaaacagagtttgagttgcagccagcaagttgagaatcctatgtgtgaccctagatacaccttcctgtgtgtcaatagcaggaagaaggtattttagagtcacggaggtagagaaaatagcatggactttctcagccaggtacacttaggttcaaattcatctctggcatttagaatttgagtgacctggaggagtaaactcacttcatgtctccaaatcacattgttctcatctctgaaatgaactgctttactgagtagttgtgagcatttagctctatagctgcacataatagaaactttttattttaaaaaaagctcattagttatctaaaaggtaatactctctggaaggggtggttatgaaaatacattgctgcatcggggtgtccagtctggagaggtataagtgttcaaaatacttgaggtttcttatattttgaattaatagctatgggaaatgcctctcttagcttgtaaatgctctggaacttttcttcatagtatctcattcttgagtagtcatgttgggggtagtttttacttataaaagtaatacatgcctgcactccagcctgggcgacagagcgagactccgtctcaaaaaaaaaaaaaaaaaaaaaagtaatacgtgcttcatggttaacaattcaaactatgcagacaactatcaaataagtaaaagtcccttatgtttccattcataccgtaaacctggttttccgtttgttttgattttgattggtttgttatctggtgggttgattagtttgagttttggttttcaaattcaaactgccttcattttttttttcaatgattgcttgcatcatccaaaaggaaaaattcctatgaccagtgaccatcctactgacagagattgcttcgcaactaaactaagcttctgtgatttgaaacagcttaaaagctctaactagaaagcttaccaactcaatataaaaccaggttttaattgacttgggttatgaaaggctctaataatagagcctgccactttaagaaaatgccatagcccactggcatatgcagaagctccttgtgcaagggaggcgtgcctacagctgatgtcatagcccagccttctaatgccatttgcataaagagtattcgattgcatgattatataaagtgaggtttactggtattttcttgtttagttcttgaaagtctaattataggcctaagggaataaatctaccacttgaagaggattgttgtggctactgtcagattccagggagaagacagattaaaagcaaaaatttgaatttcaaagaaaatactttaatgcaccaacacaatgaagtgaagtttatgtcaaaatatagaggtttgcctttcttgtattctaaactggttcttcattaaaataactttatctaaagaaaaatgaatgccagccacagtggttcatgcctgtaatcccagcactttaggaggccaggcgggtggatcacctgaggtcaggagtttgagatcagcctgatcaacatggtgaaaccccgtctctactaaatatacaaaaaatttagccaggcatggtggcacatgtctgtaatcccagctactcaggaagctgaggcaggagaattacttgaacctgggaggcgaaggttgcagtgagccaagattgcaccattgcactctagcctgggcaacaagagcgaagatccgtctcaaaaaataaagaaaaatgaaggctcactgtcaaacattttcacttaaagcattgaaattagtgcctagttaacctgtatccagagctgatttttagctacagaaagcactatgattgtgccagtgaccatgtggaaatacttctacccagatgggaataagatcacaggcctgaccccagtgggtactccctcagccaccctgtcccctatttcaccccttcgaaatccagcaactgaaggggtgacacttggcagagcaggacgctagctggattgtgcaccagcacagggtgcaggatctactctgattggcctgcgccctgctgatagtgaaataccgtgttttgaatgttcatctctatgcatgttaacttagctaaaggcacctcagtggataatccaaaaacccacatttggcttttttgttgttgtttctttttttttttttttttttgagacagagccttactctgtcgcccattctggagtgcagtggcgcagtcttgactcactgcaacctccacctcctgggttcaagcaactctgccacctcagcttcccaagtagctggaattacaggcgtccgccaccacacccgactattttttttgtatttttagtagatatggggtttcactatgctggctaggctggtctcaaactcctgacttcgggtgatccgcccaccttggcctcccaaagtgctgggattgcaagcatgggccatcgtggctggcctttttttttttttttttttttaatcacaggtatgtgacatatgaattaagtggtcaaatgtaaaactaatggggacaccaagcctcaggaagaacatcccatgtttctgtttaattctcttatgtgttatactaccttccctttctctttcttatacacatagattttccttaattgcagcccaagaggacactgccccattttgttttgttcttttgtcattgggacttaaagtgggtgcctcaagtctttggtaacagttttaacagaacactgacaatgactggatatcagtcagtgttgatctccttcccaagctactgtctgaacactaagatccttttttttttcttttaatgaaaggtaaaatacaattctgctctgtgatttatacttctaccagatttgttttattgacttttcattagtctctcaaagatgatacactgtttttctttgttaaatgtttgggccagtcacggtggctcacgcctacaatcccagcgctttgggaggccaaggccagcggatggcttgaggtcatgagttcgagaccagcctcatagcaaaactctgtgtctactaaaaatacaaaaattagctgggcctcatagtgcagacctgtaatcccagctactcaggaggctgaagcaggaggatcacttgaacctgggagatggaggtctcagtgagctgagattgcgtcactgcactccagcctgggcaacaaaatgagactccatcactgtcaaaaaaaaaaaaaaaagtttgtaggaggaatgattgtttcctattgttggaaaaaaagccaaacggagtgagaatttagagcatgaactttgaatgagtcctatattgtagtttcagccttaccccttacctgtatggccttaggcaagtcactctacctgtccaaatctgtttcatcatctgtaaagtaggggtggtagtaatagttaactctctctcaaatgtgataaaaatattaagtgcttagagcagggttcaccctactggtccttggcctgttaggaaccaggctgcacagcaggaggtgaggggtgggcaggtgagcgagcaagcgaagcttcatctgtatttacagacactccccatggcttgcgttactgcttgagctccattaatccagtggcagcattagattgtcataggagtgcaaatcctgttgtgcactgtgcatgcaaggatctaggtggtgcactccttatgagaatctaatgcctgatgatctgtcactgtctcccatcacccgtagatgggactgtctagttgcaggaaaaaaagctcaggtttcccactgattctgttaatacattatggtgagttttataattatttcattatatattacaatgtaataataatataaagtgcacaataaatgtaatgtgcttgaattaccctgaaaccataccccccaaccctgtccatggaaaaattgtcttccacaaaacccatccctgttgccaaaaacactggggaccactggcttagagtattcaacaaatgttagccaaacagttagcaactgaattttctgaccctgtcagacatgctcctggaatatttggtgtctgaattattggagagtaccaagtgaccttggaaaagtcacttgatctttctgagttccagtaaaatgaagataatacatatacctcccagggttgtttgaggctaaaatgagataatatgaaagcatctatttgataatttgctcaacaaataattatggagtgcattccatgggttataacggtgaacaaaatagacaatggccttggtattcatggcagtaaggcagagcaggaataaatactgattttcaatcagagaagggggagaagtgccacatcgtacaagttacaaattagaatgcagttctccctctgatgaagagagcaggttttattctccacaaaattaatgaagctctctagtcaccaggagttacaagattatgtcactagtaccaagacaactggtagtggttgatgactcactatttataaaccctgagtatgaacttaaggctgtctttctggagcatgggcctgagaattgccagaatgtgctgtctgcccgtggttacccattctgctgactccggtgggaacacatgttaaatgaattctggaatgtatctcgagtgatcagagccctgggtggtaaaccaaaggctctggggcacaagtgttttttgtgttttttttttttgtttgtttgtttgttttaatcccttccagttgaaggtcatgtctggaagaggtatgggaaatgaacagatggttttatacatactatcaaataaaagttagtttttctggaccatgttttatggtattgatatttcaaggttctaaagcacccctgggaagctgttgcctcaactggattagaaatgtgatagattaggggacacttttgaaagataaaggggaagacagcaggagtaggccaggacagccttcacaccctgttgtagttctcacacctgtgaggggagaaagagagaaagaaggaggggctgggtgggaaaagcctcagattgcagcacagttctgagaaagccactgacgggcccatggtgtccccatgccaaagttgcccaagagaagaatccttgcagggcagggatgggccaataatataccctcagtgctaggtcagcagctggggagagggcagggacctggacggaaaatgtggccttaacatgaagacagtggtgggtctgaaggggccagcctccacagctggccatcacattgaaggagagctaaacagcatactgagtggtgcagaccccaatttgaataccatttttgggaactgtggcatatgaaggtagatccttaggaatccaatgtacaaaaacacccacaactagatattctttcagtactgatcacctaggtgccaggtactggggatgcaaccctgagcatgatagaagggccctgcctcatgcagtgtatagtctgcgagggcaggcgcggggcatcaaggaagagcccagcaggtgtatcctactctacacagggtggtcatcacattcctcttaggaggccaggtaacctgagctctgtaggcattaggaaagcaaggacagaggccttgaggcaggaaagagggcccaagtgccagagtgaagggaacactccaggggaccagatggcatgggatgaggtttggagcagagcaggagccaaatgcggcaaggctttgtcagttatggcgaggcttttggactctattttaaatgtgatgggaagagcggcaaatgtcctgagcaagggagcagcgtggtcagatttacattctgtgaagagcactctccctgctgtgcgaggatcatttggaaggtggcgagtgtgtgcggtgggagacagatgaggagtaatctgtaataacagtaatccaagtggaagatgttggagaattggacctgctgatggcttctgtgtatgggatgaaagaaaaaggaatcaaagatgcctctcaggtctctggcttaatcagctggtaaggccatatactgagatgatagagaacatgggagaaggaacagatttgggaggaatgtgctaggaaattaagaactcagttttggatataagtttggaatgcccattagccaagtggcagtgtcaggtgcattgtacttgaaacacagatgtccagaggcatatatgattctgagggaggttaggctggagataatgaattccagagttgccaacatgtagaaagtatttaaagctttaggattgagtgtgatcacttgggaaaggattatagatagaaaactgagggcccaagaccaagccctgaggagcccctacgttcagaggttgagtagaggaataggaggcaagaaaggagagaagaagcaggggaagggtgtttctgggggagcactcagttaaatgaccccaagaggagggcaagcgagatgagagaaaactctcggtaacctgagggcatagtggggacctgagaacatttgcaaatgactggggaggatgcatgccagattagtgggttaaagaaggcatggaagatgggaaggtagaaacagcatgtatagacctctcttttaaaaagttttgttgtgaaaggcaactgagagatggattaattgctggaggcggaagtgatcactggaagggaatcttaaattttcatttatttgttcattcatttaagaaagaagttgttgtaaaaagaacattagcactaataatttttatcccactttgccaggattagactctcaaacaaaaaggaaaaacaaaagctattcccagccacgggagtggagaaagcccaggtcagcagggtttcctcctcagtcaggacgttgagtgactgggagacaggttttccatcagcacatggaaacccttggaggttggacctgggtggtgtcacttagatgtcttctgacctagatcggaggtaatgaatccaaagttcctgtaagaatgctgaatgataacctgacctaaacaaggctagcctttgaggaggtcaataagagaaccattacagtaggaggaagaggacttctcccccctcagtcaatgatggccacagctacagggaagacaaggtcagcagttaggcctcagggacattaagaccaacactgaaacaatgtctgtttctgggttaccgcctcaccatttactgccaattaaagcatcctgactgtggggcagaaaggcttactgggtattaggagcacaaaatgtcaggagctaaaaataaactattgtcatttcttttgtaagggtttcccaaactctcgattgcctcttgcaagcagatgacctgggagcaaatgttatggcagaacgatggactcctagcaagggccgaagcgtgccctgtgaagactggaaagaatatatgcttgtcagagatttggtaacctcatcaagaccttaaactgcagtttaagagggtggaaaaattactcaagtgaaactataagccctgttattcgtaagaaaacgtatgacacagagcaattggagaatctcttaatttgcatgcaaaaataacaggaggaaaaagtaaggaatgttatatctgatttcaagtgtgaatatgaagcaaaggaacttgagatgttaacacctgaaagaaatcaagatttcctagatacccctgaaacacagggctcaggactagaatatggaagccctgagagaacagatagcagaggagcattatatgtccaaaatgtctgaaagtgcacagaaagccagaagcctgcacgaagaggtgggatggagaat

SEQ ID NO: 497 - DNA, 8072 bp, Homo sapiens
aaaagagcaggctgctagaagaggagcctcgacctagagagcagcccagagtccaccaggtggccggagatttgggccaattaagtagggggttggaggtagtagtaggaagacctgaggtcagtcttgccctggcaattcgtgccagcaagtgaagacccaacacttgcatgaggaagggatccaacgaggagctcattaatgggaaatattcaggagcgcggccgaagggtttgcgccattgttggtgagttgttaagacttggaagaaaactgacttcagtaagcttccatttccacccctcgatgtgaggaaataagatcagggctgacaaacagtgatgactaataataccttaagcttgcacagcatactttacagtttacaaaacactcttatttgatcctcacaacagccaagaggcgacaaggtggctattactaattatccctagtttccagacctggaaaactctggctcagaacttgggtgacacgggtaggttaccccgcctttaagtgaccaagccgagacttactgtgccgctctcccccttggaagcctagtgatgtgcctaggtaatgagcaggtaaagtcgctgacgctgggcagcagctagacggcgctgaagctccagtaaggaatttggcattaggacccagcagaagcctggccgcccgccgcggaaaagactattggatttgctctgccgaccacacctcctcccgccccgcctacctgtccgtcttcgcacagcgcagccaattggtggcctccacatccttatacgtcattattctacgcccaggtggctctaggacaccctgtggtgctctgggtcgcagttgtcctcagagttgcctgattggaaaaatctccagggcgagggatcagtctcgaggctgccggttcccctggccctcagggatggagccaaggtcccagggcgggttttctttcctaggaagtggttgctgggttctgaggagtttcccccttggcagccatgagccggcagttctggtagtgactgctgggccctgctggacagcggtcgcatgcagctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagatgtgagcgaccccgggggcgggccgacagtctctccccagcctgtgacagggatcccgggccttctgcctctggacccgggctttcctcttgtcctcctgcccggctgtcgccctcttagcaccctactacttttgcagctatggctgagcctacccagaattccagaactccaggattattttctggattcttcggacttggttattttcttttcttagctgtttttccccgcttggttctaagggcctgcgttttacaggctgagacttctattcctcaaacaggacccgagtcggcccccttttggtactcccagatgcttgcaaacaacctattcgtcctcggccttggtgccatagccgaaataccgtctcctcctgcctggggtacctgatttcactatctcgttctgcatgtttcctctccgtctttttcgggtattcttttcttaggctttggaatcagtaggctgggatgtctagtttctagatccagtaaaatcagccccttttgcaaatgagcctagtggtccttaacaaactctgcctacatccagagaggcaagataattttaaagttttcagtggctcgggatatattagatgacagtgagtgaaatacactaatttctccctcttttctcatgcatttcatttctagaacaagaggaaagtatggggaaggagccaagcaggagacgttcacctttgccttaactttggtcttcattcaatgtgtgatcaatgctgtgtttgccaagatctgtgagtacccagatagtaatttgttgggtaccccaccaccccaagttccctcagtatgctgggcattaagcattgattcaaccttaaaggctaactcatgatctccaccccattttgtacttacacagcctctctgtgaagtctgtaaaactaatgactttgaagtggagtaaaatattatttccccaatttttatcagcttctgagttagaaatgttcagagaatgggtcttctatattccaaatccccattgaaaatacttaaaacatttttttctttccctttgagtttcttttgtgtgtcagcttcaagcatgctttgagcattctctctttgttccctggggactagcagcagagctgactggtcccttgaactgaatgaggcccccacctccaccctgcatgtggtcttttgttgggcttaggtagaattggaaagatgaataattttcagagatttcccagtgtaacaggacagaaatagcttgtgtcttgtttgacagacaagttcctttcatgtggcttcagctttgcttagtggtccatcctagccccaccaggtttctcttgtttttttttttttttcttttcttttctttttttttttttttttttgtcttctcccagtgatccagttttttgacactgccagggtggatcgtacccggagctggctctatgctgcctgttctatctcctatctgggtgccatggtctccagcaattcagcactacagtttgtcaactacccaactcaggtgaaacctcagggtgggatgatggttggctcagatatcatttgaaaaggactaagagttcttccctcaggtctgtgagttaaaaaaaaaaaaaaaaaaaagataacggtcctgtaagacattgggagtgtatagaaccatagaacttacgtttagtggtggtgggttgggccatgatagggctgctttctgaggctgaggtctctggtgcaggccctgtgcttactcatcttaatcagtgcggtacctagcatagtacctgacacatcacagatgctcagaaattatttgctggatttaatttcaggtccttggtaaatcctgcaagccaatcccaggtaagcaaagaagatggtcttcctcttctgtcgtcactcttcctatagtaagctctctctctgctacaactgtgtccctctcggcttcatcatcccatcatggctgtctccagggactttcccccagctctccctgctgcccatcctgtcatctgtgtcacttcttgtgatgttcataggctggtaatccttaataggagctaaaggctgacctagcctgcttcacttggtcagccatttctgtgttgcatgtgtttatattgtcattagacaacttaattcccattttgatcatcagtttctttatctcaacttcttttccttctccactgttccctacccttgtcctgtcccttcctggacttttcacctttgttctctacctcctccctgtcttatacttaaccctgttgctcaatccttatctaggtgccagcctggcaccctccttttgtcctctctaagccttccttctcagtcattcttttctccctgagtcttttcttggttcctgggagggagggcattggggtcatcaataccttatggatgcctgaattttccactctgttttttccctgtagtcatgctccttggggtgaccctcttgaagaagaagtacccgttggccaagtacctgtgtgtgctgttaattgtggctggagtggcccttttcatgtacaaacccaagaaagttgttgggatagaagaacacacagtcggctatggagagctactcttggtatgagatcctgttggggaaggcacccttttccagcaaacttaaccaaaggatagtctcacctaggcaggtagaaggccagttctgtgtcaagggaggttgtggtgctccttgtccccatatctgctctttgctgcaggcccctgactctattaatgccatagtgggaaacctgaaatatttaactacaactcagctctcattctggagaagagataactctgagggttgtggctgaatcctggtgtgaggtcacagagacctgagagcaaagagggaaggaataatgtctctcactgtggctttccaagaaacctggaagccagagtttaaaataatatgatagtagctggtatgtatgcattaggcactgttccgagtgttttacatgttaattgactaatttttacaacaataatctcatatgtagtattatctccattttacagatgaagaaactaggcacagagaagttaactcgcttgcccatggtcacttggctatttgaagtggtagagtcaggattccaatccaggcagcctaagcacaggatccggtctctggagcactatactccaagctaggaagctaacctgctgggactacctttcccctcccagtatgttgggaagtgagcttcctgctctactctgattacaaaatcactacgtagctcagttagcctgtcagtccagtgcgtgggccggggggcgggggtggggggtagtgagcatggtctctccccaccttccacctgtgaccaaatggcaacgttttgttctgaggactttaaaggcagtggctttccaaggagcctgagagtgagaatcctgtgtcctgggtttggaaagggccctgttggccacttcactgcaggctgcaccctttctttcccagctattatcgctgaccctggatggactgactggtgtttcccaggaccacatgcgggctcattaccaaacaggctccaaccacatgatgctgaacatcaacctttggtcgacattgctgctgggaatgggtgagagccagttctgctgttcttcccatgtatcaccagagggcaggctgccctcatccttttgatccctctagctgttagttgcccagaccaagggcctgaattagttccaagatgcccttttgttcaagcccttgagaaaccttcctggaaaaacctgcaccagcaggatttgtttgctacttgttactggcacaatgaaggagagtcgtgtgtcagttgtcatgggaagacactcagtagtaaaacacagggaggtacctgggaactttccctttcatgagggaaatgagacacacgtagtgctcacaggaaacagagttagctgtacactgaagacagttcaaatgtgaatgatttgctttgaaatcagtgcttcctaacttttcaaatttgggcacatgtagaaagtattttttatacagcacactggggttaatggtggaggctgctgatggctgaaggtgactaatgcgaggggcttccttgagctaaggatgtgtgggtcagcatctctacagcatctgaggatttctgcttgtaatcactttggtagaagtaactcattaactttcaagcctttctcacaaaattctctttagtttctctaatcagagaaaaatatgagaagaatcaatgatgagacgatgcaaacccacaccatacactttcccgcgtcccacctcccttgcagttctttaacaggccatgtgcaggagtgtctgtgtgtgtgtgtgtgtgtgtgtgtgtgcgcacattttgtgtgcacaaaatgcgccgtacatttgttgacatgtcttctcaggaatcctgttcactggggagctctgggagttcttgagctttgctgaaaggtaccctgccatcatctataacatcctgctctttgggctgaccagtgccctgggtcaggtgagtgcttgaaaggggatggcttggcttccctactctggcagctggttccctaagaaagactggcctggctggaagaagagggtggcaagattagccctgaggtctgtttatagactttagaccaatggcagatacccagaagcccaccggacctcacctttatctttctctagagcttcatctttatgacggttgtgtattttggtcccctgacctgctccatcatcactacaactcgaaagttcttcacaattttggcctctgtgatcctcttcgccaatcccatcagccccatgcagtgggtgggcactgtgcttgtgttcctgggtaagtggccacacagagacacagtgacagctgaattttttctcctaaaatttacttgtatatttatgaaatttgtttaaatattttagagaaaacttttctcttttttttgagacggagtttcgctcttgttgcccaggctggagtgagtgcagtggtacgatctcagctcaccaatcgggtgagcctcctcctcctcctgggttcaagcaattctcctgcctcagcatccggagtagctaggattacaggcatgcaccaccatgcccggatgattttgtatttttagtagagatggggtttctccgtgttggtcaggctggtctcgaactcccaacctcaggtgattccccccgcctcagcctcccagagtgctgggattacaggcatgagccaccgcgctcagcccagagaaaacttttttaaaagagaaaagaggctgagtgtggtggctcacgcctgtaattctaacactttgggaggctgaggcaggagtatcgcttgagtttaggagttcgagaccagcctgggcaacatgatgagacccttgtctctgcaaaaaaatacaaaaattagctgagcatggtggcagacgcctgtggtcccagctactcggggctgaggtgggaggatcgtttgagcccaggaggtggaggctgaggtgagctgtgatcacaccactgcactcccacctgggtgacagagtgaaaatctgtatccaaagaaaataaaaggagaaaaggaagctttatttctaatccagccttcctagggtctccctctgttgctcaggctggagtgtagtggcatgatcatagtccactgcaaccttgatctcctggactcaagtgatccacccaccacagcctcccgagtagttgcgattataggcatgtaccacaatacctgaccaatttttttttttttttttgtagcgatggggtcttgctgtgttgcctaggctggccttaaactcctgggctcaaatgatcctcctgcctcagtctcccaaaatgctgggattgcaggtgtgagtcaccacattcagccatagcctagaagttttgactcttaaatttcttttagtcttgctgtattatatatgtatctatatctatctgtatctctatatagatatatttatatagatacagatatctgtaataactagtatcctggtgccattctcttgtctctgaggaagttacataaaaccagtgttctgacatgtattttatttaaagcccccattttggagatacaaggccgactaccccaccccaccacaatcattggtaagtttcatttccccccataaggctaagcccattttcttccttttcataggtcttggtcttgatgccaagtttgggaaaggagctaagaagacatcccactaggaagagagagactacctccacatcaagaatatttaagttattatctcaaacagtgacatctcttgggaaaatggacttaataggaatatgggactgagttccagtcttttttaataaaataaaatcaagcaaaatcacatattctaaaaaatgcacttggattttaacaagacagagtggtggtttttgttcttcatgccctggagcagtctatggtaaataaaagagggagggaagaggcagagctggatgttcattacccaggctgctcctctcacgggtgtggttagcatggttgagtgggcgattcctccaagaacctgaggattatagggaggaactctgtgagatcgcagaattgtgctaatggcttctgttccgatgggtgaggcttgtcccgttagagctggtcccattagaggacgggtggctgtccattagagccagagaatgtaaaagtcacttcctctcctaaagctcctgtgggcaaatatttcattaaaaaaacaaagttg

SEQ ID NO: 498 - DNA, 38059 bp, Homo sapiens
gacgcgcgcgatttaaaaccagctcaggagacgccaaggaaagatgggacctcccggcccaggtgagccgggcggtcgggaggcgcggcgggaagggcccctagcgaagcagtacttcgggcgggcagggctggcgggctggcctgggcggggagagaggatatgctcagctcgggtcttggccctgcggctgacagcagaggccggtgcggggggaggggagggccggcgcggggcgggcggaccttgtgcgctcagccaatcagaaagcggcttcggccggagtcggagagcgcgcgggccctgcctcacactcctcagttcccgggcgggcggtggggcggcctcctccttgggctcctaaagcgtgctcggtgtctctccattaaaatggtggttttcctggaatagacgttattttcagggctttggaagcgatgtggttaccgttgtatgcttagcatgcatgcatttatttttgcatctattcaaaagtactgagctctcccgttgggcgaacaaaattgataatatctctatactgttggagttggggagacagacagtaaacaaaagaaataattacacatgaggctgagtgctgtgattgagtatagcagagtaggggtggctccgccaggggttcagggaagatctttaggcagatactagggaacgtgtttcaggcagaaggagcaagtacaaaaatgaggcagggaagagcctggcctggcctaggacctgaccagaacattgtgaccaagcttagtgaggcctgacacgtaggcagggtctggaggccttgggtaagagatttggaaattgagttacattttggacatggtatgtgtgacttacgggagagactcaggtgaagggatctataatcacttaggtgagaatttggctctcaggggagttatatggaccactcagggaagtgacccatggattgagaaataaatttggataccattatcatatagaccattagaccataaaaccatgggaacaggtgagaacactaggaaggccctgcacatctaggaccaacgtttagaagctggatagagaaggatgagctggaaaaactcaaaagacagtggtataggaagaagccaagagtgtttcaacaaggaagggactgtcagctgtttcaaatgctgctggattccaagagaaaggccagaaaatgaccatagggtttaggcaacatggaagttatagatgatcacgaaaagatagttctcatgaagttggaataggaaccagaccagagtgggttgaaaaatgagtgggaaatgaggaagtagacataggaagtgtctttgagctcagtaaccatcggttgaatgaatggatgcataatatcaaaggcaaggagagaaaccacggaaagaagatttggagaattaaagcatgcctctaattccaagtttagtttctctcttagacaaggttctccttaagtgcttcctatttctgttaaggtatcctctccaaaggtccaggttccttccttagcctgtagcctactgtgctcacatccaaatactgtcctcataagtcctcttgattcagtttctaaaaatgtctcttgcctcctcccttcctatttttactttgttgttttttgttttttgttttttttgagacggagtctcgctctatcgcccaggctggagtgcagtggtgcaatctcggcccactgcaagctccgcctcctgggttcacgctattctcctgcctcagcctcccgagtagctgggactacaggctcctgccaccacgcccagctaattttttgtattttagtaggaacggggtttcaccgtgttagtcagggtggtctcgatctcctgaccttgtgatctgcccgcctcagcctcccaaagtgctgggattacaggcatgagccaccgcgcccggcctattattttttagagacagggtcttgctgtgttgcccaggctggagtgcgtggctattgacaggtgctgtcctagctcacggcagccttgctgagcgcaagcaggctcagcttcctgagtagctggaaccacagatgcctggcaaagtaccccacttctcaataccacctatatctttctaattcactctctggttccctgactccaacaaccctttttttttttctgagacagagtcttgctctgtcccccaggctggagtgcagtggcttgatcttggctcactgcaacctctgcctcccaggctcaagcaattctcctgcctcagcctaccgagtagctgggattacagacatgcgccactacaccttgctaatttttgtatttttagtagagacgggattttgccttgttggccaggctggtctcgaactcctgacctcaagtgatcctcccaccttggcctccaaagtgctaggattacaggcatgagcccagccttgtttttacttcctattttattgaaaaaaaaaaaaaaaaaaaaaagcaaacaaaaaggaacatccccaagtctgccattgcacctgctccctgcctgcatctgtgccagtgcctctgtcttttctcctgttactgaggatgggctttctgtgctctctacaaaggcaacctctttgcctgcttgagtacattgttcagcaaattttaccttttattttggatggtcactgtgataggctgaataacacttgccctaaaggtgtccagaacctgtgaatatgttatcttacgtggtgaaagagactttgctcatgtgattaagttaaggctgttgagaagactatcatggatcatctgggtgggcccagtttaatcacagtggtccttgtaagaggaaggtcgtcggggtagagtgagagcagatgtgatgacagaacaagaggttagagtgatggggggacagtgagccaaggaatgtaggcagctctgaagctgcaaaaggcgaggaacagatcctcctctcaaagcctccagaatgaatgtaaccctccacagctgcaagagaacacataaacgtgtgggggtttttttgtttttgtttttgttttttgagacggagtctcactttgtcacccaggctgtagtgcagtggcgcgatctcgactcacagcaagctccacctcttgggttcatgccattcttctgtctcagcctcccaagtagctgggactacaggcacccgccactgcgcccggctcatttttttgtatttttagtagaggtggggtttcaccgtgttggccaggatggtctggatctcctgacctcatgatctgctcgcctcggcctcccaaagtgctgggattacaggtgtgaaccaccgcgcccagccacatgtgtgtttaaaccgctaggtttgtggtcatttgtgacagcagccatagaaaactaatacagtctctttgcttcattctttctaccatgctgaggtttttgtttgtttgttttgtttttttgtcttaaaaattcctcacttccctttcaactctcaccctctcatttctctccacccttttacagtagaagtctttgggcagggcgtggtggctcacgcctgtaattccagcactctgggaatccaagacaggcagatcacgaggtcaggagttcgagaccagcctggctaacactgtgaaaccccgtctctactaaaaatacaaaaaagtagctgggcgtggtggcgggcgcctgtagtcccagctactcaggaggctgaggcaggagaattgcttgaacctgggaggcggagttgcaatgagctgagatcccgtcactgcactccagcctgggggacaaagcaagactctgtctcaaaaaaaaaaaaaaaaaaagagaagtccttgaacaccttgtcatcgtttgctgtctccagtttctcttctcccatcttcacttgaaccactccagttcagctttctcccttactactctaggaaaactgtttttgtcaagatcactagtaaccctaggttctaaatccaatgatcagttctcagtcctcatctacatagtttatcacatcctcctcccctaaaaatactttcttcacctggcttttagaatgccacattctcctgattttctcccacctcactagttgcacatttcccagctcttttgctggtttctccttctttatttttacttatttatttattttttgtgacagagtctcactctgttgccccggctagagtgtagtggcgccatctcggctcactacagcctccgtctcccgggttcaagcgattttcctgcctcagcctcccaagtagctgagattacaggcgcccaccaccacgttcagctaatttttgtatttttagtagagacagggtttcaccatgttgaccgggctggtctcgaactcctgacctcatgtgatctgcctgcctcagcctcccaaagtgctttcctgctctttaaacctttaaagtgttcctctactcagttatttggtgatctcatccagtattatggctctgaataccctctacatgctgatgacttcccagtgtgtgtatctcatctggaactttccctaaattctgggattagatacccacctatctaacccagtaggatgactaatactaataagcatcttttttttttttttttttttttttgagacggagtttcactcttgttgcctgggttggagtgcaatggcacagtcttggctcagtgcaacctctgtctcccgggttcaagcgattatcttgcctcagcctcctgagtagctgggattacaggcgcccgcccccacgtccagctaacttttgtatttttagtggagacggggtttcaccatattggccagctggtctctaactcctgacctcaggtgatccacccacctcggcctcccaaagtgttgggattacaggcatgagccaccgtgcccggtagcccaggctgtttcttaactcctggcctcaagggatcctcccacctcagccacccaaagggtaggattacagggatgagctaccatgtccggccttttttttttttttttttggttgttatcttttaagttaagagactaagctagttttcttgaaaactgtcctgcattctagagtgtttccttgtgatatcatttaacttgttccttgaccccttgtatttcttataaaccagaagttaaagatctaaagttctttggttaaatttaggttaaacatgtttggtggaaatatttcctgggtgatgctatgaatttcacattgtgtcacatgaagagatgagtaactttcagattgatttttagtgaggctacatttgactggttaatgtggtgactggtagagtttttattgtaaaagacatttttccttttgtagttagcaaataatctggatgattctttggaacattctatttgttttacatgtttatgttgtttttcctctgtctgtttgccaagatatggaggagctggaattagagcccagcctgtctaactctatagcccatacctcacccttgtctcagcatctgtctcttccttgtcttacctggcatgatgggttatatatgtctgttgtccagtttgtgagcttatcagaggcagcaatattatatcatccatttttatatccatgcagtacttaaattcacatagctgcagagtggatatttgtcccagattaacaaagaagcatcagaaacctatggcctcccccctgcacctccaagaaacccaaactctagaggttctagccattaagtattagagttggagaagatctcagtggacagtgtgtggtgaacctccacccctgtgacaggctcaagacttctttggatataggaaatgttctcttgaaggtttcttgagcaagaattttgttccagcactgccagccacaatgaataactcttcttcagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggtgaggtgctcctgggctgtttctccttgaggcagccgccttgatatgggctgcgtaggtccaggcatctccacaaaacttcatgggtctaggttttgaaaatttaaactatcatggattcttgccagagttgtttgtttttgttttccatttaggagtattgacatttcagctactatccccaagtttacaaacacgcagattacggaacattactccacctgtatcaaactgtccactgaaaatgtgagtatttgctggtttattattgaagacgtaatcccttgatcacaggggaaatccagctatcttgtttctgtagataatgcacaatcaatgatgataattctctggtgagtcatcttagtgctggtggttttactgtttactctggacccgtggtgcacctcctgagaggctgccagctatctgctgtgtatctagaaaggcagcatggcgcatgagttaatagtagagttctggagctagcctgagttggaggctacatgcttctaagctgtgtgtgagccacccaaccattttgcttccgtgtcctctggagaatgggggtagtgcctgcctcatgaagttgtttggagggtgagtccctttgtgtgcagtgcttagagcagggcctgcacacactgagcattcaggaattttgtgccgtcattccctagccttgaacatgaggacatgcctgtgaggatttggctcttgacaagtgtttttgggaagagagatcagtgacaatatgtgggtattcctatgtaaagacttagcttcctctgttaaaagcagcattatttacatgagcctaggctataaataacaatcctttctgcaattttctgttttcagaaaatcactaccaagaatgcttttggtttgcacttgattgattttatgtcagagattcttaaacagaaagacaccgaaccaaccaactttaaagtaagaaggatgtccactttctcttgcatctgaattaaatgatgatgatttctactacttggcataacacagttgaatgctgcaaatacatgagagacttctcatttagatgttatgttagttaatttactttcttttcctaaactgatgaaatacagagagaatatatattctgtttattccctatcagtcatagagggatctttgtcattgcttccttggggcaagtaaatattttgtgaagcttgctgtgttttacctgttcagaagttgttttttgtgtatctttgtgagtgcagctctgattgtttgactaggtggctgcgggtactctggatgccagcaccaagatctatgctgtgcgcgtggatgccgtccatgccgatgtatacagagtccttggggggctgggcaaagatgcaccgtctttggaagaagtagaaggccatgttgctggtaggtgggtagggatctggatttaagtggctctttttagggcataccaggtagttacttgagtaatatactagaagaaggtcacaagaaataagtgatctcattttattgaagacagggcatttttagaaccatatatggtcttacgtgagaagatactcaaacactaaaattatatttccttgaaaaagagaagggccttataaaagcgtttatattttatttaggccaggttgtgtaaacatcaccaactaaggaacttctgatctgggagtctttggaaatggacttgcgtgagaagccaaatctaatagtttggtttctccataagttgcagattaaatatgcctgatgttttgagagaactgcgtgttttttgtttggttggggttggagttttgttttttttttttttgaaacgaggctcactttgtcacccaggctggtatgcagtggtgtgatctgggctcacggcagcctctggctcccaagttcaagtgatcctcctgcctcaccaccccaagtagctgggactacaggtgtgcatctccatgtctggctaatttttgtactgttttgtagagacggggttttgtcatgttggccaggctggtcttgaactcctgagctcaagtgatccgtctgcctcagcctcccaaagcgctaggattacaggcatgagccaccacacctggcctcacatgtttaaattacgacaggttttgaagaacttgagttagtaagttcatcacatgcttcaaagcagcccttgcagtacgcaattgtatttctccttttagatggaagtgctactgaaatgggaacaaccaaaaaggctgtaaagccaaagaagaagcacttacacagaactattgagcagaacataaacaacctcaatgtctccgaagcagatcggaagtgtgaggtgaggaactgtatgcgcagtgtggtttctgactaattcagaaccttaggggctgagacttggcagggctaaggctgccttgctggtatgtgcctgtttaagcctcaagggagtaaaatattcaactgatatctctgcattatcatcttttagcttgacagtaaagactaaaagtaagtccctcagtgtttcagaatgattcaaaaggaagagactgcaaattgctgagaaatctaattgataaaaaattaattttatttcctagtaaatgtagcagtggttatgttagctaacatttaatgtacacatagtgagcaccatgtgcttccttaagcctgtaacctgtattaactcatttaatcctcacaacattcttgtatcattttaggaagaggtaactgaggcacaatgacttgcctgaaacgacacatctagtaagtgagctagaagttgaagctaagtggtctaactccagaatcctagctttaaatcatctatctagcaaatcctaaggaatcggcttaaacaaatggtactggaggcctcatctataattagcacagttaatttaaagcaaacaggtgttactacaattttattttttaattctgccattaaaaacattgtttcagtgaacattctaatacatattatctttgcactcgtatgggagaatatctgtaagaaaattctgagacatggattttaagttgccctcaaaaaaaggtactaatttactctcccactagcagtagactagattacttttctctcttacctccacaacattcataaatggtaattaaggtcacaaaactagaattggtcaccaaggaaatgaatgtatatgggaaaaagactgggagttccttttccccaatcttaggagttcagagagctgaaaaaacatccagtaggtaggaggaaaaccagaagagcgtggtatccaaatgagaaaatatttcagggagtggggaatgatcaaccatgccaaatgtggcaacctgaggccactaatgagcttggagtgggggcccctctgaaactcaagctcagacctccagggaagggcttggctggtgctagtgtccctgagtttgagggaggggattgtgtgcccaggacccagaccctggaacgggggcatgctggctggtgctggtgtctcaataaggctggttctgtgagtgtgaaaatctgccagtggggttcagctgctgctacaggtgggctctgctgcagccggggtggaacactgctgggtgacgctctcctaacatgcaacctgcagaaaggagcagtgccttctctcccttggagcctgtagtctccctctagtgcccctacttggtaaaccctaacagggagctgccggcaaagctgaatgtcccagaccctgcatcacagccaaggagagagggtaggcttagagctgagaggcagtagcttagtaactgggacatggtgaagtgtcatgaggattactgacaaaagactctggggtggggagagagatatatatagagagagtaaatgaaaacaaatatgcaaaatgctacccattgggtaatctgagtagaagctttacagagattcgtattactgtttcaacattcttgtggatctgaaattttttttatgataaatgggaggaaaggactgaaaacacttgaatataggtagttgttttgaagagttttgctataatttggagcagagtactgggatagcaaatggagggaaaagtaaggccaagagttttgattttgtttttgaatgggagaaatgacagcatattttgttgatgacagcagtctagtttggagaagggattattgatgatgcagcagaaaggagaattgccaggctgatgtccttgcgcaggtgagaggtagggaatggacagcacaggttgggctcggctgacgggtgttgtttgggtgcactcatgggggagccttctggatactgtcttaaaacaggaagccaggtcatcagcttacagtgaggatagggaaggaaggcactgggggcgtgaggaggggaaagggtaggaaagagtcctctaggaggtgggcgagtacatgaactagggagatatggtgtgactgttagacaacttagggtctacttgagggtggtggcagatggatataaagtgaggtcagtcagcattattttgtgtctctgtccagccgtgaatagctgtgtgggtacaatcatggagtaggcagaaagttgggtttaatatgggatcctgttgagctgagtgaatggacacagctggaaagggacactggaggaggtgagtgcatgtgtaaaggtgtggttgcattcactgcttagggaattttacctcggaagacaggggaatgagggcagtggaaagtaatataatcagtagattgtaggcctggtggggtcaaagacttcgtggtgttggggacaagaaggggtgagctggaaatgtaggaggtggttgccagagaggggccctagaattgaggatatagagaggttgcagtcatggttaatgagtcaactcagagcaggcaagggagcaaatggcggaggcggggtaggggtcttactaggctgtcttggtgtcttacttggctgtcttggagtcctgggtttcttaggatggagaccattgaaggagaggatatcaaccaagagacagtgtactggatggatcaacatatggatattgaaatcaataagagctacaccaggaataaatttggagactagtaatgagccataaactaatactaagatcttctgagaagaaggacaggttgtgacctggggattggaagatgactgcaacacagatgggcagacagtggcaaaagctgatgttgtactcagagctggggcattagaaattgggaggggggatagttggatgctgcaatcacctggcccacctgtaggccactggtttgacggctgtgaagagaaagcagccactgcagaggcccgcaggggaagcctatcctcaggctggcaccatgtctcaattggagcagtgcccctcagcctgttttttttttttttttatcacttttgccccttcagacccatttagacattttgtgcctactccttccccttaaaatgaaatactaaggaataagattttgtcagatagggtagagatttggataggcaaacattattgtaatatctaagatttttcccacctagcctctaggaaacagttttcaccccttgagagtgaaatgagaacaccattgagaatacataaattagaacaagtaggtggagataatcctcaggaactaagtgggcgatagagagaattttgctgatgactgagtctagagggccctgaggaaataccagtttttgaggaggagtgggagatgggggctgtggtggggtgggaggtggcatcagagttctatagatcttagagtccaagaaatgtagaattgtgggtgtcttgggtctttttgtgtaattaataaataagccagataaagggcaacagtgagatgaatgccagtgttcttacagcagatggtagtggtaagactgagtgtgcaaggggctagggaggtggggccttgccatgcccactctgagtggtgaggtgagcagggcattgctgtgcacgggcagggaggggccagaggaaggagagtcactgagaatgaggcctaagagggaggggagaggcgagagcagctggctcttgtggggagagggagttgtattttttccttatgtgtgtgtcagcattaaccgtgggtgatgtgtgtagcatatcaccatgtttaaagaccttgacgtaggccgggtgcggtgcttagctgttgacctgggaagagttgtgaatctcactgtcatatactataaaaaatggggaacgctggccccaaccacatctcggttttatattagtgaatccatttatgccaaggtctctctctttttttttttttttttgagatggagtcttgctccgtcgcccaggctggagtgcagtggcgctatctcagctcactgcaagctccacctcccgggttcacgccattctcctgcctcagcctccagagtagctgggactacaggcacccgccaccatgcccggctaattttttgtatttttaggagagacggggtttcaccgtgttagccaggatggtcttgatcttctgaccttgtgatccgccgcccgcctcggcctcccaaagtgctgggattacaggtgtgagtcaccgcacctggcctatgtcaaggtctttaaacatggtgatatgctacacacatctgaagtggtattatttattagtcatagggatccagaaagccctttctacgttcccttccctcccccaattctccttgttttttccccttcccagataatctggaatttatcttactgtcattattattattatttttttttgagacagggtctcgctctgtggcccaggctggagtgcagtggcacgatgttggctcaccgcaacctctgtctccccggttcaaacgattctcgtgcctcagcctcccatgtagctgggacgcaccaccacgcccagctaaatttttttgtatttttagtagagatggggtttcaccatggtgaccaggctagtctcgaactcctgatctcaagtgatctacccactggggctcccaaagtgctgggattacagacgcgagccaccgctcctggcccttactgtcattcttgcttttgattctatagtgaaatgttcaaatcaatcggattattaagtacaggatgtttggaaattctgttttgtagtcatcttctttcttaccaggtaatctcaattctgggagcctgaggaaaacggactatttcccaggcctgcattagcttttcccatgattataaagagaaaaggagagagcagcaagtagggctgatttcgctaagcctgatattgacaggctgtggtatgtttatgctaagtgaaatgaatactgtcatgaagaaatgccaaatactccaatcctggaaagctttttttgctctgtaagttgctgtaaacttgtaatcatcaagagtatggaagataaaaaagagggatggattgtcacaaacagaatttaaagcttcaactgtttattaaactctcattttcttttcttttttttttttaagatggagtctcactctgttgcccaggctggattgcaatggttcagtcttggctcactgcaacctccacctcctgggttcaagcaattctcctgcttcagccacccaagtagctgggattacagacgtgcaccaccatgcctggctaatttttttatttttagtagagatgggattttgccatgttggccatgctggtctcaaactcctgacctcaagtgatctgcctgcctcggcctcccagtacacttgggattacaggtgtaaactctcattttcttggagatcagaaagcaaatgtgtgggtgtgtctagaccagttgagagcacttctttatatatgagccgatctcttttggacacagctctttggtatttgcagaacatttgctgtcatagaggattcaaacatgattatgcttcagttctttataccaggagaatacaggtagatgaatgcaaggaaggtcaaggcacatgctataggaaaccagagttggtagggctcagagtttatggaagaagcaagacttgaactgggccatgaaggaaggctaggtgtcttgtcaggtaggcattgccagggaggtgattctaagcagaggtgtaaaagcaaaagccatagcacaggaaggttctgattaggaagctggagagtatacgagtttggctagcgccaaggatttgcttttagaaatcacctaaagagatcttgaactttatcattcagtctattgtaaggccttttattgtggtccttccttactgtggacccttgtttcagaaggtttcatctactcaaactacacagtcagccataattcattgtcccattgaattgcttggggatataaatccctctgttgtcacacatgatataattctagacacaagtgaggaacattatcatagtgctttcagctttaatgtgggtcagtgtacaatttccatgttggctctgaagtgctgagtatagttccgttaactacctacacaagacttttaggggtgcagggctccaggtgggaaaccattactctggatagcatttgagaatggaataggagtaacctatttttaggtatttttaggatggggaaaaaaaataggtatttttaggatgggaattgggagaggccagagataagggtcatattgctggctctggggatggaaagatgcactgggaggaaaccgacttggacgtgtggctgcctgagggctaaagggatgggagaatgtggagatgacgaatgtgctgctctgggacaaagaatggtgagatgggtttatggtacggcaggagctgaacctcagttctgatgagcttggactccgagctaaggggaccagggaagagccagggaggcacatctgtgttgtcctatccaagcccctctctctccatagtagccacgttctgaggcatcaggaagacctgtgaaccccatacccaaccgtatctcctgtctcaaggtcacctgcagagtcccagggggcttctagcctcttgctgcacatgtgtgtgattcaccctgtccctgttcttatgcccagtgcctgtttttgcctttgggcttggtgtcatatggccatgccattcctgctcctgacccagccttagggaccttcttaaaacctctctcaggtttcacccagccagctagccctactgactctgtcctttgcctggatatcttgggtatgttcttccaaactttagaagatatttctgttcagaggaacaatagagccctgtgactagccctatcatacaggctttttaagccaatggcatttgttagtgacttatagaaggagaccagcagcaaggatacacgtccagatgtattataaaaaagccatttgacacagtgtacacttgccaccacatactgtcttctggagcagtatatgtttatctcctgactataaccagcctttcttttgaaccgggattttatctgctcaattagaaagccacttttgttgggtgcggtggttcacaactgtagtcccagtactttgggaggccaaggtgggtggatcacttaaggtcaggagttcaagaccagcctggctaatatgatgaaaccccgtctctactaaaaatacaaaaattagccagatgtagtggtgcgtacctgtagtcccactactctggaggctgaggcccaagaatcgcttgagcctgggaggcagaggttgcagtgagccaatatcatgccactgcactccagcctgggcggcagagcaagactccatctcaaaaaaaaaaaaaaaaaacaaaaacaaaccacttttgaccatgagtggagatatttcagtccagtgtatatacctgctaatgagtggggccaaatgcatgagaatttatctttcccttggctacatgccgtaaatcttcagtttcttctctctctgtgttcagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaaggtaagtacaagtgatgcctttcaccagagcatttcagtcattggggaatttttttacataaccatggggtacaataagcccatcatgctcttatgttgcttaaattacccagaagtttcctctggaatgccaaattgtgtatccttttgggagtgccttgcaacccactaacttttgtcttctctgcggcgtggagtctaaaacggtaaaccatcgcctcttggtcttgatgtgcccggtaccttaggtgcccactgtttgcagtcagctctccaagtcacatttgggagacctgggttcctcctggagtgtcagtttgttcttgggaaggggacttagagagacctttgcctagccagagaggctttgtttttatttgctccccatccagggggccctgaggagaagagagcgttgtgaattgttttgagactcctctgcagcagtctaagaactgatctctcctattatcagtcccctatactggcttgacagagattttagcatccctcccatatacgcctccacgcctgagttgggggttctccttgggatgttgtaatgaggtgccagcaggtagggaggccaggtgcgtgcagtgcagtagctacacttggggtcccagaagagctgccccctcctgcacatttccaatgcagtgttcgtactctcgctgatcttcatctcaagtgcggtcatttttatgtgttgaatgaaattaatacttcccctccaggctgggcagttgttagctcccattcttgtcatttctattcttgcctcaattttgtttagtatagtttttgtgctaacgatctattttccaagtttgtgctctcatttggggctctaatcccctgaagtaagtcttctctagtttgggactaaaaataagttaaagtaccattacatgattgcctatgtacttggtgtatttttaagacgaagcgtttgatttcccagctatagcataggtcacagaattcatttcagaatcgaatgtctgtgctttaggtttctcctctagtattttactaatttgtgcgatgacagtgcatagcctcactccagcgtgggtgtggccgacgcatctgctcgctcccagaagaggcagggacacagactggcagctagccagccactgatgatacttgagcctttgctggaggacagtgaggtaactgtgcctctcatctctcgtcccactcagtatcattctgaagggagtaaggaatgcacttgacccccttctaatctctctttgtgatcttgctatcctctccagcgcccttgcagcagtgtgcagaagatcgccagatctgcccttccctggccgggttccagtttacacagtgggacagtgaaacacataatgaggtgtggtcaagttttagtggctcatggtttcagttagttggctcaagagtggtcctgcccaatgggaaccaaaactgtggcatcatctttatttagccaggagtacagaaaatatttcctttggcacttctgtagggacaaaaaccctgagggaggagggtagggttgtgaaccccagcaggactattctagaggtaagtgagttccaggatcagctttatgtcctctcttctgctatcctagggtaaggcggccctggcattaatcagtgaacatttataattagatttactcttgaatgtggttatcccagtggcctcgaatctcttaggctgccgtcaagcttgaggaatttcctgctctttggggttgaatcccttggcacagagtttcctgagaaattgtcatgtgtagagctttcctctgtgtatttttagcatggccccctttagcctacttactacaatttccaaaataaatgatctccatggaaaactgttttctgcaaacatgtagttaatgggtacagaatcctgtttcatgttttacaaaatgtgcctgacaacaatgcagcttcctcctgtgctgcacaatataaacttccccctcactgtactatcgtgagagtcttggcccaggcaggcaggggatgggaaagggaagggtggctcaggggaaggaggaggctggaaactgaaatttaagggtgagaaggctgtccctccagtggtgatttggggtggttataggaatgagaattacagaaccctcttttgtccctccagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccagtaaggctctcagagtccgaaagtgtttctataggagttttccattggttcttttttctttttcttttttttctaattaaaaaatttttctttctttttttttccccccccaaaaatagagacgggcatctcactgcattgcccaggctggtcttgaactcttggggctcaagcaatcctcctgctttggcctcccaaggtgccaggatttcaggtgtgagccaccatgcctgggcactatcagttcttaacagatttcctgctggggtgattgaatttgatgtctgattggctgggctggtgtgctgtgtcatacacatcagctgagcttttcagctgagcctttctgactcagaggaatcacacctggctttgaatgtcggcttagccactttggttataaaactgacattgcaagagtttgtaaggattagaacaatgtaaagcgtttggaacaaagcacctgggatctagtaattacgtcaatgtggctgttgttaccacgtgcattttggtagcagagagcatgctccctttgtacacattgcttatagtgtggctgttggtgactctaagccaccaatttaccacctgaaaggtaagcaagtgggggttaggcagtgttgggttaccagatgggcagactggggacgagcaaggcagggaaaacaaaaccaaccaataaattgagaatatttggaggagaagaagaagaattggtttagtaattaaatttttgattaccctagtaaacatcataaaaataatcagaacttggttggcctttatgtacttaataggttagtattgttttaattctaaatatgatttggaagcagggtctcacaacactttaatgtcatggtcctgtaaaggtcttcaatgggcctgggggtaggagatttcatgagattagagtgaacagtccctctgttaactcctatgtctgtaacagagctttgcagaactgggattggggacagccaagctggttttgagtaaaaccttagaagttgcttagtataatttcccgctatgacaaaaatctcttcaagaccctgctcggatgtctttcctaagctcattttgtctgcccttgtgggaaacgattaggctgataatgtcttttaaagacattatcaaggcgccactgcccatccaggctcagtagcaccctgctctccggaattgtactgttcacatggctgcaattttgccccattctcatcgtgtcttttttgtttttatgtttttttgttttttttttttttgagacagagtctcggtctgtcgcccaggctggagtgcagcagcgcgatctctgctcactgcaagctctgcctcccgggttcacaccattctcctgccttagcctcccgagtagctgggactacaggcgcccgccaccatgcctgactaatttttttattagagacggggtttcaccatgttagccaggatggtctcgatctcctgacctcatgatcctcccacctcggcctcccaaagtgctgggattacaggcgtgagccactgcgcctggccatcctgtcttctaagaagggagaaatgataggttgatgggatgaactcttaaaaacatcattttcaaatgtcagagaaaagctatcactttccttaaacagtgaggtgacatctgagggactgacaataacaaagggcttccatgacttttatttggtttctggaagatgttttctgctggttattttgaacaaatgtctccacttctctcccctattccaaacagcacaaaatcttagactctatcctacctagtacattaggcgtgggaggctgcagttctagtctcagattttacccatccttaaatcccctccccttgccacatcgctggcctttcctgggaattcagtgagtgtttgatctggagtagatctgatcttgccgttactagccctgagatgtggggcaatgttatcaccttttgcggtctttgttttctcatccataaaatgcaaggttgggaccagttgataataacaatatctgatatttattgagctccttattctttgtgcaagatgctgcgccaggtgccttatgtgtgttatttcacataatttacataatatctaaaattaattattttattgcagcaaccctataattaggtcctattatcctcattttacagatgaggaaacaggctcagagagtttaatggggtggagctggttgccacccagcacctttgaccagtcctggccacatatagtgagctttggatggcaggctccagtccacaccacctgagcatctcagtgggtagagggggccagacatcacgttaccatccccgggtgattgtgttctgcacccagggctgaaaaccactgtactctactgagaggtcttcggaggcctctggatgaaggtggggtggggcaatgctgagtgataaataccagtgttgtgtagatgcctcacgttattggtctctgcatggcagcacattgacaactgcaagcgtaaaaggtggagctctttgtgcacatgcattggtaaggactggtctgcaaaagtgcttgatgtctaagagtgagctccctctctgtgcagcagcaacagcagcccaagaacacttggagccaagtgttctctggccgacccttctgtagtaccagcatgcttacataaggcagttactgtggttaatgacctagtcggaggtcaaagcccagaacacagcctacttcacgcatgcgagaatgaaacattcggctgcatgctgcctgatgtgctgagccagctgggaggagaccttatcttgccagtgttaggacagtggattgaaccatggctaaattgaaggagggaccctgtgatattatggggaggggatagaagaaatacagagttttcctggagggactggagatgtttgaagtgggcagccttgaaaaatggatagactattttggactataggtggattcatttagttgttgagtggtgaaattgggactggtaggatgcctgcgacatagcattgtatgttgaaagaattattgaattactacagttcaaaaatcctgcagagcctctgtccagctccatcaccagaattgggaatgggagccactcttcctaatggaagaatatccatcagaatggagtggggatgctgttgaaacttcttccttctacctctggagttcacagcacagtgcatttgttacttaataacatgctaggtatcagattctgttacagcactaggccatacagactagaaatgtgatttttttattgtgtattttatttttttaaattaggttttaattacacaataaatgcacaaatgtagtctcctgtttttgttttttaaaattctgtatgtaaagacaaaatccccttttaaaagcctttttagcttattccatatggcttatataaacgggaactatatgtaggctcaatacaaatacaaggccactcttctgaaacttcttggttaccttaccttcagagggcagtacagcagcaccagcgtcctttctgacatgttggagccctttaggagaaagcttgtaccttgtggaaagagtgaaaaatggctgggcacggtataatcctgacacgcctgtaatcctagcactttgggaggctgaggcaggaggattgcttgaggctaggagttcaagaccaacctgaccaacatagtgagaccccatctctattttttaaaaatgtagaaagagtgaaaaaccaaactgaaactgccatgctgcactgaccacttagacactttacacacggcaaagaataaagctggatgacctaacagattataaggggagcccccaaagcgttagaggaactaaataattagacaaacatgttttttcacttttagtaggaactatagcggtatcttttggagccctcatttacagaaggatggtgacgaatgagggatttgtcatcttgtgtggcaagaagcatgtgtgtggaaagaccccgaggctgggattaagggacttgtgtccagctcccagctccggcattttactagctgtagattcttacccaaaggaattctcttttttttttgagacggagtctcactctgtcacccaggctggagtgcagtggcgcgatctcggctcactgcaagctccacctcctgggttcacgccattctcctgcctcagcctccggagtagctgggactacaggcgcccgccaccacgcccggctaattttttgtatttttagtagagacggcgtttcactgtgttagccagggtggtctcgatctcctgaccttgtgatccgcccgccttggcctcccaaagtgctgggattacaagcgtgagccaccgcgcccagccaaaagaattctctttacttttgtcatcttgtctctcaaattaggtagactagcattttatggtgcactttgaaacttccagagtacttgtatagatatgattatattgttataaaattaagggaaggaaaagtacttgagaagtaaaaggaattattaataatgaagttatttgtattggactcacagaaatgcagctcatttgcggacatatgcttcatatgtaaatacagcattataatatatgtattgtacatgtacaaatatgtgtgttacagggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacgtatgtaattctaggtggaattttaagaaaagaagtagtgtagatgaccagccagtcagcagttagccaaggaaaagaaatgccagtcacagccctgttgtgtctcttaataagccgaggaagcatacagatgagccagcctcctggttggtcagtttgcctggcctgggatgaagggacagtgaaaatggaagcctctgagtgaggagagtgagtactggagtcaggagaactggactcccagcctcacactgctccctagtatccacatgacttcactcagtggtcacgggtgggcatgacccccgggcactagagggcacacaggagctactgcacatgttggcattctgtagaactccaaagggctgtgctgaccttatgtgttttgcattgtctctttgaaagaaagggataagcatctgttgttttatgttttgttttgcttttgagacagggtctcacactgtcacccaggctgaagtgcagtggtgaatcatggcttactgcagccttgacctcctgggcttaagcgtcctcccacctcagccttctgaatagctgggactgcaagggcatgccagcatgctcagttaatttttaaattttccatagtgatgggatcccgctttgttgcctaggctggtctcgactcctggcctcaagtgatcctcctgccttagcctcccaaagtgttgggattacaggcatgagccactgcacctggccaagcatatgtttctgatgtgttttcttagccaaaacacaaattataagtttaggatgaaaagagggtgtgtgattgagcactcctactgttgtgatgctcagacacaatgctgccttgtggttttgataagccttgataaggctgtcagcagatcttgtgaaatgagtaaatagtttaggccacagaagtgaagtgctgacgtctgtgttcactctgcagaagatgctccttcccaatcagaaaacaaaaagaagagtacaaaaaaagattttgaaattgactttgaagatgatattgactttgatgtatattttagaaaaacaaaggtttgtactgaatttattaggattgtgcttactcgtttttccctttcagatgtgattttttaaaattccgtataaatttaactgttagagcaaacagatggtttcattcttccttgttccttaaacgcactattaagaaatagtcctaaactcagtggcagaaagaatcaaatttagaataaaaagaataatgctagcaaaatcacttttttacatagaactgtgagactgatggtagactcatgctgcccaaacccttcccagactgctttaaaaaaagtaagatgttttgcccactgttaaaatgcctaaaacactttttttaaaaaaattaataggctgctactattctgaccaagtccactttggagaaccagaattggagagctaccacccttcctacagatttcaactacaatgttgacactctggtccagcttcacctcaaaccaggcaccagggtaagcctatttcttggttcctttaagcacacaaggtatcaagtggctgatagtatgacagttaggcagtgcctttgaggaaaagggagaatgtgaggagtggtatgtgttagccaaagcgtgttgccaggaaatcaaatagataaggcaaagaaagctaaaaggaaaggcttatatgatggacacacagtaaacacttggaaataccttacctggcaagaatgctggatactgaagcctccatgctgaaattcaggggggcagtgagtgtagttttttggtgaagtttcaacagtttttaagttatttcttgattcctttgctttctccttttttttttttttttttttttttttgacagagtttcgctcttgttgccctaggctggagtgcaatggtgcagtcttggctcactgcaacctctccctcctgggttcaagcaattctcctgcctcagcctcccaagtaactgggattacaggtgcctgccaccatacccagtgaattttttgtagttttaacagggacagggtttcactatgttggccaggctagtctcgaactcctgacctcaggcgatccacccacctcagcctcccaaagtgccaggattataggtgtgagccactgtgcccacctgattccttggctttctcattgaagttgtggatttactcaccaattgctttatacagtgaggttgccttactcatgatccaagtcgaagcgagcccaaggtgacacacgggctcacatcctcaggaagtctcctagggctctacaggctgctggggctccttctgagattgtcacatggagccttctgaattacctggtgttgcaccctgattactgcctccttcatttgcctggggctcttctcacatgtccctgctgacagggtaagcagtggttcgtgtaaaccattccattcacatcctctgcttacttgcattactggttctcctactctcatggagtgtattaagactttatactttcctctttattttgcctgtttttccacaagattttaatgatatatatatatatatatacatatatatatatacacatatatatgtatatatatgtgtatatatatatatatatatatatttttttttttttttccctgaattgactgatattacacattctatttgtttttttgtatttttttttagagacagggtcttgctctgttgcccaggccatagtccagtggtgtaattggagctcattgtaactttgaactcctggattcaagcagtcatcctgcctcagcctcccaaagtacagggattacaggcgtgagccgttacacctggcctcacattctgtttttataaactaaccaagatatgtttttctttctgatcaatattgtttacttcaatagaaatactctttttttttcagtcctagctacttgggggcctgaggctatagtaagctatgatcatgccagtgcactccagcctgggggacaaagtgaggcctcatctcagaaaagcaaaacaaaaaaaaaattgtgattcatgagagggggtcaaaatatcaacattaacaggagtttggaagaagttgattctgactcttatggatgattttgaggggttcaagacttcagtggaggccagtcacgatggctcacgcctgtaatcctagcactttgggaggccgaggtgggtggatcgcttgaggctaggagtttgagaccagcctgagcaacatggcgaaaccccgtctctactaaaaatacaaaaattagccagacatggtagtgcaggcctatagtcctggctactcaggagggtgaggcacgagaatcactggaacccaagaggtggaggttgcagtgaactgagattacagtacactgcactccagcctgggtgacagagcaagactctgtctcaaaaagacttcagtggaggaagtcattgcagatgtggtatgcagatgtggtagaaatagcaagagaaccagaatgagaaatggagcctgatgatgtgactacattggtacaatatcctgataaaacttgaatggatgagaagttgtttcctatggatgagcaaagaacattttcttgagatggaatttactcctggtgaagatgctgtgaacattgttgaaatgataaaaaaaaaagatttagaatgttacatagtcttagttgatatagcagtggcagtgtttgaaaagattgactttgaatttgaaagaagctccgctatggataaaatgctatcaaacagcattgtatgcttcagagaaatctttagtgacaggaagagttgattgatgtagcaaacttcattgttgtcttattttaagaaattgtcgcagccaccccatccttcagcaaccaccacccaccctgacagtcagtagccatcaacattgaggcaagaccctttaacagcaaaaatattacaactcactgaaggctgatatgatcattataattttttagcaatgaaatatttttaattaaggtatgtaaattgttttttagacatatactgttgcacacttaatagactccagcatagtataagcataacttttaaatttgtgtgactggaagtgcctgtattaaacactggacatttggctagggacacctgagagtgtgcccagaggagagtattctaaatgaagatgcagttagaagttgtgtcatatgaagaacagtggaagaaaatggggcgtttcttaattcaagtatttattgtttagtagtagttttggatttgttacaagcacattgtgggtttatttgagttgtttttgaggcacagaattatattaaaatattcagtgtgctcttgtaaactgtgcacatctccagtcacatttctcctacttcagagatttatatatcaagtagaaatcactggtctaaggaaggacctgcaaatatttgaaagactgtgatccataggcactcgtaaaagaggagcctcattccacgaggctctggaatacagaatgaggatgatggatgtaattagagggaagagctggatgtctctccttgttgccatgtagggaacagtggtttccattcaggaatgagacaggctgttaattaaggtaatgggttttcctttttttttttaaagacagggtctcaggctggagtgcagtggtatgagtatggctcagtgcagcctcaacccctgggctcaaatgatcctcctgcctcagcctcctgagtagctgagaccacaggcacacagcaccatgccatctttttttgtagagatggggtctcactgtgttgcccaacgctagtctcaaaattcctaggctcaagcagttctcccacctcagcctctcaaaatgctgggattacaggtgtgagtcaccgtgcctggctggtaatgggttttctgtcaaaattgttcaagtgcaacaaggtgactttcagaaagctggagggtagattttccaacttttgtttttagtgaaggaaccctttttcaggtaaaactgtgcagaaggcctaattgccagtcacacagaaatagagctgctctggtttatttgggattggtagagatgctgagccctgctactccaggtttgcactgtatagtggaaaagtctgttagacttagatgacttgtgagggcccttctgactctaaaattgtataattctaggaggagattgggcataggaattaagatttacttctctaacctagttcagtagcttttaacaaaatagctttctgcatttattctttcctttagttacttaagatggcccagggccatagggtagagactgagcattatgaagaaattgaagactatgattacaacaaccctaacgacacctccaacttttgccctggattacaggtaaaggggggaaaggggctctgtcctctcttctaagccagggagtcgtttttctctgcttctcatgtccccattttatatggtgggagactgttggcaattttgaatccagtggaggttttctgggtaaagggtctgccttccacccagtgcagggagctgagcagagtcaaggaaacagcctcaccttggcctgccttacctcacatcctacatgcaggaagcaaatggccacactcaagtgaatgcgtcgacatgtggatgggtgtttagcctctgctacaaagtactaatcttggctgttgtgggatttcaaaggaatataaacactttgtcctcttatgagctaatattttggccaggtagacaaccagatcacaccatatgtgatctggtgtggcaaaaaataagtcttcggggtgtatctcagatgaccagatttctagctgtgaatgcagttctcatattgcaagcttgctgtgaacttgtacaagccaccccccatctttagatcacggtttagactaaataatttccatatcccttctctgagtctactgatgagatggctaatacaggtaacagaaactggaaaaataggcttcatctgtgtccctgtatgtggaaaggggggaacgaactggaaaaaaatgtattcaccttattttcttacttaggaagagagttaggctgttatattttagtgaaaatccagactgacctcttgactagtgcttctcaaactttaacttacatacaaatcacccagggagcctatttaaggactgattcctgacctgtgtccccccaccccaccccctgcccgaagatactgatacattcactctggatgtgatcgcaaaaatgactttctcacctgcttctgggtggtatgcctgctactgaccagatggccccaggaatctcctgtgctttccttgggtgatatgttcaggtcatatctccggtatttgaggaatgtttctgtaaaatgaaatcctaaatttgttagaagctgaaggggggacatagtggcaattatggttatcgaattccttttaactcccgctcaaaaggtcttaggttgataacagacacctctctaatagggtttacgtgaaacaggatgataactagaggcacctagaagttcatcgtagtgtaactcactgagtgaaccatcagatggtctcttcttgctttgtaaacatggagtctatttcaagggtgtttctgagctcctctgcagcgtccaccaaactcgaagagctgtttcttgcccaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtacggatgaaacagctgagaattacattgtttgcctgaaatctatttaattgtctcttatatgagagtcacgcaatctgagcttgatttcttttcttctcagttttaacctgttgctctccaagttttaaatagggttgtgggagtgagctgatgctaattaggtttgtgtggaactgaccatctctccaaagaccttgataagacatgtaactagggaggaactggtcacccaaataaggcatatgaatgaaggctgcaggcagagaatataaatttatatgctaattcagcaaggctagctagctagctgtgtggctctgaaaaatcttggccaaattcagtttgtattaaattatcatgtattaaacatttatctcttccataccaggtggcaggctttatgcttgcctttatatttgattcatttatctcttttacactggaattccagttagccttaatgtagattgcactggattgaaaagaaattagatttgatatgagggactctatatagtgtccaaagagagctctgggctgggcgtggtggctcacgcctgtaatcccagcactttgggaggccaaggcgggcagatcacgatgtcaggagttcgagaccagcccggccaacatggtgaaaccccgtctttaataaaaatacaaaaattagctgggcatggtggcaggtgcctgtaatcccagctattctagaggctgaggcaggagagtcatttgaacccaggaggcagaggttgcagtaagctgagatcatgctattgcacttcagcctgggcaacaggtcgagactccgtctcaaaaaaaaaaaaaaaaaaaaaaaagagtttgagaccgcgtggccaaaatggtgaaataccatctctactaaaaatacaaaaattagccaggtgcctgtaatcccagctccatgggaggctgaggctggagaatcgcttgaacccaggaggcggaggttgcagtgagctgagattgcaccattgccatccagcctgggtgacaagagtgaaactctgtctcaaaacaaacaaacaaacaaacaaaacaagagagctctgtagctccttggttgaaactggattccttctttagttgaactccagacctttgtttttacagtgaattatggtaaaagtttctttattctgcttagttttactttgtcatatacctatttcaggtaaataaaattgaaattcactatgccaagactgccaaaaagatggacatgaagaaactgaagcagagcatgtggagtctgctgacagcgctctccggaaaggaggcagatgcagaggtcagatgctcttgcctgttctctaggtgcccagcatgcgggaggggagtggttgatgtctacagctgaagacacctcgatttgggcaatgcctccaatacagaaatgttcgttcaaaaatacaaggagctgggcatggtggctcacacgtgtaatcccagcattttgggaggctgaagtggaaggatcacttgagcccaggagtttgaggttacagtgagctatgatatgatcgtaccactacactccagtctgggcaacagagagagatcctgtatcttgaaaaagaaaacaaaaataaaaggaagacttcatgcttctaagagagaagtgaaccaagtatacaagtaggcaggtcacacagactgtgatacaaatagcaaactagtgtgtaagacgtgattcagccttgctggtaatcaaaaaagacaaatgaaacaatcttgatgctactttaaaacagcagcagttttagtaattaaactgttttccattactgaggaggaaaatttggagtacttattcactgctggtagcaatttaagttgctctatgctatgaaatgtttaaaccttttgatctaataattctgatttcaggaatgtattctcagtaggaagatagtggaaaagtaattattatactgtcagattctacttcttcagaacaagctgaaaccttgattaacttggtccacctcaatgaaaggaagtctcagttaattagaatccttctctctttctgacttctgctcagataatattctgagtttagaccttctgtagctgagaaatgaaaactcataagttgattgagggccctgagctgggtatcagagaaagctcttcagtcatatttataaagttttatcaactagaacagaatgggatgcaagtgtgtgtctttgtcttaagtggaaagtttgagtttacttttaaatatgaattttgtgctgcccttagcagtgtagtccagttggagctataaataatcatggctttggctgggcacagtggctcatgtctgtaatcccagcactttgggaggccgaggtgggtggatcatgaggtcaggtgttcaagacaagcctggccaacatggtgaaaccccatctctactaaaaaatacaaaaaattagctgggcgtggtggcgggcacctgtaatcccagctactcgggaggctgaggcaggagaattgcctgaacccgggaggtggagcttgcagtgagccaagattgtgccactgcactccagcctggcgacagagcgagactccgtctcaaaaaaaaaacaaacaaacatggctttttattactgcttttttttcttgtttgttttcagggcaccctaggacactctttgcagtgtgtcctttaccagggtgatgctggctgttgacatccatgtttaccacaatgtcattagagcagagctgaggcactggttctctttgtagatcctttttcttcaaaataactaagaaatttgttttcattttgtttaggtatagactttttggtgacacaactttatttttgttgccctttcaaaagtgcactagccctaactgtccgatgtataaatgtgcttctgttaggcaaaccacagggaagctggaaaagaagcggccctggcagaagtggctgacgagaagatgcttagcgggctcacgaaggacctgcagaggaggtgcgggctggcaggcatgggggctttgttggggctcacctctctgagctgtccgcgtggcaggccttccacacacaacctgtttcctatgacatttatagtggctgttctgttttctctctgtgttgacagataatacagaccaacttttaaaaaggcgtttttctgtgtcagtgatcagagtgtaacaggagatattttatctcaaataagaaactagaaaaatctgcttataaaatgcatctgaaagatttgtttctcattagtttagtcattgcatgtgtgtattattcatacttgatgaacgagcttttgttctaacagttggcagtgacctaaatacttgcccctttctttccagcctgccccctgtcatggctcagaacctctccatacctctggcttttgcctgtctcctacatttagccaatgaaaaggtaggtaattaaggtaagcatgggagtattagagtattccctgtttatgtcaactcatttagctttgtatttgatctttcatgggctaacataggatttcttaaatacagtgacttatgtagcaccttcaacccaaatgattagccaggcatctagaagtaacttaggaaaaagccatcaggtttgattagcaatgaaaatagcacagaggacccaaatagtaagattttagatgatggaattgtgatcggtaagttccccagcctaagaacacgaggtgcttttacttcacggggtgtcaaagactttaaaggccaaagcctagtagtaccaaagtcaagacatatgggagacatggcagagagaagaggagagaaatgaggatgaaaagaaaacagttgcagaaagagaagagtactaaaatatggaggtaacagtcagaaaagtcaagctgtgtgtcacaaggaaggagaatcctgaagtgccagctgggtcagcgtggcagactcctgtgctaggccagccaacagctgcatagccatgggacagctgtggaaagagcagaggagggcactcattttctcaggagccgagtggtactacccagggataccacagagagggcagccagcagcaagcccacacatttgagcatcactgaacacttggtatccattagggtccccagccagctgatgcacagcccagcctttggcacgtgcagtagagggctatgggctgggccatggcgtgtgcggcaagcaccaccctggggctggggcaccatggccatggtgtgcaccaacactgtcaactccccaggaggagggggtgggcactggagtgcagttactatgtgaacgccgaaatgtggttttggagggtgattatgggaatggaatggtagcaaaaatggggtgctggtggaagcatccaggatttcctacatgccaacatttgacctctggcctcctaatgaaatcaggagcagtgaggattggctccattttccaggtctgactctgctttggagagaagttgccctggcctgtgtggcacagccatcagccaatcccagtgacctaccactggaagtcagagaccaatttttctcttgtcaataccttgcttagctgacaacctcatgaagaagaagaaactgtccagttagcagaagctagttttgattctgggtggggagcaggtgtagaagagccactgggccaggaccaagtgctgtatgtctccaactactgtgctgaccattgggcttgtaaccaccagtctgggtgttcaaacctgaggcctaagttgaagagcccagtgtagttcccaagaaggaatgattgtgcatcagagcccttgggaatggttttaacccaggaatgctgaacttgcatggctgctgttggggggcagtaaggcggtgaccggtgactgcggagagaggacatgccctgttcacaagcctgtgaaggcagacatgcccgtggttatgggaggtggtagttcctatacctgacacatcctaaagcatctgatatcacatgcaaactatatgaagaatgactaagaaaataaaaaataaattattatcattgttctgacaagaaatctacaagtggctctgctgaggatataccatctgaggtgggtggtgtgcaggccatccatctctctgacttgagaagtgtcgggggaggcctggaatctcattcgcacaccatcctggtggaaataggtgctggtgactctccaacatgggtgctggtctcctagcacatcaggctcctaggctggcctccaaagctcagaaacccttctgagtccaatttaagagtgttactgctttcgctcatcagccccagcctgaaggtcagagtgcttctctgggtggtgtgtctccacagaaacctgacttgagagagcggcttcatggccctcacttgtttcttaaggagtcaggccaggccaacactgctaagaaatattagtgactctgcggcttcactgaggtcgtgctgctccgactccagctctgcacccctgctctcagtggcagtgcaggcatgttcattttgctgtgatcaagtctctttttaagggtcccagagctcttggtgtttgaagaatggtgggtggctacagcccatgacttgttgggctgagcaccgaggccattactggggcctggctttgggctgtttgagaaaactgggcttgtaacattagccacaacagttactgttataatctacagggatctgtgataactcaacacttagagccaccaagagaaatattctcaacgcttcacagcagaacttgacctcctcttggacttctttctctccatctttcactcccgtctggagtctgttcctccaccactgtgataacagtctcccctcacatagccaggcagtgtgtggggcttaggagccagtgatggacgtgaggccctctgccttcatgtctctgcatgttagcagtgtgcaactaccagaacctgagctgcagaaaacccgcgaggtgtgacttgagcgttctgtctttagtggcaaggaaaggtgcgagtgactgttgagccctggcacatcccatctgcctccagtgcagagccagggcaggctggttgtggtgaagttcgtcaggaaaggtctcatagctgcttagtcctgagggaaacactgcctggggttggggaagagctgggaggtaggtagggaaaggcctgtgcagagactggcaggaggtcactgctgtcaggaactaatggagagatggggcagtggggtagttgaggggtgcctggaggaggtgcgcgtggatggggttaatacagtagtcccctagtttccatggatggggcattggggcagttgggggtgcctggaggaggcatgcatggttggggttaatatagtagccccctgtttccacaatttcactttccatggtttcagttacccacagtcacccatggtctgaaaatactaagtggaaatccagaaataaacagttcataagttttaagttgcaactcttctgagtagtgtgatgaaatgtcaccatgtcccgctccatcctgccccggatctgaaccgtccctgtgtccaacagatccacactgcagacgtggctctcccattagtcacttggtagccatctcagttcccaggtcaactgttggtggtactgcagtgcttgtgttccattccctcttatttgacttaatttttctattttattattagttattgttaatctcttactgtgcctaatttgtaaattaaacttgatcataagtatgtatgtataggaaaaaacaaggtatatttgtgtatacatatatataaaaatcatatatgtgtatttgatttggtactatatgagttcaggcatccaccgggggccttggaacacccctcgaggataaggggggacgactgactatatgtatgtgttgtggctcctcatgacctcccatctgcctccattagcatcttcagggcagacggctcagctcttaggccctttatagggggtgggttgcaggaatcagagccagagaaggcttgctttttgctttttcacctaagtcattttgttataacaaggattgggaatcaggtttttcatgcaaattatacttgctatgaaacagtttttcttataatcatgggacaaactttcttctttgtagtcactaccttgtgactgtgattggaatttatgattcttttattctccgtataccaaagtccatgcatgttttggtcttccctcagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatagaactggcaaaata

SEQ ID NO: 499 - DNA, 31229 bp, Homo sapiens
agcgttctctagcccttaggcagccgaatccctaatttgcggacttgggcatgggactgagtcaacctgtccccatctctgatcctgtgcttaggttctgtacggtgagcgggagtaggcttgcagtggggcctaagactgagaggaggggttggccggaaagcggactcatgaaaggtgaccctgaggagagccgttggggttcgtgttggaattggcctgtgtcctgttagcggtggcagttgagagtgaattcatgaatttaaactcacaggacaccaagaaagcggggatgggcaggatctcacacatggatacaatgtctaaatcaaaaaacccaggctccgtcaccagctgcgtgacctttttaatcttgtgaacaaaagttctccgaaaaggaatttggaagacagagactttattccagcaaaccggggagaaacagccttccatgtttattggagaccggagtctcgctctgtcgcccaggctggagtgcaatgccgcgaactcggctcactgcagcctccgcctcccaggttcaagcaatcctcctgcctcagcctcccgagtatctgggattacaggcgcgcgccaccacgccccgctaatttttgtatttttagtagagatggggtttcgccatgttggccaggctggtctggaactcctgaccttaggtgatctacccaccttggcctcccaaagtgctgggattacaggcgtgagccaccgcgcccggctccccggtttattttatcttatgtaaaaatgcagattcattgagctagatgaatgcataagtgactatttctctacccccctcacatgtgaaggttgatcaaagactcagaagaatgcaaccgtttgcctcttatctacccacatctttttaaaatttattcatctttccccaatatctgccccttcccctataaaaactgaagccctcaaaatcatctttggagaaaggcacggacctgtctccaaagatgatgcacgtccttaaacttggcaaaattaacttctaaattaattgagatccgtttcatatacttttcggtttgcagtatcagcatttagaaaggctctcctagaagattctaaggattgcttcttggccatttggctaagatcaagtttaggagattctaagaagccccctctgtgctaagtaaagaactactgagctaggactagaccaacttagtaaaattgctgcgctcagtgatgcacgcctcccatctgctcaggaggcttcggcagaaagatcacttgagcctgggaattcaaggctacaaatgtgctatgattacacctctgaatagccactgcactccagcctgggcaacataccaagaccacgtctctaaaaaaccaaaacgaaacaaaaaaaaaaaaaaaagaaaaacaaacacaaatcagggcactgacatgtacagttgtttcttgaaactgatggactgacaagacagcaatatgattggtggatcagacaaagttaccaacctaatagaacaacaagtcctaaggtcaagattaattgttatgtaacaaatcctggctgtccactggatattgctttcaaaataagagtccatagagggcagaggggatagatagtaatataaaaggtatttgttaataccgaaaagactgagaaaaaacacttccctttccaatgtgaaggactaaataatccaaacttttcccactataaaacacagacttttctaagtcattggatgtggggctctggggtagcctgagctgtttgtcccacaccaagatgcttcaaaacattattaaaaatgtttggatccccatgaagccctattataaccaagtttatcaggagatttgagtaggaatggggttaatgagcctcatcatttataaaatcaggagtactgataaaataagtaaaatattgaaagcttctccacctgcttatggtcatcactaaccagcttcacttagcatgcacatgaaatgaaacattagtcgacctgtgaatttaagcaagctatgttagaaaggaacctggaaaatcactgtacacttatataagtaccacttactttgtggcatgaataagtataccaaaaaaaaacacccagaaatgccagataaaatacaataaatatcattttaagctgggtgtggtggtacgagactgtaatcccatctacttgaggagctgaggcagaaaggctgcttgagtccaggagttcaaggctgcagtgagctacgattatgcctgtgaatagccactgcactccagcctggacagcatagtgagaccttttctgttaatacaaaaagacaaaaagcagcgaggcacagtggctcatgcctgtaatcccagcactttgggaggccaaaatgggaggattgattgagcccaagaattcaagaccaacctgggcaacatagctccctatctctaaaaaaaaagaagaaaaaacaagaaaaatctttttaaatgggtggatgccaggcatgggggctcacacctgtaatcccagcactttgggaggctgaggtgggaggatcacttgaggccaggtgtttgagaccagcctggcaacatagggagacctctgtctctacaaaaaatttaacaatgagccaagtgtggtggcccactcctgtagtcccagctactcggaaggctgagacgggaggatcccctgagcccaggagtctgaggttgtagtgaactgactgcaccactgtactccaatgtgggcaacagagtgagaccctgtctcaataaaatagaatacaataaatgcatggaatatggaggagggaaggtttttcttttaatcttatacccaattatagtttgtatgttttgtttttgcttcttttttttttttaagacagaatctcactctgttgcccaggttggagtgcagtggtgtgatctcagctcactacaacctccacctcctgggttcaagcgattcttgcacctcagcctcctgagtagctgggattacagctgcccacaaccacgcctggctaatttttgtatttttagtagagacagggtttcaccatgttggccaggctggtcttgaactcctgacctcaggtgacccacccacctcagcctcctaaagtgctgggattacaggcatgagccaccgggcctggctagtttgtatgttttgattttgtgtatatattagttttatttttgctaaggcatgtttttaatttttgttattgtgctttgttttcattttcattatttattttgagtaagttatacttaaaacaaaaatcaagattcaaaaagtataaaaggggccaggcatggtggttcacacctgtaatcccagcactttggaaggccaaggtggacaaatcgcctgagctcaggagttcgagaccaaccttggcaacatggcaaaaccccgtctctacaagaaatacaaaaattagccaatgttgtggcatgtacctgtggtcccagctactcaggagggtgaggtggaaggatcacctgagcccgggaggcagaagctgcagtgagccaagatactgccactgcactccaatctgggcaacaacaacatcctgtgtccaaaaacgtataacaggtcaaaccgtaaaacttgtctctcttacccttattcccagcctctcggttcttcttccctatccttccaaagatgttttatgtaaatacaatcaaatatacacatgcatactcttatcccccttgttaacacaaatttttgttttctttattatttctttcaatagaggtggggttttgctatgttggctaggttggtcttgaactcctggcctcaagcaatcctcctgtctcggcctcccaaagtgctaggttcatgagcatgagccaccagacccggccaaattttagctttctttacacactattctgcattttgacttgtttcatataccaatagattttgaagattgtttcatatcaatgcataaacagtttcctgtgttttgttatagctgcatagtattcagattattgatgtaccttttttttttttttaagtagagataggggcttgctatatttcccaggctggtttcaaactcctggcttccagggacctacctgccttggccttccaaagtgttggaataatagggtgagccaccacacacagccccataatttatttaaccaaccctctattgatggatattgagactgtgatatagtttgggtgttggatccctccaaatctcacgttgaaatatgattcccaatgttggaggtgggccctgttgggaggtgactggatcatggggacagatcccttgtgaatggtttagcaccatccccttggcgataaactgggacctccccacctaattttcttgttcctattctcgccatgtgacatgctggatccctgtcaccttcagccatgattgtaagcttcctgaggcctcaccagaagcacatgacagcaccatgtgcttccagtcttttgctattataaacaatgctgcaatgtacagccatgaacacgtgtcatttcacagctgtgtggatttatctgtaggttaaatttctaaaattggaatttctggggcaatgagcttgtgcatttataattttgatataaattaccagttgcttttcatttaaagacattcacatcagcaatgtgagagtgctttgtatatactgtgtttaagagaataatttttttttttgggacgcagtttcgctcattgcccagcctggagtgcagtggcgcgatctcagctcactgaacctgtgccttccgagttcaagtgattctcctgcctcagcctcccaagtagctgggattacaggcgcccgccaccacgcccagctaatttttttgaatgtttaacagagacagggtttcgtcatggtgaaaccctgcctctactaaaaatacaaaaaaaattagttgggcgtggtggcgcgtccctgtaatcccagctacttgggaggttgaggcaggagaatcgcttgaacccggaggcggaggttacagtgagccaagatcaaggcacagcactccaacctgggcgacacagcgagactccgtctcaaaaaaaaaaaaaaaaaaaaaaagtgaggcgcaaatgggaggtgaagcagtgaggttcgcaagtgtagacacgctcaagggactcattaaatgtcatttcatttaaaaaatgaaattgagcatatgtgcaagcaaggttcacacaccccatttaatcttcacaccaccacggggtagtcactattatccccattttacaggattaaaacactgacgctgggaggttgacagagttacaccaaatcacacagaggagctgggcttcccccgacctcctccgctcaagtctccctgtccccgggaggtgcggaaggaggcaacagacgcttggcccataggtggagcaattggcgaaggcttcgcccgacgccggaactgcgagctctcagcgggagccgagacggtgcagggccggagaagcaccttcactcccagcctgcgccccgatgctgcgcgttctgtgcctcctgcgcccctggaggccccttcgggcccgcggctgcgcttccgacggggcggccgggggctcagagatccaagtgcgcgccctggcgggtccggaccaaggtaaatgtgcagttccggggcggcgcatgacgcgactgggactaggccggaggcagcgggggaccggcaggtgggccgctcagtgcgttgaaggattcgatccccagtccctccctcccagttctaggcgccccaaaccgctccaggcctgagaggtgggcggccgccttagtggctccagactctagctgggggcggggggcctctggcaacctcggtctcttcaaaggccctttggggtcttccgactgtgtggaagggggagcggggtccgcacgggtaggactgggccccgcggcccccaggccaggagcgtttaagtgcgcgttcccctcccccgccaagggtcctggcccggttcgggggcggaggcagcggagccagtcccagtgcccagtgcggcagcgggcagagtgaggagggtgcctctccagccgcgcgcccgccctgggccgctagcgaacctttgcgtccttctggctccagggaaaagttcgctgtttctccgccttttggccaagatcaaggatagtatggagcggggacgaggggtggggggcaaagttcgcgggtcactggcagaaaacgcctctgatcgcgtgttgcgtttttgttgttgttgttgtttgaacttctggagcattcagtggtgctgataacgctcctcagtcctctgctggtaaccatcagggctaggcgcttctcctgccttgggtctcctccccgcatctcatcccctgtctcctgcatttgatacacagatggcattgtactgtacatttcgttgtattgcttcttttttttttttaacaaaagtttattcttaaatgtacaacagctccaagacaacacttaattccagccataggtggcaaaagatgttatggcagggaatagagaggtttaaatactgatgaaataaagggtcaccatctccttaggcacagggaacagcttactttttgccagatttcttaattccacttgtggccaagggccccttccccgtggccttccattttagctcctcgagtttcttctgctcctctttttgtttctgcttgaaagccttatcttcctcgtccatctccttggcctgcattcttgggctgtttcagtggcttcttgccaccttcgtggccggacatggcgcctgccgccccttccccagcagtattgcttcctttttaccggcttgacaacaagtttgaagcggggctttgccataaaatccagttccttgctccctgctgttgcccactgttcccaagtgtgcatctaccaccttcagtggacacggacaggccacctagagtcccactgcaccacttggtgagaatttccttgaacagttaatattgctgaaccttatacccccaatctcatgcttagttcactacccaactggcaacagctcttaagacagtcaagattattctccccactttacagattaaaaaactgaggcacagaaggttaagttatttgaaccaggtctgatttcaaagcctgtgttctcaaccattaggtaatcactggctcttctagtaattcagtgactcaaaatacagacttgtacatgtgtaaacacaaaattatcatgggttaaagacctttaggctcacttgcaaatatcgggaatcattttatccaaaaaagaatgacaaggatcagcagattaagcctctgcccctgccagagggctcaaagggcaggaaaaggcagtgagagaaggagagacagaaaccaagatgacagtgcagaggaggcatggggatgagatcacacacggagccctcacagggaatgagttggggtcatttgatgttcatattagaagctgcaggttctgccttccactggggctgatggcacaagagcactgttacattttacctgctgcctttgagcttgaggttgggtggtaaaccattcttcactgttcttagcggctttatttctcatagagtcatgtgttgcttaacaacggggctacattctgagaaatgcatcattaggtgattgtggtcattgtgggagcatcacagagtgcacctacacagtcctagatggggtagcctactgcacaccaaggctacatggtgtatagcctgttgctcctagaatacaaacctggacagcatggtaccgggctgaatactgtaggcaactgtaacacaatggtaaatgtgtatctgaacatagaaaaggcacagtaaaaatacagtctaaaagattttttaaatagtacacctgtactgggcagttaccataaatggagcttgcaggactggaagctgcactgggtgagtcagcgagtgaatggtgagtgaatgtgaaggcctaggacagcagggactggtttggcaccagggactattttcatgaaagacagtttttccatggacttgcgggcggacagatggtttggggatgaaactgttccacctcagatcatcaggcattagattctcataaggagctcgcaacaacctagattcctcacatgcacagttcacaatagggttcgcactcctatgagattctaatgccaccactgatctgataggaggtggaactcaggtggtaattcaagccatggggagctgctgtaaatacagatgaagctgctcatctcctgttgtgtggcccagttcctagcaggccacagactgggatgggtccacagcccgggggttggggacccctggcctaggacattactgtacactactatagactctataacactgtacacctaggctacactaaatttgctttacaaatgtttctttcttcaatgataaattaaccttagcttactctgtttttactttataaactttttaattttttcaacttttgactcttttgtagtaacactcagcttaaaacacaaacacattgtacggctgtacaaaaaatgttttcttctttagatccttattttataagcttttaaaaattttaattcttaaactttttttgttaaaaacaaagacacaagcacacacacgagcctagacctatcactgtcttccacctccacatcttgtcccactggaaggtcttcaggggcgataacgtgcatggagctgccatctcctatgataacaatcgggaatacctactgaaggacctgcctgaggctgtgttacactgaacttttttcttttctttttttttttttttttaataagtaggagtacacacggcccaggccaggtacagtggctcacctggctcactcttgtaatcccagcacgttgagagggtgaggcaggcagattgcttgagcccaggagtttgagaccagcctgggaaacatagtgaaaccccttctctacaaaaaaatacaaaaattatccaggcatggttgtgcatacctgtagcccctgctactcaggaggctgaggtgggaggatggcttgagccggggaggtcaaggctgtccaatatcaaggattcctgatatttgcaagtgagcccaaaggtgtttaacccatgagtgagccatgatcgtgttactgtactccagcctgggcaacagagtaagaccctgtctcaaaaaaattaaaaataaaaagtaggagtatattctaaaataatggtaaaaataatattgtaaatatataaacctaaaacatagtcttttattatcattatcaagtattatgttgtgggcctaattgtatgtgctgtgcttttgtataactggtaaagcaagctagtttacaccagcctcaccaccagcatttgagtgttgcattgcgctatgatgttatgacagctatggtgtcactaggcaataggaatttttcagctccattagagtctgatgggacttatatgtcttatatgtggtctgtagctgaccaactaaaacatcatcatgctgtgcatgactgtaattaatggctgtccttcaactccttagctgggcactaaggttctccaccacaagctgacctttccatcctccctcctctacccatgggctcatttgaaggtgtgttacctctgtgttttgctctagctgtgccctgacttggctcctcttccttcctttctgcttatggaaatctttttggaactcccctgctctgctgctccgtcccccacactgtccttttatgtttcgtgtgtctgaacttgtctctcttctaggctgttagctctttaagagtcaggattgccagctgggtccagctgttatttgagcaaatcctccttgtttccgggcgtcagtttcctcttctgtatagtaaagtgttgttaaatcagttgttctccacactacccttcagtggtttctttttttttttttttctttgagatggtctcactctgttgcccaggccggagtgcagtggcgtgatctcggcccactgcagcctctgcctcttggtttcaagcgattctttgccccagcctcccaagtagctgggattataggtgtgtgccaccacgcctggctaatttttgtctttttagtaaagacggggtttcaccatgttggtcaggctggtgttgaactcctgactcaggtgatccacccgcctcggcctcccaaagtgctgggattacaggcgtgagccaccacgcctggcccttctagtggtttctgttgacttctacccacaacacctcgcctgtgacccaagccatctggacagaagtgatcctaggtcagctgctcagtggtatggtaggtttggtaagagtgggaagggtgcagcacagccccatccccgctgttggggtcagaagggcaatgttcccagcatcggggctagactaagaacacagggaccttggctgattactgtccatttctccaggacctggcatgtggtagtgcaaattaaatgttgcacaattgaatgtcggcagccaaagacaccctgcctggctcctggggggctcccagcttaaagttcagatactgtattaggtccgagacttgccctagtatctgggcgttttacacaaactctggttagacacttaaatgcattatctcttttaatcctaacaataacctttttattatttctcttacagatcaggaaattgaaggccagaagggtaaagtggtttgcccaaggccatggggctggtgtgtggctgagttgtggcttgagctaagggcttgtaagagttgacagtcagtattccgagagggagatgtaggtggagacaggagatgaagctgaaagatgagagacagtcagccagagagaatggaaggaaagaacaggaaagcagagagaggagtgtctgccagtcccaggataccacggctatatcagctttctattactacctaacaaatgatcacaaactttgatactcaaagtcacacacatttatcattttttagtttctgtacgtcagaagtcaaggcacaacttagcagagttctctgcttcaggtcttgccaggctgggctgcagtcgggagttggccagggctgtggtctcatcccaggcttgacgggaaagatctgcttccaaggtcgtcaggttgctgagacctgaattcacctcctatggttgttggactgaagtcctgttctcttgctgattgttggccgggggtcactctcagcaattagaggttgcccgcagtcctttgctacttgaccctctcgttaggcccatgagtgtctctaataagacagagccttttatatactataaccgaattacagaagtcacattaccttcaccatataacttaacctaatctcaggagtaacattgtataacctttgctgtatactattgcttagaagcaattcacaggtcccacccacatgcaagggaggggattattcaggatgtaaacatgagggccactctggggaccttggatctagactgctctgaagtttgtgggggtcagggtccttgactcctcctgatctggcatctctctatccactgcagtctcccttctccagagttgccccattttctctcctggagcactggagctggaagcgaccttatggccatctgcacacctctctggagcctccagacctgctgggctctaagagctctttgcaggtttctggggaggctaaggaagtccagtttgcctgaatgttacagttctttgcccctagccatagttctgtaattcctggctgaacaccctgtcccttgagagcccagaaactttcattggcctttctgtgtctctgatcagcttaaactgagaatgccaacttcataaacactgcttgtttacagacaaagctgaggaccctgggagataataataaggggtctttgaaggccaaaggattgggaaacactcctctgggcacctgctggatttcagccctgggaagacctgaaatgtccatcctgatttttcgtaggaggagaaacagcctagaagggatgataagggtgtgagctccttcccagagcccatctctcttccccacaccctgactagatggcgggggtgaattggggccagagtgggtgcaagagtcagattgggggggccttatggtcggtattaaggagttgaactttattttgaggaaaagaagggggaaggggagggacgtggtcggattggggtaagaaagatgactgtgacccaaatgtgggaacgaatgtgtgtgtgctgggagggagcaagactgaggactcgagggccaggtgggtgatccgagggatgcaggaaagagcctatgccagattaatggctgtgagaagcggtgtgagctgagaggcctgagatctctttaagaggttggattagcaggccttagtgactgagtgcattttgtaggtgaggtaagagcgaggtgacaggatcaacttctgagttgatagcaaggtcattggctcatcaatggagcaggacataccagttgagatatcaagtaggcatttggctattcaggcctggggtgcacaggagagctctgggctcctgggcacacacgggagccctgggtgtacaggaggcaggcgtgtgttagctgtggaagggaggtccctcctgcctcagcttatcctgctctccctctgcctgaactcctccagttctggaaggcaccctgcagtcccacacctgggccctcttctctgccactccctctgcctgcaacaggcttctctcctggactgcccccttccctgcaccttgccaacatgcatgcacacacacaggcactcatgcacacgctcacatatgcacccatgcatgcacacttacatgcacacatgcactcttacatcttttgcctggccaattcctactctcctgtcagctctcagcttaaaggccactgcctcctctgataactcattgctgaccttctatactagggctcccctctgcccactggaggccccttacttgtttgtcctttttctccaagttctcctcacaaatagtaattatttaatgtctgtcttccccactaggctgtaggttccatgaggacaggccttgagtctgtcctggtctctggaatcacggtgtctagtagaggccagcacacagcaaatatataaatgtacaaatgagtgaatgaagagaatctgattggccttaaggaacttacgcacttaaaataattgggcagaagagaagcagtgaaggagtgcagaggcatcacctgaaaggtaggaggaaggagaatgggggcctgccaaagccaaggcagatacgtgtcattatgcatctgtgtaaacccacagagtgtacaccaccaagagcgaaccccagtgtacactagggcccccgggtggcgacagtgcatcagtgtaggttcgtcagttgcaacacgtgcctctggtgggggatggggattgcggaaggggctgtgcctgtgtagggccagggagtataggtgaactgtattgaattgtattttccactccattttgctgtgaccctaaaactgctctaagaaaatcatctatttataaacaaataaatattcttctaagaagccaaagcagaaaacgatcaagtggagtgtgttaatgtcagcaaaggtttttgctgccacgaggttgaggcaaggagagaaacgtgtcccttggttagtgatgtggctatattcatcactttaatgagaataatgtctgctgagtgatggggctggaacctagattggagaaggtttgagcgaatggaaggtaagaaagtgactaaatgagtatagaaaactaccaagaagcttggctgttgctggtgaaagaatattacacaagtagggccaggattactgtcttgccaaacaggacagaacactaagcctctgtatttagttgctaatttattgtgacagaggagcatattgatctgtccccgtgattgtgcagttagcaaaacccaggctttgagaaaccctgtaggtcaaataccccaggctcctccacagataatctctgagggaaagacagagttgtggggagcatgtgggggttgtaccaggatttaaaagatacacggcaattttagaaattagcaagtctaaactatgatacctaaggatgcacacctgggtgataaaattataaagaaatggccgggtgtggtggctcacacctgtaatcccagcacttttagaggccgaggtgggtggatcacctgaggtcaggagttcgagacaagcctgaccaacatggagaaacctcatctctactaaaaatacaaaattagccgggcgtggtggcacatgctgtaatcccagctactccggaggctgaggcaggagaatcgcttgaacctgggaggcggaggttgtggtgagccaaggtaacaagagtgaaactctgtctcaaaaaaaaaaattataaagaaatacacagaggtgattactataagtcaaagagttacttgttcagggggaaggagggagctacgattgagtcagggcatgtggtggggtttctgaggtggccggcacagttctatttcttgatttgggtggtggttataagggtatttgccttatcataactcctcaaactctagaggaagaagtctgctgtgaagaaaagattaaggccgcggtggctcaaacctgtaatcccagcactttgggaggccgaggcgggcagattgctcgagctcaggagtttgagaccaggctgggcaagatggcaaaacctcgttcctacaaaaagcacaaaaattagccaggtgtaatggcgcatgcttatagtcccagctattttgggggttgagggaggagaattgcttgagcccaggaggttgaggctacagtgagccatgtttacaccactgtacaccagcctgggtgacagagttgagaccctgtctaaaaaaaaaaaaaaaacagcaaaactctcccccgccaaaaataaaaaaaaaaaagatgaatatggagggagttgtaaaattaaagaaggtacatgggtgcatgtgtgcttgtgtgtgtgtgtgtctgtctgtctaacaacagcagaagcaggcaagggctactgtggtagtcactgttgttcctctccccattttgcttcacagtttacaagtccttccactttctctctgaggcagaaagagcaagggtttttctctccattttatggttgggaaaattgaggcctgcctgagtgtgtgacttgtggcaagtcactctggtcatctagggcagaggctccccagatcccaggcctcctgcctccagtccccagcccgcagcccaggattaggcagagccagctgctttcccgtggctgccctgactccttacagggatcactgagattctgatgaacagaccttctgcccgcaatgccttggggaatgtcttcgtcagtgaggtaagaaagggcgggcgccagggtgggctggggatgggctggcactatctaactgggtgtcctctgtagctgctggaaactctggcccagctgcgggaggaccggcaagtgcgtgtcctgctcttcagaagtggagtgaagggcgtgttctgtgcaggtaggttctctctcctgcccccatctgtgctctgcagggtgcccaccagcctccaggggttgggggaaaccttagatcagcttcagcatgggactcattgttgccattttaccgatgtgaatgcagagactcagggaggaaaattcccttgcctaggatcacatagctagtaaggggtaggatagactttagtttgaacttggcctctctaacccttagatcttagttatttcggctatgccatgctttgttctgacccttcacgggggaaataagaaaatggagtccaagacgggtacagtggctcacatctgtaattccagcactttgggaggctggggcgggtagatcacttgaggcccgagttcgagaccagcctggccaacatggtgaaaccccttctctactaaaaaatacaaaaattagctgggtatggtggcaggcacctgtagtcccagctactcaggaggctgaggcaggagaattgcttgaacccgggaggcggaggttgcagtgagctgagattgcagctctagaattcctgggctagttcctgcccctctcggagcttcagtttccgcatctctcacagaagggctggaactgatcaaagatttccaaaggctctcccagctctgacttcctgtagtctaggactggaagagtctatttactctctactcctgctcacccctgcatctggcctttgaggaccccaccacggtcactcttcccgccaaggcgcttgcccacctgcatgccaccgtatcttgtgctcacttccgttctcgtttacttgacctttgacctctcagccttcttggaccttgctgactctgcctgtaaaaattagtcaagttttaattttcttattacttacatattttagaaattgtgggctgggtgcagtggctcacgcctgtaatcccagcactttgggaggccgaggtgtgtggatcacctgaggtcaggagttcgagaccatcctgaccaatatggtgaaaccgcgtctctactaaaaatacaaaaattagccaggcattgtggccagtgcctgtaatcccagctactcaggaggctgagacaggagaattgcttgaacccgggaggtggaggttacagtgagctgagatcacgccactgcactccagcctgggtgacagagcacaactccatctcaaaaaaaaaaaaaaaaaaaaaaaaaaaaaaaaaacgaaattgtggtgaaatataagtaacacaaaatttaccgttttaaccatttttaagtgtacaattcagagtggcattaagtacattcacaatattgtgcaatgtcaccgctatccattcccagaacttctttatcataccaaacaaactcagcctgttcagacagtgactcccattcccccttcccctccagcctgggtaacctctatggtactttgtctctatgtatttatctattctaaatacctcataccagtagaatcatatcatatttgttttttggtgcctggcttattttacttaacatgtcctcaaggttcctccaagttgtggcaagtgtcagaactccattcctttttatggagtaacattctattgtaatgagtagcattctattgtatatataccacattttgtttacccaatcatctgttgatagatacttgggttgttttcacttttggccactgtgaagaatgtccccaaatacattggtgtacaagtaccgtcagccctctgcatctgcaggttccgcacccacagactcaaccaaccgcagattgaaaatgttaacaacaaaaataacaatgcaacaacaaaaaataatatagataaaaacaacacagtacaacagtttacatagtatttacattgtattaggtattgtaagtaatctagagacaatttagagcaagcttgtccattgtccaaccctcggcctctgggccgcatgtggcccaggatggctttgaatgtggcccaacacaaatttgtaaactttcttaagacattataagatttttttgtgtggtgtttttttttttttttttaagctcatcagttaccgttggtgttagtgtattttatgtgtagcccaagacgattcttccagtgtggcccaggaaagccaaaagattggaacccctggcttagagtatacaggaggatatatgagcataggtcatattgcaaatactacaatattttatacaaggggcttgagcatccatggatttttgtatctgaggggtcctggaaccagtcccctacggataaggagggactgtatctgtttgagtccttgctttcaactcttttgggtatatacttgggactagaattgtatggtaattctgtttaactttttggaactggtttccacagcagctgcatgggtttacactcccaccagcaatgcaccagggttccatgtctccacatccatgccaactttttgttttgtttgttttaaaagccattctaatagacgtgaggtagtatctcattgtggtttttgatttgcatttgtctaatgacgatgagattgagcaacttttcaagtgcttattgaccatctgtgtatctcctcaggagaaatgtctattcaagtcctttttcctttttttttttttttttttttttttgagactctgtcacccaggatggagcgcagtggcacaatcttggctcactgtaacctctgcctcctgggctcacgcgattctcctgcctcagcctcaacctccctagtagctgggattacaggtgcccaccaacacacctggctaattcttgtatttttagtagagacactgtttcaccacgttggccaggctggtcttgaactcgtgacctcaggtgatgtgcccacctcggcctcccaaagtgctgggattacaggtgtgagccactgcgcctggccctttgcccatttctgaattgggttgttttgttgtttagttggagaagttctttatatatcctagatattaaacctttatcagatatatgatttacacatattttcttccattctgtgtgttgtcttttcttttttttcttttttcttctttgaaacggagtcttgctcgtcaccgaggctggagtgcagttggtgcgatctcagctcactgcagccttcacctcctgggttcaggtgattctcctgcctccgccacctgagtagctgggattataggtgtccgccaccacacctggctgatttttgtatttttagtggagacagggtttcaccatgttggtcttgaactactgacctcaggtgatgcacctgcctcggcctcccaaaatgctgagattgcaagcgtgagccactgcacccagccatttctgtgggttgtctttgtattctattgatagtgtcctctgatgcacagaaggtttccattttgatggagtccagttcacctttctgcagtgtcacaccctccttgtttgatgctcctcttttcccttgacttccttgcccgggttcctggtgtttctccttcctcgctggctgcctgtcctcaggtcttctttgctggatcctttaaccgcctgggattccgtaaagtgccattttcctaagggctggtaccaaccctcgccatctgcaggtgcagacctgaaggagcgggaacagatgagtgaagcagaggtgggggtgtttgtccagcgactccggggcctgatgaatgacatcggtgaggatctgggtgtggggtggaggagggggtttgggggtccctgccgatgacagtcccgctacccccaccagcatctaaggagagtcttctttctgtttggagttctgtgataagacagatgactcacccagggggatggaggaggatgaccgagggcagttctctcagagagggagttctggctcttcagcttttgtgtcccgccccaccctcagggttcaagcctggccattccaaagcagttaagtttccccaagcatgctttcaagttttgacaattgctgttacctttgcctgagataccccttcttggttacttgaacttttacttgtccttcaagccctccagtacctcctcctccaggaagccttcccaacccaccctctgagctttttattggagcactgatgatcctgggtcaataatgcctgatacacatttgtcttccccatgagactgagccccatgggaacaaaggctatgtctgattcattctgtgttcccagttcccagcacccagcacagggcttggcacaaagaaagggaggccccagggaggccagcggattaggcctgaacagggatcatccagcccatcctcccattcctcttccctggctgattctgtaactttccctaaagggaaaattggcttctgagataacctggctgcgggaagcagaggttgtcgtgagcagagattgtgccattgcactccagcctgggcaacaacagcgagactccatctcaaaaaaaaaaaaaaagaaaaaaggaaaaaaaagaggccgggcgcagtggctcattcctgtaatcccagcagtttgggaggctgaggcgggcggatcacgaggtcaggagttcaagaccagtctggccaacatggtgaaacccccgtctctacttaaaaaaaaaaaaaaaaaaatacaaaaaaattagctgggcgtggtggcgcacatctgtaatcccagctactcaggaggttgaggcaagagaatcacttgaacctgggaggcagaggttgcagtgagccaagatcatgccactgcactccagcctgggtgacagaacaagactccgtctcaaaaaaaaaaaaaaaaaagaattaagataacctggctgaggttccatgtaatgtccccagacctgggtccactgaggcctctgtcccaaccagcttgcccctccccagccttgagtctctgtcctggtcccaccagggctttgcaggctgagcctttcttcctctccacagcagccttccctgcacccaccattgcggctatggatgggtttgccttgggcggaggcctagagcttgccctggcctgtgacctccgagtggcaggtactgggccaggactgggggcagggggtggggctagggagtcaggggtgagtgaaacagggtgagtctggacattctgcagtcagccactgttcttggcttccaaccaaaagcaaaactaaggcaaggcagagcacagagggtgctcaggcagaagctgcttcccctcctggtgcagccattagctgctgtagtatctgtgacctgtcagaacctgcttccttcattttgggaatatttgaccaacctcagagcaattgctgttacgagccaaggaggtcaaagagcaatgtccagtcttcccattctgtccaagtcagatttatcgaccatgtttcggaaaaaggtgagcctcagggatagtttgtcaatggctgagctaatcacaaaggtgcctgggcaggaatactggcaccagccaaatttgcattacttgttctgagcaattgagctttgtttgaagaatgggaggggataaagaagataactgatcattttctcaggtgactgacctggtgattaggagcagccttcttggatgcagttaggcaaagtctgaatgtcttcccttctccccccaccgctctctcctgccaccccaggagcaacatataaaaatgtgtagctccaggcatgaaagtagcttctgtctacacaatgcaggtcaaagagaaggaactgaccaggtgtccaggcaccaaaataccaggctggtctagccccaactctccttctcacatgcccacgttcacgcaactaactcacagggttttggggaagactaagacggagtgaatgtaaaacccactcccttctgcccacgttcacatggtccatgctgagggaattcagaaaaggagacagacccgggggggtgcgtcagtcaaggcaagtttctcgaaggaaggaagcagaactcaggaggacatggactggaacagtcagggcaatttcaggctgtgacaaagctggaacggacgactgtagcaggagcaggagtcactgacattctaggccaggccagggctaagccagagaacctattaatagtaatccacaaatagatatggggcacctcctaggaactctccttgttccaagcgtcgtacctcgtgtgatccttagcggctctctgaagcagacagaagagggccagccatctttcttccacctttgaggcttgggaagggtgagacttgctggtgacttacaactccatcaaaggggcatggtgaaataagggcctgggctcctgacttctgggctagggctcttccaaaggcagagtctggagaggcctggctgtggccagaccatggggcaagtggctagaggggcgagtagacagcagaggcagctgtggcccccgggattagcactgggggaccggatgggggagggaggcctcactttgttctatctgagcagcttcctcggcagtcatgggactgattgagaccacgcgagggctcctcccgggggcaggtaatcgcaactacagcacccgcccaattccaccccatccagggtccttcgctgctttccttttttgccctctgttctgggctctgccctcccacctgaaccctgctcctctgagaagtcttggctgagtcccaggctgagccttctctgggttcccacttcccatgctgattcccaccctgctccctccatcctggtaggagggactcagaggctgccccgttgtctgggggtggccctggcgaaggagctcatcttcacgggccgacgactgagtggaactgaggcccacgtactggggctggtgaatcacgctgtggcccagaacgaggagggggacgccgcctaccagcgggcacgagcactggcccaggagatcctgccccaggtgtggtgacagctcggcaccagaaggagggctggagtcatgggggaggcatgtgtggggcagggtgtccccttgggctgcacatccattctcccagagacatatgattaaccctctttggagtttgtttaaccatccagtaaacacaatcaagtcaaattttaattctgaattaaaatgtaaattgaattccaaagggctggaaccaaatgggcttgaaagccctctgaatgtaacactgtccagtagaccattctgagatgagataaatgttctatacttgtgcttatccagtatgggagccactagccaaatgatttaaattgcagaaaatgaatgcagttcctcattcacactagccacatttcaaatgctaatagccacatgtggcttgtggctactatactatatagcacagccttaaaatcccccaaagactgaaaaagcaagattctaaaatagatacagaacttccaacccatatttcctaccatactgcctggtgggatattcttgaaatacaacatgtgggctgggcagggtggctcatgcctgtaatcccagcactttgggaggctgaggcgggtgtatcacgaggttaggagttcaagaccaccctggccaatatggtgaaaccccgtctctactaaaaatacaaaaattagctgggtgtggaggcacgcacctgtaatcccagctactcaggaggctgaggcaggagaatcgcttgaacctgggaggcggaggttgcagtgagccaagatcgcgccattgcactccactgggcgacaggacgagacttcatctcaaaaaaaaaaaaaaaagaaagaaagaaagaaatacaacatacaggacatgtattaagcatttttttctttgaagagatagggtctcgctgtgtcatccaggctggagtgcagtggtgcaatcatggctcactgcagttttaaactcctgggctcaagtgatcctcccgcctcagcctcccaaagtgttagaattacaagcatgaaccaccgtgacgggccaggctcatgttttagccagatgtggtagttcgagcctgtaatcccagttatttgggaaaaagcattgcttgaacccatgaattcaaagctgcagtaagctggtcacgccactgcacttccagcctgggcaacaaagcaaaatcccgttgctaaaaacaaacaaacaaaaacaaaaagccaaaaaaaacaaccaaaaaacccctcattaaaaaaatcctcaaatagcatgggaaagggtgagggataaaagactacacgttgggtacggtgcaccaaaatcttagaaatcaccactaaagaacgtatccatgtaaccaaaagccacctgttccctaaaatctattgaaagaaaaaaattaaaaatcctcaaacaataacctctcagcatggtaccccaaagggtaccatgctcagtagggagcaggtcaggccctgcccaggtacaaccctaccagctgcagggcccaaagccctcagcagggatatctgggatctggctgtctggggtatccaaggccctgcgagggtctgctggcttctcccaactctcagggggcccaggatacagggggttgggtacaggagatcccaaatttccataaagattaaaagtggcttaaatggagctaagttagactaatttataataaatttgtcttagcctataatgctaggtaccttaatgtagtatctcagctcttagaataatccagttgaactgattatccccattttatctgtgagaaaacccataaaagttcagtgacttgttcatcaaggtcacaaagagtgattgtagtattagaaaaaaaaacaacaccggtattttggcatttattttgcacaatacagaatgcaatataaaaaaggtattttaagagagcaaaatatgtacaaaattttaaaaacaaactaaatatttaatgtatttcaaatacaaaaatttacaaatgtcacaaaacaaagttaaccatacatcattttaatattgacatatattgaattaatcatataaaagtaaccattttggcttagcatggtggctcacgcctgtaatcccagcactttgggaggctgaggtgggaagactgcttgagaccaggggttctagaccaggctgggcaacatagtgagacctcatttgtattaaaacagaaaagaagccgggtgcagtggctcattgctgtaatcccagcactttgggaggtcaagacaggaggatcacttgatgccaggagtttgagaccagcctggccaacatggcaaaaccctgtctttactaaaattacaaaatttagctgggcatggtggctcatgccttttattacagctactcaggaggctgaggcacgagaatcacttgagtctgggaggtggaggttgcagtgagccgagatcgcaccactgcactccagcccaagtgacagagcaagattctgttaataaaataaaatagtataattttgaacaaaaatcctttctttcctgtctctcaaatgtaaataatcctaatacttcttaaaacagatcttctttaatttggaggtgagggactatagctttttgaaagcatttgtcttttttttttttaagcttcatcatatataaatgaagagtctgatgctattgcctagacaatattaatgctgtcaagtttctattatacttggttagaaagtctccgaactaatacagaactctgggtcactcaatggagtggctgattgcagctttcatatctagacctgtagactatagggtttgtctttttgccttaactaaataacaatcacaaaataattcagatttccaaatatactaaaatattggtactatataattactgatattttcagtacttaaaagtagctttgtataccaaaacaccagtctaccaaaaacaagtactggcatgagtaatcccagagttgagaccttctgggtcaacctgaaaaacaaaacttcaacttccacctatgttactgggtgctcagaataaaggtttccggataggagagggccagggatggtgtagatggccaccatctagtggacaaaccactctgatagggtagcaaatggttccagagttttctcagcccagaaaaaaactgtcaatatccacagtttgcatcagatttccttcttaaatagtaaatacacattacactttgagaaatggattcagctgtgttttttttcttttctttttagagacaggatcttgctctgttgcccaggctggagtgcagtggcacgatcatagctcaccacagccttgaagccctgggcctgagcagtccttccacctcagcctctgaatagctgggactacaggtgcaagctactgacttggctagaatttggctgttttcactcacaaacatacgtacataccgtttttaactttaataaaaggttactttatttatttatttatttatttatttatttatttttgagacagggtctggctcttttgcccaggctggagtgcagtggcatgatcacagctcactggagcattgacctctcaggcccaagtgatccttccacctaagactactgagtagctgagactacaggtgcaagtcaccacgcccagctaattttttattttttgtagagatgggatctcatgatgatgcccaggctggtctcaaactctttgggcaagcaatcctcctgcctcagcctctcaaagccctgtgattacaggcgtgagccactgcacctggccaagattacttcctttattgggtagttacctaaataataacacatatggcaagcaaatctaaaagaacagaggagtaagaagggcataaggtaaaaatcaaaggcaagatgaccagctagtcctggtttacctgtgactaccccagttttaaaagtggaagtcccatatcccagtaacccttcagtcacaagcaaacccaaacagcccttcatttcccaatccctctctctccccagatcatcactattgtttccatactcttccagaaatttccattgcatatggaaggacgtgtattatgcacatatgcttacatatttaaataaattccttttaatggcttagaggacaagaaatatctttcgaggctaatctgtttctaacaaattttaaaaacaaaatttaaatatgcatagtaaggaattcaaacatggaagaatataaaacaaaaccttcattttatataacaaaacatttataaaccttcgtttataaaacaaaacaaaggtttggttttgttttataaaggcacaccagcattttgccagtttttgccaaattgctctcctgtggcatactcttttacttttctatcaataatgtatgtaaatactggtttccccagtctcggcagtagtaggcatattgatattttagtatttgctggtctgaggtgaaagggcacagtacctcactgttttgatttgcctttcaagcgtgtagcagctgctggacatccttcacgttcgtacttcttttccggtggaccttttacatactcttttgtaaatggtttaaaagttactttatactaacttttttgtaaatcaaggaaattcatctgtcataagcattgcaattctttttcccagttttttttttttttgagacttttcctgagaaagttttataaacacttcaaataatatgatataggaagtaattcctccttgcctggaagtggggctgagactggagtgctagggctggtgtggaaccaaggccagtgacaaagcagacactgttgcttctatgtggctgtattaaaatgcacccgcccctctgcactgccccacagaccaggatttcaacacagccctgtcgacttgaaagcccaagttcctaaccctgactttgtttcactctgctggggtaaaaccttaccgcagaggctggcatttgctgaaatgaggtcgaggaagtgggaaaggtggttgggagtccaatccaagtctcaccaatgattggataaacacagccaagtgcttcacctccctgcactgcaatctcacagctgtaaaatcacagctgggtcatcagtgatgacaccagcctagaagtgtgggtagcaccattagatgagtctgtgggggaggaaagcactttgtaaactagttatgttgtgcatgttggaaggatgggctgaataacaagaaacccaggtgttcagggatcagagtctggcttctttcatgatagaaaaagaacctcagctaacaggttataggactaacgctaaagaaactgtcagcagaatggctggaaccagacccagacatctgcctccctcctttaaaacaaagctgtgcacctcagacctgcaactatcagccttgatgccctcctcaaccaagactttttgcttttccctaggcccccattgccgtgcggctgggcaaagtagccattgaccgaggaacggaggtgagagggttttgggttgggacttgggtccactaaagttggtcgcggctgggacacagtgctttcagagctcagacagcacagctgggaaaaactcaggaagtggactcttctaacagacttgaactctgacctcgtgctctacgtcagtttacacatctgcaaattggccagacagtattattgtttacattctatcctcatctttctcccttggagagaggatgagattgaggttaagaaagggtaaatgatttgcccaaggtctcagaggaagtgagtagaaagaacccgggtctgtgtggctgccagtccatgctgcaagatttgtgctggcagtaatgtggcctcagggcagggcttggggtgatgccttgggtgtggctaatccatctgtccacctcaactctcccatctagttaatccatctgtccacctcaactctcccatctagtcactcatcacacactgaatccagaacaaagctgggaactgggatacagatggatgagttaaacatggtcactgcccccgggagggggcagatacagacacaaatcaaggataatggtaccacgctgacaccccagaaaggttagagctttgcggtccattatgatatccatgtgtggcttttaaattaaaagtaaaatgtggtcaggcgcggtggctcatgcctgtagtcccagcactttgggaggctgaggcgggcgatcacgaggtcaggagatcgagaccatcctggctaacacagtgaaaccccgtctctactaaaaatacaaaaaattagccaggcgtggtggcaggcacctgtagtcccagctactcaggaggctgaggcaggcgaatcgcttgaacccaggaggcggagtttgcagtgagccgagatcgcaccactgcactccagcctgggcgacagagcgagactccgtctcaaaataaataaataaataaataaaataaaatgttcagtttctccttcacgctaatcacagttcacgtgcttgacattcacatgcggctagtggctaccatactgggcagtgctcggttaaagactgttttctacagttggactgtgggaaggataaaaattccagaggaaaagtatgggcaaaggcacagaggaggataagcaagcagctcgtccagatgagagtgagggaagaagagagagtgcaagttcgaggcactaggctgtctgggttcaaagacctgctcttccacatactgttgtgaactttgacaaattatttcacctttctatgcctcaggtttctcagctgtagaatagggatactaacccttgctgtgaaaattaagttcacacacacatggtacttctcttagaatgaggctttcaagtgccagtcagtgggccctagaggctggagcaattgccagggcccaggtcataaaggttcagaaattaacgggtgacaggaagcgtggtgaggcagccggatgggaaggagaactcctcttctctggcaaaatgtctcagtctgtctcgtttctcccagcagttttgtcatagttacgaatggtgtttcttctctaggagggaaattccttctcatagctatctctgctcatatagatgtctgtaggcaatagggtgggctggcttccagtgtgggtgaagatggacaaggtcagaccaatccagggagcacgtctttcttgcaggtggacattgcatctgggatggccattgaagggatgtgctatgcccaggtatgtagcaaccagcccatgcctgcttgttaacataggctgggccaggctagagggactttgtatggtacatgaccaattttagaaggttcttctcaacacaaacagtctgaccgcatccatcgtccctcataagtcacctggagtggcttgaggagagccatagtgcttctctctgggacttttccctcaaccatctaatgtactggggttcatcctgcccacttaatgccgagaatcacagaacacaggtccttaagaggaagaaccacatcttttgcctctgtatcagatgccactgtaaagttcaggatggagttgggaggtcaagggcttggttgtagcctgcaggctgtgttcaatgtaggggctgtacacttgggactgacctattaaatctcttactcatgggtgagtaaaaaatgctaatctccacgttaacagatatccaaaatactcctaaggggtcctgggacttggagaaactagtgtgaacctggattcaaagccagatttcttactgcaaagaatttttttctctactgagcagcctcatgtcagaccactgcagacggcagctgagttctcaggaggcatgaaagcagtgtgcaagtggaggctaatgctgatggggcacagagaatacaaaggctggcctgtcttccccaggagacaaagcagccacggaggcttatacctttgcatgcctcaagatcagagtccagagacaatggaaacacttggaccctggccttgtcttgggctggacaagcttaagcaactctttttgggcctgtggccctgctcccccaaaactaatattttgtaccttgttgcagaatattccaacccgggaccggctagagggcatggcagccttcagggagaagcggactcccaaatttgttggcaaatgacccccattttaaccttcagcatgggagatgcatgccctgaagagcaggatccagaaggaagatttgtggccagattgccttcatcatttcacctctccagacttccatttcttcacaaggatgatgatggaaataaaatgactggcgtgatgcctggaaccaaggtgctgatcctaccacctactgctaccttccttagcttcaccctggctagaaataatcacgagggttgggtttgctttggaaaatgcctgtctctctacttgaatgataaagaattaaattagatctctctgagtcttggtatcattggctctcagcccctgacctctctcagttatcaggcactcattagagatgtcagaagattttaagatacccctagtttcttcctgtgaacaacagaggtaataaataaactctgacatcggttgaacatgtgtcaggggtcagactgcagatcccagtctctgccagttacttgctgtataaccgtggacaaattgtttaaatgctctgggcctcagcttcctcac

SEQ ID NO: 500 - DNA, 28868 bp, Homo sapiens
ggcatatcctatctcatgactatggtaacttcaagcattacatcgtcacgcaactattcaagcctggatgaaaggtaggcctgctatctaccagggagtatactttttcccagaagctcccccacgtacttcctcttacatctcattgctcacaggtctacttttgtgccagtcgctatcaaggggaatgagatattgtgcttggcttcaaccaatcttagttcaggctctggcaacttggggaaaagcccaccttccttaacatattacccaagcaaaattagatttgcataaactgaagaaaaaggggaaatggctatggaagacaaccaatagtgtctgcttaagttcaacttgacactatgtgtccagagcataaaattatgcctctgttctattttagtatctatactaggaaagtgttaaccccaagctcagtgtttctcaaactgtatgtggtgaagaaccagcttttttcccctcaattcatcacagacccaacactaggaaaatgaaataaacccatatagatttaaaaatatgctatacaaacccagaatttttgttagttcaaaggccatagtttctctgtgaaattgctataaaaaatgtctaaagtcacaatttctgtccttaccccagcatgaaccagcatggacaagtaacaaacagtttgaagaccaggctgagttcatgaccacacttgttgactctggtgacttcataagatggcccccgcctgcctcgcctgcctcttgtctgctgctccttttgattcacctacaacaagctgttctctgttaccagaatatgccacgtattttgttttacttctgggactgactttacaatctgttctttcttcctggaatgccctcctctagctggggaaaacctactcatctttttagaccagattaaaagtcaccttccctgtgatgttttctcgtggaaaaaaatatttttttaagagacagtggtctcactatgttgcctaggctggtctcaaactcctgggcacaagtgatcctcccatctcagcctcccagaatactaggattatagacataagccatcacgcccccaacctcatgaattttagttaggttatagcagtatagtaaaagtccctatggattgaattatttgctccctcataagtgttttttctttgaatcctaagtacacttattttattggattacagtttctgagtcagtatccgggatagactgaaagtttcttgaagtgataattgtcttattcatctttatatcccctgttcttggaacacatagtctgtcctgaataaatgcctattgaattgaatcagctcaacaaatgagaaaacttatgtttctttccttttttctttcccagttgttttttattgtgttctgccttcatgtttgtgtatttccttataagaacataccattttgacagacaatacattttttctttccttttctatcaaatctggacttacacaagacacaacttttcattgttgtgttctgatcacaggtcctatcctgtgggcatcaatgtcactattactgcaggccactattactgcagtgtaatgtcactattacatgcacccatgattctctgacacgtatgccaccctggcaatgtactcaaatttccagcagcaatagatgagcttgtatatgcacacatgtaaactcccaaaagtacctggtaggatgttattaatatactgtagagaatatacaattcagagacacactgacctaggctttaatccttattcacatactgactagctttgtgaccttgggcaagttccttagcctctctgagcctgctgcttctattaaaacaaaaaataggtatagtaagataacataaaacaatagctgcttgataaatgttagtcccctctgctgagatagcacatatgtggattgacaggaaagcaggctgagtgcagtctggacagcaggacaagtgaaccatagagttaatgggtctgcctgtctctttaatgggtcagggccaacctatttggcaggtctcctaagaaagatgagctgctttgaaattgtatcttgggcagagctttggttgcttcttcatttctatgcttctgacttccctgcttacagctggcagggacagctactctggaagctcaggggctgcatgtctgtgatagaaggatgagcagctgctgcttgttaaagtaggggggttgtttgggaggcaggcaagtgatgtaaaaacagtatatggaaatccccaaaccccactgttaaaatgatgtcaggggtccaaatcatgtccatggagtgacctcagtgacatttcttctccaaatactctagctctttactgatttttttcctcttaacttagaaaggaggaaataaggtatatatttgttggtcagatgattttaatgaggttaagaaaaaactggcttccttcaacatgccatgcattttcatgcctctgtgcccgtgcttctgctgttctcaccactagaaatgctgttctccccactagaaatgctattctccctctacctgcctggtgaattcaacccctaaacctcaaattagaggccagcccttctttgcatcttccctccctgatgccacccttccttctaggctgccaccatccttcaaagttaacttggttgttgtgcttcacatactgaactgcctttgttttttgaggtctctttaccctaacagggtgaaagtttctcttgaggatctttgatgcccaagggcttagctcataaaaggcactcaataaatatttgttgagtgaaaacatctccttctcaccatatttgacaattttgaatttctcataaattttcatcaagttatagcagtatagtaaaagtccttatgaattgagtccttgattagttctgggaggttactgagcaccccgcctgtacttcaggggcgataggagtaatgggagtaagtgctaacccagcagcagggaggaagaatcaaggagtcatttggaatccagagagtcacatttctttttctttctttctttctttctttctttctttctttctttctttctttctttctttctttctttctttctttctttccttccttccttccttccttccttccttctttccttctttcttctccttccttttttttttttttttgacagaatcttgctctgtcacccaggctagaatgcagtggcacaattttggctcaccacagcctctgactcccaggttcaagagattcttgtgcctcagcctccccagtagctgagactacaggtgcccgccaccacgcccagctaatttttatacttttagtagagacagggtttccaccatgttggccaggctggtctcgaactccagcctcactcaggtgatccacccgcctcagcctcccaaagtgctgcgattataggcgtaagccactgtgcccaactaacatttcttagcctaatgtttgcatactccagctttatctcttggcagcccaaagtagattcctaggttcaaccagaagttccttgaaaattgtcagacttcatagaagtgtggagttgggagtcatggatctagtactgtacttccacttactggcaaaccccttgggacagagtattaagtttgacagacttgggttcaaatcctggctctgccacttagaccatctgtgggagcttgttacctctctgagcctcagtttcttccagatctagaaggagaataatatttattttgaaggattgttgtcacaactaacttataagtgtataaaatgcctaatctaggtttggcacttcatgggtgtttaataggtgggaattataatttggaagcaccggagtgggtgggatgatgatctgggcaatgtattattatttgtttactattaccagatccagatatatgcaggggaaagccagcttagaattcaaaaagccactttacatagctacttttgttaaatggatgtcaaataaatacataatgatatttgcagtgtgacttaataaaggccttcagggggttttccagctttcactgttaggattttttctgataatagtcccatactttcctactctgatgtgtcctcactcagaagcactgtctggctctccccaaagggagctcgggacagtttcctgcctgaggtgttcaggtgaattctgtgctcacttttcctttctctctccttgtctgtctctctgaccctgaggtcttatcttgtcctctgggaggtatgttaagtgctctgccaggctgcctgtgcctggcctgttttttctcactgccagtacctcttggattccaattccaaacatggtatccatctggggtcaccctttcttccggtgccaagagagaacacattccaaatggaacacaaatgtgcctcccatgctggctctcctcattctgcttgggaaaaacagagagcaggatgtggccgcatcatcccacgctgctggacttttcagtcctgtagtgctactttcccttgggactatttaggtttttctgctaagaaccaaatttgaagactcccaagaaacatggaaccaaggaagcttgccagagctctgcagggagagccagagccttgctgagacagcgggggtggtggggaggagagagggggggagagggggagagagagagagagagagaaagaggtttttaaattctccatgaagtgtactatgttccatcattccttcccaaagccaccggaagcattccttctaggaaaggtggagtcggtagtgagaagccggaggtgagaagacccctgagcggatggattcattcattttctgaatttcctatgtgaggacagtattagagcccagtgaggctttgagaggccccaaagatgagcgccaacagcagcagagtgggccagcttctcttgcagggttcagcgtgcattaggtggaagcaggatgtggaaggggctgtctaccacctagccaactgcctcttactcctgggcttcatggggggcagtggggtgtatggatgcttctatctttttggcttcctgagtgcaggttacctgtgctgcgtgctgtggggctggttcagtgcctgtggcctggacattgttctttggagcttcctgctggctgtggtctgcctgctccagctggcacacctggtataccgcctgcgtgaggacaccctccctgaggagtttgacctcctctacaagacgctgtgcctgcccttgcaggtgcccctacagacatacaaggagattgttcactgctgcgaggagcaggtcttaactctggccactgaacagacctatgctgtggagggtgagacacccatcaaccgcctgtccctgctgctctctggccggtaagctactctatccattgcccagaatttctttccccagcccacacttctcatttcctagtgtgtccctttccatttcatgtccctttccatttcgtgtccccttccattgagggaaggatgtgacaagtcaaacaaaccaaaatagatttttctaagagtggggttgcttcctctttcttggcattttccaagaagaaaccagttcatgaggcatcttggttggcaagaatgattgtatgtgcacttgctgctggaaggtgtgcagtgcgtgtgtcttgagcctgggccttaaataacccctctaccatcaccacacacatatcagtgtgtcatgcctaagctgcagcaatatctctgtaagctttgaaaaactaacatttcaataaggttaatctgttccttactcaaattcaacatttgctaagcaccaactgtattcagggaacaatgccagaaatgggaggtcgggatagcggggtggttctcataacccctgttccctgccaaggcatcaagcaaacagccccacttgtgtttggggtagctgtatgtagccaggtagggagagtgaataccccttgcccacctttccatttccagttgttctattgaggttcttgaagactaagaagtcaagtacagtactgtaaatctgagggcccaacaatgggagaagagaagtgatacacctatctcatcaaggcttttgtggaagcaccgcctcttttggagaaggctgacagtcagatatgggcagaaatggtcttagtcaggatcagtgtatgcccagtcaacctggatgtgaatgttgggcattgatttcttctgagaaaacatcacggggctctgtgctacacacttagtaggcaattgtggatttttttatactgccctagtggctcttgagccccacaacccccactccaccagctttcttgagaccaggagaatgtgatagaaaaggtaagatggcaattagaaggctccaattccaagaaaaaaaaaaaaaaaaagcaaatccagataatactgccaaccacacaatggagaaaaaagtttgacaatgatgctaatggtactacaactaccactaatagtaataatacgtgtttgtgtattcatttatagaacctgaagtatcatgtatatatgttttgattttgtttgaactcagaggtcctggatagagtgagctaggaggggagacattttgtgagggtacatttcatttcatttattggtgaactgaaagtgtaaaccaatgcgattatttgtaaacagatatagatgtaaatacaaatacatataactattgtgaaaatgtttgcacctatagttccatgcttaaagacaatttagggaacttgctcattcatgagacccatgatgttatagctcgtctgttcaaaggaggaaattgagagcagcagaagtgctccctccagtgtagggtgcccatttgctggaagcatgtatggttactgtatagttcagttaggatagatttactgtgaacttgtataagatcacttcccagtgaaggggagaggggggcttgcccttggtgtagcttttcctggtatacttagcatcaaaaggctgagtcagaaattagacaattttgatttttttttttcctgcctttcaaggtttggagtaagagttttgttatctttcagtgtcaccctgtctcagctttgctgagctggacatagaggaaaaggcttctagtctatgactgggctctagttttaaaggagaatcactgaaccttgggctggttacagtaagggaccaaacatctcaaagcagcagacaagaactttgtgccaggaagtggggactcttgtgcagacttccacatctcacatgcacactgttctctagagtccttcactcaaacctcagaagtctttttgttttgttttaataaaggaaaccaatctctttcaaaactcagagagggaaagtgactttctcaaagtctatcaccctgttaagcagcgcttaacttagacgtttctctcatataaaattcaaaacacaaacttccatatatacaaccccctgagcaggcaactaactatctaagctattcatttaggagaagatcatccatcttccagtagatcaagaaggaagaagaaacagatgataaagggcacagcattccgatttaaatggcttcagcgagccacgaagatcattagacattatctacactctacggttgtcactctttggtggcttgcctgggtggccgaaatcctcgcctaaggagctgacatatgctgcagcagcgccattctcttctgctgtcttcctttgctatggaagcttttcagtgaggttttgatccccttttatggtgacacaagtgagtttgttccttggtttcctttgttcatttattcatccttactttcttgcttccttctttccttcttttcccccttccatacatatttattcagagtcttgaataaagctcctgtcttccagctttaggttgtcagataataggtgcaattgtttttttaattggtgctggtctttggtaatttgtatacacgcatgtatacctaggcattcattaagagcaaggctcaggagtgctgatatcccattggccaggacttatcacttgcctatgcctagcagccagggaagtagagaaatgttgatttttttctctgcagtcatgtgtccagttaaaatctagcaccattaaggaagagaagaaagcagatactggagaacagactgccacactggatttcccaggtctttgttcattctcatctttatctgcttctcaataccctttgcatccctcaaaattcagctcaaatgtcatctccttcgagaggtctgctgcccaaagagaaccaatctttctctctcctctgttactgttccacaatagcacctatcacattgacttgcagccagttatttatgtgcctgtgacttccactaaattgtgaaatcctcaaagacaaagaccagattgtgcccatctctgcattcccagatctccagaaacatgagagatgctccagaaatatttgtttagccaataaacctccagaaataatggaaggatatctcccccaaatgaacaaggtgtaccttagagatctttttcatcttccccctttgcctaatagaggcacccctattgcctgatataactcactttagaagagaggttaaagatgaaactctgagttttctgggcaggggtcgggttgggggaaggataaagcccatactggattctaatcttcttccagatgtggcctcacatctgaaatacactccctgtcctcaggcatcatcaatgacatgccatcagttctaacaagttctcatggaatgcagtctttttaccctgcaggggcagagcactaggctaggtacagccacaagggtacaaaggcaccaagcagcaatagtaaggctcctaaccccttaagttgtgaaaccaagcctgtggtcatgggcaagtcaagagcagttaatgacttaagacttaagacttaagaatattcataaaattaaagcaaataattcggatttctggctgcagccacagtaacccactctagccaacagaagggggaaaaaaggtctttatttaaaaaaatacaaggatttcttatgaaactcaaggaaagacatgcacctaagcctcaggtagtgctagaaacaagaacatgtcctactaggacattttatgtgatttcaagtttattttctctatagccaattgggacccatgcttttcaaagtctgagttacgtgataaaaaaaaattttttttagttccttcagggaggagtgtgttagttttgttaataatgcctgataattgtccccatccaaggcatgatttacacgcaattccatttccaaattcccagggaaggagtttgattggctcagcttgagtcaggtgttcactctaggaccatcagctggatagggtgcatgggatctcattgtctaaagaaacaagctgttattgtcacctacggttagagaggtccgggaaagggtcatgctaggagagtccactaccatctacccaaagctgtagtaatagggtggcaacatggtgttgtgctaagaacatagaattttagttccgccacttgatcgctatgtagccttaagctcgccactcaacccttctgagcaccagtttccttagctataaaatacagaaaagaataatctaccttgtggtgttgtgaacattatataagagaacactggtaaagtgtctagcagagtctggcatatggtagacttgccacttccttcaaagtctacaaagtggttaaatgtaagcatgaatcttcatgtagctaatgggaagggagaaaggagaatctgtggagcagcggatccaacagaactttctgtgatgacagaaacgttctagatctatgttgtacaacatggtagtcacaggccatatgtggctattgaacacccatattgtaattaggtaaggaactgaatttttaattttatttaattttaattaatgtaaatgtaaacttaaataggcagcagcattcttttctctttttttgagacagaatcttgctcttttgcccaggctggagtgcagtggtgtgatctcggctcactgcaacctccacccccgagttcaagtgattctcttgcctcagcctcccaagtagctgggattacaggcacccgccaccatacctggctaatttttgtatttttagtagagatgggggtttcactctcttggccaggctggtctcgaactcctgaccttaggtgatccacctgcctcagcctcccaaagtgctgggattacaggtgtgagccactgcgccgggccagcagcagagttcttaagcagtagtttctatcttggctacacattagaatcactggggagatgtaaatactaataatatccagttcctacctagagagattcttgtttaattgctctgggataaggcccaagcctaggtgcttttttttaaaagcttccctgggacttctactctgcagcctgaaattgagaaccaccagtaaggagaaggaggaggaaaaatgagggttctggaagtctcaatgggttccttttctgaactacttgcatgcagtaattaggctggctagtctagctttgggttttaccatgctttaggcaaagtatttctacaggaagattcatgttaatcagcgacacctaacttcagcataggtggcttggagagccattttccttttcccacatgatctcttctcttcccttgccagggttcgtgtgagccaggatgggcagtttctgcactacatctttccataccagttcatggactctcctgagtgggaatcactacagccttctgaggagggggtgttccaggtaacagggagcctggtggcagcaccgcctcaccccatcccactgtagcccagcaatatccgtgcctccatgtttcccctcttacatctgtccttcgcacccctgccagtgtgaagctacaggcgggggcactcttcctctgaaaagagttcctgggctcctagccataggtgaggtagggtaggaagatgctggcccctgggtagaccatgttacttgtatgcttaaactcttctggaagaccctagtgccacaacataaaaacccacacttgttatagggtaacttaaaccttttagtgctctctagtcgcatttccagctctccctccttcatattttttgctcatactagccatgctgaaccactagtacttccctaaacacaccacattgttttgcagctctatgccttggcccctactctcccctctgaaatgcatttccccttctagatgagaccacggaacctcacttccactgtgaagcctgcttccaccccacagcctcaccagcttccaccccacagcctagcactcctgtgtgcctgttctagtccttttacttatgctaactggtgcacatcttgctgtctgttctaataatctggtctcctttctgtcttctgcacagtgaactctgaagtacaaatctaggcttttccctctctgttcccagactctaaaggaaagtacctggagcacagcagctgttcagtaaagaattgcttgccgggcgcggtggctcacgcctgtaatcccagcactttgggaggctgaggtgggtggatcctgaggtcaggagatcgagaccatcctggctaacacgatgaaatcccgtctctactaaaaatacaaaaaattagccgggcatggtggcgggcacctgtagtcccaactacttgggaggctgaggcaggagaatggcgtgaacccgggaggcggagcttgcagtgagccgagattgcgccactgcactccagcctgggcgacagagtgagactccgtctcaaaaaaaaaaaaaaaagaattgctgaactggtttgccactgggcagctggtgtcccagaggactccatggggcattcacatacatgctccaatgcaggttcctggctgcctggcccctactcttcttatctctgccaatccctcaggctttggtcactttctttgtagctctcacttattgaatggctagcatgtggcaggcactacgtatcatattgcctcattgattctcataacaactctatgggttgaatatgattattactccatttaacaactgaggaaactaaggcccaaaaacatcaagtaatttgcccagggtcttcagctagaaagtgacaaagccaagttgcctggatctaccatttctgttctttattaaaatgggaaggtcaccagaagagtagagtttacacacacacatacacacacacacatgcacacgcatgcacacacgcgcacacacactcactcacccttttaaggactcccctgcctggatagtttgctggacctggaaacactggattccatgtgtctcctactacttttatcagggagtccctcaagccaacatatgagccaaccccggaacagacacacaccgggcagtgctacctggcagggcctgcttctgcccccaccctgacacttggctctgtgatgatggagcctgagaggcagtcctgatcccactgccagggtcaccagccacagatccacttccatcatgttcctaccctgacctccgtccacacaccctccctaactagtccagaaaccttcttcaggaactctctcaggcacatgagaacctccaggagggctcagtcaggacctgagccagctggaccaggcctctttctgacactgacacggaggaacaggtggtgggtaagccgggtgtcctcccctaagttacgctcaagaggaagggctgtaacctcacatggcctctcagcctggaatgtaggtatggtcatgttcctcccatttatatttttagcgtgtacctcctttgggagtaatgagagccacacatttgctattggctgtgtaaagtcccatttcctctttgcaaatgtcaagtgttatcttaagttagagttcatcctgtccttgccttttgcaattacatagtctttgttgactgagagcaatccacagtgacagcctaaattataattcacattgtacctaatataaatcaatcagcattccagcacacctctcgacaattcaattaagtcagaattcattgtgtgttcggcactgtgacactcattagtcaccaagaacacagcacaggagggatcacacagaaatcatcactgtttttctaatttgcatcctatcttactggacctaagtcctatttacataggttatctcatttaattcattcaaccaacatctgagatgagtattaaaaaaaaagctaaatacttgtcaaaacgttacaacagatatgtctatatatatgggagaaccaatcaagaagcagatttcaggaggacctttggggaaggattttatacaggacatgagaaagcaacattagaggctgggcgcggtggctcacacctataaccccagcactttgggaggccgaggcagttggattatgaggtcaggagtttgagaccagcctggccaacatggtgaaaccccatctctattagaaaatacaaaaattagccagggtggtggcaggtgcctataatcccagctactcgggaggctgaggaaggataattgcttgaacccgggaggtggacattgcagtgagctgagatcacaccgctgtactccagcctgggtgacagagcaagacttcgtctcaggggggcggtggggtgggggaagaaagtgacattaggttgttttgcaatatacaagattggctgtcttcccttgattcatttattcacttcaataatatttattgaaaacttagtatataccaggcactgttaaaaggatttgaaatatatcagtgaacagaacagatgaaggtccctcccctcatgcaatttacattctaatgggggagacaaaaagccataggcataatgaataagtaaattatataatttgttagaggataatcactgctagtttaaaaaaaaaaacctagagtagtgcaagggagaaatggtggcaattttaaatagggtggtcatggaaatccttgttaagcagataacatttgagcaaaaacctgagagagatgacaggtgaggtctgtgaatatctgggaaaagcatatcagacagaggaaagagccagtgcaaaggccctgaggtggggccagtgtgtttgatgcacagaaaggaggacagtggacctggaatggagagaggaaggggagggaatagcaggagagaaagttggagaggtgacgaggtagcaagatcatgtagggccatagcatatattgtctagatacagccaaaaggattttctaaagggttggatatagtatgtgagagaaagagaagatcaaggaagactctaaggcttttggcctgagcaactggacaggtggtgctgctgtcaactgagacaaagaaagctgcaggtagagctgctttcgggggactaggaagttcagtgtttgatgttaggtttgcatcatctgtggacatttgaatggagatgctgcataggcaactggatatttaagtctgaaattcaggaatgagatctgggcctgagacataaatttgggagttggttgtatgcagatgatatttaaagccattggataggatgagctcaccaagtgagtgagtgtggatggaagagggaatggttcaagagcggagccctgggatactttagtggtgaggagttggagaggaaaggaggaagcagcaaaggagcttgaaaaggaacaatcatgagattgggcaaggagtgtatggcatcctgggaaccaagtgaagaagatatatcaaagaggaaggggaaattgatggatgccatgaaaactgaccatcagactcagcagcttagaggtcattggtgaccttaacaggaacagtctttgtggactgctagggacaaagtcttattggtttaagagagtgagaagagaggaattggagacagttaagtataaacaggtttttttttcttcatgagttttgctaaaaagggaagcaaattagtggagtgatagctagccagggaagtgaattcgagaaaaagaatttttatttgtaaaattttgttttattttaagatggaagaagtacagcatatttctaagaaggttcacagtctttgtgtttggctttaagacattatttacattcggcgtagttcttgctcaaacacatgtgcttcatatttggtactctgatttcttgtttgggaattgttcataagtacatctaaggtacaggccatggcagatgtgacaactacttgctgaactattagtaatggacagattgtattattttcagaattctttctcatgaggcaagagagattaagtaatttatctgacatcatacaactgatagaggtaaagctgaaacatgaaaccacttctggcctcgataacgtagtttaggtcctgattgcagtgctagcaattagtggagaaaagttgagaggaggaaatgaataaaggacgtgggggaggggtatagcagaaaggaaagaagagaagaggagggtaatgggagatccagtaggcaatacaggaatgaaaaggattatatataatctctaataaagaatgtttggaaagctaccctactttaaatttgacaattcatataaagtgcttaacacaacgcctggcacctcttgacaaatattagctgctaacatcattatcatcatcatttccactgtctccatccacaaaaatatatcatgaactctgccagcccaaagtattagggtcaattagattattaaaaattgtgtgattctgcacccttttcctgcactgtcctaagcatgtttccattttaaccccagctttaccacttatcattattttaacaaggatttatcaaacacctgctgcatgctaggcacacgttattgcttatttcccatgcaagcgtaatttagctttgcatcatgggcacatagtgagtactcagaaattcctagatgaataaacaaatggagaatggggtgccctttgattttctaccctttagagtttgtcttccgctatgccctttttctgatttcagtcatcagatccttttggttacttgaaatggccaagttacgagcaatttcgtaacttgctcgtatcccaacctgaatcccaggcttgggatcctgatgtagcttggcatacctcatcagaagctttttctcaaactcaactttccaactctttttatgtccctaccccaatatcttacccttcctcattcttaaaatgaatagttgtcagcatttcaaccactcttcagagcacaagaaggccccttctttctctatcttaaaatcataagactcagaactttctgcagtcattagtggcattagccacggaaccacagaattacagttgaggaaagtggatgtggaaactgaggcttcaggaggtgatgggtgagtgagtgaatggctgatcccagggctcctgacacaggacccccccatatcagtgcacacaagtgaaagtcatccactagacctcctccaggcaaggccatagaggggtactcccacacagcttcttcagtaaaagtacagctgtttgccaagtgactgaatgatctctgtgctcagcatggacaaattttctagtttaaacttttattgtctgcttctgacccctctcaggtcactctgactgctgagacctcatgtagctacatttcctggccccggaaaagtctccatcttcttctgaccaaagagcgatacatctcctgcctcttctcggctctgctgggatatgacatctcagagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactgggtgaggactccaccagtctggtgctggaggattttgaggaggtgtcaggatcagaatcgtttatggattataggagtgatggggagtacatgaggtgaagggagaactaacatgggcacagccaccggctcaggatcctatgtaagtactcagaaggcagccgctgcacattcctgtcaatggctggccttaactcagcttgttagggcaaaaaaaatcattcgtggaacatttcctcttagaggactcacagaaagtggcattaacccaactttgaagatagcaactcactccgggtgcatgcaaggcatgaagggattttaaaaactcattcgttattaacttgattgcattttagaaagtgggctggttgatacgttgagcaggaaggtagattgctgtttttttgcaagtttattctaatagctgaggccacagctggggcttaaggggcttttatttgtggcatgcattttaaaagaaaaagaatgtggcagggttctaattctgattgcttgtctttcctgatacagagcccgtcctggaaagcagttgttatttagcctagactgggcaggcatctctgttaaaactgcatattttaaagaggattgtgattatgagctaatagctcggggaggaaaatgtcctcatcttgctttcctctcacccagtggagaatgtgtttgttgatcacacagacagaggactagatactgctatgattaaatgttactatgatcagataggtatatggcagcctggctttccccagtcacccacacctgtgggaggtaggatgtgcataaatcctggagggcctaacagtgcgtgcaggatttccctcacagaatttccctcccagagagtctacaagaaaggctgtgcccagtggttctgggaaattgctctcatgtttccctggctgccctcataatactgtgatgtttttctctgtaactccacccaaccatgatgtaggcctgaatttcctgaggaaaatcccattgttcccaatttggaaggcgcctcccatggttcttcagaaagcaccaataaattacctgagaaactagcccagtgaggaaggcctccagagtacatgaaatgaatgagtgaatgtttgtctattttgaaaaacaggttatataaatgatgaaagaggccatagagatgactgatgaaaggttagagatttagttttgtagatatggaatttacaatctcctgtgttaccagcatccttagaaccatagttcagctcattctgaggtaattccaaggatcaatctaacaccccagatcactttgttgagttccccgaagtgtgcattgacaactctgatcactcctttccctctgtgcagctgttcgccttcctactcgttcatcctgcatccacgcatgctccttatgtcctatggatccctcttggtccaacttgcccatccacctatacactctctcttcgactcacagcagctctctgttttctcatgttgttcttcctggttttcttctcttttcttggttctatttttctcttctttcttctccaatttcttctcagtccttgattgcctcagtttgatgttctgttcttttttccttttctttcttgagacagggtctcactctgtcactcaggatggagtgcagtggcatgatgtcggctcactgcaatctctacctccaaaagctcaagcgatcctcccatcccagcctcccaagtaacagggattacaggcacatgtcgctgtgcctggataatgtttaatttttaaatttttttgtagagacaaactctccccatgttgcccaggttgttctcgaactcctgggctcaaataatcctcctgccttggtctcccgaagtgttaggattacaggcatgagccaccatgcctggccagtttgctgctcttaagtgtccattttctatgtcttctcagttcatttctccctcttcacttgtctcttgttttcttccattttattgttcatatatttatctctcctattacctccttttttctttttcccaccttttttgccttgctgtatctattcttcctcctaaacaccctgtacccccatcttattagtttttaatcctaactcttccaaagatcagtacttttccctctgcctataaagaaaaccattcaagtgaaggtgtaaaatccccagctttaggaatgttttccaaacatcaggaggcaggcagcatggtaaatgagaaagaggccaggactgggagtccaaagtcctggcttctatgtctggctttgctactaatcaaatatgtgactttttgcaaaccatacctcactaaaccttactttcttcatttgagcgtgttggaccagctgtccccaggaacccccttggattgatctgagaaggcaaggataagtttttcaaaggaagaaaagaggagtagtcagtccgcagtacagtagacacaagccccaggacatctgagtgtctttcagcaagaactctctgtgatatttcactacaatttctctggcaccttgggactctcctcagcccttgtggtggtgggtcttgtttaactagcagttccctccattctatgcctgtgaagaatctatcacctaccatgtgattacagtgcagatttttttttccttttccttttctttttctttctttttttttttttttttgtttgagacggagtctcgctttgtcacccaggctgcagcgcagtggcgcgatctcggctcactgcaagctccgcctcccgggttcaccgccattctcctgcctcagcctcccgagtagctgggactataggcgcccgccaccgtgcctggctaattttttctatttttagtagagacagggtttcaccgtgttagccaggatggtctccatctcctgacgtggtgatccgcccgcctcgggctcccaaagtgctgggattacgggcgtgagccactgcgcccggcctacagtgcggatattttatgagagaggagatcacaactcagtccccaagccctcaacccttaatacatactatcgtatgaaatgcctctttccaaattcagccttttctaaaactcaagatgagaaaactgctgatgaggctcactttctaaaataccggaatttgcaatatagggagaatagtttttcatgtttctttgtttaagcaatagagagaaaggaaacttatgtcgtttacttttcaggccatagaggttttcagaacaacttgaaaacatgatcaaattagccaaacttctgatagttttcaatgtagtctgtgatcatgggataatttagcctcagttctttttctgaaattgtgttttgaatgtttgatttgacttatttaccatcaaacttgctataaggttattactctaatgaataagcatattcccttaattgggagcaatttactattatttctttcataaagtagggcaccattcaccatctatttcctggctctttagttatcaaaatgttaagctcattgctattcatcccggcacagcacttatatgagaggcatgaagctggctgaattctgcatcattaggaatgacacagcctcatcacattgacaccagtgcttgtctctcacaccaatccaaattaagaccaactgaaaatagtcagagtttcctctggagctcctttttgaagagacatatgttttttagtctggtggtacccaaaattgaacaaaaaatgggtgctgcttctcttaataggcaaaactatgctgcaggataatgtattcatgcagggtcttccagccagaccccaaatcatccctcccttcactagaatttttctgtttaattcgatggccactctccacagggatccattctgtgtcttattacaggagatgctcaatgaatgagggacttatcttctagaaatgcagctccgaggtagtctgttgagtgaaataatgaatccattatcacaaaataaattgaaagctgtctgacatttggacaatttttattttgtttcacattgttctgaaaactatactgtttcttttctccctattatttaaataagcaaatgatgaacagattacaaaattgaggacactcgaggtaagggaaggagcccctcgacaggaggatcaggacatagtaccaagggcaagagaaacgattcaataaacactatttactatatattttaggcatggttctaggtaatcacatgataagtagttgaaagaactgaaaatgttttatctgcaagaaaagggcaagtgtaatatcttcaaattttagaaagaatgtaaattagaatttgacttaatttggtgtagttcttgtgggcagaaattgaattgaataggctgaaagttataagaaggattttagctcagtattgatactggattgctcatgggtggtgagagttactcatcactggaagagttcaagcaggggccataagaaatctcagggattttataaggtgattcatgctctgggaaaaggatgccttggattattgtgtcagggtaacttctaactctaggattctgtgtttctaagatctggactctagtcttgccactcacctgccatcaagaacatgttcctcatctgcaggacaggaccaagatggctctgtctaccttaccgggttgctgtgaggcgtgattgtgataaaatacataaaggcagtttttaagctctgaagcactagttaaatgtgtagcgtattttaagattctgttgtatgtacaattgtttagcagtctctctctctttctttctctttcttttatcagagatagatgattttccctcttatttccaccagtttggcttttcagggaaggtggcagctggcagaatcccctgacaacaaaaggtacagcaaaaagtggaggcctaaagaaaacatgtgctagctctttagcccctgaatagctaagtcacatgtcagcctgctctccttcatctgtttgggaggaggcagattagagtcacactgtcatcatgctcttcccctcagaagcagctgtaaggtttttggtagctgtcagtgctagcaaacagtgcttttctcacagaactactggaaagagtcctggctcggaaaacttgctcttgaaagtggcacggccagagcaggggtctctagagggtcgtgccacctctacctgccacaggttccattgtcggtcaggtaagttagaggcagcagttccccacctgccctctggataacagcagcctggggctgctcctgagtcatgtttccacttctgtcttacaggcctcattttcctacccatctttctgtaaaaatgaaagtcaggagtcttatgaaacttaccattattcaatacaggcttttggtttttttctttaaattagatagggttaggtaagaagtagagttctatagaacgttcataggaagcaacaaaagttgatctcttggtctctacaataggagaggattgggctagataccttcaaagctgacttgccctaatattctagtatgaaatgattcgaaggtacacctgcccctatcatgtcaggcagtgagtacagttaaaacattgggaattggtaaaggaaagaaaaaaactgaaaagaaccctttgaagttagacaaactgtccagagacatagtgctaaaatcctccctctttttctttccacagcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcctttccctatgttgtttctttgcattgtctgaaaggatcaatggagtcaaagatccagcttttcactggtggttattttttatttttcaattaagattcaaatttatggaagtggaaatttaaaaacctcgttttcccttaggctgtgacattcaacttacaaatctctttttctgttgatgaacctagtattaaacaatagtttttagagggacttttacaaacttagttaattagattttcttaaacatcttaaagtagatttataaatgtaatatattctattttcctttttctttaaatacttcaacatatatttcagttatctattgctgtgtaatatcaatccctaaaatagtgacttaaaattgtcctaataatatgtggtgctcatgagtgcgggacctgactgggctcagctaggcggttctcactcagggtttctcatgttgtttcagtcagatagtggctcagtctagaatcatctgtaaggcttctttactcacctgtctgggaagactcaaacagatgagggctgaaacagctgggaatccttgggcatctctccctctcaatagttttttcatttttgttgttgtgtgctctttgtatgactataccacaatttatttatccaatctacaattgatgggcatttggatagtttccaccttggggcaattacaaatagtgctgctataaacactcttgtacctgtcttttggtatacatatgtatacttttcttggatatatacctaggaatggaattactcaggcattgggtatgtaaatacgaccaatttttctaagtgattgtaccaatttacatctccacaagcactgtatgagagttccagatgcttctcatcctcagcaatagttggcattatctttttttttttaattttagttatttgggcatgtttagcagcatttttattttcctgatgggttgagtagcttttctttcttttcttcttcttcaatttttttttttttttggccatatggatatcttctattgtgaagtatctattcttgtttctttttttttgtccattgctctttctttttttttttttttttttttttttttagacagagtctggctctgtcctgaggctggatggagtgcagtggtgcgatcttggctcacctctgcctacctggttcaagtgattctcatgcctcagccacccaagtagctgggattacaggtgtgcatcaccatgcccagctaatctttgtatttttagtagagatgggattttgctatgttggccaggctggtctcgaactcctggcctcaagtgatccacctgccttggcctcccaaagtgctgggattacaggcatgagccactgtgcccagcctgtatgctttttcttattgacttaaaggagttattcaaataatcaggttaaaagtccttctgttacttattgagattttatatatatatgtatatattctcctacttttgtgggtattgtttttctctaaatagtatcttttgatgaacatagtttttaatttcaatgtaatggtttatcaatctttctgtctctgatttgtgctttctgtgtcgtgtttaagaaatcttttcctcccctgaaggtactctcccaataaccttctagatttcttattgttttacatttcaaagttagacctacaatcaacctggatttggtttttgtatatatgactaagggccaagattcattattttccatgtggctatccaattgactgagcactccctattgaaatgattatcctatccctactagtgttcagcttatcctttgtgacaaatcaaattttcctatagatgtaggtctgtttctgaattttctgttgtctgatggttctatttttctaccctttggcagtaccatctggttgtaattattgtagctttacagtaagttttgatatctggtagtcttcaaactttcttcttcagctccattataatcttatgggaccaccatatgtggtccattgtttaccaaaatgtcattatatggtgcatgcctgtatattctgaattcgactcacaatctctactgccaccgctaatttcaagccaccactacttcattctaaattaacttcaatggacttacaaccagtccttctgcctcataacctacacacagtaaagaggtcatttaaacatatacaagatcttatcactctctggctcaaaatttgaaatgacttcctatcccacttagaataaaatccagacttcttaccatgtgatattagtcaggattgacttattattacttaaaagcacaaagttttatttctctcttactcaaaatctgagtctccatgactcataatgggcactccagcctgggcaacagagcaagactccatcttaaaaaaaaaaaaagtacactatacattgtaaattgagattcaacataacctggatgtggtgccactccccaacctggaggatcaccaaggcagggctgtcattacacacctgtggtgtatagcagtggtttctcaagatgaggacctcttttaatcccttttccccaccaaagaatcagaccttacgtagtggaagttgtgcttttattatctaatggtgtatgtaaggcaaaagacatttggatttcaataggatttttagataaatttataggttttaaaaattagccacaacagtctctttatatgtttgaaaaatagcattacatatatgtataaagcaaaaacccgtgagagatcctggggagaagaattgcctggagggggaaattgagtccatctccaatgttcagcacctcttctctttctatttttgaccccctggtttcctgtagacatccacacaaatcttgaggtagaagtgaaaacaatgctgtcagcagtttcacgtctgtcaccattgaattcatgccctgacatgtgcctcctactcagaaagttatctggtgattatatcacttctgtgatatcatccttcctgaaagtgtccttacccagcacatgaccaccaactgtcacatgattgcatcactgccacaggggagcccaggacacagcacacaaatcggattagtccagcctgtaaactaagcctttgcttaatagcctggaattgccctccacccctcagccctcaggcctgaaatcctattcagccctcaaacctagtacacatgtcctctccctacgcacactctcctggccttcacctcgccctcagcattgaacaatccccttcaggactcgcagagccctctgggatcgcccccctcagctctcatccctcgctaggcacttgagggctggggaagtcttacttattgctgtggccccagcaccccacacaaggccacatgtgtgacatttagttggtaattcttttttttttttttttttttttgagacggagtctcgctctgtcgcccaggctggagtgcagtggcacggtcttggctcactctgcctcccgggttcacaccattctcccgcgtcagcgtctcgagtagctgggactacaaggcgcccgccactacgcccgactaattttttgtatttttagtagagacaggatttcaccatgttagccaggatgtagttggtaattcttaaatgttggttaaactcagctgttacctgctagtaggacaattcatgtgccccattctggcaagggtaaggttaacacttgtggttttagagacttctagttccactttccagtttacttttgcttctctccctattcaaaccagcaggaaaagagagtagtagttcaggagttgttgccaaaatccagagccttatcgggggaatacacaggaagggacagacctcagatgcattttaagatattgagagacagagtctgagtataaatcatatactgggggaaggaggcaaatggcttaaaatacttttttttttttttttagcactgtgatgttctgagtcaaagatgactcaggcttcaagcctggatgattggatcatggtggcagctattaccgtaaaaagaggaggaacaactttggggaagatgttgatttgcttttggatggattgagtttagactgttgtcaggacactaagtggacacataatgcaaacagttgctttcatagatgagggtgaatgctaaggatcagagaggattccaaggccttcctggggcctaggaagactcaggcactgggatactctcatcacccccatactcttcttaaggggaagaaacctacctcctctgagatggtggggcagaggggagttgtgatggtcatcccagggcttggggtgtgcccaagagtgagatcagagatgtgtttgaggctgtggggagcagcgtatgtcactttcagaatgtcagacttgggaccactcaacaaggagatcaagggctgggtgagaattcagcaattatggaagatttatgtttcaatataatatcctttttcctatagagatttaaaacttttaaaatgtaatattgacacataaaattttaaaacaagatgagtatgtgaaggccattcctgacacttatgaaaagacattaagctctcctttaaagttaagcctctctgtgcctgaccttctctccctgcctttgtctatgccactaagattactgcctttagttcaattcaaggagcttttattgcatgcttacaatgaattatagtgttttggggacacagcgaaagagaaaatatagcccctgcttttaaagaccttacaatctcatcatagaggcctgacatacatgcagtaagctattaaccaccattgcaaggcagcatagttactgactgatagaacatacgggtgaccagtttccctggggaagatagaactggaagtggaccctgaatcattggtagaatataaaagtgggggtgggtgggaaggagaaggagcaaaaaggcatggaggtgacattgaccatagtatgttttaggggaatgctggcttcagcacactggggaaaatggcagataatttttgttaggcagagtagggccagactgaggagccctatttagctaatacgtcttagttgcaagtgctaagaaccaacgtgagcaggctaaactgtataacatggtggttagagctcagattctgaagtcagatggccttggtgtgaatcctgattttatctattgctgactgtagtggacaagttacttaatttctttgtccctgtttcctcatatgtaaaatgaagtaatacatggattcactgggaggattaaataagataatttgtgtaagctaattggaactttacttggcacatagtaaatgttcaggaagttttatcttttttgttgataatgttgacaatgttgataattatgatgacaaagcaaaggagaatttataaggacacaggggtgtcttatggaattcaaagtcagaaatgccactagattttaatatgggactagatcagaaagccatcagggaaagcaggaagctgtcagggacccagtcaccatcttctgtttctgtttctcttaggagaactgcaacatgtttctgttttccaacagagcagtcttccctgtttctctgttctca

SEQ ID NO: 501 - DNA, 29372 bp, Homo sapiens
aaagccacccagaggccgaggcgtcaaccctccgtttccctcccggtgctccttccagcgcccggtgtggtcgatttggcgggggtggagcgccaggcgcgtgcagagccgggcggaccagcctctccggccaaggcgggaggcggagctcgtactcaagagccgcctcccgggcggctggggcggtccccgagctgctttccgcgttctcccctctccgcgggcagtgctagctcgccgcggccgcctccggggtgagtacgctggctccgccggcgcccgggaaatgcagttccctggacacgggcgccgtgcgagggtagccgggcgacggccggggtcagtcccagggctgtagcggggcgggcgtggggatgacgtggcggcgtccgtggggcagtcccgcctcagccggagcggtgggccgggccgggggcctacggaggccgagcctggcgggaggcaccggctcaggtgctggcgttccgcgcggcgccgcctctgctgcgggccgggggagccagacgaggtgctgccgggtaggaaaaaatccagggctcattcataccccaggtcacgattccggggtcgcccccagcacttctccgccgggtgcatcaacctgaaaaagccccttcttcctggaaaccctccttctccagcgtttcaacggggaaactgatcagctgacaccagccccagtcctgcgaggggccggcgacctttgacctttctccaaaggggttggtcacctggattataaaagacttcggagacagccatccagtgtttgttgatctgtatcccttgatgttctgtcttccattagataagggctgttaattcttggtttgaaaaaaaacagacaaagtccaaaggactctgcatcgaggagaggcctatgggttggtagccttaggagagtagttatcaacagtgggtgggtgtgcacactgttgcaaagtgttccagagtgggtgagggatggggacgtggcggtggtgagggtactggtagacctcctcagccgtttggtgatgaaaaggaggaaaaagaaaatggtaatctgagcgtggaggcgagttgtggcttttttttttttttttaaatttttaaagaaaggaaaataacacctttaagatgcaagaaaatcaaggagagatcaggatgaataggattcagggtccggattgagaaactgggattcagaagggagggctattcccgagacccaggcggggagtgctggaaggtctctcttgggagaggagataatgcttgattggatatagttcagaagtttttggaattttgtcttctagagcaggtttgttctttatggaaattgtaaaccccatgaaattgcaataactttcgtctacctatagctttgatcagattgaaaacatacgttgtgaaaaagtactgacctggattgaactgtttgactacataatctaaggggaagtggatagagagggcaataaaatcagctctgtggttgtagtttatatgccacttaatataataagtatttagtatctactttaagccgagctaatagtaatgcctgccttttccagagatgcatgcaaatgttttgggaactaaccttctctttgaagatcttttattcagtggaaacatccaaagcaaatcagtgatggttttctattctttgttttaagccatcagtgaacagtggtttctaaaacctggctgtgtgactcagagttacctaggttctcgataaaaatataatttttttttttttttttgagatggaatctggctctgtggcccaggctggagtgcagtggcacaatcttggctcactgcaacctacacctctcaggttcaagcaattctcctacctcagcctcccgagtagctgggactacaggcccaggccactactcccggctaatttttgtatttttagtagtgatggggtttcaccatgttgtccaggctggtctggaactcctgaccccaagtgatccatttgcctcccaaagtgctgggattacagatgtgtaccatgggcccaggcaaaaatatcaatttcttgactccacttcaggcctttgaaataaaaatctctggggctggagcctgggaataggcatttcaaacacagaccacagtgttctctggcactgaagattactaacagcctctgaagtttttctttgagattggggctttttggcctatttagaacaggttttcttaaaggttatatgaatgaattgtcaaacttatgtaactaaaagttataattcctgtctgtgatgttatctttaaattttaatgtacagtcgtcctccttattcttgggggatatgttgcaagactgacagtggatgcctgaaaccgtggatagtgccaaaccctatatacgctgtttttttctatatatgcatacatatctatactaaagtataacttataagttaggcacagtaagagatgaataatatctaataatagaacagttacaatatgctgtgataaaagatatgaatgtcatctctttctcaaaatatcttaccgtatttttttgtggttaactgaaaccgcagaaagtgaaaccaaggactactatattttaaaggaaaactatgtagtcattttatcagaaaacaatattgtttctgttgatgaaaactccattttagaaaaattagaagatacaaaagaaatagaagttttctcctaatactgtaattaagagatgaccaccagtgactatcattttgtatgtaaaaggtatgcacacacacatgtattgcataattggtattatattttatatacttttttttttttttttttttagagacagggtctctgatgcccaggctggagtgcagtggcatgatctcagctcactgcagcctccgcctcccgggttcaggtgatcctccttcctcagcctcccaagtagctgggactacaggcatgcgccaccatgccaagctaatttttgtacttttagtagaggaggggtttcaacatgttggccaaactggtcttgaactcctggcctcaagtgatcctcccgcctcggccttccaaagtgctgggattacaggcatgagccatcacacccagtctttatttcatatacattgttatatctttttttctacttagctgttatgagcatttttctgtgtagttattgtaaacattttaatgaaagcatatgtcccatcatatggatgtattataattaattaaatcagatcgctattgttaacatttagactcttcaatttttggttattttagcaatgttggtttgaatatcatggtatacctctctgattattttcttagaatacatttctaaatgatggaatcaaaaacctttcaaatacatttttaaaatctcattttcacatatcttcttactgcttttccttaccagagggaaaactaacatatctgaaagattgattgcattccaggtccattctcttatatcagtggttctcaaactttaatgcagataagaatcatttggggagcttgttaaaatttcatttttctgagtcctagaggctgctgttctgacccattggctttggagtggggcccaggaatctgcagttttaacacattcctttatgtatttgataaaggctctcttggaaccagatgttgagaaatgctttttaaataaatggccaaacagactcaaaacatttaggttacttgtcaaaagccattcatgcatctgataaccagaatttgaactcagctctttgtgacttcagagccctgttatacccatgatctcagagctttttaaacctttttaaggtttacggtgaggtgcccctaatgactgcagaaagtaaactcctactgactccactgttggtttcttagggacagctgaaagtcacatataagtacacaatgaacttctattggaacctcccatcagaaattctggtgaattctctattatgctgcataacatatactacacaaaataactttggttgtttgggtgttgcaggaccacctggcttcatgtgtggatttccacggctcttgcccagaggcgggtacactgtgttccaatgtgccacggaactcacgcagtggcactttgtggcttcatgaaggaagaggcaggccacgcaacacttcctccccaagccaaggagaagtatcacttttagaggcagaggagcggaaggcagtgggtgtgaccaaaagtgccatttgttaaaggtgaggaccctacccttagaaaagtgttgatattagtgaactgaagggagctagtatcggggtgagcctttttaatttttaaaatccttctcaggtggaattttgtactcatattattaatctttatttcccaccttcttttttaatgtttcattccttttagcagtagcctggaattatgatgtgtccttgtgtatttcaactagtatatcctagtccgtcatttgttactaaattgagtacctgctatgtgtcaggttggtttgaggcactaggaatacaaaaacaatgattctccttgagaattaagttaatttactatcatttgttgactcaggttatacctagtctctgactctttatttttagttttagttaattttagacttacagaaaagttgtaaaaatgatacacagttcacctagcttcccctaatattaaccccttacataaccatactacattgatcaatactattaactaaactacaaactttattgaaaattcatcaattttcctactaatgtctgttttttttttctgttcccattgtattttatcaaggatcctgcattttatttagtttttctttctccttagtctcctccaatctgaaatagttcctcagtttttcctcgtctttcatgattttgattcttcgaagagtaccagttaggtatatcgtggaatgaacttgtggtgagcgattggatttctccactacaaagttactgtctttccctttgtagttaagaattatcttggggaagatactttgagactatactgtttatcctcaaatttttgcctgttagtttagcatccactggtgaaccttgtctgcaacagttattaagtggtgtttgctgagagtgattttttttccatcgctcactttcttactagttggaatttaagaaaagagccgccccttctcttctattcatttatttgtttgatcatttttatcagtgtagactagtggatagtcactttatcctatgggttaaaatacagtgccatcattttttttttaaattactcaaatgcttctaggttgggctgttaggagcttaatctctgggtttaaatgacttgtacatgtaaatggctgtcatcatttttatcccattcctaccctgcccagggaaccactgtccctttaggatctggccagtgatcatttagaagtctcctaaaggagttgtaattgggataatgaataccaaggcctaaggaaagtggggcaatgtgtgtgtaaaaggtaaactcctaggaactctgcaggagtaaaaagagtagcaaaataatcagtctttcttctggtgttgccccagggagccccaaggcatcaggatcatgtgcctgggacaacatcaagcccactcacatgccctgtgtctgcaaaattacctgataggttcagagatgttggaatgctgattttggtgctcatagctgccgaatgaacacaccctttctccttggtgcaaatgcttagtaaatatttttagagtgatacatggtgtcctccccacccactttagtggagtaaaaatgtgtgtggttagagattctccaagaatgatacttagcacttatgtttcctttccttttgttatagcttatcttccttgccagattttaaaaactattatggaaaatctcaagcattcacaaaagtagagagaaagaaaggactctcaggtacctatcacttatattcaagacttctcagtattttatccgtcttgtttcatctgttctcccactttgggatgttgttctcatatttgacaggaaattgcagacattgagatctagaaaaagatagaaataaaccctgagtacaaagactaggctttaattctctttatatggttttccctttgcttgaaaatagcaggtagtcagaaaaagactggttgaattgagtggaggaaaaccaaatatgaaaacatgaccatttttaactaactacggggcagacttctagaaaggaaaagagtggtaaatcttgccctaaataacttctttcatgttgcctgaatttgttctcaatactgatgatgtagtcccttggcacttcaagacagccttgactgaaaaagaaaataactctgagactcctgtgagaattaagggtctctcaattacttaaatgttagtgtaaataaatccaatatgatggcactttcccaaacaccaaccaggagtcacttgccctaaaaataactttctttaaaaagtcattatgtttttctaattataaaaatattacatactcattaaaagaaaaaatggaaattacagagttagaaagtaaaaatcatctcattaatcccagagataacattatcttgggcaatattctgataacatttgaacatgaatcacattggtaattagagccaataaatacatgtgttcctggccaggcatggtggctcacgcctgtaatcccagcactttgggaggctgaggtgggcagatcatttgaggtcaggagtttgagaccagcctggccaacatggtgaaactctgtctctactaaaaataaagaaaaattagctgggtatggtggggcatgcctgtaatcccagctacttgggaggctgaggcaggagaatcgcttgaacctgggaggcggaggttgcagtgagctgagatcacaccactgcactccggccaggccgacagagggagactccgtctcaaaaaagaaaaaaaaaaaacttgtgtcctggaaatgtaccagatataacagtgtacttgggtgcatcatctcattaaattcctagagcaactttgtgagataaatatttttcatcattttatagctgggacacaacggtgagaggggttgcctccagtcacttggctggtctttcttgaaacatagatggacagacagatgacagacccttcacacttcagatgtttactcacaggagccaaggaaaccttacttctgaacttccttatgctggctctctgtacagtttttgggagagcacttagacttagaaagataggtaagaattatttttaactgggtcagatgtctcagaagcaggattagtaatgaaggcctaatacttaagtaattattaataatggctccttgcttttagaataaatgtcttacctttgaacagagtctgtaagctgcagttgagcaatattagtttatgaatatttgcagctattcttggataggtttttttgtttttgtttttttaaattacagtcatccctcagtatatggaaggaattggctccaggacccctgcatctacccaaatccatgcatgctcaagtccttttgtcagccctgaggaacccacatattggaaaagttggccctctgtatacacaggttttgcataccgggaatattgtatttttggtctgcatttggttgaaaacaatctgagtataagtggagccgtgcagttcaaacccatgttgttcaaggttcagctgtattttttaggacagttttagattcttaaccaaactgagcagaagatacagagatttcccatgtaccccgtgccttgggtaggtttttaaatctcttcccactctgtagaatgagggaggtggatgtgtggtctttaagatcttttctgatttcaacactgcagtaattttatggtcataacctccttccacttggcgattctctcttccaggggactctccctctaaaaatagctcttagaaaagccatgttcccagggctgggtgcggtggctcacacctgtaatcctagcactttgggaggccaaggtggatggatcgcttgaggccaggagttcaagaccagcctggacaacatggtgaaaccttggctctactaaaaatacaaaaattaactgggcgtagtggtgcacgcctgtaatcccagctgcttgggaggctgaggcactagaattgcttgaaccgggaggtagaggttgcagtgagctgagattgtgccacggcactctagcctgggcaatagagtgagaccctgtctcaaaaaataaaaataaaaaataaataaagataagcaatgttcccagtctgaattttctaagattaagatccttattttaaaaattgccaatcctagcatttaagcctcctacaattaagtccacaagaggttgtctgattggccccaggaacctgatgacttactgtcaccaggtgggaagagaacagacctccaggaaggcatttgatcagacagtccctaggaaacggaaggcagatgtgggagagaggtagaaggcccccaagggaacctgaatattcaagggtctgtgttgggactacccaggcaccaaggggagaaaagaggaaatatccatgtgaaggatgtggagctgagcacctgggcggagaccccacgctaccacttactagtcgtgtgggctttggcaaggtacttaaatctctccaaaccttcctttccttttcttacctgtaagatgagactagtaattcttacatcatatggttaaatgagaattacataggttaatataagtgattttaccccagtgcatggcacagagtaaatgcacacataaattgccctttttatttgttattactgctttcagcattgacttcctgtgataccttcacaggaccctgaacacaggccatattgtttaattgcttcctgggtcaaacattccccaagaactaacctcccttttcatctatagcattgtgtttagagagaaatattttctaggtttccttcaaactaacctgaaactaaatttctggagttgtatcctttagtaagtgtgaaactatcttgagagtttctgaggtggttgttgttttttacagttacttactgcctctctattcaccattaaaaaaattcactttgttttcattgtaagactgccatattataaaatgatatatgtaaaatatatgtaaatatgacaatatgtgatatacaaaaatatatacatttatataaaatatattaaaaattctaaaaatataaaatatattaaaatataaaatatattattttatattttataaaatatactattaaaaattattaaataaaataaaatttataaaataaattttataaaaataaaaattattaaaaatataaaatatattattaaaaattctaaaaagaaaagagaaaaaataaaccaccccagcgaatcccattctcctaatataattattattagctttctagactttccttaattgtatatattgttagttgtaatcatagcacagatatagggcttactttctgtttttctttttgtcatttaagatttaatcataagtgtttccatgtgattatttagcatagaaaatattttggtctccattttatttgtttgagaatatgtttgtctatggagattatctgtgccctagctttagcattttctgtgttcttctgagaacatgtttagaatttgaggagagacgtgatttgtccacacagagaggatatggtggatgttgctggcggcaaaccaggtatccttgtcaggtggcctttaccactttagtgtattttctgtggtccagggtgggccctcagctaggtggtcttaaaaacatgatttttgtcaataattaagagcatagccccctcttagaagtgaattcatattatcccatctcatgctactgaagtatgaaatcagagtggcaatttatcagctgacagtgagaaatacagtacaaaaagtggtgtttcagtgtgtctacttgttggtcaaggtgggataacactttacatattaataaattaggtcatctaagccccacaataacttttctaggtagatactatttttatccccattttacagataaggaaactgaggcttagttaaatgactggcccaaggttatgtagctgttatgtggtagagctgtagtttctgtctaagtccaaactcctgatcttaaacactgtgctgtagttttgttattcttacagatagattgttgacctcctgtttgggattctcataatgtttcttgacagactccctcctggcccccattgcaatgtgccctgtgccagtgcctctttgagaatatagcattcattccctgttgttgaggaccatgtttttctagctgtcacaggggagaagaacttttcccttttcccttattttctctttgggtcaaaatgtgcttctgtaacaaggcttcacatttttttaaatcctccttaaaactgtgccaggaaggggcaactgaggcagagaaccattagggctatgtcttaggctgtgtccagctcaggtctttgcagtctccttgtctcctttgcctatttgttctgtccaacatttggaaattgcttcccttcttgggtggcagacagcctggctgataaactagagagtgcttctgtgatgtattgatgcttggaacctctaaaacctctggttttcgaatctctaaatgctaagtggaagacctaccattacggttagtcaaggtccatcggggatgggttttcagtttgtgctggagtgaatcacttcaggatagaatttccatttgaaacaacgtgtcttttgtgattgcgttttagactgttggagcagaactactgagaaaaaccaggcattgtatcttcagttgtcatcaagttcgcaatcagattggaaaagctcaacttgaagctttcttgcctgcagtgaagcagagagatagatattattcacgtaataaaaaacatgggcttcaacctgactttccacctttcctacaaattccgattactgttgctgttgactttgtgcctgacagtggttgggtgggccaccagtaactacttcgtgggtgccattcaagagattcctaaagcaaaggagttcatggctaatttccataagaccctcattttggggaagggaaaaactctgactaatgaagcatccacgaagaaggtagaacttgacaactgcccttctgtgtctccttacctcagtaagtgttgcttttttcctttgattaagtagtatgcaaactttttatttaagtataatatgtacttgcctgtatcaaaacatctcatgtaccccataaatatatatatctcctgtgtcacaaaaactatacattcaaataaaataaatataacatgtacaagaaagtacaaaactcagaagtgtaccacttggttaagtttcagaaaatgaacatacttgtttaacaagcatgtaaattaagaaatggaatcttgctggaaccataggaactcccatgtttctttcagtcaccactccggcttcaagattctaactctacacattagatttttcctattttggaactttacaaatcggaagcatacgttatgtactcttttgtatttggcttctgttgcttaacgttacttttgtgagatctgttcttatggttgcgtgcagctatggtttgtccattttcattgatgtatagtattccgtcataggaacagacccacttttattatccagccacaaaagtttagcagcacacattagtagcgtccattgatctaggctggtggctctgccccatgtgcctcctgtcctcctcctgaaactagtgggctagcctgggtatgttctcctcatggcatcagcagagcaccagagcatgagaggagaaatgcaagcacattcaagcctcagtggggtcacatctgttgtattcctttggccaaaactatggagtcaagggacagagactaggtaagtttttcaatgtggtctttagtgtttatttcttaaatatgttgtatgttttggttcaccttttatgtcttgcctctcaacttatgttaaacagtaaattagtcttaagatcagggtgccagcatggtcagggccctcttactggatattgtcctcacatgcctttccttggtgtgtgtgcgcacacacatacatgcagggggaaagggaaagagagagggagagagaaagacagagatagatagatctcatgcctcttgctctttttataagtgctttaatcccacctggcagctccacccttatgatgatctcatctaaacctagttacttcccagaggccccacagtgggcattaggaattcaacatatgaatttttggggacacagacattcagtctgtgtacccctttcctagttgagtcacagtcctgtattgtattcatattggcatgctgcttctctttagtcatggaagagtcaaagtgttattcctgattgtgtattccttcacagattatacaagctgcgatgtaaaaatgagtcagggaaatgcaaattttactggctgattattccccttgcttaaaatgctcacagtatatttaaacagtaaattcattcataaagaatagagggacagtgatgcattactgggcaagtactggactaaaggtgatgtggttggtgatgacttaaaatgggccattagtgacccaaggaggggcagatcttgagaagatgttggggtagggggagtgatagggagactgatagagagtaagtggaagcagatactaggttagggcacgtaaaaagttatgacgatgagaaggtgagccgggggactagtttatattagacctgttgcgtgaggctctttgagcgcgcaagaacagagacacagtcaggttaacgatggggattgtgaacaggccacacaggagaccatctcaacagctaccccattatctctggtagctcgatagcccagcatcagctctagtagttgtcatctgtgtaactccattccttactgtttgtttttagggcattactgactgctgtgtcttgcatgtagaccctgcaggaaggctctcgtaggccaattattctctttgggtggcttgaagaagttacttaccttgcctgctgttgagcagagcaccaaggtgccattagacacgtgagcctggtctaagcagccatggccagggtaggggatggttacatggaacaagtcatggcgactttcgcacaggaagggcctatgactgctttactcagaaggggatagctcaatttgcaagcatcttgagattttacagcctgaccagtatacgtggaatttagaaacaaacaaacaaaaaaacctgagctgttttcctcctgtggatggctttgggtttcatctgtttggattgcttccagacactgagcaaatactgtgctcgattggaaacgtctgttgtggtggcaaaatgggagagttgttgcagtgccacacatacctgttacagctgggttagggagggagactggtttctacttctttttagtgctttgcttacagggagccagggtggttccagagtttagggaaggggtgggaagagtgccttgtccaggagcttgattctgtggaatgctgttgatatttaagagattttcccctcctcctggaatttggtgaaggaaaagaggatagaccaaagttgaagttactctgtctagccctgccctttgctcttaccagagttcaccaggatattccctcttacagatggatcatagagcaagttgattacccagccacaaggaaatgcttatattatatatccaccacttgcttttgcagccagtaaccttagtgacatgatgctctggccattatcatgactaaatgagcctttaaagtaatcataataaaagctgacatttgtagtactcactgtgagctgggcagtgttctttctatgcatattagctcgtgtaaacctcaacactttttgaagtagctactgttattgtctgtgtcctatgttcattgtaggaggccagagcaagctcattttcaaaccagatctcactttggaagaggtacaggcagaaaatcccaaagtgtccagaggccggtatcgccctcaggaatgtaaagctttacagagggtcgccatcctcgttccccaccggaacagagagaaacacctgatgtacctgctggaacatctgcatcccttcctgcagaggcagcagctggattatggcatctacgtcatccaccaggtgagcgtgggggcagaccagggcctgccctcgaccctcctcttctctgccagacttggccatgtgactgtttgtctatgttgggtaaaaggaacatcagactatcatcaaaaacgagttctcttacctcatttatccttgaaaggagtagaggaaattcttgtctcagagtgtggagttatgggttcaagttctgggaaattttactgcccttaaaggaacctctggaggaagcctgttttgtgagcccttccatgttagccaatgactgccctcagatttccccggaggcttcctggccccttctgtttctttctgtgcgtgccatgcactatatgatgagattctggaattgtctgtcattatcaaccatagcaactcaatggggatctagacagaggatttgaaagaacattctgtattagtagctgtggtgctctatggctgccaccacatttctgccctgaactttgccactatttattatgtgaaacatattatgtttgattttcactttctggattcatctatttgacttccagaagcatgatttggtaggagcacagcataactatcggctgcttttgaagagcttacctctgaggtcagtggagtggatgattaaagatacctctatttggcattaaagtttattgaaagaaaactaagacatcagtttaaacatcagtgtctaaacttttcacagttatccttggccatccaaggaggccaagaagagggataattccccctcaaattcttataaattctaagaatgtcagcaaaatcatcactactgttagaacaggtaatatttcttttagataaaactttggacaactcagaggaccagctctgcagtatagacttggtgataaactgaggctcttgaaaatcagtgtgcttatatagcacacctatgtctgtattttagtacttggaacaaaatgttactattatattgttttatagctatttttgtttttaaggttgttggtcatagttatgatttatttgattctgagttcttgctcaggacagtaacctacaaggtatagtactatttttatgaatagaaaaacatgtttgctttgggccaggcccggtggctcagcactttgggaggccaaggtgggtggatcacttgaggataggagtttgagactagcctggccagcatagtgaaaccctgtctctactaaaaatacaaaatactctgttaaaatactaaaaaaaaaaaaaaaattagttgggtgtggtggcacatgcctgtagtcccagctacccaggaggctgaggcaggagaatcacttgaacccaggaggtggaggctgcagtgaggtaagatcacaccactgcactccagcctgggcaacagagcgagattccatctcaaattaaaaaaaaagaaaaagagaaagagaaaaatatgtctgcttcgtgttattcttatcaggaaaacattgtggtaacttctgagaaatacttgcacttttatgataaaccacttaactggaattcattctgaaggaatttgaatgaagcagccatgaaaaaattatttaatttttttattacagcttcaatcatattacaggtcaaactgtgttcttttattgcccagtgacgaatctacctccataaggccactgtgaggattagcctccaccagtagcattataacaggattctcttacagggatttctgagaaactttaaagtagcttagaaatattagcaataactttctctttctataggttgagatttcttgatcctttctggcaagctattaactaagtctcttagaagcttagtgtaaattcataacagagggtaagattgggattacctagggttgaactgtgaagcagtaatactaattgacatgactagtatataagaaaggttttgtagttttatacagaatacgtaaaggtatttgtaaaattttaagagaaaatttttttttgttaactgtggtaagaatatttaacatgagagctatactcaatacattttaagtgtacattattattgattatttgagttatttgtattttaaagctgcttttaaaaaatttttaattgtgaaacacacgatgtaaaatttaccatcttaactttttttaactttttaaaatttttgctatcttaactattattgagtgtgcagtttagtaatgttaagaatatttacatgcaatgtatctatgcataattatgcaatatattggttgcataaatatatgcagtgtatttatgaaatcaatctccagaacttaatcttgcaaaactggaactctctatcattaaacaacaagtctttggatttcaaggactgtttctaagttctggaatataagtatgtgtgaagcacgaagaaaaaaatcaaatggtcttttattgtcattgcatcttctctgtcagatctttatgtcacaagtgtagtctcgtgcgtagaataattagaataataccatctcctgaatcctaactaagaggcaaacaatatgaaactttatctcaggagcttttcaagttttaattttcatatctctaggctgaaggtaaaaagtttaatcgagccaaactcttgaatgtgggctatctagaagccctcaaggaagaaaattgggactgctttatattccacgatgtggacctggtacccgagaatgactttaacctttacaagtgtgaggagcatcccaagcatctggtggttggcaggaacagcactgggtacaggtaaggtggttctgctgagggtggcttaggtcgagaagctcaactattgtgatcaagactgggtggaacaagcatccagagtgtcataagaaaatgagaaatagaaaaaatggtccataatgtatgcatcacttaaagtgcaaaacagaagttagagaatgtaatgaggaaaaagccctacaacttcagcagaggatcacaaagacaagggaaagcattggagagaaatatcatccaagcattgcaggtggtggccagtctcacccgcagcgcccctgtcggggggctttcgcaagctttcccacactgactagaatgcaagtaacttgtttgtctattcctgactccccctctaggaggcaacaggctggtgtccttagtgagacctctgttgagacatcactttccagactgtggcctctttctagagtatggggagaggtgggggagggcatgtcctctgagtagtcttctcgggagccaggacacccaggacaagttcatttctctcaaagccactgtgagaagtgccagatgccatcatctgtgtcttcattccccatcccctccacccttaagaagggtgtagctgcttttcagccttatttgattcaccagctcctattcaagcacaaccaagcgggaatagtgacacagaatgtttctctgcaaatgaaacactatattccctcatttgtgtgcacacttacctgtcagctttccccaggccctgctgttcatgggtgctcatatctgtggtgctgactgtgctggaggccataagaccagtttgaataaggcagagcacctgccctcacagggctccccgttgagtgtcagtgtggggagacaggtagctacagtggagttgcgttaattttgcatttctgcaaatacaactataagcacttggtaaggaggggagagagggacaaatgaagagaggaagaagaaggcaggagagaaagaactgtgaaactatcaaataatgctggagattccaccagtatgtactctacgtgagtgtgaagtggaaagtgagtctcttgatacctcatttgttctgggcttctgtgttgctctctcactttgggcaatttaagagaattcttaagtaacattgatgtaggtgactgttgcctcaggtactgactttaaaccccggctgtgtgtaagctgcaggacataaacacctagaacaaactatggtgggtgagagcacagtgtctttaagaaacaccttgaagggaagggtttaaagctgttccccaggtaaggtggtaccttaatcttgtggaacaacaagagcttctcagcagagttccaagacatgccagagagcacagcgcagttttggggaaaatgcaatagttcactggtattctagaaggaatgtctgcgaggagaggcaagaactgaggctaagcaggagccagattacgcaggccttctttagtctgatatggagttcgaagttgctgtggcaggggttggggagctgttgacacgttacagctggggaaggatgggagaaagcttggttcagctgattttgaatgtatcagatgaagcaagggaagaggggaaagctgaggggagagacgccacatgtctgagttagggcgggggctgtggatccagagggcaaggagagaatcccatgatttttttctttggggaaacttgatctttggatctaatcttattatctaggggttttgttttctggtttctttgagtcacttctgcattgaggaaagcagtgtatcatggctgggcaacttggttttttcaaaagcatgtcaccatctgttcacttactctgtagtaagatgtcactatttacaacacagaacacctgtaccttagacacttaccatagatgataatcttaaacttcccattgcccagatttttttaaacacctggttgcaccattcatttctaagcaatcacagaggattgcttaaggacaggttttttgctgggattctagattttatctttctattaagctgaaccataagaaggctgagctcttggacattcctgccaggaactgattttcactcatgctttggtgtcacagtcatggatttcatcagatgccgctcactctgagaaacagcatatgtatgactcttgctgtttctaacttgccattctaactggccagatgtttcttttataactaggtatcagaaagcctttgttgagtaactgacaggttttcttaatatgattcaggtaattgaatgtgtttccccttttgatcgagaggctctgagccaaatccatggccctcttttagaaattgaaaagaatcttatttgcagatcagggttctaatgtatttcccatcttaattttctattctgatttaaatgtttctagggtcctggtttatcatttatgattttctcttttttgtatgtatcatgtaagcagcctcatcttttgtggctggagagaggtatgtataagtaatgtaggtaggagttgccttcctcctggactacttgattttgctgctttgggcaaagtccctgtggcaggcaagttcatttccaggcagctgagtgtctgccccgtgctggcaactgtgtgccccagtgccacagagcttaagtcagtacatgcctcatcactgtcacaccagccccacaagtacaagcgcaagaaaggttttcaccttacacacatgcagagggaagaagttaaagtaagttgccccaagtctctcagactctgatgaagccagaaacaaatcttgtttctcactgcctatgggatcagtgatgaagctctggaccagccagtggcaaattttactggcaagaactcctttggtaccagcctccttcctacaaggattctattgttattttatgactacgttttccccacccttgggccttacagggctttaaaaataaataaaaaggttccagggccagttaaatatttatgcttttacaggtaagaagaaaagccaaaagcaaagatcaataaacacagagatagttgtcatctgacaggcacctgagaaacagttcctttttttttttttttgagacagagtctcactctgttgcccaggctggagtgcagcggtgcgatcttggctcactggaacttccacctcccgggttcaagggattctcctgactcagcctcctgagtagctgggactacaggcacgtgccaccacgcccagctaattttttgtatttttagtggagacggggtttcgcagtgttagccagggtggtctcgatctcctgacctcttgatccgtccgccttggcctcccaaagtgctgggattacaggcgtggagagacaattctttaacccttcttgctgacttgtcttcttctgcccctccccactccagctcacccctctccaggtggtcgtcgggcagcctgtgtctttctccctcctgtgctttgcctcacagagttgtggtcaccaggagatcccccatttttctgcctatttgaatccttccaggccccctcctcctgatgtggcgacacctctctcctcagaaccctgataatgttcacctctcttattaggttataaactctgagggcggggctcccgcattcccgtgtttagccagccgtcttgcacatggcgatattggttttgataatctaccacatcattcccttgttctcatgctgattgcttgttggtgtcagcaggttatgcctgccttattaccgcatcctgatcaggcagctggtgttcaggcagctaagaatccctcccctctataaaatgcattctgataactatggtaatgagacactgctagtagatgtcttggtcagtgatatttaccttctaagcactttatttccttttttttgttttattataggctgcaaaaatacaatttcccagaattttaagttaggggcatataagtaaatctgcttctcttatgggttaaacagagtccccagtcttttctcagaacgtagaaagaaacaactgaactacagattagcttttgggatgccacttgtttgatggccagtgtctacatgtttattgatcactccttttggtttttctttttatctagaaaatcataaatattttatcggtcctggaacagtttgacctgaagttaaagttaaaaattctctagatattcacatctttttatttagtaacatccaagtttttaagctaccttaacttgcatttctgaattgttcaaatgttatatttaagggatacctttatttctgagatttacaaatttgtccactgataataagagtcctatataactgggaggctgggaggtgctctctaacttttacctcctgatctttctcctcttgcctctttttcttttcggtattcctagggttccacagagctgagccccttgggtctaccctttgtactcttctcaccaactagattgttggagatttctcgacctatgccttcaggtactacatgataacagcttatttccaaagccatatctgtagtcgttcctctcttgtgagcttggaccctgtatccttttgcctactggcaaagccccaggtgtatctaaaattcagcttatctaaagcatgattcactgtccttcctttcaaaacctaattcttgttctgtacagcctattttcatgaaaagcactacctagactctgtctggttggcaggccagaaacttcagagggtgttgacatgtgttgggttatccaggaaacagactctgagctggagatgcatgttgagaagtggagatttgcatacagagtgtgtgcgggagctgtctcctgccttcaaccctcccctgcaaaagtgaaagtgaaaaaaaagaaaggtatattcatcatgacacgcattcgtgctgaacccggatgcagcctcagaatccttcttaacccagtgcccttggcaactgttaccattccttggattggcacatgagatgaaatcttatcaatatctgatggtgtggttcacattgacaggtatctctataggcctctacacacaaacatcaccattaacagctgggtggcactttgctcagtgagcagaggtgagcgtttgtctagatagaggaaagaagacaagacagggaaggccaggagcattgggaggtgggtgtcaagcaggagaagcaggagtgggtgggtggaagtacatggtctcccaggtgttcctagaacgccagccctgaaatcagagacctttggtgcgaatattcttaccatttctctcatctcttttgctccaggttacgttacagtggatattttgggggtgttactgccctaagcagagagcagtttttcaaggtgaatggattctctaacaactactggggatggggaggcgaagacgatgacctcagactcaggtgaacaacagagaaaggtccccttcacggggctctgcactcagtgtggctctggagacctgcatttatatttattcctttagatgccagtccagcaggtcactaggctgcagatttgggcttgaagggtgcagggggtggagggaaggtaggatggcccacatcattctgtgccagtagcagtttacttctggcctgggggcatttggggtccagaagtgttggtggaggcctcatgtacttgtcgggaaagacttactgagacaccagtgagtgagaaaccccaaactgcaaggtgtctgctgaactgcaatttggagaccgggttgttaagagcctcatgctttctgtcagaccccttggggacacagttcccagtgtccccctgcagggagtgccagcagcctctggggagctgcacatgttgaagcaggcaaagaggtcctctcctcaagcgttaggcagccctggcagccctgcacgctgtggagactgcaggtggcctgaccccaggcctgactctgggctgttgacattaccctgggttctcttggactgctttctgctctgaggggctcaaagggaataagtctggcctccacccacagcttcttcccctcaacttggatttgggggccagatagttatagttatccctgcctcccagaaataagtaattattcaagagcttaggctggtatctttagacttgtaatcacaaggccattctgggtgtcaggaggcccccttccctcctgcttgttgcctcttggaaaagaaattctttttttttttttttttttttttgagacaaagtctcgctctgtcacccaggctggagtgcagtgacgtgatctcgactcaccgcaacctctgcctcccgggtttgagtgattctccagcctcagcctcccgagtagctgggactacaggcgtgtgccgccgtgtctggctaatttttttgtatttttagtaaaggccaggtttcaccatattggccaggctgatctcgaactcctgacctcaggtgatctgtctgccttggcctcccaaagtgttgggattacaggtgtgagccactgtgcctggctggaaaggaaatttctaacctggggctctgaattattagttacgtgactgtcagaaatttttttgttgcctcatcataaagaacccaggggctccatgctgctcttgttcccatgtctaggctgagagcctctggaatgtttctagcaggagggagtggattcccctgaccaggggctctacagaaatggccgtagtgatgggcaacagctcttcacagcccagcccatcagcagcctatgtggtcatggcttaggaactggacagagggtacgtgctacatttcaggacaagagtagcaaaggctagtgataaacaatccccattatcttccctaaatgtacttcactggggtgattagtagaattttgccctgatcacatatcttcagtgtcttctttcctgctatgcttcagcttcaaagtagaggggagcctccaattttgctttcatttgaaaagaccatcatggccttcagaatggtttttgactaatgtggtagataaactaagatgatttgaatatgaaagttggttgagatttactgcttatttattcgcctgtgcaacaggcactacccttctttgtacttatataatacatataatacattgcagagtacaagcatgttccatgcagattatatcatttgaatatttgaaatcaactccctatcaccattgccattttacagatgagggaactgagacctggaactgtgaactgacttactgaggttgtaaataacagagtccagatttgaacctagaattgtagctttaaaacttgtgaccataaatggccattcctttctttgttaaaagaaggcaactctaagtaaattggggatcctaacagacttgattctcctattcttcaggatgttttgaaataagtactttatcatttttttttctttttgaaaatgactaagtataaactaacacatctcctttgtaccccagtaataaatgctgaatctcattcttttttgggcttatcgcctgaagttccaccattataagaaattggaaattttagaagtttttctttttttaatactccaataatcaagctgtttgtgacactgtgtgtgtgtgtgtgtgtgtgtgtgtatgtgcgtgtgtgtgtataaattttcgcaaatgatgctttttatttgcctagtggtagataaataggatggactttaaaaaaatctctattatttttctagggttgagctccaaagaatgaaaatttcccggcccctgcctgaagtgggtaaatatacaatggtcttccacactagagacaaaggcaatgaggtgaacgcagaacggtaagtcctggcttcacctgcctagcaggctacctccctagtctgttctgtcaataaggactatgttgaattcgatcagatttgagccagttcattgtgttaaaagatttttattaagcaaattttcaaacagacacaaaaggagagaaagtggtgcactgaaccctcacgtctacagttctcaactcatggcctctcttctttccctcagtttttttcttaccccactggatttagaaatgtgtcacagatgtcatagcatttcatgtgtaactgcttcagtatgtattcttaaaatataagcaattttaaaaaaggaatcagaataccattatcatacctagaataaaattaacaatatctccttaatgtcatcaaatgtctagtcagtgttaagtacttttttatttttaaaaccagttgatcagatcagtgtctaaacaaggtccacattgcatttgaatgatctcttttaatatgtaggttccctctccctttctttatgtgttccttgatatttatttgtggaacaagccagattatttgtccaatagaattccttgcattatggatttttccaattgcatcctggtagtataacttaatatgtcctcctgacctctattttctcataaactggttgtattagtcagggttctctagagggacagaacgaacaggatagatgtatatatgaaggggagtttattaaggagtattgactcacactatcccaagatgaagtccacaataggccgcctgcaagctgaggaacgaggaagccagcccgggtcccaaaacctcaaaagtagggaagccaacagggcagccttcagtctgtggccaaaggcccgagagtccctggcaaaccactggtgtaggtccaagagtccagaagctgaagaacttggagtctgatgttcagggtcaggaagcccaggagaaagatgaaggccagaagactcagcaagttggcttctcccttcttctgcctgctttattttagcctcgctagcagttgattagatggtgcccacccacatggagggtagatctgcccctcccagtccactgactcaaatgttaatttcctttggcaacaccctcacagacacacccaggaacaatacttcacatccttcaatccaatcaagttgacactcagtattaaccatcacactgggatttctctgcatttctggagacttgaacagaatcttatttttgggcaagaattttcatttatggtgttgtgtacttcctccagtgtcacaacaggaggatgtaatgtctggttgtgtcattttgtgatgttaggattgatctgtgagtttcgatattgccagtctaatctatgcattgtgagattcctcatcagttttttacctaatgacttcagcagtcattgatgcttgatttctaaatttattatttaattaggagttgcaaaattgtaatattctaattctattgttccttctgcatttattagatttttctacaaagtactttcccttttcatgtatttgggtactctggggtatagtttttataggaaaggcagaataaagagaaaagagtcaagcactgattaaaaatttttcagactaatgacttggtgtttcctagcatccttcaggatgtagttcttgtactttttggtactcatattgtctcatctttggccaatgggatcttcttcaagctgggtcctgaatcccagtagtcctcgagagcttccctccctgtgctctgctgtgatgaaatgttctaggctcttcttgtacttttcctgccttgggaattggcctattcacaaggaatcctggcagataagccagttcttatgaggctttgattgaagaatctgtatttctttgttctgatttttccccttaaattttcaaacagtcttaaggggtttttagtgcttttgttatagtctacattttaaaacaatattaaagtgcttttagcctgatattaaacagtcctgttaaagttcatttatttttttctgaggcagggtctcgctcccaagctggagtgcagtggcgtgaccatggctcactacagcctcgatctctcaggctcaagcaatcctccaagctcagcctcccaagtagctgggaccacaggcatgtgtcaccatgcttggctaatttttttttattttttgtaaagacagggtcttcctgtgttgccaaaggctggtcttaaactcctgggctcaagcagtcctcctgcctcagcctcccaaagttctaggattacagcatgagctaccatgcctggcctaaagtttatattttaaagcattattaaatggcttttcacccttttggtagagtcaaccactccaacaaaatagctatttctattttctatgtttttctagtcattgtccataggtatgcatttttctctttatgttaaaaaaattaattattgagtagatacaaaagagtattcctaaattgtatgaaaagtatgaagattcttgatgccatgaacactgctgatatctcctacccccactttgagtgcatgacctgtgtggtcctccctaattctgtagtctcctccttcacatctcccctatccacctacccaagtaacacttctctgaatttttgtgataagtatttgtgataatgatagttatttctgctgtttcttggttttcttgttttcccatatgtttgtatccctaaacaaaagattgcttagttctgcatgtttttcaactttatgtaaatgaaatcacactgcatttattcttctctgactttatttagctgaacattatgcatctgatccccatccatattgtcatgggtaactagcatttattgtcttcactgctgaacaagtagaacctattcagttcactgcccacttgtcttcccagattccatggttctggccacactagtgacttctttaaatgcatcctgctcttttgcgtctgtgcatcttgcccagggtggtctctctgcctggagtgctttttccttcaccttcttcacttggtggatttctctctttcagcgttactgaaattttccttctccctgacacctcacccgacttcctcatgaagttaggtctcccttcattcatcctcatctacatacattctaatttttttggaggctcgtgaaagctatgtacccacctacagacaaactttccttataacataggaagattcagagatcccctgaagctcagccaaggatcagttagcaatggttggtacatatcctgtagtatctgtattccttgcacatccttctgtcctgtagactgggggctcactgagtgcagtgacacttttcatcatgggtccccgggttctcacgtggagtctgacacatgaatacatggctatcatgtctgtcaccttcaatggggcaaacaaactttgtaatggtaggaaacacaacaggtacaataatttacaaaaatatgtttgccacatttcagggcaaggcaaaatgcagtggagacatatgttaaattcttatcattcacatttgttctttttatctttaggatgaagctcttacaccaagtgtcacgagtctggagaacagatgggttgagtagttgttcttataaattagtatctgtggaacacaatcctttatatatcaacatcacagtggatttctggtttggtgcatgaccctgggtcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcagctgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagctttgagtgtt

SEQ ID NO: 502 - DNA, 87689 bp, Homo sapiens
gacgagcaagcaaagagcttcccctgcgcagccaggctgagcttcttggcgccaagctgccgcgagccgtgacagcgtccgacgtgatgacatcacgcgagcggcagccaatgaaacgaagcgctgaggaaagtggcttgggtttgaatattgtggttgagtctgaagcgctgggaggcggacattaaagtgaagtggttgcggtaacctggcctgggcctgaagtgagtgagaggcacatgaaggtaaaactggactctgggacgctccttttggtgacttgtattattgggaacggagggtcctgccgcttcaggtctagaagaccaggtgggcttcttgacaaacacagaagcgttgaggggtgggggatcagggtacctggggagaaagtgaaaggaaaaagggattcgagaacctgctaagagcacagctctgcttgaccgtaatcctcgactgctcagctggaagggcagggatctccttaagtcctgagaggaagtcttaagttttaaagggcatcttggcccctttcccagactggcagagaactttaactgcccagcaccttgtagtgtcagcttttttccggactccaaattgggagtgttttgtttcagactcacatataagcgtacccaggggcttacctatcaaacgaggagcttttgttcatcactgcataaaatttttgtctgaagagctttaactgttagtcttgcactggtcaatcgggaacccctcctgagccccagttgtaggtagcatcgagataaaagccgctctgactgcctaacgggattgccgaggatcagatgaggtacggaagagatactgtttggcaaatgctctgcagatgaaattaaactgtaaacatttagaatcagtcctatagtctgttcttggtttccgcaggacttttttttttttttaggagctcattagtcactcagttacagagaagccaagactgactgctgtttattatatgagaagagagtatttgaccagaatgaactgattttgtggtataatatatagtttagattatggataattaggtagaaatttaggcactctacagattttaatttttagtgtcattccaccacgtctagcctcctgtttcgtttttgtaaggtttttataaactttgatgctagagaatgtgatatccaatgactagatagtgcttcttattaagttcatagtttgtaagaactatttcaataaacaaagattatctacaaagcacaatcacaaagaaaaaaacttaaaagattatctgcctttaatagtagtaattaatctccttttctattatttattcatttatttgagacagagtctcgctctgtggtccaagctggagtgcagtgacgtgatcgctgctcactgcaacctccacctcccaggttcaagcaattctcgtgcctcagcctcccgagtagctgggattacaggcgtttgccaccacactcggctaatttttgtatctttggtagagacggggattcactgtgttggccaggctggtctcgaactcctgacctcaagccatctgcccgcctcggcctcctaaagtgcaggaattacaggtgtgaggcagggcacccagcccttcctcttctactattgaaaagtatttacaaatacataatatttttatattgaaagtgcatcttgtcccatcatagaaataccccaaatcaattaagagacacgataaaaatgattttttttttttttttttttttgctgacaactgtgaaaactaagaggaaaaaaaatagctcagctgtcagtgccggccttccctccagttgaaccttttattcttccctgatggttgtaagttggtgggagtagtgcccccaagactgatattccaaaaagagctttaagatggactgtagatgatagtgttgagtatcgttttcagtcctatacagtgtttgttgaatctgaatctaattcaggtttgagtttgtatttaatatatcataactgtcactctacttctgtatcattgtttggaagcattctcttctgattccagtagaacctagctgttaataacatggactttagatttgtacccgttaaggagtttgtgttttattcttctggtgagaagtcattggagactttagagcaggtgaatgccatgtgatgcatcacatgatctgaatgcttttgatgaacgtatcagtgaatacaatcaatgaattaaatttattatagtactttcataaaattaggggtgaatctttgactgaattgacttatatttgacatttggttgcccacttgttacgtcatcttggaaaagttacttatcctaaggctaagtctttgtttttgtaaaatggaaatactactacaacctaccttacgtgattattataaggattgaatgcaatgacgaatgtcaagtgtttactataatgcatgagacagagtgtacatactcaaatgaaaagcattgttgttcattattaataattatcaccatatcaacctaatctaagcattgttaaagcatacttattgagaatggccactctgtgatatctgacaagtacagagaaatcataatcagttttattttcacattcaagagctcctgtgccaggccctgaggtttctatcaaaagtaaggaaatataagagagtggtaccagaagctgagttttgggggaaatagggagattttggtcaaagggtacactttaagttataagataaataagttcatggcatttaatgtacagcatcaatggtgatagacgtattaatttaattgtggtaatcattccattgtgtataagaatatgagaccatcacattgtacatcttcgttttatacaatctttgccaattaaatgttttaaaatttctaaaaaagtaagcaatatatatatttttaacttctataagaaaatttctgagggttatatatttacatcagggagagtagtgattaagtatttggcctttagattcagtcagtctgagttcaaatcccatggcatgtgcttcctcagttgtgtgactttagccagttaatttctctgtattacactttctgccttaataaaataggaatgacagtacagggtttatgtcataggttgttatgacgatttagtaagagtatgtcaattgttagtacatttctatttgtgggatatgagctcaatagaaaatataacttattgttactaaattaaatgttgcgattaaggtaaattttaatagtggttttgttgttgttgtttgtctgttttgaaataaaaatacctagaccttgtttaaaatttaaatattacaaaagaatatgaaatggaaaataaacctgtctctcactcagaccttcatatttcccttctatagggaaagtggtattatcaatttcttgtgtacccttctgggaatgaccatgcatatacatatatatcttttaaaaatacaaatggtaacatgctataagtctattaaaactgtactggtttattcattcatttattcaacaagtatttattgggtcctaaatatttgacaagcagtgtcctaggtgctggtgtgcagatgaactccgtgctctcacagtgcttacattctagagggaaaacaagcaataaatatgtaaccagataacatatactttccaattagtgctaaactcaagaaagaaaaataaacctagtaagggattggagaagcaaaggcagggtgacactatcttagatagattctttagggaaagcctctgtaaagtggcatttgaagagacctgaataatgaagtgagggattacaatttgcaaatatctggaggtaatgcctgccagtaagcaaaaataaaaaagccaggaggccaaaacaagactgaagtgttttaggaatgctaagaaagtcattgcagctgaagcagaataatgaaatggggagacagcagtagaagtcattgtcagagaggtaggcagggccatatgtggaatttataggccatggtaaggagtttgtattttattcttatgatgagaagtcattggatagtttggagcaggtaaatgacatgcaatacatatcatgatctgaatgcttttgaagaaagtatcagtgcatacaatcaatgaattaaataaaatttattgtacttgcatataattaggggtgaatctttaatctgggatgagcactagctacatatgttataagttaaaaattgacctgttcaacttggcttattaccatgcaagtattcaggataaatagattttaatacctcattaaacattgcagaggcatgagctgttctacataaatgaatcttccagaaaattgaatattagctttgctaagtaataaagtattttaaccacacttaatgatgaaaataaaacatgatcttgccatttctttaattttctaaacaagaaattgggaacattatttctttcttatttttttctttttgatgcctcagggttctcattgtgattgcctgttgttgtcaactattgtactctaatatgttgtttctcttggagatatacattttctttttccttctactctaagtgagtaaattgctttttggggtctgtgagcattttttatagtttattaattcattcattggtatatttgaaaatttactatatactagactctctatgagagaatagggatataaagtaaaagtctattaactgtcatttcttattctcttgtacccttttctaatcatgcataataatcataaaattttggagctagaaaaagactttccgtatcatataatctaacccttttgttttatacattagcaagtaaagcccctttccttagccccttcattcttcttttttgataccctactctctctagactagacaaatattcttcttcaggtttagtatctattatataaaatgcttggtaccagaagtttttttgaattttggaatttttttttttttttaatttttgcattgtgcttactggttgaggatctctaatctgaaaatccaaaatactctaatgagcatttcctttgagtgtcatgttggtgctcacaaagttttagattttagattttcaaatttggaatgctcaacctgattataatgaataatcacgttggaagtatttgtctttcatgttttagttccaccaatgaaatcctaccagtttgctcttttgattctgttcagtaaataccacttaggggtagataggacaaaattgatcagaggctataatactatcttctgaacagctgtctgaaaagaatttgtgaatccacacattcttgcgcagataacgatatttaggcttttcttttgctgcttcatattaaacatggttgaagaatttactctctctgtgccttattcagaatcaactaaatgctcatttcttttagtcagccatcctagaaaacaaagaaggcaccacataataatgtaggaacgatctcattaattcctgcagatgtaagtatatttgaacatagattaatttttacatttgatgattctgttgaccttaggcatttttattaagaaaattctatccacatatttgtttttaaaagatagggaaatacatgatactttaaaaattaacatccatgtctttgttaaaatatgcaactagttgtgaaacaaagttatatttgacattatacttaaattctattgactgaaagagtcaaactctgtaaaatatttgaagagatttattctgagccaaatatgagtgaccatggcccatgactcagccctcaggaggtcctgagagcatgtgcccaaagtggtcagtgtacagcgtggttttttatattttagagaggcatgagacatcaatcaaatacatttaagaaatacgttggtttggttcagaaaggcgggacaactcaaagcgggggcttccaagctataggtaaatttaaacattttctggttgacaattggttgagtttgtctaaagacctgggattgatagaaaggaatgttcaggttaaaaataattgtggagaccaagttttattttgcagaggaagctctcagcaaatttcagagagagagagcaggttgtaaaatgtttctccgcagagctaaaagggtgcctggcttttagttgattatctactggatctgcaaagaaaagaggaaaacaaagagggaaggggattctctatagaacgtggacttttccaacaagaaactttgcagggcaatttcaaggcttggcaagtaaatctattttgggtgttaaatattttttctttgtctcataatgttatgccagagtcaattgaaaagcaagtcacaatatacggggtcaaataaaacgcatctaatgaaaatccatgatttatagggcgtgactccccagaccccttagataggaatttgggcaaaataaaaaatcagagtttagtcctcattcctttaggtaattgtccaaatttctccctggaatgttacttaaataatcccctcattatagtcttataaagcactgttaaccttttccctataatggcacttgtcacagttatacctttacatgtttgtgtcaatattttattaatatctgtttccctcactacactgtaaataataatagcaaacacttgtagttcatactctgtacaaagtattgttctaagtgtgtaatctttacaactttatgagataggtactgttgttagtcttactttacagatggggaagctgagccacaaggaggttaagtaacttatccactatcacagtcagtacgtcatagagctgagattttaacctaggctgcctggctccaacatgtaatagttgtcatgaattaattaactaattaattagggagggatatcctccagccttgagattctaaggtttattttgaaataatcacttagtattttatgtttactttgttaacaatttcatttatgtatatttaatctatcatttaaaaatagtatatctgttaaaatattgttgaatatttctaaaagcttttagaaatgtgtataggagatagtttttgttatcacaaggaatatgggacactgctggcctttaatagacaggggagagaaatgccaaacatcctctaatagggcagttctaaatgccctataacagggcagttctaagcaaggaagaattggcctacccaaagtgctagtcataagcccattgagaaaaactcaaaagatgaactcagtctctttggcaagaagaagcaggagtggggcagataggaagagaattggtatttactgaataccttaatacttaccccttttagcctttgcaacaaacattgaggtattattatctcttttatacaaatagaaacctgagactcatggggttaagtaacttgtccaaggtcataaaagtgaggtgtaggtgctttgtgacacttggctagacggaagctcagggatgaaaaacaaagtagtaattcacctgggacctgacttagaatccaaatgaccatcccttccttttcagtattctatttttggccaaagacagagtcctaaaaaggcaaagatatgtctagcatctactgcttttagattcctttgaattctgtccttatttgaattctgtccgaaagtatatggctaagtggttttgtgacatatttcagcttgaatattgctatttctcccatttaaaaaaaaatacaaacaaaacatcttgacaccacccccccccttcactcacaccatttttctcctccctttgaaacagtcctttccatataccttgtctatggatcttctcctttcgggttttttccccactactgccccaaaattgcttttctcgatggcctctgtgttagtaaatcccatggttaattctcagtaagtacttgacctattagcagtatttaacacaatagatcgctgtttcctccttcatttaggatttcccgaaagtttttaaagcttaatactgcattaagactgaggacagcctttattttcttattttcttaacttccacctgccctgacatttccacctggatgtctgtcaaaactctgagacttaagctatccaaaactgaactgatctgaccctgcctcccaccacttcccgccctgctgaaaaaagccctgcttcttatttccatctcagttggtgactactttatccttctaattctcaagccaaaaaccttggagttattcttcaatcctgtctctctctttcactctacatctacctgtcagtaaattctgtcacctttaccctcagaatacacccataatctgaccacttaccacctctgctgccactaccctattctgagctgacagagttgtctcttgtctacattacttcaatagactagtctattatattatccacatagcagtgagagtgatagattatgtcactcctgtgctcaaaacgacttccagttgttctttgtcttactcagagtacaagccaaagttcttttaatggcctccatttctcctctcatgtcttactacactcccctttgctcactccattctggccaacataaagtagcaccctgggtccttctctctatggggaaaagcttcctacaatacctgtatgactaactccctcacctccttcaagtccttacttaaatgttgttttgggtgaatttattatttttgtctcttttattttaacttacaaatgacaaaaaaaatgtgtaagtttataggatacaatgtaatgttttgatacatgtgtacacagtggaatgagcatatcaggctaattaattaacatatccatcacctcacataccatttttttgttgtgagaacatttaaaatgtactcttagcaattaaccatggtcaccttgctgtgcaatagatcaccaaaactattcctcttgtataactgaaactttgtaccctttgaccaacatttccccttttaccacccaccccaccctcctcagcctctggtaaccattactctacttctctgtgttcatatttttagattctgcataaaagtgagatcatgtgatatttgtctttttgtacctggcttattttacttagcataatgccccctagattcattcatgtcgtcataaatgacagaattttagtcttttttaaggctgaatagtatttcattgagtgcatataccacattttttcgatctatttatctgttgataggcacttagattgtttatatatcttagttattgtgaataatgttgtagcgaacatggcagggcaaatatctcttcaacatactgattttaattcctttggatatatactcagaagtgggattgcaggatcgtcctaagtctcaccttttggtccttactcagatcttgttgttttggggtgttttattttgttttgtggtttggtttttttttgtctttttgttgttgttgttgtttgtttttttgttttggtttttgggtctgcagattctagagtattttctggatagttgagacttccaaattattgatctttgttactttacttttcttctttgcatgtgaaccagtcataaaatcagaccataatttttaaacctgctatcattgattccttaaacttgcacacaattagaaagcagagagtaggatcaatattcagagactaggtctctgaatacaccaaggagtctatgccatctctatcaccttcagacctgagctatctagttgaatgcatccttggaactatttttaaccctatgggcttctgagatacaggtagagaccagcctgggtgtatcactttccacggccaaggggcttgcagccaagatcacttttactaaaaatagttcacaagctaaggctctccaatcataccttgatatggttctgggagatccttttctattcattcccatgacctaagctgaaatagtgctggagggcttgtgaaaatcaaatctgggttttaggatagcatatctgtgattatatatggttcagctatagtatttgagtttaagccaaatatcctactaatatttcaggtaaagagatttttatcgtagttgtgtgtacgtatgtgccatttaattgtttgttttagggtacttaagtgcatatgtgtgtatgtgtgcatatatttgtgtgtgtgtgttgtgtgtgcctacgtatgtatgtatttttcccccagtgtttacctagtgagtgaaacagaattattaacatcttttttgaatgaatactacatgccagttgttttgcatgaaagtaaaaactgatattaaaactttattttcttttttaatttcagagaagtattcaagtatttatacagataggaatcaagataatcaacaatgtctgtcactgaggaagacctgtgccaccatatgaaagtagtagttcgtgtacgtccggaaaacactaaagaaaaagcagctggatttcataaagtggttcatgttgtggataaacatatcctagtttttgatcccaaacaagaagaagtcagttttttccatggaaagaaaactacaaatcaaaatgttataaagaaacaaaataaggatcttaaatttgtatttgatgctgtttttgatgaaacgtcaactcagtcagaagtttttgaacacactactaagccaattcttcgtagttttttgaatggatataattgcacaggtatttgtttcaatttgggatttaatttctctatccgatttcacttttgcattaggacggacatctacttgacccttctaaatataatcaaatttaaggagcttgtatgctaaaaattcttaagaaattcaatagacttgaactgtaaatatagactttgaaattttagttatcatatataacttatacatcatttgtaaacctttctcttccagggccttactgtggcccctatagacatctgtcctttcagttgcctatgttattaaaccacatgcttattgcaattaacatcagttttctcataacctgtatttataacttttcctacagcttacctatgtaattatctattcctggagagtagtcagacatttctgaacatttgacagtttcttttcagcagtttttcttcatggcacattgaaataaaaatgtttaagttggcgaaggataggaggagactgaggatcaaaaaactacctatggggtactacactccttacctgagtgatgaaaaaatctgtacactaaaccccgcagcatgcaatttacccatgtaacaaacctgcactgtacccccaaacctaaaataaaaattggaaagggggtaaaagtgttaagatcccatgttaattatctcatgccctttagctcattgttagcccaagaagcatctttagtgctttttttggcctttcaagaaagccatgttgatttcctttttaaaaaaaaaaaaagagagagagagagagagatacccaagatgcaaaatggccagtttttcagtgcctaccaggcactaaacaccattattaatatcttatttttgtaattattagtatttatgatattttccccaagacagctcacaactataacatgtttcactgtcttttcctgattcatttcagttttatcatggaagacataccctcttgatcaagtaaggatggagtgtggtttattgattggtactactgtgattcccatttttaagaagatattcttttcctctttcatgaaacttcatatgtctctagagattttgaaatcttcttaactctaagaaaaaaagtagactctctatcaaactactattgaatttttggtttctttttggctttctttatattcttaccctgtctttaagacagcttaagaataagcttaagaataagccattttaaaccttccttatataccagcttacataaaatagaacaaagtaaaatatacaccatcttaattcatcctactgaaaagtatttttgtggtttgttaacatttggtttagcagacagattgaatttataaaaatattttcaaccaataatgatatgagaagttattgccttaactgattattgtattgggtgtttaccatatgtaattcacagagtggatttttttctttctctttgtctttttttttttttttttttttttgatgaagtcttgctgtgttgcccaggctggagtgcgctggtgcaatcacagctcactgcaatgatatgagaagttattgccttaactgattattgtattgggtatttaccatatgtaattcacagagtggatttttttctttttctttgtcttttttttttttttgatgaagtcttgctgtgttgcccaggctggagtgcgctggtacaatcacagctcactgcagcctcaacctgctgggcttaagcaatcctcccatcttagcctcctgaatagctggactacaggaatgagccactgccctcagctaattttttgaaaatttttgtggatacagggtctcactgtgttgcccaggctggtctcaaactcctgggctcaagcagtcctcccaccttagctgtccaaagtactgggattgtagggatgagccaccgagcctggcccacagagtggattttttatacattggaagaaattcacatgactttcttgtactgaatagaatctaggaaacaaagtaattcacctaaaacaaaaacttaaaaaggaatcttataaatggcatctatctggtatttattcaagtacctgctttgtggcaagtgatttgttaggtgataaggatacatggcctctgccttggtggagcactcaattggaaatacagtgtgatacatgccagaagagagggatgtggatatgcagcatatactaagggctgaagtgaaagagtggatgtgtctgcctaggacaatgagggaaggcagagaaaaatgatatttgtgctgagcatttagaagcaggtggaagttttccagctggatcaagtagagggactcctcagaacaaagacagcagagtagaaaggagcagcaaatgctgagagtattgaataattaagtatccctagatcacagcaaggaagcagtaggctggcaaaataagcaggcaccctctgagtgctttataatattccaaagtgaggaatttgaacttatgtaaacctggaacaattaagaaggtttaacgtattccaatttctttttcataaagatgactacaaattgcaaaggataaagaagatggaagatgaagactaatctgtagggagattttaagattgctttgaaagagtagttgttagagtggggggccgggggtagtgataccatttatcagagtaaagaacataggagtaagagtagatttgtggtaacattcccaggttttaaggataagactataattttggatttgtagggtttaaagatactgttcaggatatccagatggaactatccactagatagtagatataatagagttatatttcataacaaagagttttgatccctttcttaaaaactcagtacttgcctatggtgccactggtgctgggaagacccacactatgctaggatcagctgatgaacctggagtgatgtatctaacaatgttacacctttacaaatgcatggatgagattaaagaagagaaaatatgtagtactgcagtttcatatctggaggtaagttgggaatttagattaatcaatagttttgggaaatcattgacatgattcatacaaatgattttattatataagagttttccggtgaatatataaaatcattaaaattccttgtcttgaatatttgttatgcatctttttctgttaattttttttttttttactttggcaaaatttcagacttatagagaagttgcaacaatagtacaaagaacttccagatacccttcatacagatcccccatatgttagcattttactgcatttgctttctatgtgtgtgtatacatttctttctttctgagctaggttgcagacttgtaaaaacaggactttttaaaaataactgctaaataggtaccaaaatcaggaaattagcaatgatacaatataattatctgtagatcttagtgagattttgctagttatttcattaataccctttattgtaaaagaaaattgtattcagttgttatatcttagtctccttaatctgtaattttttgtcttttataacactgccataaaaatccttagtttggatttatcatgattagattcagattatgcactgacagtaacacaagcaaagtgatgttcacttcttactgcatcaaaaaaggcttaagccgttgattagtccccatactgggaatgttaactttgatcagttttattatgctgtggtctgtagagtttctccactttgaagatacgttttaccatttataattagtaagtactatgtatgtagacaatgtaaatattccttactcctcaaacttttatctattgttattagtatccactgatgattggtgactgaatcaattactattatgatggtagatgatggtgatttttaaattccatcatttcttgtacatttctttattgactttctactataaggaagagttttccccttattatatcagcctcctgcatttttactttattgaatagattataatccctttctgtaatcattttttgtatgttcaaattgtgtaagatttggctagttgagacttcttcatgttgtctcttgtgtccttttgaaataccccatcattctttgaggccttctaccctcttaatagtcaacaaatggtaactaagtggcagacactctaactttgcattcaaatagtgtttcagaaaccagtgcagaaacataaaaaccctgatttcattgcctatttatttctggtgccataaaatttctctcttattaacatcttgtagtttggtccctactgagaatttcttccaaagattgattaaaatcatatatgttgctaaaaatttcttcattagaacttatagataaaaaagaagtaaaactcattttctttggttggttaactatgaaaagaattgttctgaactcaattgggaaaagagggtgccagcattcattattttttccttagatcctttttataactgggagaattttgaagtttggttattttcacaatttttattttttcttttaatctactttcatattattaatgataaggcagtgtataatatggttttctactcaagctgtgcaccagaattgcctatagaactttttaaaaataggcctaggcctcacacttgggatattttaatttagtaggtctggggtgtggctgaggcatctgtgttttttaaatgctccttggtgagtgtcatacatagaccagcttgagaacaattattctaatttttgatttgttatgattgaagtgggtaaggggaagcaatagtaaagtgactgctgctcatcaaaaagatatgatttaaaaatatttcttcatattatcattttactacttttaagggtttattacattctaatgcctatcattcattgtagagaattgtaccagcaatgaattatcactatgagctacttattagaacacagaaggaaataacacaaaataattttttagagactaaattttgttattttttttcttaaatcttgtcagtaatagttgtaattgtcatttggttagcaagtaataaactttatacctttaataaattcataaaatcgggtcactagtactacatagaaatgtgtgttacttataaaaattactttttaaaaaatggccagagatataaactacagatatgtattcagtatgatgcagtagagtgaagctgtctaggctccagttcctactctgctaatacctttatgaccatggacaaatcatttaacctctcagagtcttagttccctcatcattcaaatgggtctccttttgaaatttattattagtaattatatgtcaaaattaatgtaattgaaggataaccgaaacaaataccacctgtccttggtatgggttttctgtaacatttaagctctaaaatttcaaaagtttggactacttggacattgtgaaataatagatatcttccacagtaagaaccatgccatctccatacaacctgcatttcccagagtttcccagtaccgtgtgttccatacatttcctgaaaataagaaaatgggccgggcgcggtggctcacgcctgtaatcccagcactttgggaggccgaggtgggcggatcacgaggtcagaagatcaagaccatcctggctaacatggtgaaaccctgtctccactaaaaatacaaaaaattagccaggcgtggtggcaggcgccagtagtcccagctactggggaggctgaggcagcagaatggtgagaacccgggaggcggagcttgcagtgagccgagattgcgccactgtactccagcctgggagacagcgagactccgtctcaaaaaaaaagaaaagaagaaaatgcacttcagctatcttacttatctctgtttcaccatagtcatcaaggcaggaattatgagtgaggggatgactccaactttaagtttcaatttcaaacctaggtaatcaaactcttcaattttctggaatgatagaaaattaatggcaacatgagatcgaaggtatgaggtgaataaaagtgaggtgctgcttgtctttaggataaaattctaataactttaaattagcagtgtatgtgtgatgtaatcaccattttttttttttacatcaatgctaaagcagttctttttattttaaggtatataatgaacagattcgtgatctcttagtaaattcagggccacttgctgtccgggaagatacccaaaaaggggtggtcgttcatggacttactttacaccaggtatgtatataaacatctttttccctgttagaatagcaaatgtgactattaagctattttcaccagccatgcacttactttccatcctgtttgagaaaaaaaactaatgaggtacagaatttaaatgattagggtatatttttagtcttattttgttttcttttaaaatagagtgaactttttaaaaacattttttaaattttatttttaaattttaatctacgtatgtatgtatgtatgtatgtatgtatgtatgtatttatttatttatttatttatttattttgtgaccgggctatgagactggctaatttttgtatttttggtagaaagcgggagttcaccatgttattcaggctggtctcaaactctggggctcaagatctgcctgcctcagcctcccaatgagtgagcttttctttcaaaaatctgcttgaacatttaatgtcatattattctactcaatagactccactcctgagaaactagattttatcttttattcttcatataaacacacacaatactaagcagatgagacaaagttagtatttaataggattgaatttatagaaaacattttcttttacctttaaatctttttgttttttgaacatttattgaaaaatttaaagatatattgctgatttttaaattttgcttctacttaaacttctccagcccaaatcctcagaagaaattttacatttattggataatggaaacaaaaacaggacacaacatcccactgatatgaatgccacatcttctcgttctcatgctgttttccaagtaagaggccactagactatcactcttaaaattggatttaaaataaatgaagctaaattcatgaatcatcattttcatacatgtgaaaaaaatctgtctgtagacttcacttgtcagtactttcctttatagctttgaaaagtttctgtcaccaagagtatttataattgagatgcttaaaacaaaaatacaaaatttctacctttgtaaacatacaggaggataaagttgtagtaataaaagttttgtttttgctgaaaatatttaatctttccaataaataatcttatattcacagtaaaacttatctctataaatctagacttgtagaactaataatttgggaacatactgattcatctttaaaagatttcaccataaggaccatgtaaatagtcgcattccttaaggaagtatgattcagttggcacagtaagtcttaggaatacaattccagaaagagctaaagcataggttaatagctattatttcttatagtttctagtccttttaatacccaaatgataatataaagcttcttttagtattatgccatctgagatacatcttataagaaagaaattgttatagttgaaagaattgatattgaaggcaatcaaaccattcatatagtccctggtcaacaaaaatttcattaatcttttttgttcttaccactaactcttcggttattaatagtcttgagagaaatgtttctctgtgaaactgagatgtctctgaaatatcttagatcctgctttataaaacaatttaataaatgggtttataattaagtaatatcttactttcctcatcttttgtttgccacctaatgtagttcagataatccttacagagtagcttaaaatatttgaataaattatgctttactaggcagttgaaaatgacaagtagactttactgtatagtcatgtgccgcataacgacatttcagtcaacaacagtccacatatacaacagtggtcccataagattacaacagagctgaaaagttcctattcatctagtgatgtcatactcatcataatgtcgtggcgtaacacattactcaaatgtttgtggtgttgttggtgtaaacgaacctgcactgccagtcatatgaaaatatagtacatacaattatgtacagtacatgagacttggtaataaatgactgtgttactggtttatgtatttactttttattgttattttagagtatgctcctacttattaccccaaaagcagtctgctacattctgtttaccaagtctgtggattttatcattttctctcatgtttgatttatgatattttcacaatgaggaaatcacctaacagtgcatttctcagaaagtagctgtgttgttaagtgatgcaagactgtactatcttttttatatatgatattttaattatgaggacatatacaggtttgggggattagaataaatttactcttcagtttggatcaagattcgaattcagcttcccttgaggggcaatctctagatacatacaaggcattctaacgagtagctttggttttttcttaggaacgttatttctataggacctgtgtttctaaccatcacctctgataattccatgtcctggttcaaggggtaccagaatagaaatggaagttttgatcttctatcaagtcaagagttatttttcctctggtacacatatagaaagtcttttcatttttatatttttctcagctatagtgattacttatagtgctcttaaatatcaattagattataccttgttcagttgttttttaaaatgaaaataattttgattttgtgctctattaaagtatatatttcccttttaattttgttaaatcttatcctcatttttttctattttgtaatttcaaaaagatttacttgcgacaacaagacaaaacagcaagtatcaatcaaaatgtccgtattgccaagatgtcactcattgacctggcaggatctgagcgagcaagtacttccggtgctaaggggacccgatttgtagaaggcacaaatattaatagatcacttttagctcttgggaatgtcatcaatgccttagcagattcaaaggtaggcattatatgtttatttgttaaatagtttgaaatattgaaatagataagaaagatactatttaatatgattttgttttaaaggtctgatatatatcacatttcaagggtatatcagtaatgttaatatatagatcaaagacctcagaaaacctagtgtattaaactgatttttatttcttttttaatttccagttttataatgagaattggttaaatagaaagtaatgaataccagattgatagttaatattttatggtacattctcatcacttattttgaacttggtttttaaagtgatcactacacagcaaacatgttaattaaattggcatgaagacaaactaaccatatttttaaaaactaaattctgttgtttagtattttatatattataaaatagggttaagtattaaagagtgttgatttttttttaaggggggtttaagttataaaatgtcatgaaatcacctaataaggtaatgtttactagatgcttctgggcatatttaaatatagtttacatataccatatgccagaagtgcttacctagaacacagtgtatttcacaacatagatatttgtaaaaatgacatcctttcaaaaaaattataatatggcaatttaagttaaaccatactcgaaagctttagcttgttaaactgttcgaaaagctcatcattagtcattagaaaaatgcaaatcaaaaccacaatgagataccatctcatgccagttagaatggcgatcattaaaaagtcaggaaacaacagatgctggagaggatgtggagaaataggaacacttttacactgttggtgggagtgtaaattagttgaaccattgtggaagacagtgtggcgattcctcaaggatctagaaccagaaataccatttgacccagccatcccattactgggtatatacgcccaaagaattataaatcattactagaaagacacatgcacacctatgtttattgcagcactattcacagtagcaaagacttgaaaccaacccaaatgcccatcaatgatagactagataaagaaaatgtggcacatatacaccatgcaatactatgcagccatgaaaaaggatgagttcatgtcctttacaggcacatggattaagctagaaaccatcattttcagcaaactaacacaggaacagaaaaccaaacactgcatagcaggttctcactcataagtgggagttgaacaatgagaacacatggacacagggaggggaacattacacgccaggcagggcctgtcagggggtgtgggggctaggggagggatagcattaggagaaatacctaatgtagattacaggttgatgggtgcagcaaaccaccatggcacatgtatacctatgtaagaaacctgcacgttctgcacatgtatcccagaacttaaaatataattaaaaaattaaatttaatttttttaaaaaagctttggcttgttaaactgttcaaaatgttacctttgatttagaataagtatattaaaataattggagcaggttttttttttaaaaaaaggcaaattactgaaatcacatgaagattgcaaaagcaagatgtcttttatattctgagttaaaatctcaaacttgtaagcagacagcatgacacagagacggattttgtaaacttaagccattcataagatttttgccatatgaactaatctataattttttaataatgactcctattgagtcatttgtgagtcaatgtttaatatatgtcttgtacatgtaaaatcacttaaaatagcaccagcagtgcatatttcacactgtttgggaaagactgctatggtggaagcacattgctactgagaattgggggaactaggacctatttctggctctttgaactactagctttgtgaccctagtcaaatcatttcactttatgcttagcttcaatttcctgttttgcaatatgaaaggtatacattggataacattaggttgcttttagcttaacattgtaaagaatctgttcttatataaacattctactttctggaaaatttatttgttacttcaaaatcagaaacaaaacttaacaaaatttatttgttacttttacttttttctttttaggtaaaagaaaatcttgaagtattaggttcttttagaacactatagtgatttcaggagaaatgtctgtaacattgtaattataatttatttcatatcgatattagatggttatttaaggagaaaagtagctctaagccatgcagttattattcctctagtatatttgtataggacatctgtttacttttgtgttttaatttttttcaatgattggaaatatttttaaatagacattttcaaatagttttagatttacagaaaagttactaagatgatacagattttgttaaatatgctccacacctggttttccctattgttaattttttatattaatatggtacatatatcacaactaatgaaccaatattaatgtattattttattttgaactaaagttcatacttactcagatgcagatatttttaaatatgatatttgtttcatatattcactgaataatcctgtaagattctttgtcatcacctcaatcaccaattataagtctggataaaattgggtagcgcttaagttcttatagtgaagtgtagggtcaagccctacgggacttggcaggtgtcctccccgtgtgcggagacgagagattgtaataaataaagacacaagacaaagagataaagagaaaacagctgggccccaggggaccactaccatcaagacacggagaccggtagtggccccgaacagctgggcgcgctgatatttattgcatacaagacaagggggcagggtaaggagggtgaatcttctaagtgattgacaaggtgaggcaagtcacgtgatcataggacaggggacccttccctcttaggtagccgataacagagagagagatggcgcatacatccgtgttttcttctgtgcacttataagaaagatcaaagactttaagactttcactatttcttctgttgctgtctactgtgaacttcaaagaggaaccaggagtacaggaggaacatgaaagtggacaaggagcatgaccattgaagcacagcaccacagggaggggtttaggcctccggatgactgcgggcaggcctggataatatccagccttccacaggaagctggtggagcagagtgttccctgactcctccaaggaaaggagactccctttcgcggtcttctaagtaatgggtgtcttcccagacactggcattaccacttgaccaaggagccctcaagcggcgtttgtgccggcataacagaaggctcacctcttgccttctagatcacttctcacaatgtcccttcagcagctgaccccatacccgccggttattcctaggttatattcgtaatgcaacaaagagtaatattaaaagctaatgattaataatgtttataatagtgattgataattgtccatgatcatctctatatctaagttgtattatgactattcttattctagctatttttttcattatactgaaacagtttataccttcagtctcttgcctcggcacctaggtaatcctccccccacagtgaagtgctaaagtggtagcaggtttgcatttaaatgtggaaaatgacataagatctcttttttgtgctttcagagaaagaatcagcatatcccttacagaaatagtaagcttactcgcttgttaaaggattctcttggaggaaactgtcaaactataatgatagctgctgttagtccttcctctgtattctacgatgacacatataacactcttaagtatgctaaccgggcaaaggacattaaatcttctgtaagtctgtttactctgcctttgttgtgaaggtattgtctgcatatgatttttataattgtaatgaaagtattaattcaggttatgtttctacataatgagttaggcagctgagggttagaagggtctttgctaacctgcttagtcgaacattaatttagacggttaaaccataaagcatcttgattatatatatatatatataatagatactattattcgatcttttgggtactatggtacttgagtggctttctccctaacctctttgatgtcatggcgtattgtatttggatggcatcttggagtaatcactcaaaacttgaacacatttgttgcagcccaggatgatgctctgctttagctgagaaccaaaactttcacctgaaaatcttggatatgttagttaagctttccaagcctattatttcatctgtaaaataggtataaagcttattttttaaaaagtcttttctacataatttatagtccacattcatgatgttgatgtaccaatctctgtatttctccagaaatataataataataattggttacattagtatttttgccaaagatgtgttgtacttaaaaacatgtatatcaaaatatgtatgtttaaattataatatatcggggttgaaaaaacctagagttaagctgttgtgatgactcctcctcttctccctttcccctctgccactctccttaagtgtctgaagatgagcatgttattgtcatcttaagaaaaatgttcccaggctcattatataattaattgtaaaaggtcatactatatgggtgtacagaaaggtttgtaacacatgattttcatgtagcccttacactagccccttgaggaatgaattcttagctccactttacagatgagtaacccaaacatcaaacagttcgaattctaagtcaggttaagtgagaagtaggcaaggtctcaatatcaagtatttggatttatatgtttaatatcctctctactataccataaatgtcaaggggcccatactatgataaaaatgttaaaatatagtaagaactcagtgaaaaccaactgaattcctgaaagggtagcatgaaaaactatctctgcattacttagaagtcaaaggagtaagaaagtagggaattttattatattgcaattacatgcttataaataccttttctcaataaagtaatttctttataatttcatttacattattaatgtgctcagcagatcctcttgtcatagattttaaatgtgagcataattatcacaaattctgaattcatggaactcaatgaaaatgcaatgtcatgttattcatgtatttatctctgtgattattatctctctataaacaatcataatttctatctttcaacagttgaagagcaatgttcttaatgtcaataatcatataactcaatatgtaaagatctgtaatgagcagaaggcagaggtatgtctgtttatatttttatgctagtcttgcgcagttcttcatttatagaattttataatcttaattgtccaaaaatttaacatatttttctattaaaattaaaatctggttaattcagttattttttacagctaaatttggctgtggccatgtaaatgacttcttttgtattttaactagtgatttctctctactagattttattgttaaaagaaaaactaaaagcctatgaagaacagaaagccttcactaatgaaaatgaccaagcaaagttaatgatttcaaaccctcaggaaaaagaaatcgaaaggtaaacattacattaagatctaattttgaggaatttattgttttaaaattttgttaagtattttatgttaattatcatttgttatgtcttttatatgtacatagatatgtatgtttataattttatatatacacacatacatacatacatacataacaggcttgactcagagatattgcagatttagttctccagaccactgcaataaatgaaatatcataataaaatgagtcacacaaatgttttggttttccggtgcatataaaaattatgtttacactacactatagtctattaagtgtgcaatagcattatatctgaaaagataatgccttgctttaattttagacatactttattgctaaaacatgctaatgataatctgaaccttcagcaagtcataatctttttgctggtggaggtcttccctcaatgtttatggcatctgactagtaagagtaatggttgctgcaagttggagtggctgtgacaatttctgaaaataaggcaacaatgaagtttactgcatagattgactcgtcctttcatgaaagatttatctgtagtgtgtgatgctctttgatagcattttacccacggtagaacttctttaaaaatttgagacaatcttttcaaaccttgccactgctctatcagctatatttatgtcatattctaaatcctttgttatttcaacgtagatagcatctttatagggagtaggtggtaaactttctcaagaaaccattttctttggttatccatagaagcagctcttcatttcttcaagtttaatcatgagattgcagcaattcagtcctgtcttcaggctccacttctaattctagttctctttcatgtccaccacatctgcagttagtttcttcactgaaatcttgaacccctcatagttatccatgaggattggaatctacttcctccaaattcctattaatgttgatattttgacctccttacacatatcacaaatgttcttaatggcatctacaatggcaaattcttttcagatgcttttcaatttattttgcctagatccgtcagagaagcatgatccatgaaagaaagtatctatagcagctatagccctacaaaatgtatttcctaaataagaagacacaaaagtcaaaattgcatgatccatgagctgcagactgggtgttgagttagcagacatgaaaacaacattaatcttctcgtccatctccatgagaactcctgagtgaccaggtgtattgtcagtgagcattagtattttgaaaggaatctttttttctgagcaataggtcttaacagtgggcttaaaattattaagtaaacggatgtgctgtcctctagactttgttgttctatttgtagagcacaagcagagttaaatttagcatatttcataagggccctaggatgtttgtaaatggtaaatgaacatcgacttcaacttaaagtcaccagctgcaaaagcccctgacaagagagtcagcctgttctttaaagctttgaaagtaggtatttacttctctctagatatgaaggtcctagatggcatattgttccaattaaaagctgatttgtctatcttgaaaatctgttgtttagtgtagccaccttcatcagtgatcttacctaaattttctcgataacttgctgcagcttctacatcagcacttgctgcttcacctagacttttatgttctagagaaggctttttttcttacacttttaaactttatgaaccaacacctgctagtttcagaattttcctctgcaacttcctcacctctctcagcctttgtagaattgaacagatttagaaggcttgctctggataaggctttgacttaaagaaatgtgatagctagtttaatctatccagaccattgaaactttttccatatcagcaataaggctgtttcactttcttagtgtgtgtgttcactggagtagcacttttaatttccttcaagaatttttcctttgcattcacaacttggctaaatgttttgtgcaagagacctagcttttcgcctatcttggctttctacaagccttccttagaagcttagtaatttccagcttttgatttaaaatgatagacatgcaactaactctttcacttgaacacttggaggccattttagggttattaatttgcccgatttcaacgtgtttcaaggaatagggagggctgaggagaggtagggaaacagccagtcagtggagccgtcagagcacacacaacacttgattaagtttactgtcttatatgggcacaatttgtgacactctaaagcaattacaatggtaacatcaaagatcattggtcacaaatcaccatgacagatatgtaataatgaaaaagtttacaatatttcaagaattgccaaaatgtgacactgaatgctcatgctgtaggaaaaatgatgcttatagacttgctcacagcaagattgccacaaaccttcagtttgtttaaaaaaaaaaaaaaaaaacagtgtctgcaaagcacaataaaacaaggtatgcctgtatatatattctcaactgaattcaagaagtcagtgatttctctttatatttcacactttgtagatcaagtaattttagtttttattttacatatattgaagagaaccagaacttaggtataagatagtggagacaaagccagttatgtcaccctgtagacttagtttaattttagtggcgctcatattgttcttttctgacataatcattatttgtatatttcatgtaaatctactctattcttcattttattaactctctatagcttaactaatctacttattgagcctgaatgggtaattatttgaatgaacatctgtcagtgatataaaccaatacagaattttgagaggtttctactaagcttcttagcaggtaaatttttaaaaagaaagcagttagtaatacagtatgcaaaagtactttttcctcaagcagctaagacagttttccaaattgacccattgagacactggatcaagatgttaatcttgagtacttctaggaggacaataaggaattcctgtataaacaagtttggaaattactccataaggaatctaggaaacttccaaagtacatcagcttattaaagggaaaacctgtagtaaaggaatctgttcaactttcattaaaattgagtaaaggtaaacttatttgacattctgcagagccagttatctgttattagtatgagaaaccaactacaacttaaaccaatggttattcatactgttttggagctctagaattagtagaaagtgtctcagtatctataaggaaaacaagattatagtcaaaagtggctttcagacctgattcagctataattttttaaaattgcatttgtgtgttgaagttttacataaaatattttacagtatttcttaagaaataagtaaaaatgatttctggtttttcatctcatcaaagaaaacttttaactctgatatagtattattagttgttgttatttcattttgttagttaaatgtgggagcggtcctcatgtaattggatatctattagaattctccagcttctcaaatttagagtaactgattccataaaattgctcagcactgcttaaccaagtctactataccaattaaaaccttacagattagtaaacttttctggagttgatggctttaaataattgaacctttctttctggtaaggccctcctctcaggagggaagggcctgagctatgaaataagtatttatttggatgtttttcatatttcaacctgacttttgaccaacaataaaagctttgattttaattctggcaatatgttaagtaacttacttgtatttatgaagaagttaatgataaaaattatgtaccaaataacttttgttatttcccctaaaaattactgccttttgaaataaatgtatgaaatatcttttattttatccatcatactgttacatgggacttttttaatgccatgaattttcaaagtgtcttttgttataaaacttaaataacatttttatgaagtttaaacagataaaaggaagaatctgcagtattttctgtctatcagagctatttggaaaggtaattctcaaaaggaaatcataaaaagaaaacacaattgttcttttataaagagtaattataaaacttcacttatgactataccaagaaaattgtggagtttaatactcatgtattacctaaaaatattggtgcagatacttttaacttgaatgtttgcttagaactctttcagttttaaaacgatagctttttttggtgttgttaaggagctctctagaaacctttgataccaattcccttcctttcatcctaatcagtgaacaccaccacctaaaataagtctagatcacaaaattgacaaatattaactttgtccttgaataaaaagttatagaaaaactaagaaattatctctttaagtataacctaaagataacttatcaattcatttactggcattaccgttggtgtaatataatgcaatgaaatcacagtgtctgtacatatttcctatgaaatatttatcagtttgacaaaactgcagtaaagtcagtgttttgtggcttatattcattcccaatagagtttcattaagagctactgacgtaaattggcagtgtttttaccgctgatccttatgagtatatctaaaattctggccagtttagaacattttttttaaatgcatgtacttgattttactttattttaaagtcttcactgttatgaatgtttatactgttactgtagctcagagctgatctatgacttaaaaccatgaatatattttaaaaaattaaaatattactgtgaccagtgttctactgacccagaaggatacaggattgcaggttccatccagagttttcataaaatttaatcagcttgaagtctgtggccatttggaaatatgaatcaaactcctcatctttgatattctagacctacattgcccttaggaggaagcacactgcagcagcttttctaggtttaccacattataaacttggatgttttaagtcctggaagtgtcagttgattcttagccaggctgtagggggtacctaaccgtatggtctgttttcactataacaaattctgaagctaaaaactggctctgtcactttccctagggggccatggaggcaccatatgattatgcctcctactgcttattccttcacggtgagccaacaccgtaacaacacataatgctgtgttgctaatagggccttgtgaatttggatagtgcatgcccaggttatcatccttttccaacaaacaaaaattattttatttttgctaagcaataggattacatatagatgtaagcatagacaaaatgcagtatgttagcaataccagacaccttatgatgcccatatctttcagcaacatgatcttccttgggtgagaaagaaacctaatgtagtataagtaaagttaataactttttctaaacattttttataataggaaatagtcatttttacctatttgctgtttatcattgagtgtagttctgtgaattacatatattcctttgtttatgcatttctcttaagtaaactttgtatgatttgctacaaaattagtgagattctgtaatgtgttttaattttggtaggtttcaagaaatcctgaactgcttgttccagaatcgagaagaaattagacaagaatatctgaagttggaaatgttacttaaagaaaatgaacttaaatcattctaccaacaacagtgccataaacaaatagaaatgatgtgttctgaagacaaagtagaaaaggtaattaacaattttataattaaattttagaaagtataaaaacatgggggcttttttttttttttttttttcagaaggagtctcttcttctgttgcccaagctggagtgcagtggcacaacctcagctcactgcaacctctgccttccggattcaagcaattctcctgcctcagcctcccagctagctggtattacaagcgtgcaccactacgcccagctaatttttgtatttttagtagagatgatgtttcacaatgttggccatgctagtcttgaactcctgacttcaggtgatccatccgcctcagcctcccaaagtgctgggattacaggctgagccactgtgcccggcctggtggcggtggttctaactctggaaattttatagtcaaggctacttactcacccattctttacagacatctggaaatgttggagaaaatgtagcaaacattttttaaaatacatagttaagtgcacaagaaagaaattttaattcctggatgtcagtaacaaaaaggaaataaacaaaaacaacagaatctcagttacaactgttgtttttctgggcattttatggaacttttaacacgaagtttacccactcaggttagccagttactaaaggtagagcaatagaagcagtctatcctggatgcaggcagtagcttacaacttagaccaacaggagatttttgttgtcagagaagaattttatcactgaaattgttagatgtgccagggcaggggcctaatgaaaagcagaccaaacatttaatcagttttactattttttttaatacaataatatactgccctctcccttccaaacacagaccactcccactcttctaactttgattacatcactacttagataagagacccaaaggagacggtgagttagaaatgagagctcctatctaaagcctgaaatttcagtggcctatatcctttatactaggggtataccaggaaaaaaaaaattcttgccaaccatcactgttggcaaggatggttgcttttcttaccccaagtaaccatgcctggggtaagaaaaaaaagtcatttgaacactaccattataggcttgcttttcacaatgattgaggtttaaattgttacaacccatgtattttgtatagaaaacccctaaagttggtcaattacaatgcacattatcaaaccaatgataccactagaaaacctggcagaagcaatgcaaaaatcagcctcttaagagaaacagattctcaactctagccactaataaattcaactttcaaaattacaaaacagatggagaaataattcactctagacaagattcagtactcttagcaaatatgacagaactcccaaatctttagatactagagcaatctaatagaaaatataagaatgaacaaagataaaggaatcaaagataaagacaccacaaaaaaagaactttcaaatatgaggtaaaaaacacatgaaacttccagaaattaaaaatttattcattaaaattaaaaactcaccttattgatacaatatcagaaaatgttaaagcactttacatatattgactctttttaattctcagaaaaccccatgaaatatttagtaatattatcctaataatcaatgaggaaaccaaaatacaagtcattttgtccaaggtgacacagctcctaggtgctgagttctgatttgatctgcagcatgccagatctagagcctgtgctcttatgtttatgcttttttacatgagctgggagacagatttgagaaaattacaccaaatgcaggataaagataacacatgtggacaagatgttgtataaaggatagacttcatgtaacaagaagaaaagtcatacatgcatctaataggcatttcagaaggagatatttagtgaaaaagagcaatatgcaaaaatttgtggttgagaattatctaggactaataagatgtaaattcaagaagcatgagttctaagcagtataagataaatatatacctaaacgtgtgaaactacggagcaccaaagatcagaaaaataaatattttgaaaatactgacaattctccccagtttcgatattcattggtgatgagtttatttgtatttttatgtattttatgtaatttaattacatagacatatgatgttcaaatactacttattaaaaagctttatcttataagtaacaacccattcctctcaaactaccaccccaaacatgttttcttcttttcctactttcacagaagtaataattatatagaaaaattttgcatttcttaatgtccagaagctgtcagattttaaagagtgcttttcaaagctaacattttagatttttgttagcctatgaaatgggaaagatacgctgtaccggaaattaatcataaagcattcagtaatgtatcattgataccagtttgtcagtagctattaaactatattatcaaaattagtaatatatttattgagtgtgtgctttttatgccttaatgaaattttcttttcaattttgtgttttgagatgcatttaagatgttccttgcattcttttaaggcagaaaggaaacaatttatttcttcgaatttatatcttgctgctatatttgtactttcactttcatgaacttcaaattgttgccaatattctttgataaatgtaatgacttccaaataactatctcattggattaatttatcaatttgttgttgtgaacttctttcatatggttgctgaacagaattctggaatagtaccatattatataagaattatatattttatttcaaatttttaagatgtttttcttcttttctttattttttatgtttattttattttatttttggagataaggtctcactccacaactcacacaaacctcccaagtagctcagactcccaagtagctgagactacaggtgtccaccaccatgcctggtttatttcaattattagcacttatattacatagtaatcttcagtgggtaataattcttctcagttttgtgtagattatataagtgtcaattatttgaatgtgcagttatctaagatttactttttgacaaaaggcaagaaatgcagccataggaagctgatattgacttaacatctcaactttaacgaaactcttattgaacacttgtttacatgtaaaacccttgtgcttgacacaatggaggtaaagaaagagaagtgtttgtccttcaattatttacatactagttggagcaataaaaataataaaaatgataaggcactatatgcttgtcatataaatagtaataataaaaacagctgatattgaacgctatttgccagacatttttcaaagttttttgcatggattaattaatttagtatttataacaagcctatgagatagatctaatattatcaccatttgtgaggaacagaggcactgagaactcaagtaggttgtctggagttacttacctaattaatgtggctgaaccaatattaaaccccagctgtctggcttcagagcctgcactcttaatcactctgctatattctaagtaccgtgaatgctatagctattcagaaaagtaagcagtgacttcctatttttagtaagaaggcttcctggtggaaagatgagatttgtactgggccttgcatttctatacatattgtccaacaaatgtgacttgctctgctgagtttgaccagagcaggtcacatttgttggacaatacgtgtagaaatgcataactatactcaaaacttcgtgccaattcccactcccttacccacagcaaatttcactgatctgtggccataccttctctcagaatttgaaagtagccagaaccacaatgaatggactggagttggcacatgatgttaaacatatttgccatgttaggaattattaacaatagattgggaaggtaggatattggtatagattgtgaaattgttggttgctaggagtctaaaatctatttttgtagccaaaatgcagtctttcaagcaagggagtagcattatcaaaactttgagttccattttttaaacacttgaatattattatttagtataattaatgagcttggactatgtaatcccaaagtaatttagataattgttattttactgtcttaattcctccattgaattttgaatgtggttatctagaaagattaagacatagagtaatagaatgggtttgactggttttatggttttgttttttttttttctgttttcatccttatttttctgcacagtagcttagacttttttcaacccaattgccttttctgatctcttacttttggtcatttcaatcctcaggttcccaattatcatagctattcttatgagactaggtaagcagtggagataaaaactcttgagttattgggtgtagttaacccactgaaaaacataggaagacatctagaggttgattcgttttgtttttacacagaagtgtcaaactgtagtatgagtaaactgcttttctaaggcaaggaattttatgttttggattctctccaatagaggtttgttatcagaagtgctgaaagaatctcataacatcgattcagctataaatagttctggagtatggattttgaaattactattaaagggaagctcctgggtaatttcatgaccccataaaaataatctgtaagattgtttttaatgtaaaaatatgaatttaccatattagcaattattttacacaaagcagtagtaacaactaaaattgtagaattatgtttgttctctcgcaagacttttgtggtgtgcaggggattttgttaatgaaatatgtaaagcttttttaaaacttaatgggaaacatttcactctaatgtcagggtttaacatgcatattttagaatgtattcccaaacacttacttgccattttagagcaatgggtggtggtagtattctgatggaaaatgtcctctgagaaccatcacagaggatacatttgatggacattagaagtaaaaagtcataaatggactttttgaggtttcatttaggattttctgatattaaatattgctgccaccagacccacatgccctggtttctaagagtccctacgactgtaaatgctaaagcaaaataaagatgatttaattagctgcctgccttcagttaggtacaatattttcatcttcatttttcagacgaagtaactgaagacccactaaaatctgtttgcctaaatttttacatctgctgaatagcagagaaaagtcaataggtcacacctcccaccttctgttatagcagtggctctaaacttcaagtttcaggacccctttctgcttttaaaaattatttaggacttcaaagagcttttgtttatatgtattccctctaccaatatttctatattagaaattaaaacagatttataaaaatatatttatgcattgattcattttaaaataaataatattaaataatagcttaattgtaaataataaaaattatattaataaaatataataaatagcaataaattataaataattaaatgttaaataataattaaaataaaaattatgtgtggttacataaataattttattttctcaaaaatagtgaaaatagaagagtggcgttgttttacatgtttgcaaatttctttaatgcctggcttttcatatcagctctattctcataactgctgaattgttattctgttgtgatgttacacatcatttagcctctagaaaactactgtgcaactaactgtatgagcaaacaagaattttaaaagactaataacattttcctgatattataaaaatggttttgatagttttaaccttgtgaactctctgaaaggatctcaggaatccttaggggtccctgtaccatgcttgggtaacctttgcatgatagcattctttttttagtttttgctgtcagggtctcactttgttgcctaggctagagtgcagtggcacaatcatgcagtcatggctcactgcactgcagcctcaacctcccggactcaagtgatgctcccacatcagcccctccaccccaccaagtagctggaactacaggcacatgccacgaaaccagcctaaatttattttttaatttttgtgtggagacacggtctctctatgttgtccaggatggtcttgcacttctggcctcaagcagtcctcctgcctcagcctcccaaagtgctagaattactggcatgagccaccatcccagcctgcattgtagcattctgtcacaattctcatcctagcgctgtggtcagtttgatgggttacattttgttttgttttctcttcttgactatccaggtttttgtttctttgagacatttgttttgtttttgttactgtcttactgtgacagacagagactaggatattataattaaccagagaagccataaaaaagagtcaggaaccttagtgagaatgacggtggctatcaactatttttcccttatctatgactctagcctgaaatggaatctgcttctctctgactcttgtatttcccttgaggggaaggtaagtaaaattttatgaatatctaagatttggttatgacttcatgatagccacctttgcctgaccttaaatcatttataagctcatatcctctatccagatgaagataaccatatttttctattatatgcccaagtctcaatagtacatcttttgtcaaaattaagagatatttatctcccaaagagggggagttcttcgaccaaattcaaatctagtttctgctcttcttttttttgatttcctgcttccagaaccagctgcaaatgcttattttaacctttggggatccactgtttcaggtctacccatcctatctgataattattgactttagtgtctgtgggcaaataccccagagacgtcaagatgttctggcccattgttttcatgatagtgtgcaagacccttagggtaagaaatcaaagactaattttaatttcaatttgtgcctaggtaaaacaccaaaaatattttgaatactcattatggctcctgaaccaagctacaggcaagatcagatactgataagcactctgatataagctcttttttctgtgatttatatcagccaatttgaggccttataggcaaacacagaacaatagaacacattatttcttcacatcaaagacaagagcaatatatgcatctgctttgattttgagtaaggagatcatggaatgtatctgaccttgtatgaacttttcaaatgaaacatactgaagggactgtactttaacgccaaaaaaaaaaaaagttatagtctttgatttggtcgttgtatttcttaaagccataaactctcaacctgtaattttataaaaatgactcacagctcaatttcctattttcttgcaagcagtagtattctgagatttcaagggggaaatagctttaaatacaaaaatgtagcctaacttaatttactacaatagtacacataagaaaatatactagtttactaatatcatgtacatcaaatatcataaaaattagatttactgttaaatgaatcgtgtttcaggccactggaaaacgagatcatagacttgcaatgttgaaaactcgtcgctcctacctggagaaaaggagggaggaggaattgaagcaatttgatgagaatactaattggctccatcgtgtcgaaaaagaaatgggactcttaagtcaaaacggtcatattccaaaggtacaaatatctctgtatgttcagatttaatttgtaggaactgagctcctaaaatgtgttctttttcttattgagtaaatgtctttcataagacaactattattgcctcataactctgagatttaatttacttttaaatgttatttctaagtgattgcatccttttataaggtagcttttaggttaaaataaacaattctatttcaacctgcacttgaggattcattatgtaggtaatttgtttgaaatcttgatattttatgcaaaaatagtttaaatgaggtcaacattaaatgtgttatggttaaagaaagttgatttgaaagggggtgtgtgtgtgtaactgaagatattccaccttagaatggcaaaaggttttatttttgaagtgtagtgatgggtaatgacagtatcatattagaattatgttctgctacaaggttgcagtagtctaactttagtgccttaactagtgtgggctgtcttttgttctcttaacaataagtcttggaagtatgcagttcatttctaatgcagtacctttaaaatgtcattatcgtgcttgtcgtttcatgattgtaatattactgtttcatatctagtctcaagtttacacacctaagccagaagaagaggaaagaaaggaggagggatgtctatatcaggagagcaaagatgtttccaaaaattcctaacagactaatgtattggctagaaatatgtcacatggctatctgtagatagaagacactctgaaaagattgtctttttttttttttgcataattactctgaacagtattggagctcccttttttttttttttaactttaagttctgggatacatatgcagaatgtgcaggtttgttacataggtatagatgtgctgtggtggtttgctgcacctatcaactcgtcatctatgttttaagcccggcatgcattaggtatttgtcctaatgctctccctccccttgccccctacccctgacagcctctggcatgtgatgttcccctccctgtgtccatgtgttctcattgttcaactcccacttgtgagtgagaacgtgcagtgtttagttttctgttcctgtgttagtttgctgagaatgatggcttccagcttcatccatgtccctgcaaaggacgtgaactcattcttttttatggctgcatagtattgcatggtatatatgtgcaatataccttttctttatccagcctatcattgatgggcatttgggttggtttcaagtctttgctattgtaaatagcactgcaataaacatatgtgtgcatgtgtctttatagtagaataatttataatcctttgagtatatacccagtaatgggattggagatctcttaataagaaagaagaagaaagtaaatgtgggctaagcaactaggagcaactgctatgaaataactaattttcacccaaatacttaatagtttaaaagaacaacttcttttcagtctttttctaaaagaaaaaatatctacagtctctactttggtgatgctcttctgaaattctataactctgtatcagctaattgatatggaaacttctaaaatctttgaattcctagaaaggcaccagacagaaaatacaggtgaaggaaaatatgaaatatttaccaacaaatgccagagatctttaaatgttcaaaagtactaatttttttataattcaaagatactagtcaatgcattatgactggggaatggattctctgatgggctagcaatggctgtaaatgattattctgttaatatggaagctcagacatgactggagagaaaagactagcagtagtagttaatgatgacagttcaaagtagtgaaaggagcaagcagcagatatcctgtttcctaagaaggaaaccaaagacagtatttccttattgtggatatttattgagccaacaatttaatctgcacctcaaaatatcttgataaaagcataccagtcagttagttaagtagattaggacattaaacatagaatacagcacattctagtaatattttgcaataatataacttagtttgtaaggcactttaaaatattccccacaaaaataatgtaaacattgggaaaaggatagactttggagttggagtgtttggtaattctggcatatagtagttgttttgaataacaactctaacaataattatatgactttggacagtgtgtttaacattgatgtcttaatttgtcatctgtaaatgtatttaagatattatgagcttaagtggagtgctacattcaaaacctagcaacacttaacaaataataatggatgataaataatagtttaatactattctaagcaacaatagcatagacatcaatatccaagcaagttgtacaaagaaaagtgtacatagttaacaacagagttaactgcatcatataatataatataatataatataatataatataatataatataatataatttctcttccagaacaatgattctgacctttttgggggtcatagatgcctttgagaatctgttcaaagctgtgtagattttcttccagctgggagattggggaggtcaaatttatacaattttgcatatttcctaagtcattgggtttcctaaagcccttccattgacacaagattaagaatatctacttcagaaggaaactatagcacgttttttttaaacgttgtgtccatcttaagatgatataatgactcaaaaggagtaagcaaaaaaagacaagattcattaataaactataatataagttagctaggatcagaggatataacttctgaaattccatataaagccatagaggctcatcatagaatgcaacaggctctatcacagtgcctgtaggaatactgaaatatggttatgttgttgataaaatcacttcaaagaaaacagctggataaccctggccaaatgagtgtttctcatttaatacacaagagttgattctcttggattggtagcaggtgtggaatgttgacagtacttttcagtttatttcacttattatttaatagtttatttggagactgtatatctaaagcagtcatattctcaagattatcattttctaaactacataaaactaagtcttttggttagtattaaactttgacctcatttaaaattaactactgaagcttccttaatttgtttgtttacttatggctgtgatattctcatagattatttaccccttatagttggcaaaaattttctcaagaagagtcttgaaacaattttttgtgtgtagtaaaatataaaataaaatttaccatcttaaccatgtgtacatatacagttcagtggcattaagtatattcattaaaaattttaaatatgtttgtgtatataagttttaaatgatattgctagagtattttcacctctcaagatcctaacttaatttacattatgcttgtattatatgtttgtccatgtaatcagcattccaactacagaagtactaagaacttatgaagtattaagcaggcaaaaaagtcgattgtagaaatttactagtttgccttttctatcccacattaccgtaagcttccaattttaaaaatggtatggtattgtttctgatatcattattatcgctattttgtgtttgcttttttgtctacttagtagtgtttatgaagttaatcaatattgtctggatttttaataaattaaaactttttcaatatggtcaaatctaatttttctagcaatctgtcttctagatttctcttacgaagaacttttgtacacctgaatgtgaacctggaattgatttttgtatctttgatttttatgcattttatcacaaataacttgagcaaataaaattaaaaccattttcattgccatcacccaaatctaaccctcaattcttttttgtgcagatatttatagctgaaaaaatagctgagaaaattatctagttataagccattattttttacataagcaaattgagacataactttacgataaagggacttatccaaggtcacacaactctggacagatacccagaacttctgactttcaaattggtgctgttttctctgtactctcctgcattatttactcttcaatattctgaatctatccacttctctttatgcccctctgctgctatcctaatgcagactcctatgccccattattggactgctacgtttggtccttctgctttcgttcatgttctactgcaattcattctctccactgcaaccaaagcaagtttttaaaacgcaaaactgatcttgttgttcttcactgccttctccctagaataaattctccattgtgatttaccaagcctagcatggtctggcacctgaatacttctcaaggcttgtatatcacctttcattatactctatactttagccattactggcctacttatagttctcaaaataagccatgttcttccaatcagatttagtcattagtatgtcaagaaagacttaaattgtaaacttgattttccaaagttaacaggctagccaaagacccattattactaatacaattatacaatcaagtcttgtctctttaaaagaatgactcaagaagataaaggaataagattatcagaggatgtatataaaggagggattgttttttctttatactttaagttttagggtacatgagcacaacatgtaggtttgttacataggtatacatgtaccatattggtttgctgcacccatcaattcatcatttacattaggtatttctcctaatgctataaggagagatttttttaaaggaaaaaagatgcaatatgtggcaaacatgttcacactattatgatcatccaattttctaactagtaatagaaagaactgaagagatcatctgatccagctcttaaattttagtcaagtaaactgatctccataaagggcatatatttggcttaaggtgacatttgtttcaaggctaagcccgtctctaaaatcacatgactctagccgtatcgtcctgcctccataaagataaatttttttctaaaacatttgctatatttcttgaagtataatgaattatataaataactcctaactttaatatataaatatactatatttcttgaagtataatgaattatataaataactcctaaatttaatatatcctaactttaatatatataaataactcctaactttaatatataaataggatgagtgacattgttctctgtcatagtctcaataactggcattggaagtactttctaaaaaggagaaaaataactttgacattttagaaaattattggtcaactgcagattggaaaggagttttattaaatttgatttattaaaattattttattaaaattgatttaatcttaatattctttaaaagaatctgaagaatactttgcattgtttccactcgctaaagctaagatggattatgagaattgtccctaggaggaagtttccagtttccaggcatagctcccctgcatatggggttcctgtcttagccattcaaaatgtccaaagaatttaaatttttttcattgtattgtttgaaatttttccaataaaatttctgagaatgttactagattatcaccatttatactttggtgtaatcccttcgctgatatattctgtagataaggtttagtaggtttaaggaaagacaagtaactttaggtggtagattacaggacacctggccctagacagatgaggcttaggaaaatggagcctgcaaaaaaacattttcacacttttgcctaggatggagctaatatcaagagtgggtctcaagtcttgtctctttaaaagaagaaagattcaagaagataaaggagattatgagaggatgtatataaaggatatttttcttttaaaggagaacagacgtaatatttggcaaacatgttcacactattaggatcatttaattttctaactggaaaggactgaagagatcatctgatccagctcttaaattttagtccagtaaactgatctccataaaggctgtatattcaacttaaggtagcatttgtttcaaggccttataagcccatctctaaaatcacatgactcataggccagtgctctaaccatgtcatccaaccaaaggtgatatcaaccatatgatcttttgtttcatgcaaaaacagaaatttttattgcacacaactcaagactttgtacactggggctttaacactgaactaacctgactcggtgcctgtcctggtggtaaactatatgttctggtgtgaacagagaaattataaataaatgaatacatcaatgaaattgttactcatcaatagagtaaatgctatgacaatattgaggggtggagagtgtctatccaaatacaatgctcaaggaaagcctttctgaggaagtgacatttaagcaaaaactggtcatatttatgtatttttacaacattgtgaacaagttggatagaccaagaagctgtcatcatagtaaaatttcttctgaattcctaacattcagtttctgaggaaacatgaaaacttatcttgcttgtaaattatagaccaccttttccagaactcttatttttcaaattgtttctaaacatattatttaatatctaaaaagaattaaaactattggcaacaatataaaattattaaactgatttaatttcaatattcttagagtgatctgaagtacattttgtattgtttgccctaggaactcaagaaagatcttcattgtcaccatttgcacctccagaacaaagatttgaaagcacaaattagacatatgatggatctagcttgtcttcaggaacagcaacacaggcagactgaagcgtgagtacatacatttacctattttccaattttaacactatatctgaagcacagaagttcaattttccactgccagaaagttgagttttatgtgttacaggatacattatttttaagtgtctgtctgaaccagaaaacattaagagagttatttccttccaacaaagtttttacattggtttataaatttgaaagtgtttttctttaaaagtatgttacttttacttaatatatgctatgtaatacaaaatttcataagtacctacacacattgaaaagaaatctgccttctacctctatcttctagccatccatttctccacttagaagcaattgctgttaacatcacttgaatttttaagtaggcaattgttaattattcataattccagaattttttgctgtcattacagtgaagttgctaaatatcaggtgtcctgatttttatgtgatgctataacagaccttttatgttctctcttctagctcagtagtaacattagtcatttagtttttaaaacataataataaaaagtatggcttaatcttttttttgtcacattggatacgtcagtcaactccttaggcatcactttgatgttccatgcaaatgggatatttatttctctaagtgctttctgctactctaagaatctattcatgttctactggtatgctcaaataactgataattatcttgatttagaggaaatcatattagtatagctttttttaaaaaagaaaaatgaaaaacttcagggagttactcttatgtggatggaagttcagactaatctctttatactttctgtgtctattcctagagcagatattgaatattcatttactaacactcaaaccacttacaagagctgaagtcatcaagaaacaataatttcttttaaccatattacatttgctatatcagaccccagatgaatatactatcttaagataaacatttaccttaaaatggggggaaaaagactaactcaacaatttagaaaactggtgaaccagaggatcacagaggaaatgtagcatagaagaaagaggatgagttttggaatcaatcttgaattctagcttatatgagcaatataaccttacgctgattatttagctttgctaagctatagttttcttatataaaaatagattataatacagttcatataaaggttatgaatagattataatacatttcatataaagtttttgaaaagattaaacataaaaataaataacatgatataattcctgtgttataggtgcctaggactactttcaggttcagtgattcattaggaggactcacaggactcatcagatagttgtattcttagctgtgctttatttcagcaagaggctacaaagcacattcggcaaagggaaaaggtacagggcgcaaagtctgcaggaaccctgacacagagtttcaagagtcttcctccagtggaatcacacagaatgtgcacaattcctccagcaaaaagttgtggcagcacatgtgaaatgttctctgctttggaagctcttttgagttccatgtcccaggtttttattgggagctggttgcataggcactttctgccaggatgtatcaaaattccagacttttcaaaaggagagaaggtgttttagcataaaccacattgtttgtgcaaacagtttaagcacagtgagccactcttgtcatatgagttctggaaatgctgggaaccctcctaaaatccatattttaaaataccagccaggtatcaaccttataaccaagcctttcttagcagtgtcagacctactatgataactttcctgcacagtacctgattagtgtagatgctaaataagtaattgtttaaatgactttgattaataactttttcttgtacttgttacctacttgacttaaatgcagcaccctccagccacccccaccaaaaggaaaaaggtcacaatttcttgtgctgctattgaaatatttaagacttgtaggttaaaaggtggtatttctttgtgtatgaaagtgaatgcccgattagtcttttcccactaccctatccatacttctaatggttctcttctcctcgatgttatgagtcaactggaacatcatctattgatggactcaggattccaggactgaatcatttcaagatcattcatgttgttagacatatttctttatagaaaatttgggaaccactgattgagtgtataaatttataactgtttagctgtgacatttcttcaatgaacacttacacagaggtctgatacacaaaaaattacattcggtgctgctgtaattgttgctaataagggagattttgagttaaagccgtgaatccagtgccctaacgattatttatactccccatccttatccacaacttttctccttaaaatccctttaagtgccattccaaaagccatttctttaggtcatttaacttaaaggagaggtaggttttgttattttgttatgtgtttgtgtgtgtgtgtgtgttttaatgttgtatacctaaaatatgtctcatcatttcacatagtatattaatttttcatttcaattttatgataattagtagcagtaacaacatctgtagtttggaaatcacattatgttttgcaaaaagcttttatgtacatttaattcatttagctagggacagtggctcatccctgtaatcccagcactttgggaggtggaggcaagaagatctcttgaggctaagtgtttgagaccaacctggacaacatagcaagaccccatctctaccaaaaaataaaaaaattagtcagtgtagtggcacacatctgtggtcccagcaacttgggagcctaaggtgggaggatcaagtgaggccaggagttcgaggctgcaatgagatgatcatgccactacactccagcctgggccacagagtgagaccctgtctctaaaaaataaataaacaaatatacttaactcatttagccctcaaagcaatctcctattataagtagtggctatttatctgtccctcacattacagaggaaaaacttcagtttttgccttgtccaaggtcatatggaagcaagtgaagacaatctgagactagaactcagttcatacatgggaaattattttaatgatatgctaatgctttgggtgttacataaaagaactaaaataatgtgtttaaaatgtcatatttatctctcctttcttctcatcttctgtatatagagtattgaatgctttacttccaaccctaagaaaacaatattgcacattaaaagaagccggcctgtcaaatgctgcttttgaatctgacttcaaagagatcgaacatttggtagagaggaaaaaagtggtagtttgggctgaccaaactgccgaacaaccaaagcaaaacgatctaccagggatttctgttcttatgacctttccacaacttggaccagttcagcctattccttgttgtaagtataactttcgttttaagtaaatagtaacattatttctaaagagaacctttgtatatcaatctatagaacagttaattttaataggtttgtctattttatgaaaattaatgggaaaattagctttatagtcatttcaattaaccagtatcttccaaagatctagaacaagtatgcattgatgttctatataactctagcagtaaaattcattttacaactcttttcttttttttttttttttttttttttttttttttggtgacagggtctcaccctgttgcccagcctggagtccagtggtgcaatcaaagcttgctgcagcctccacctcctgggctctagcaatccttccacttcagccccacaagtagctaggaattacaggcatgcaccaccactcctggctttttttttttttttttttttttttcctgtagaaacaaagtatcactgttacccaggctgacctcaaactcctgggctcaagcagttgtctcccctggcctcccaaattgctgagattataggcatgagctgctgtgcctaacccattttatctatttttgatggaacaattttgcttcccatccttctttaaaatgtaacctctattaagggcaggaaattataattaatcatatcatattttatgataataatctgttcttaagatcaactaacagtgtagagtttactatttttctattgacaaatcacttgatatttctctttctctcataaaagtatgtgtgagacattttaattgcaaagctaacatataatcttagttaagaaaaaaattcagacaatgtagaagaaaagaagtagactgccaccttcaactcttctcagaacctcaattttatgccctatctcagagattaaatgctgttaaatatttatctttgcagtatgtgtgtaatacacatgtattacataaagctttttgttaggtttcacgtgaatgctagcacattacacatagtgacctgcaacttttttgtttagtttattatgtttattggttttatttgtttattatgaacatttttagggtgcatacatgaagaatctacctcatttttttattgtttttgagaatccagagaatagatgtaccataatttaattaaccttttttctattagtgaacagtacatcagagaacacatctgtgtattcacatttgtgcgtgcatagcagaatcctagaagctgatttgccaggttaaaggacatatcattttttttttaatgcatcatgttaaactgcttttcataatttttttctgtacttagtacccatgagagtaactgtttcatctttacctaaaccaaaaatagtaacaacagcaataataatgcatagtcttttttgttttgttttttttgttttgttttgttttgagaccgagtctcgctctgtcacccaggctggagtgcagtggcgcgatctctgctcactgcaagctccgtctcctgggttcacaccattctcctgcctcagcctccaaagaagctgggactacaggtgcccgccatcatgcctggctaattttttgcatttttagtagagacagagtttcaccatgttagccaggatggtctcaatctcctgacctcgtgatccatccacctcggcctcccaaagtgctgggattacaggcgtgagccaccgcgcccagctgcatagtcttttaaaatgtgtaactctcagattatcgatgaggccaattcatcccctgtcaggtatcctttgctcattcacactagtggaaatttttgtttatttgttatgggtttgaggggctttttgtttgcttggttttttacttggcacttcgtatctaataactctttgttcatttggtgctgcttttttttatatatatgttgagcaataattgatcaatttattggacttttaacttttatatagtcaaatctgcctatattttccattatggggaattttcttgggatctggtgtttattagcccctcactcccaactagagtccatttttcttatgtgagctaaatgtgtgctgggacatttggctcaaatgtgtcccagcacacatttagctcacctaagacaaatagacaaatagttgggagtgaagggctaatatgtaagaccttattcacagagaataatagtctgttgaagtcagattttatgttaagtgttgcccctctgaatacaatctgtcttctggcttattgaaatatttcctcagtctttggcttgtaatagttttattatgttatgcctagttgactttatttttacttctcttaagtgggttcctgactttctgaatttgtttctgcattatcttttgtttgttttggaaaattcttaaccattatctcctcacctattgcttttgtcacttttgctctctcctctacttctgggactccaattatattgcatggcactttcccattgtattgtctatgccctttactcttttgcttttaatgtttttttctcttcctggataattttgtttctcacattcttcagtttactttcttttttcagctttatcaaatgatccttaaatccataaaatttttaatttcagtcgctatatttccaattctggaatttccattttattcttttttatagtttcatatctttgcaaaaattgttattaagcacaaagggtataattatagtcagccatccatattccatgggttctgcatccatggattcaaccaactaatcaaaaaaaaaaaaaacatggatggtttcatctgtactgaacatatagactttttttggtcattattccctgaacaatgcatcataactatttacatagtatatatatatagtattaggtattgtaagtaatctagagattattaaagcatatgggaggattgtataggttgtgtgcaaatgctgtattattttatatataaaggatatgagcatccatgaattttagtatggtcatgcaacctatccctcacagatactgagagacaactataatttaaagtctgtgtctgagaattccaaagtctgtaaccactggatctgtttagactgattttcttgcatgtggtcttaattcctcatatgcatgcaaattttttgtgtgccagtcaggtatttgcaaaattatttgcagaatattttgatgcatctgatcatgatattaaatatctcagagaatatttacagttccttctttcatattctaggtagcattagcaattcagaatcacctcagtcctatttcagagactgaggtaatttgatactaaactgtagtttcctgaggtcctgcctatttctgatttgccctctacagtatagctgttcagagtcccaactcaaagcaaggaagatttacaaagatcctaaattccagttccagcaccctattcccccaaagctcttagcactgttgctatgcttttctgccagctcttccagcataagcaaacaacctcaaggggaaattagctgaaattgcagaaattactttcctgagcctccagcttcctcctgatactcacctgtaatttttcaccatcttattaataatccagtgccttcaaacagatgttttttatattttgtccagacttttagttgccttcagaagaaaggttggtctgagttatctccatctttattattagcagaagttccctatattatacctttacattaagaaaatacggaagttggatagattatcttaaaacatatatattgtatatacacatatgtattctttttcttttaataaagcattagacctgacctagttgtgatctctggaaagcaaaacttaagtttttttcagattctctcatacctttcgggcatgattcattttttataatgtactcaagatgttagaaaggaaataggattttaacaccaagattgagaaatactgaccacctgctatatgatgctcattattccttatttaaaaatctatatttcacatacagtataattgcacagactatacttgtcaacaataaaacaaaagaatttacttgactcttaattccttctcatgatatttttgaaggaaagacttgaagccatgttacattttataattaacgtgttttctcttgaacacatattagaaggtgagttttgtttttataatgttttgttcttggttcgttactttactatttcattcaaatgattttagagatcaactatttatttattatgtattttccatttcatgaattatgtatgttgtatacatgactaatagtgtcaaggaggaataataggaacggtgtttataagtgagttcaagtgccttagggacctttaaaagtatttactagattaactatattctttttacttaaatacacacacatgcagtgcttttaagaatctgggccagggacagtggcttacgcctgcaatcccagtattttgggagactgacgcaggccgatcgcttgagtcaggagttcaagaccagcctgagcaacagggcgaaaccctgtctctacaaaaaatacaaaacttggcaaggcattgtggcccatgcctgtaatcctagctacttgggaggctgaactgggaggaacacttcagcttgggaagttgaggctgcagtgagccgagattgcaccattgcacttcagcctaggcaacaaagcaagactctgtctcaaaaaaaaaaaaaaaatctgatgagattaactataatgaatatagtctatattgttgggcatttgggttgtttaataaattttcactattattgccaataatgttttagtaagcaaatatgtatatttatctttgtgctcatatctgactatccctacaataaattcttagaagtaaaatttctggctcaagataaatgcccattatgcaaaatttgaaatatatattgccaaataactctcctccttcaagtgatttaacccccatcaagcagtataaatgaaggagctttttttttttttttagcctcaccagcttttgatgttaaaatatttttaatttctacctttagtaaatcaattacaaacatgtatataagcacaaagaatactatgagtaccatgtgcccaacacctaactttaaaacttatcagctcatgtctagtcttgaaaacccatctgctttcctccaccccagctcttacactagattattttaaagtagatctcggagaacacatggacacaggaaggggaacatcatacactggggcctgttatggggtgggggaaaggggggagggatagcattaggaggtatacctaatgttaaatgacaagttaatgggtgcagcacaccaacatggcacatgtatacatatgtaactaacctgcacgttgtgcacatgtaccctaaaacttaaagtataattaaaaaataaataaataataaaattaaaaaaagattaggattcatttagttgtagcttgcaggccaaagctgattcactatctgttttttatgtcccatgtgccaagattttttttttcacatttgtatatgactggaaaaaattagaaaaatattttgtgacacctgataattataaaacattcaaatttcagtgttaataaataaagttttatttcaaaaaacaaaacaaaaaaaagtagatctcagacagcacatcatttcttccatttacatcaagtgtgtataaaagaaaaatgtcatcaaatatctaatgtgtgcaaatttcccccattgtctcataaattatttgtttctatgatttgtttgaattaagatacaaacaaggttcatgcctatgcagtcttttttaatcttggacactctctcccacttttgtctttgctaatttttaggttagtgcagaagtaattgtggttttcatcattgaaagtaatggcaatgcttgttgatactttgccaatagtcataaatactatcttttttccatattcattactaatatagttgagtgtgttttttttaattgaagagtcttttttctgtgaattgcccagccatcctttgacatttttctgatatagtcatctttagtaacaatcgttacttttttacaagatcttaagtgtaggttttttttcattcattcaacagtgtttaacttacagcagtatttcaggcacttgtctgatgatagggatcaaagtatgaaacaaactccaccaccctcaaggagctcacttctagtagagaaagacaataatatagtaaataaattaaacagaatgctaggaggtactacatgctataagaaagaaataaagggagttcaggagtgtggccagggaggagagagattgctattttcagtagcatggtcagggaggatctcactgataaaacttgaaggacttcacaggactagctatatgaatatctgggagaagaaacttttttaggtagagggacacaatcacagtgcaaaatctctaacataggaatttgcctgacatattcaaaggctggtgaggatatataactggtacaaagaaaaagagaatgaaagtagtgaggagatcagagagataaagggaaggaaggcagatcacatagggccttgtaggttactatcaggacttaattagtcttttactctgaataaaacaaggagccatgacatggtctgagcagaaatgtaacatacctcaattgtgctcttaaaagatctctctgactgctgtggtgagaatagattatactatggcaagggctgaaacatgaggaggcactagaataacccaggcaaaagatggaggttattcagaccaggataatagcattggagctggtgagaagtggtcagattctaaaatgttttgaaggtagagccagcaagatttccaagaaaattagatttggaataggagagaaagaaatgcttaagactgaatctaaaattttggaacttagcatctaaaagaattgagtcaccttcagagagataaggaagacttcagatggagcaggtatacagggtggaggttgtagaaaattaggagttcagttctaggcatgttaaatttgtctaagatacatccaagtggagacatcatgtaggcagttaagaatctgaagttcaggagagaagtctaagctaaaacataaattcgagagttgttaacatttagatgatatttaaagccataggacaggatgaaatcactaagggatattaactttttcctgtaatatacatagtataactatacccttcaagatttgccacttattcttgcttttgtttgaggtttcctttttaatgctgaaagttaaaacatttatgtagtaaaatagcttttttctctctcttactgccttcgggatctttcctcaaaaggcctttccattcataagcttttaaatttttgtttccactttctcctaatttatgttggtgttaaatgataggcaagaatctaaatttattttttccaaggagactagcattcttatatagatatattggcaatgcatccttaacagccactgtgttttttgtacagtaagtagtcatatataattctgtttactcaatttctactctattgtttcacctgtttgtctgtcttagggccagtagctattattttaatatgtgatactttatagttttttttatatagtatgctagcccttcttcattattctttgtctgaaaaatattctttgctttgtctaggaaatgaatatcagaataatttccagtttcaaggaaatgaaatttttttaattcataaattgacttcacatatttccaatatcaaatcttcgtactctagaatagtttgtctccctgtatgcatatctttttgtatgttcctcagcaaagtttcagagttttcttcgtaagtgttttataaatttgactgaatagatccctagatacaatattttgtatttttgtgacatagactactttttacttttcttaaattaataagcctaaattcttattttggaagaaactaattttgtaaattttatgaattttaattattttctaataaatagacttgatttttgaatagatatttatttgacgtgaaatctttaccttcaaactacaagtgtattgactaagagtaaaatatgtacctattttggggtctggaaaatagatagcacactcactaagtgtagtgcaagacgggggtgctgacagcaaaatttatttatggaactgataaaatttctgacattaaatgaaaagtcaagatttcctcattatccatctggaaactcacatttggtaatacttctgtctgtaacctttccttttttaaaattttgcacccaatgtcagtgattttatcttaaagtacaataaaagatactaggagaaccagtctcttaacatagtaccaatattctgattgaatatagagttcacacataagtttaagtttcccctaaaattacttgaatacaaggaaatttcatttgaaagataggaaatctctatactaatttctcatataacaaatataaagcaggaaaatgttaataaaccaaatcttccatattttttccatttggcaacaaaatttaatcatgaaacaatggaaatcatgcttgtatccctaaatacattttgtttgacttatcatccccatgtacataagacagtatttagttattcatctatagctgcaaatattactgtgaattaaaaggttctttgtattgtcccttcttttccatctttggtaagtgtaaatactgagaaaatgaaactgagagagaaacatgatatctgctatttcccacagaaaaaatatcaaaaggttatgggttgatttattattcaaagtgctggattaatttaaaggactataatagttccctatgtattaggacaatagttccctatgtattagggaactattatacatccctaaccatgagagtgtctcataagtgtattataaaatgtttattagtttggttaatttagtggtaccttatcttatatttggttaatttaatggtactttatcttataagataagtttacgtatcttataaatagttaaaattcatttacctgtatcatttgcaactatgaattccatgagtcataaggctgttaaaaagaatccagatttatgatgagtacactaattgtatcaatcatttgtagcctagaagtttttattgaaatgtatacattaatatttgatttcactttagaactttgccaactaattttgatttagcacagtttcccagaatttctcctcacgtacatattaacaggagtgcttgcttgcaaaggaagaatccttgccatcgttttgtaccaaacctcaattagatctaatcccattcatcaatgtctccctgtcatgaaccctactttgcagcctatgactcatgtttgctaaataccgcattcttcctttacaataacatacagctctataaatctcttaacgtttacagtcttaaacttttgataaattacttcctctgggtaaaatcattcagaacacatgatatggcacatcaaaagatgaccccaaaagccctgcccatttttaagagagggattttaaacccattagtgataaattatctagtctctttattttatgtaaaggaaccatctgtgaaatatttccaaaagctgaaaaataaatataaagccccctctacttaagaaaccacatgaattgccatttagcaattatgttttagagatttatttaaaacaaagagagaaaaagatgtttcttaatttattttaaaatatttttagaaaatttggcataagaaatgaataatatagtgacatctaaactagttttaatttctcttgtctctttccactgcagtctacacttcacactgccaacaaagtgatcttcctaataaagtgtagacctctcagaagagtcttcaaaggctttccaagtccagtgtcaagctataggcatacttttgtccagcaccttgtatcccaaccttctgttatcatgatttctgtttctggcctctgcaatttccaagcttttccatcaatttcaaatgcttgttttctctacatccatcccacttcttggcctaaatctttctccacaatgagagtccaattcagatacttccttctttattaaatcttccttttaatggatcatctttcctttgcctgcatatattcatctgtattcccatggcttttaagttttttattcctttcactagtgttttaaccttgttactgtcttagcaataaatatttgtttattttaatttggaaaaaagtgaagccaaaagaaacaagatatactttattaacttatattagtatttagttttaatagcctactgaactttttttctaagcatacatttgtggtttgcttttttaaaacaagaacagtggaatctattatatatatatagttgataaccagcctctttttcactgaactacttgctgtagacacattttgctatcaacgaatatgaatttaagtcatttttaatagctgcatattatatttgcctaatctcctgctaattaacatttagtttgttttcactttattattacaagcgacaccccattaaatgtctgtgcatgtgtatttattttgcaacttgcctaattatttccttaggctaagcccttagaagaagaatagcttaatcaaacagtatgtatactttaaaggcattagatatgcattgtcagattccccacccccagaactattataagtgtagtctaccattgtaagtgggtaatgaaggtgaaggtgaacattttttcatgtgctttttgtctagttatagtttgttctgaattaactgcctcttcctttgccttattttgctcttatccattttgttttgtaagaattatttctctcagagacagaccagccaacctatatacacatgtatacatagacatacatacatacacatacacgagctctaaatcctttgccaaatgtgttacatgtatttttttctctcttattcatggttggttttgatttttatgtaacccaattttaagttatgaagatattcatattttatttgcctactttctcttttcagtaataataggaaatagcatttcattttgggagcaatgaagtagtatgttgcctcctattcatatttttgagtctgtgaagaaagttttatttttttaagtctccattatgtttattatatatgttattactctgtattacttgcattactttttacctgacttctacctggaaaataagaaacatgactccaactctggcaacaacaaatataattgctatcatgactttgagaatgtcattttcttgctgtgagcaacaaattataaaataatgaagtttaaataaacactaaaaccatctagtactaaattctggttgtttgtataagatgatccccattgtaactttcctggtggccagtagttaggaccactcttttaaagtagagattcagtgaaaaatagatatagattgctaaactatataattcccatgacatagaaatgtcatagttaaagtacgtaaggccttatcttgcttgagcctttcagtttttgctattaggaaacatttgtgtgtaagtttattccttttttcttgtagcgatggactaaaaccaagcatttggtttcaaattatttggatttgacttgtcattgacaactgttttaaggacatttccaacatttcttaaaactatccttaggaagatataaaattactggggatttttctgttttctattggaatatatgctggatgattatatataacaaacttacaatatttacaatatttctttctcttttttttttttttttttttttctgagacgaagtgttgctcttgttgcccaggctggactgcaatggcatgacctaggctcactgcaacctctgcatcccaggttcaagcgattctcctccctcagcctcccaaatagctgggattacaggcgcccaccaccaggcccggctaatttttttgtatttttagtagagaaggggtttcaccacatttaccaggctggtcttaaactcctgacctccggtgatccacctatctcagcctcccaaagtgctgggattacaggcatgagccaccacagccagacagtatttacaatatttctttttttttttttcatttaatttcaatattttttttctttttttttttcttttattattatactttaagttttagggtacatgtgcacattgtgcaggttagttacatatgtatacatgtgccatgctggtgcgctgcacccactaactcgtcatctagcattaggtatatctcccaatgctatccctcccccctccccctaccccacaacagtccccagagtgtgatgttccccttcctgtgtccatgtgatctcattgttcaattcccacctatgagtgagaatatgcggtgtttggttttttgttcttgcaatagtttactgagaatgatgatttccaatttcatccatgtccctacaaaggacatgaactcatcattttttatggctgcatagtcttccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatatacccagtaatgggatggctgggtcaaatggtacttctagttctagatccctgaggaatcgccacactgacttccacaatggttgaactagttgacagtcccaccaacagtgtaaaagtgttcctatttctctacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttttttcttgtaaatttgtttgagttcattgtagattctggatattagccctttgtcagatgagtaggttgcaacctacaatatttctaaacagtatgctatactgctgtttcttgattcattagtgtttagatgttataacttctaatcatgagagatgaagaattagctcacttacaacaccgccaccttatttcttctctggttttgctaatgtattttagcaggatcaggtaagaagtgacatgtgtatgttatataatatatacataaagtatgcaatttcacattatatttatacatatgttaatatgtgtaacatttagagcctacttaaggaaatattttataattaaataaaatattatttaaaacatttattagaagtaagaatatactgacatttcttaaaactaattttagggaaacagacatgaagcatctctttttttttttcctttttttctgctttttactggaaacgtttcacagtcctcagccaaatctgtgagatagacttcctggagaattgaaatatttgaaagatgcaaatactgaagtagattgattgtccttataggtagacttaagtagcttaaagagcaataccaccaataaatacatttgtagatgtttctcttgaggtataggcagtcaatttatcaaacttttttcaagtcttttttatgtacttcatcagattatcctatgttttattgtcaaaatcaaaatgcccaatttattgcttttattacactaccattcatcaattatatgtcttaaaatcctacacatttgagagatagtgaatggcagatgaatatccaaactttgtttacttttttaaccacttaaccactcaccaaatatttatttataatttttataaccacttagcaaatgtagtttgtcatgcaaattaattatgttttcattatgatttcactgtttttgtttttatttttagctgtggttttattaatagcaaatttaatactctataatactaatgttaatatacttctgttgtaatccatgttacattgttttagaacctgggttattgatgaaaatatttgtatttcttctccatctaatccatgatttcagtgcatgcatttacagttaattttaaaagtggttttaatacttaaaagtcttttgagaggcttctaaaacttggcagtctcaacaaaatgtttttgtctaacttcctttttaagtctgtctttggacttacagtaaacaaactttttgaagcgggaatctctagccataatgcaggaacagatgaatagaacactcgccactttatcctgaaacgcatactttcagttttttataggatgccttaaagcatcatataaatattttaaaaatgtttgctaaactattaatgagtaactattacaaaactagggttggacttattaaacaaagctctgatttatagttatctccagaaaactagtcaatctgggggaacctacagatgtccatcttttttatttttatgtttcatttacaaagaactttttgattttccatttagggggtatatgggcctggctaccagtattacagagaagtgggagaaaaatcagcatatatttattattaagaaattatttaatgcacctagtgtcagctgtgcatgttggccccagtctacagcctatccagagagtaaaacttcatgtcttttaatagggtaacaaaggagcagttacctagcaatgtaggtgatggtaatggggtaagggagatctgggaatccaacttccttatacagacttccaagaattctcctgttttaactccaccctgtgctttcagagacaacctcatgccttcagttcctgagatcttcagaggtttgaaagagctgattttttattggcttcctacccaccaccccaaacattattccccctttttttttttggtcatttattattttacagagcaggattatatttattatataaaataatcaaatgtataaaaaggaaaataaaataattcattattttcccagtgagctataaacctgtgttaacattttgatgaattggattatatttccttctctgttttctattacttttccccccatttttgctcaggaggtttgtgcgctttgatttggtttttgtttttgtttttgtttttgttttgtcaaaattgggatcatactgtatactacctcattaatgaacatttttttatatcatcaaataatctataaaatatagttttaaatatcagtgtaattgtggatgttcatgttcatttagttatttagtcattgcctaagtgatttaattaacttctgtggtaggggctcagcattgtgtggtggtgaagaacttggcatctggattagcaaaaggtctgagtttgtatgccagttctgtcatttctttacattttctttttataggtccagtgagttttctgtttgcttattataattatgttttttcctgtaaaattaaggggaaaaaatatattcctgtccactgatccaacagcccagggaatgtagggaaggaaccagagccacaggtagtctcagctagaaatctgcccctttgcccaagagtatctcatccatgtgtgatatagccaacagtgatgggaacaagcctgataatatcgggtactttttaatattttttttctgcactgaaacaactgagccaggactgaattttagagcctcttagcgctacttttagtgttcagatgttgccattttactatattgcatagctgtgtctcactcattctccccaactcccaccttaccccatcatccctggttctaatttaaggccctttactgatatctgccagtgtcttttacttaactccttgggatagcactgaagggtaaaggatagggagtactataagtcattctcctccatgccttcccttaagagtctgagctatacaatactctttagaaagtcctctaatgttctggcactcagatgataatgttttcccattaccaacattaggtcaagtttaccctttttttaatgatgtgatcattttaaagggaatctgagtgggcgctagatgcctctattcaggttatcactttggttaaaattgtcttttgcagttaaccttcaaatgcctccttgtactatgggtatttctcaagtgtgccaaccaagtactgtttctagtgagaaattcttcaagcagccagtgtctttctaaattccttccctatcaaaaagaaaagattctaatatgtatattcttttatcaaaactcattcattacaagtttgcattttgcattttcaagcttccttaaacatggatcaaaatgcattggctcctttttaaagaactgaatgctatactaacaaaatattataagaggagcaattagaccttgtatctgaaaacatagtatgtctatgcctggaactgtctataaacctgttttaattgtttgggagtgtccagagatgaatatgcagagacagtagggtgcctaacctaaaaagagatgctgtttttaacatcattctaccaacttaaatcttacccattaattgcctttggtacaacttcctaggaggtgaacttcattttcaatactgtctctatctgctacttttgttctaggactgtttcctacttatccttactccttttctttcctttcccctacctcagcataataataacactcatcgtctctgaataagaaatcacagcctcaaaccccaaagagtttctactgcctcaagtctctatgagtgtccaaactagaaagggaaaaatgcagattccaggactcctacagttacatggatcagaactcctgaatagaggacaggatcccaagcttgatgagtgggagtagagggaaggggatgtcaaaaaaaaaagaatgccaaagttgagggaatgacatgcataaatggttcatggttttatggagcattgtcaatttctcttaatttacttatgtagaattaatatatactactttctgtgaactctttattataaggcagctaattacatatatagatattataatacccttctcacatctctccatcactgctcctaccactcttacccaagctgtcatttcttgcttaagctatagcaatagccttgttaccgatttttctgttttctctcttgaccattcttgacacagcaagcaaatcactctttttcctaaacatcaatcagatcacattatatccatatttgaaaccctccacagatctccctttacacttggaataaataaaaacccttgtcttgtccataaatcctaacataagttgccccttttgatctctctagcctcttattctgcctgtccctctaactcacagcacttcaatcaaactagcctcttttcctcgagctcaacaaattcattgttgccgttggatctctgcacatgctattttttctgccttttcccccagatcttcatagaactgcctccttagccattcaagtctcagatcacatattccatccttagaattgttattctagccatcatagttaaaacatcctatctcccatcactgtctattccatttctctgttttattgtctttacaattaatttatcatcctaatttattttatttgtttattgtcatctgccttctcccctcaaaaatgtaaattcttaactgtcttgtttaccactgtacctagcatggtatggtaggtacttaataaatattgggtgggatgaacagtgaattctttttatgcaggtgtactccttttagattgttgcttttgtaccatagctgactacaactttttttcataaataaaacatatgttgatcctggattcaaaatagtagtagtgatttttttcttttaaattttttgacattatgcttcctgttattatttgggcataaatttcaaaaagtcctattcacttacatcccatgggtcataatcattcaaggtaatagaaatggagcacacttacaatatgttgaggagttaaagtctcaagagatgttgtggaaatagcaaaattactcagaaaccataacatacattgctacccactacctcttatatttaagtatatgatacactggactagttccttagatagaccctagagatatgtcttcccaagtgactgccagtcttccctattccagtttgcaagagcgtgccttataacaatgcatttttaatttcctgttcccttctgtgtagcacccacgttgctagggtattttatgggctatcatcatctatatggtctcttgttctgcaaggcacagcctgcaactttgtgattcattttctcattttatggggcctttctgaaggaattataatctgcctccaagttccttcttatcacttctactctataagcacaagaattatggaatattgttagatagtgttttcccaagctgaatcaggggaaactacaactgtcccatgcctgctcttctggaaatttactgtacacccttttcctctaatggaaaagtacagcagatctcttttatagacatagacctaacatatccaacagttcttatagcctattgaactttctgatcccccaactcaacactctccacttgccatacccacataaagttctttattacctaacttagctaaaggataataattatttgttatgtaattgtatttatatattataaaaattgtattcagagtaaaatttagttgtttatgcttttagttttcattaagttgggtcattttccttttatgtttatagttacagaagattgacttaaatttttatttaaacctttaaattttgtttttgctctggttagctcctgaagctttctaagcaactaatcagcctaagtagttctgaattgaccatctgccttctgcccttttattttatctgaacttaataattgagagaatgaaaagaactctttagatttatatcatatacatgttgtgtgtctgtagcatctcttcttctaggcccagtaaaacaattgtatgtaaatccacattaactaccacatctccatgctattccttcagcttatactctgccaggagagcaggattatagctaaagatatatcactgtaacaccactattccttttactgacaaattgttagtcagtctgatcatactaaatttgatgtcgggtgtatgcttagattatcccagaggacacgtggatatttcttcagtgttctaccagaagactgtgatttttatcactctttactagcagtagggaaaatgtggtccaccatgatgggaatttgcccagttgccactcccagagattatacctgctaagtatgtattttaaaaaataatgactctataattcttgtcccttgagatttcatgttccattgtattttaaagtttaaaatgttattataaggtctgcatttgcaaagaacatatatacctgtttcaataatacctgtggtttatattaatcatcagccttgataaactggatatctgataaactgaaagtgaagcactgtttgaaatatattgttttagagataacagtaagtttttgatgattggaaagtaaattacaactctccttgtaaaagttgtaatattaacagttgaaacatatttgcatttctagagcctttctttgaacccttatcatataatcctattcatatataaaaaggtaatatccgcttttttctaggggatattaatgcccacactgcttaagtgagttgcccaaggtcacttggtgagctgttggtggagccagaaatagaatccaagtctcctgactcccaattcagtcctctaccctccatgtagttttctatcccctatacccctgctgcctctcatgggaaaagaagttaatctgccagctattaatagccaccaaattggtggtagcagcacagtggagaaaagtaactgtctttactctgcagcattagtataaaaatatctggtaatggaaaatttgacaaatgtcatgttaaagggagtggaaaattattttaagatctggatctcatttatctagttctcagaaaagtaaaattcctcagtagaacagggatcatatttttcttctgtttttgaattttatttcctagagggtaattgtcaacctagccaaagcagagcatattgtcaactaatataataagaatagtgcttgtactgttgctgattgtttaagtgtattttctaacttggttgaaagtttgaattgctttattgaaatgcataacacttatcttattctgctttcaatgttctttaagttagtattatacagtaaagtaaatatcaactgggaattttacttcatgattagacaacgtgaatggaaatacacgtaatagtttcttccattgaccgtacactccaagcaaaggtatttcatgtcagacaccatgaagttcaccagaatgaagtaggtagagtagaaaaaagttaattgaaaaatataagataatcacactgaagttgatcaagtgtattgttacatatgtcattatttggggcattaataaaaggtgtttaccagatgtttgtgtttttaaatgttaaacattaaatactaaatctagtattgtggtaataaattctaatgaaacaatttgtttcttaattttggaccaaggaccaagaattacccaactaaaaatatcagcatattttgtttctatttaaagattactaaaaagtctttaatcagaaggatgacatgaacagaattatgttttaactataagcataaaaaagacagaattggtatacattggaaaatgcaagggaaaaggtagaaaaaaaaatctagtaatttggaacccaggtgacagagaaggtaatggtaagaggataattagaaatatgagaaactgtgtagaacaaggcaactagagggtcaagtacagctccttagggaaatgtgtacatttactagatggaagaagagaataacacagatgttagaatagtacagatataattttgaaaagctacaggaattatcagataaggctgagaaagatcatcagacttagtgacctcttgacatttgggagactgacttctccagagtgatgagggtgaaagtactctgaactctctgaattatttcatttatctttagtattaaatcttgtttttacaaacctatgagttatgtatgatacaggagacaaatcagttaactagaatgcttaattgactacagttttctctcaatatcctggggacaggcaagttgattccaggaaccctcccagataccaaaatccatggatactcaagtcccttacataaaatggcatagtatatagcctacatgtatccttctgtgtactttaaatcatctctagattacttataatacctaatacaatacaaatgccattaagtggttgttatattgtatatttttttaattgttttggtttatttgtttgtttgttttgtgaatattttcagtctctggttggttgaatccacagatgcagaatctgcagctactgagggtcaactctgtatacctgacactgtaacagaaacaatgctttcattcacccagaattttactggttattgccattcttgttcatttagactagacttccactcaattagtaataaactggtcactgacacccaaaccctagcatcacccagtatactcatataacaaacctgtacgtgtacccgcaaatctaaaaaacaaggcaaaacaaaagtaataaactggtaatattttacaatggaacaagtgttaacctctgtgcctataaaagtttaatactgttttcatcttaaacccaaatcaaacatgaaagctagaaattgtgaattttattggaattgattgataatttgtttcctaattacccaatatctcaagaaagctatacctataaattaatattgatattagcaatatattcttttgttatagaatttctttataatgagtttatctttatttaaagtttttagcagtaaaccgtgatattttcctttccaacttatatttttcagatttttatcaattggcataaaaataccttattattagggtttcttagttttaaaagtaatgggggttatttaaaaaactaggaaacattatcgagtgtctttttttatttttttgaataggctcatcttcaggtggaactaatctggttaagattcctacagaaaaaagaactcggagaaaactaatgccatctcccttgaaaggacagcatactctaaagtctccaccatctcaaagtgtgcagctcaatgattctcttagcaaagaacttcagcctattgtatatacaccagaagactgtagaaaagcttttcaaaatccgtctacagtaaccttaatgaaaccatcatcatttactacaagttttcaggctatcagctcaaacataaacagtgataattgtctgaaaatgttgtgtgaagtagctatccctcataatagaagaaaagaatgtggacaggaggacttggactctacatttactatatgtgaagacatcaagagctcgaagtgtaaattacccgaacaagaatcactaccaaatgataacaaagacattttacaacggtacaaaaaaataatatttgccaattctttttttttaacatagactttcaactattagttgaggtttatttcataaaccaagtgtgccattttgattataaaacagtctgttttattttcattaaattttaattatctttctctctgaatattaattcactaacaaaatattttaaagtcttaaatttgatatcttaagtcagttgaccgtcgttagtctaggagagaccttaagatatgtttagtttgttcttcttactctgaaggtggattatacaagctattgttggaggattatcatgtttattattcattaatattttcactgaaggaaatttcacactttctattgatgtttagcaaacctcaacttactctgaaatggtcatacccctaaagtatggttgaatgtgtgtcatccaagcaaacatatccttctcactttatctgcataatcatacccaatctaaatatggaaagaaaaataccttcactattctatgccactgggaatgcagaaatctcttgatagcaactttacctgtgttataaagagaaaagaataccccaggacaagcaagggaatctttacagtatagcagaatgtttttctttatatattaataccaaatggttttctaattatggacacatttgcttccttttctcttcatagttcaaatcaaaattattattttttatttgtcactattaatatacaggcttgatccttcttcattctcaactaagcattctatgcctgtaccaagcatggtgccatcctacatggcaatgactactgctgccaaaaggaaacggaaattaacaaggtatgattaaacataaactggtttggttctgtagttatataagataatctttatatattatatgctattgcttttttattttttataattagactctcaattcatgtttaagcatacttaggataaatttctctgaatggggtactggatttatattatcaaagggagatcttgaaaaactcaagtatttcacttgatattttataaaatatttcatattacagacttaaaaataaattgaaaagttttctgtcaaaaactacttaattttaacttttctggggtgacaatttttacttatttcgttatttctacttacttcattatcctttttaaacattaccaaatttcttccatcatagaattatgttattttaatggattaagatatatgactaaaatataatgagtgaagagacttttatttctgcctaagacagtgtagcttgtatcagaccaagctacctatcaagaacagttgtaaaaagtgcataaaatagaaccaacagctgcttgaaggcaatggagaacaaccatgatagccaggatggagagcctgagatcccagagaaaagagaaacatgctatagacagctagactttctctgcctctgttttttatttagcatttgccaatttatggcataaggcatagaggccgaacagaaaatggaaacttagagctatcagctgtcttactctgagctagggaaacaaaattattctgtacaggttttgtcctcaaggtattcgccaagttctcagctttgtggaatgagaggctaagatgcctagctgaaagtagctgctaagaggctaaagtattaagcagagttttgatgttcttatgaggctttcacagaaaaattggagttcagggaccaccatgaagaaaagaccctgttaaacacattaggattttatttgagatccctgaagggtgtttcactaggagtagggcaacctagaaataggccagttcttgaaagtctgaaacagaccttagaccaacttaattcttgattggatcaaggtgatttatctttgctctgcatcaatgtttggcacttaaacaaaaattacaaagtatgccaggagacaggaccaaatgactaaaaattaagagaaaaaaacatcatgggagcagtgattcatacgtgaggcagatattggaattatcagataggaatttaaaaattttaactgtaataatttcaacaaatagatacttccccaaagaaccagattctattaaaattaatcaagtggatattctagaactgaaaatatagaatttactgagatgaagaactcaataaatcaattcagcagattacatacagcagaagagagtattagtgaactgaaagatggatttgttttttactttttatttttgtgggtacgtagtaggtgtatatattagggggtgcatgggatattttgatacaagcatacaatgtgtaataatcacatcagtgtaaatggagtattcatccatttatcctttgtgttataaacaatctaattatactcttagttattttttaaatgtacaatacattattgttgactgtagttaccctgttgtgctatcaaatactagatcttattcgttatatttagattaagcatccccccattaaccatcctccccaatctcccgaaaaacccttcccagcctctggtaaccatcattctactctctatctccatgagttcaatttattttttagctccccaaaataagtgagaacatgccaagcttatctttctgtacctggcttatttcacttaacataattaccatcagttccatccatgctgttgcaaatgacagggtctcattcttgtttcatggctgaatggtactctattgtgtataggtactatattttctttttctattcatctgttgattggcacttaggttgcttccaaatcttggctattgtgagtagtgttgcaataaacatggtagtgcagatatctcttcagtatactgatttcctttcattttggcatgtatctagtaggggcattgctggatcgtatggtagcactatttttagttttttgaggactcttcaaacttttctttatagtggttgtactaatttacatccccatgaacagtatacaagtgttcccttttctccatatccttgccagtgtttgttgttgactgtcttttggaaaaaaagccattttaactggggtgagatgatatctcattgtagttttgatttacatttttctgataatcagtgatgttgagtaccttttcataagcttctttgccatttatgtcttcttttgagaaatgtctattcttttgcccattttaaaaatcagatcattagatttttttcctagagttgtttgagctccttatgtattatggttattaatcccttgtcagatagatagtttgcaggtattttctgtaattctgtgggttgtctcttcactttattgattgtttcctttgctttacagaagctttttaacttgatgtgatcccatttatccatttttgctttggttccctgtgtagggtattactcaagaaatctttgtccagtccagtgtcctggagagtttccccaatgttttcttttagcagtttcatagtttgaggtcttaaatttaaatttttatccattttgatttcatttctgtatattgcaagagatagggatctagcttcattcttctgcatatggataaacagttttccagcactgtttattgaagagactatcttttttcccaatgtatgttcttggcagctttgtcaaaaataagtttattgtaaatatgtagatttattttggggctctctattctgttccactggtttgtgtgtctggttttatgccagtcccgtgcttttttggttactatagctctgtagtgtaatttgaagtcaggtaatgtgattcctccagttttgatctttttgctcaggatagctttggctattctgggtcttttgtgattccatataaattttaggattgttttttctatttctatgaagagtgtcattggtattttgatagggattgcattgattctgtagaccactgtgagtagtgtggacattttaacaatattgattcttccaatccatgaacatggaatatctttctatttttttgtatctgcttttcttacatcagtgttttatagttttcattatggagctcttttacttctttggttaactcctacttattttatttttagcttttgtaaaggggattactttttttttcaaattatttcagtgtttgtatatagatatgctactgatttttgtatattgattttgtattctggaactctactgaatttgtttctaggttctcatagttttttgtggactctacgtttttccaaatatatgataagatcatgtcatctgcaaacaaggataatttcacttcttcctttccaatttggatgttctttctttcttttctttctcttgtctgattgctctacttaggacttccagtaatatgttaaataataaatactggtgaaagtgggcatccttgtcatgttccacaacttagagaaaagaatttcagattttctgcattcaggatagtaccagctgtgggtctgtcgtgtatggcttttatcgtgttgagatatgttccttctatacccagttttttgagagttgttttttttttttatgctttaagttccacggtacatgtgcataacgtgcaggtttgttacatatgtatacatgtgccatgttggtgtgctgcacccattaactcgttatttacatttggtatatctcctaatgctttccctctgcgctccccctaccccacaacaggccccggtgtgtgatgttcaccttcctgtgtccatgtgttctcattgttcagttcccacctatgagtgagaacatgcggtgtttggttttttgtccttgcgatagtttgctgagaatgatggttttcagcttcatcctgtccctacaaaggacatgaactcatccttttttatggctgcatagtcttccatggtgtatatgtgccacatcttcttaatccagtctatcattgatggacatttggattgggtacaagtctttgctattgtgaatagtgccgcaataaacatacgtgtgcatgtgtctttatagcagcatgatttataatcctttgggtatatacccagtaacgacatggctgggtcaaatggtatttctagttctagatccttgagaaatcgccacactgtcttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatcatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttaattagatcccatttgtcaattttggcttttgttgccattgcttttggtgttttagacatgaagtccttacccatgcctatgtcctgaatggtattgcctaggttttcttctggggtttttatggttttagctctaacatttaagtctttaatccatcttgaattaatttttgtataaggtgtaaggaagggatccagtttcagctttctacatatggctagccagttttcccagcaccatttattaaatggggaatcctttccccatttcttgtttttgtcagatttgtcaaagatcagatggttgtagatgtatggtattatttctgagggctctgttctgttccattggtctatatctctgttttggtaccagtaccaggctgttttggttactgtagccttgtagtatagtttgaagtcaggtagcgtgatgcctccagttttgttcttttgccttaggattgtcttggcaatgcgggctgttttctggttccatatgaactttaaagtagtcttttccaattctgtgaagaaagtcattggtagcttgatggggatggcactgaatctataaattaccttgggcagtatggacattttcatgatattgattcttcctatccatgagcatggaatgttcttccatttgtttgtgtcctcttttatttcattgagcagtggtttgtagttctccttgaagaggtccttcacatcccttgtaagttggattcctaggtattttattctctttgaagcagttgtgaatgggagttcactcatgatttgtctctctgtttgtctgttattggtgtataagaatgcttgtgatttttgtatattgattttgtatcctgagactttgctgaagttgcttatcagcttaaggagattttgggctgagacgatggggttttctagatatacaatcatgtcatctgcaaacagggacaatttgacttcttcttttcctaattgaataccttttatttccttctcttgcctcattgccctggccagaacttcccacactatattgagtaggagtggtgagagagggcatccctgtcttgtgccagttttcaaagggaatgcttccagtttttgcacattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggttctgtgtatatgctggattacatttattgatttgcgtatattgaaccagccttgcatcccagggatgaagcccacttgctcatggtggataagctttttgatgtgctgctggattgggcttgccagtagtttattgaggatttttgcatcaatgttcttcagggatattggtctaaaattctctttttttgttgtgtctctgccaggctttggtatcaggatgatgctggtctcataaaatgagttagggaggattccctctttttctatagattgaaatagtttcagaaggaatggtaccagctcctctttgtacctctggtagaattcagctgtgaatccgcccggtcctggacttttttcggttggtatgctattaattattgcctcaatttcagagcctattattggtctattcagagattcaacttcgtcctggtttagtcttgggagggtgtatgtgtccaggaatttatccatttcttctagattttctagtttatttgcatagaggtgtttgtagtattctctgatggtagtttgtatttctgtgggatcggtggtgatatcccctttatctttttttattgtgtctatttgattcttctctcttttcctctttcttagtcttgctagcagtctatcaattttgttgatcttttcaaaaaaccagctcctggattcattgattttttgaagggttttttgcgtctctatctccttcagttctgctctgatcttagttatttcttgccttctgctggctttttaatgtgtttgctcttgcttctctagttcttttaattgtgatgttagggtgtcaattttagatctttcctgctttctcttgtgggcatttactgctataaatttccctctacacactgctttaaatgtgtcccagagattctggtatgtcatgtctttgttctcgttggtttcaaagaacgtctttatttctgccttcatttcgttatgtacccagtagtcattcaggagcaggttgttcagtttccatgtagttgagtggttttgagtgagtgtcttaatcctgagttctagtttgattgcactgtattctgagagacagattgttctaatttctgttcttttatatttgctgaggagtgctttacttccaactatgtggtcaattttggaataagtgcagtgtggtgctgaaaagaatgtatattctgttgattgtgggtggagagttctgtagacgtctattaagtccgcttggtgagagtttttatcataaagggatgttgaattttatcaaatactttttcagcatctattgaaatgatcatatggtttttgttcttcattctattgatacaatgtatcacattggttaatttgcatatgttgaaccatcttgcatccctgggataaatcccacttggccatgatgaatgatctttcaggtttgttattggattcagtttgctagtattttgttaaggatttgtgcatgtgttcatcagggatattggcctggagttttcttgttttgatgtgtccttgtctggttttggtatcagagtaatactggcctcatataatgattttggaagtattccttccgcctctgtttttcagaatagtttgagtaagattggtattggttcttttttaaatgtttggtaaaaatcagcagtgaagccatcaaattccaagcttttctttgctgggagactttattatgactttgattttgttacttattattcatttgttcaggttttggaattttttctgaaagatagactggtaggaaaatatccaaactgatgtgcagtatgataaaaatatgggaagaagtgaaagagacatgggacacaatttttaaaagtctagaaaatatgtattttgtgtctcagaagggagtgagagaaagaatagggaaaagtaatatttgagatgatggctaatacttattcaaaactaacaaaagacattaaaccatggatttgagtagcactgcaaaccaaaagccgggttaatataaagagaaacatacctaggtatatagtagtaaaacaactaaaaactaaagataaggaaaaatcttaaatatattgagttatatgactagaagttcatgatgcattctttatatcctataaattgaatgcaatgacaaatatactcaataaatataaaatggatctgacttcctctacctctttttctttgctatgtgattatggggagaaaagtttatagaagaccttaaaatgactctttttaaatgtattttccaccaggagcctgttatcatttaagtaacaggaagcgaatttacaagtagcctacttatttgtgctacatagagtatcttctcataagtgaatttaatatctgtccttgtccctcctaaacaaagtataacagagacttggaatgtgtaaatttaaaatttatggatttttcctaaatgtctcatctatgacatttaaaattttatatttgctaaggtacaaatttgatttgtacaattattctggtttatatacagaagtctgtcactttatgagtgagcctagctaaccacaatcatctgtttcgtctacttttatcactaatttgcatagtgtcagttttgtcatttgttccattaattaattttagtgagttttcttgtccttcactggtagtatgttgtgtttactaagatgtcacaaatgtttatagataagaataatttttaaatatgaacttagctattataaaatcaaatagtttttcaggaaatgtccaggtatgtgaattgtgtatttggagtgattttagataagttaaagggcttccacatgaacaactaatattgtgaaataatattaaaggacatgtaaagaaagtaacttgatttcttatagcctattaattgttctattacattccctctggtaccagtaattagatcctgccattaactaaggttaaaagagattaatgctagaaatgtacatgattactttttttaatcttctttttccccaattaaagttacatgcgcttcagagtaataaactgtggtattttccatttagcagctttatatacatatttagttgtgtatatattctaatatagtttttaaaataaagaaggggaagctctctatatatgtatttcatttattttgcataaaatggcattagagtttgaaagcactggatattccaaaacctacccaacagatttgtttaaataattgagtatattagatttttaatcttaacaatttatttaatatttctctagcacactattttactaaattgattagcctatcaaatatttaaatataatgcatacataatgttagcttttacttctcaattatattaatcagagttttggattgtttgttttgtatttgtttggttgattggttttttgtttgtccacaatcttctgagcaccccaaagcagtttcatatttgccatacacttttattttgttttgaaagatgtctaattatttcaactagaaattatttcagataaaatagtagaagaggtattatgttgagtagaaacattctacctatataagggagcaaaaggttaattcttaactttatttatagttatgggaatatgttttgtgcacaactggaagtgtctttggatttttcagtatagcctttaacataatttgaacttgcgctcatcagttttaagtctttgtagtttatgacctacaacataaatgttaaacatttcatcagtggactatttaactaaatcgtaaacatgtttgggtatattttacttttatataaatacgcaatttattagggttggatttgatttctagaaatatgagttctaatcaaatggctttattcaaaagcctaattttcaagaaagaacatgctatgagtaaaaagtagggtcctggaactagccataatgcataatcgtactatgaaataataaagacaactttgggataaatttaagaaaaaacaatgttttatcaaaagtaactaataatattgatctttatatttgaaaaaataaaatcaccaaatgatcaaaaaagaatttctgccttggacagctgatatatacaaaagtgtgtttaatatgcaaaacagaatcatagtaatttatcaccatttaagaagtggggactactgtagttgatataatatttgtgcatacaaatttgtgattttatcttcttaaactgtgtcattttcattacttccactgagtagtcaccccttattcaagttttgctttctgtggtttcagttacccatggtcaaccgcagttcaaaaacaggcgattgtagaacaataagatattttaatagagagcgagaccacattcacataaccttataataattataattataattgctctattttattattattgttaatctcttactgtgcctaatttataatttaaactttatcatagatatgtgtaggagaatacatagtatatatccggtttgatactatcctcggttgcaggcatccactggcgatcttagaagatatcccccccgtcgataagggggattactatatagtatctttattagccagaatttccctaagcttaggttgtttgaatcagcgtggaaggatgttctttttccacccaaccccccccaatcctacctgttaaaaattgatcctctttaggactaggaaggattgctgtttttcaggacccagatcaaattcattgcatccacaaaatttccattattctttcttactctacactcaagaatctatagctccttgtattatggaaaccttggcactatatttttactttaccttatattatttcatgtatttatcttatttttttctcatctccactgtatgtctattctataagtttttaggacagggatttttgtgccttgtttacttgtatatcatgtaacacaaggccataataggtgtttactaatatggcaactcaaattgagtaagaaagttgaaccatcagcagtgtaagactgattaaatttttgaagctagagcaaatgaaaacaggtcattctttttatttcagtttctgtgattgtaataattagagatttttattgttaccctgctttcattttaaaacaaggtttttcaaacaatctcacttgtttatacctttcacattaggattcttggtccaaatttgtaacatgagcttagttttttttttttttttttttaacctcttgtgactatgtgctactgatctctacattttgaataatagtgcttacttatctgccagcaaagcaccctggaatattctgctacagaattgtaacatacacctacaatcataacattcaatttgaataaaaatataaaatatccaatttaaaatcacacacagctaaatttctctgtgggccaaaaatgtatttagtacctccacttctgtgagatttcacaacttaatatttttgtgttttatttctttaatcattgtcgcatgtacaatatgtattagaactttgaggtataaaaaaaatgcttaactaaattaaaaacttttcctctcaagttctacatcaaacagttcgttaactgcagacgtaaattctggatttgccaaacgtgttcgacaagataattcaagtgagaagcacttacaagaaaacaaaccaacaatgggtatgtctcagcttttaatttgatatttaatggtatgactctgtaacacacatatagtactttacgttttttattgtgttttcataagaatctccctttattcatcacctttactatgtggtagaacaagtatgattatccacatattatagataaggaaactttaaaacacaaaagcatttacccaagatcacacagatattatattggtagagccaaaactcaagaaccagatcttaaaactctactttctacacccttttagttatccctactgtctcataataattgaaataattggctaaatgtattacttaatgttactaattaagtgtattttgcagataaactatacccactttaaatttttctcttagcgtaatattttgaataatttggcctctaactcaatgtgtaactactacacagattccagtctgtatctagttacaatcatattgtaactcccattggcaagttggaaaagatactgatggatctttcccatcagtatgaaagatactacattccatcaaccgcatatgggagtgacatgagtttatggtaacaaaaccacttcagttaaactagtggtgtatcatgccagccagttttcaggccccaacatctagacctctgtctctgatactacagttcctaagacttcattcagaaactatttattcactaggcatttaccatgtcctgtgatgaatacagagagcagtaagacacagtttgattgttctctataggaactgataattatagcaaatgcaatttaaaggtgtctcatgatataatttttctaaggataacatgaaagctattgttagtttttttctgtcgatgccctttgattagagtaatataaaattcctcagtaactttgtcaaactatattggtaaatgcctgcttcctgtagtagccagtgtttaccttaagttcaatggaaattgaagcatcagacagcaaattgaaacatcagacagtaaggtagtaaagtacaaaatttaccttgatcatttggtttgacatgttgtatttaataatgcttaaaaatgtgtatctgtagttagtttaggtgtgtactgccccactgatcttcttaaaaagttcttcaagaatcataattctacagccaaataataaatttataaaaactctcaaattggccgggcgccgtggctcacgcctgtaatcccagcactttgggaggctgaggcgggtggatcacgaggtcaggagatcgagaccatcctggctaacatggtgaaaccccgtctctaccaaaaaaattttaaaaaattagccgggcatggtggcaggcggctgtagtcccagctactcgggaagctgaggcaggagaatggcgtgaacctgggaggcggagcttgcagtgagccgagatcgcaccactgcactccagcctgggcgactgagcaaaactccgtctcaaaaaaaaaaaaaactcaaatcatagaacttggctttttctaatatgcttattatctgaagatacaaattcatcaaatatttcatgtataaagagatgtgagtaaaaatatctactatggggaaaaaaaagtgggagatgataataaaccacaatgcttgccaaagaggtattagtttgtaaggaaagatattttatatacattataatgttcaagtgaaaaatgtattaaaccagttttctaactaacaatgtacaaataaagaaacataggaccatcagtagggaaaaaggcaactcctgttaacttagcagttagagaaataacagagagtgttaagggaatatgtccctctaaaactaaaacctaatatggccaacaaagtggataagcaattaaactaatcctgaaaaaagtcaatggcaccctgttgtaacaacactttgttgagtagaaaatgacggtgaaagctaatgaagaaccagaagaatgggcataaatagaacatacttgagaggtggcagtaaaagaaaaaagagctataggattaagatcagccctttaggaagtactagatgcaaatgataattttaaaattggaaaaatatggaagtttaaatccctggggaaatataatccaaggaatgagaaaaaatggtgatacaacaaagaaaatgaagaaatgcttgtagaaatggtcttttattagtcagaaagaaagaaaatgaacatagtatttaattcagcgacttcacccgatgtctgtgtatgtgcacgcactcactgaaactttagtttgcaatatgaatttgaacagcttttaaaccaaaggtattaatgtctctttgttgttgttatattttaaattatgttaactaacaactatgaatttcaagagtaaatttttctttctatggtcataatttttataagttgaacgatgaaaactttttgaatgatatttatgccatatttatgcatctttttatttcttctctagaacataaaagaaacatctgtaaaataaatccaagcatggttagaaaatttggaagaaatatttcaaaaggaaatctaagataaatcacttcaaaaccaagcaaaatgaagttgatcaaatctgcttttcaaagtttatcaataccctttcaaaaatatatttaaaatctttgaaagaagacccatcttaaagctaagtttacccaagtactttcagcaagcagaaaaatgaaactctttgttttcttcttttgtgttctaaaaaaataaaatttcaaaagaaaaggttgtcttttaagttttttaaatatttgttgccttttaaaatccctgagtgtaagttaccatggtggcagcttagttttactatgccacaacaagttgactaggacattttagtaaatggtagtgagttaaattatctttattattttttaaaaataagaatttagaagtggtaaaattatggcccaagatgtatttggttctctattatgttttgatacattattttaatcatatatatgactttccttttcaaaaatactttaatgtacaagtgtaaatatatgtgcccataaaatcattgtaaatattatttagtcatcacaaataaaatattgtcccttgctacttgatatattaaagatgtagattttaaagt

SEQ ID NO: 503 - DNA, 59196 bp, Homo sapiens
aaagaagataactcattcaaggtcaatcagcaagtaagtagcagaattggaactcaaacccaggtctagtttgatgataaagctgttcctttaagcaatttgccataacatgcacctaatgggaaatgttgcttggatcactggttatggccatcattcacggagatactgaacccggagttttctttaacatagcctttaccctgtagaaacatttaaacttcatttcagaagagaaatatctatttgaaaaataatctaagtaaattcatcagatgctttaccccagagagactctggtcttggtattttggtttttgttgttgtttgagacggagtctcgctctgtcgccgaggctggagtgcagtggcgcgatctcggctcactgcaacctccgcctcctgggttcaagcaattctcctgcctcagcctcccgaatagctgggattgcaggcgcccaccaccaggcacggctaatttttgtatttttagtagagacggggtttcaccattttgaccaggctggtctccaactcaggtgatccccccgcctcggcctcccaaagttgctggtattacagatgtgaaccaccgcgcccggccggtattttgtgaagaacaaactataaggtgactactattttggggtcaccttgacatggaggagaggtgaatggaaataaaacttattcttcccagtgtctttagaatgtaggcgctgaaactgagtgaaactgagtaaaactgccacccaattttcctgggaaccagcgattctgtagtcaacagaagtttgcttttccaacagctggaaacgccagggttgggcacagcctcaagaactgaggctgccttgttcagactttcacacggtccctctgttccttccacagaggcctctttttcttctatatcccgcatctgccgcttgggacactcattctgtagcgcagcaccaagtcttccaaaaaggcggcgctggttttgcgctccttttttaaagggatctaggccagcctctatctgaactctgtacgatgttttttgtttgtttgttttgttttgtttttgagatggaatttcgctcttgttgcccaggctggagtgcaatggtgcgatctccactcacggcaacctccgcctcccggattcaagcgattctcctgcctcagcctcctgagtagctgggattaaaggcatgcgccaccactcccagctaattttgtatttttagtagagacggggtttctccatgttggtcaggctggtctcgaactcccgacctcaggtgatccgcccgcctcggcctcccaaagtgctgggattatagccgtccgtcacagcgcccggccaactctagacaatatttattgctctactttttagtgtctgaagaagaaagaagaggacaggaaagaaacttcagtctgagggttgaggacacgtcccggagcagaggaggaccaagctcccaagccccctgtcaccttgacacgcagacggttccccaggactgcgaagaggggggcaaccagcgccccgccccgccccgctgcgccgcccgccattggccggtccgaaagacgcggggcgttgtcggtttgaatgagagcgcctggagccggggcgcaggcgcagaggagggcggtgttgagaccggcggagcggcgggacccctaggtggcggagggacgctccgggaaagcgaggggcgctacgagctctggcccacgtgacctgccgggggcgggagcagggggcgcgccggcctcctgcggtgcccctgccttggggaggggccgtgaccacccgtctgtcgcccgaggcggccgccgctgcaccttcaccgcgtacccgggacccgcccgcccgcgggaggtgagcgcttccgcgacgcgggttctgaggcgtttgaggggctctcggagggaggtgacagggaggggtgcgtgtgcgtgcgtgtggggcttctgtgtccagaggtctgggggtgacgtcctttgttttgggcaggaggcgggctgggggcttgcgggacctgtgggcgctgcggggacgcggcgtcgatgctcaagaaaccagaaactcggcttgaggagttgctgcttttttgtcggaaggtcttcaaatgagagtaaagcgttaagagcctcactcctgagtctttttttttttttaagataaaaactatactagagtccagcgacttcttaccactctgaatgtgagtaacaaattgtgaatcaaagcccgaatccccgtggaattcattccgaggctgattgcaatcacttggagtcgggcgcgtcctacctaaaccaggcagtttatggcaaatacctgccttgaccgtgcttaaattagtgaacttttgggcaccaactggtcgatttaccatagaaattggtagttgctgcaaaaagagtaagtaaacataaaacgttaagaaaactctttcctgaaatctatagaataccttcgaataaaaaaaaatctgtaatttccttgttttaatagtaaccagttagagcatttgaactagtagcatttgaactctgttaaagaaaacgagtaaggatggaaattttattggccttaatgcataatttaaccacaccgtagaattaaacgaagtaggttcttggctttcctttctatcgggtttgcattggagcgttcgtggggtgtgttggaagtcagcaggaccaacagagctgagttttcaagctgccactttagaagggtgtaccgaagatttctggcctgataatagccggtgtgattgcttctgataaataccacttttgattgggttctcactattcaggagcagctttagttgattgtttagaagtgaataaacaacattaaaaagggtagatcactgttggttgacatggtgtgtgtaaggagaggggggcctcagggattaggggtggtctcacacctacttctctttacaactaccacggagtcgttttcgcaagctatttcccaggctattacttataatttaagtattggagcggtttcaaagtaaaaagttgtgtgatgttgttgtagaggcatgtctccaaaatcctctctggccagataagcagtttaattgtattttcttacattcttaaatcagatattcggtgttacaaacatattttaatatagatctgagacttgcttactagactaattaaaacagtgataagatatagtagttttaaaaatgaccttttcataaacataaaatatttctaagatctatctttagaaatttgtaattagttctctggaattttaaaatggaaaatctgacatagatttaggttattctaaatttatttgaatatatattaaatatgtctattttataataacagttactgttattactacagcactatgttgagtacttttgttatgtatcagagccaggtgctgggtcaggtgctttataaatcatgtctgtaattatcacagcacattttaggtaagtgtcattatgcccacaccaactgagagtttagcgtaagatcatataactaataagtcactgtgccgagattcaaatcatggcctgatcccaaagcacatgctgtattgcttctgtgtgtctgtttaaatctctgctgtgtctctggattccatttgtagggacaagttctactttaaagatgcctttaggtgctgtgttttgttgtagcttcgcagaaatatttcaatctttctgttggaactatcttgcttcattattttataaatcatcttataaatcacattatattttcaatatcttcttaatcatctttatacaaaacataagtgaagagtaagacttttctgagtttcttacataaatatgaatagaatctttactgtggagaagaaatgtattacagtccggttttctcactattgtaggattctttggcctcgtcataattcctgtcttcttcccagggaagaaattaaagtttgttgggcctctcttatgtgcaaagcaatgtcgttggtgttgtgagatgacaagaaaatgcttcctattcagtagttgtttctggagtttttgtagtatttttcttttctccccattcctgccttatatgttgctgctggtttatcttcctagcagagatccaacttggctattcctttgtggggaaaaaataccagcaaggttccccattgtgtaaataaaaggctgaggccgggtacggtggctcacgcctgtaatcccagcactttgggaggccgaggtgggcggatcacgaggtcaggagttcaacaccagcctgaccaacgtggtgaaaccccgtctgtactaaaaatacaatagttagcccagtgtggtggcacacgcctgtaatccaagctactcaggaggctgaggcagggaggcggaggttgcagtgagccgagatcgcgccactgcactccagcccgggtgacagatcaagactccatctcaaaaaaaaagggggggctgaatatgaatatatgcttctgccacatgttcagagtccctcacagtttgttactgttctaccttctcagccttctctttcactactctgaatactgtgtgcttatcctggaacacattctgtgcatttctaccctccctttttcttgagccattcttttcccttgactggaatgcctttccttcatttggctaataagatctacccatccttcaaggtgctgtacaaaattccttgcttccaaaaagttttccctggtccttttcagttagaattattattcccatattatcacaaaacattattgaatagaaacatttattttcccacagaatggtgataacttttgggaagagaagacaaaatcatgtttaatatattttcctatggagaattctaaactcaaactctctagggaccctttctaagcatttataatatttctgcatttgggatttatttctgctttaaaatgtgtttgggtcaggtgcagtggctcacacctgtaatcccagcactttgaggggcccaggtgggcggatcacttgagaccaggagtcgagaccagcctgcccaacatggcgaaaccctgtctctgataaaaatacaaaaattagccaggcgtggtgctgggcacctgtgggaggctgagagaggagaatcacttgaacccaggacgtggaggttacagtgagccaagatggcgccactgcactccagcctgggcgacagagtgagactccgtctcaaaaaaaaaaaaaacaatgcttagtggaaaggaccatttcttttctatttcactattgagctttaaaattatgtatatgtattaattgattgaagctgatgactggaccatcgttggtaataataaatggctatgcttaccaaaaaggtttatatatagttcagatgatctaacctggtggcaagaaaagtaaattatatttattgtctgatgaatgttaccagtttgtgtagatccatggatggaagaaacagaccaaaaacaaacaaagaaacagaccaaaagttattggcatttaagtggcagtcaggatcagatagtttagataaattcgaagaagcacaaaatgtaacctggtttgcaaactttttactgccagtggagtaaagcagggctaggatttctttgataaagagctagcctttcttgtctgctctgattgcataccttggacagtgcctggaagtccacctagctgtctaaagggagtctgtctattttgacttcctaatcagataattaaatgtgaggcagttagagttatgtactagttgatctttctatatgtctctgtcaattcccgggatatggaaaaaatgattgccttttctttatggttagatgccgtgatctagcaattttgttaattttgaggtttttggagcattgcttggaagatgctattaagagacagatttgttccttgcagattgttagttgtaaatagtagtggaggttggaggttgaacttgatgacttctcaatatcctttcaaacctacaaattattttccagttcttcgtcctgtgattaaattttcttatcctaatgatcaaatttgtaatttaatatttgttgcaaattttactagtcttacactatatacacacacattgtatctaggaagtaggtttgttaactccatgtaatgaggaacatgagtgaacacattattgctaaattggctagagagttcttaaaacatgaatcatgaatcaagaattgcttgtttgttcagtgaatatttttttgtgtgaagtgctacctaattgttatggagattgtaatgtaagaggcacttttaaagatattcttcccttgagaatagtaagactatattataaattgctcttattgaaatagtgaatagcattctgtcttcttgcttattttaatggtcttagaaatggttctttctacatgcagttttcatcaagtaaaatattttgcaactttatttatattcatttacttattcgttaatttgtgaaacatgtaaatgctacatgtttacatcttaaggagtatgaaattaacattttataattgcaaaatttagaatttcattaagaactcatggatgagaacaatattttgttttatttttttagagacagggtctcactctgtggcccagactggagtgcagtggtgcaatcatcgattactataacctccaactcctgggctcaagcaatcctcctgcctcatcctcccaagtagctggggctatagtcacaggccaccacacctggctgatttttcaattttttgtagaaacggggtcttgtacgttgcctgggctggtcttgaactgttggtctcaagtgatccttccaccttggtctcccaaagcactgggattacagatgtcagccaccgggcctacctaagaaaaatatttaaatttaatatcagtatctgtggggaattggttccaggaccccctgaggataccaaaatccatggatgctcaagttccttatataacatggtatagtatttgcatataacctatacgcatcttcccacaaacttttaatcctctctagattatttatgatacctaatacgatgtaaatgctatgtaaatagttgttatatggtattgtttagggaacaatgccaaggaaaaaagtctacatgttcagtagagacacaacttttcattttctttcctgaatatttttgatacgcggttggttgaatccactatgcagaacccacagatctggaggacctactataatttaatttaattctaaggtaagttaattctaatacctctctttctgctccattttataaataacagcccaaacctcatagtggataacgggagataatatcattgccagtttagctgtttgtgtaatctagacgcctttggagctattgcaatgagtatccacactaattccctttattaatttttttattaaggaaaaaagaggcacagtggaattctgaacaaaaggaaaagagatttgatgtgttgatagctgctatttgatgtgttgatagctgctacctttttgttctttcttaaaatactgctccctagcccgtgctgtggcatgcacctgtagtcccagctacttgggaggttgaagcgagaggatcaccaagagttccaggctgcagtgtgctatgattgtgatgtgaatagccactgtactccaacctgggcaacatagcaagatcccatctctaaaaaaacaaaacaacaacaaaagatagtgcttcctttgttggccaagggaagagataagaggagtactattttgtgtttcttgcaggctaaacttgttattaatgtgaaaacctcatttcctcttggaaacttcatcagtattcccaaggctgtttctttctaccttccctcctttcaccttctgctctgttccctattaacttctagctgtacttaattaacagagcagtgagtattcattagtctggtttatgatatagctgaaatacttaaaaggatgttatatagaagaggaattaggctttattgtatatggcagcagaaggaagaagtagaacaaatgggtagaaatggaagaattgctcaaagtatggaacgattttcttacaggaatattcaaaattaagattagctgctttatgacctatgtaggaatgctatagtaagatagtggactaactgacctctaggattgtttataacactgagattccaggactttatgattgtatatctaccaatttatctcatatatgtatatgtatatccttctttgtctttctcaactgttatctcagaggttatagtttatgtctgatatgctgtagctctctctaatgtatcggtatggattcatttttatttaaatattctcagtctttatcactgaagattttacctttattcctctctttttctttctcaccctcctattagatatattatagagctgctcattttgtcctccttttctctgaacttctctttattatttttcatctgcttattctttctttagctgcttaactagtacattgagggtttgttgttgttgttgttgttgttttggtgggggcagacagagttgcactgtgtcgcctgggctggagcgcagtggcataatcttggctcactgcaacctccgcctcccgggttcaggctcactgcaacctccacctcccgggttcaagtgattctcatgcctcagcctcctgagtagctgggattacaggcttgcatcaccacacctggctaacttttgtatttttagtagagacagggtttcaccgtgttggctaggctggtcttgaactcctggcctcaagtgatcacctgtgtctgcctcccaaagtgctgggattacaggcatgagccattgcacctggccctaactagtacattgagttattaatatcagtgttcatggtagttttttgtttcattttgttttggggcagggtcttgctctgtcaaccaggctggagtgcagtggcatgaatattaatactgttagtaacagcaatccaaaaaactataatccaaatgtccatcaacagcagaatgaaaaatacatttggtatacaatggaatatacatgcaagttgtagctatgcacaacaattgagaaaaatctcagaaacaacgttcagcaaaatcatataaaactaaatggtatcttatttaggactatactgacattcgtgttaaagttgtaaagacaagcaaaggaataaggaacaaaatacagtttagaaatcaccttagagggaaaaggaaggagatgggttaggttggactacccaggagactttaaaggcaggtaatgttcttattttagactgaatggtgttatataaatgtttgttgtgtcattctttttaccatatacatatttcccaaatgtcttttgtacctacccaatattaataaaaaacattttaaagaccttaaagagtttaagtagaatatattttgaaagcaaatgaatccaactataaccgaagtatcagtgtgatatcttctttgaagaaataaatttactgagtttggagttgactatttcaaataattattgaattttcatttgatttgttaatagtagtttttaaaagtttgaagcagcaattttgtttttagatgctaatatgatacatactgttcttttttgtttatagcagaaaatattacataaaagtattaaatttcaaacatattttaaaaattacagttctcaaatctcatctattcccacccctatttagaagctccatgatgacagttaagccctgtgctatcttctgtattgattgacatgacagcagtctgcagagttagcttgtgattatgtacagctcagggttactgtaggttgttctttgaaaataggacttcaagcaaagcatcttgtattccttttgcagaaatgttgctgaagtgctgctgaaagggccagagatgcaaggatttgggatacattttgaacctttaagctgtctgacattgacctcctttcattattaataaagaagaatcaggagcttaggatgtattaacaccaactcattaatatactaaccggacaatgttctacaaacaattctacattgtaaaggactggattggcacaaaataaaataattttattttattcagcttataatatgactcgatggaggaaaatttgataagcatgagagaagaccattcttttcatgttcgttacaggtaagactattgctgtcttaatggatgacttttaatccttattttaaagtgtttttaactctgatgaccatttcaagtttcagttgaaaatactcaaatataccagccatagtattgtctgtagacaatattttctttttgttgtaagttttcctttctgtaagaaaatgatagtagagaccaattatgtactatggtttgtttaatgttctctggaagagtttatgaataatttctttataatttgtaactttttatgtaatgcaaatatgtaaatgaaatatgtttgaaaatctttggggctaaaaggtggattttttaaaaatgtggtcagctgaaggaccaaacctttgcattgtaatttaatgtgatcttttagacatgaactttttatttttgatttatttttattttttgtagtgtattgttttgattcccttctcatttcctttttttgtatattttttattttattaattttactttttctatattatcagagatgggagtctcactatattgcccaggcaagtctcaaactcctgggctcaagcaatcctcctgcctcagcctccagagtagcaggaactacaggtgtgtgccactgcacctggctttttattttatctttaaaggaaattttatttcacaaccattattactgttttaaatatgtacctaatccacattaatataaatacattattattaaaatacaaacaagcgctgttcaaaagaaatgtcatttttaagcttaatgtctagtgacattttgtgttgttttgctgatttaatacttaagaccacatttttacatgaagtagtggtttggtaatccctaatttactccagaaagcaagtcaggctgaggaaaggcacccacatgcattctctcacaagcttcacggtccctagggaaatggcctggctcctctaggacttacagtgttcccttggatgcccaaatggattgtctacattcctggtagaaggttgcagattgtaaggaccagtgttcccacctttgttctgcatccacaagtgtctttcacaaatacaacacactccctttggctacaccttatatataataggttatgcacatgtatgtgtgttggtgggggtggatgcttcccactgatctagatcaggatccaaatcagacatacacatcaggaaaggagggaagatagccaggaagtgatagctgggcagaatgaaggtacagaatgggcaggtcttcctgatttttcagaagagcccaggaaatctgaaaatctgaagagtgtgtgtgtgtgtgtttttgtgtttttgtttttttttttttggagacagtctcactctgacgcccaggctggagtgcagtggcacgagtttggctcactgtaacctccgcctcccatgttaaagcgattctcttgtctcagcttcccgagtagctgggattataggcgtgtgtcaccacgcccagctaattttttgtatttttagtagatacagggttttgccatattgaccaggctggtcttgagctcctggcctcaagtgatatgcccgccttggcctcccaaagtgctgggattataggcatgagccaccaagcccggccggaaatctaaatctttattgtgctgtctccaaattctgaaatgttggcagctaatgcaaatttttttttaaaaatgtgggttgaacattttaaggaggagaaagaggcctgtaacagacacaactctctaaaaaaccacacaggcaggtgggggaggtagagctcaaggttttgagaaagctgctctccaggacgtaacatacacttaccctgggactccgaggcgctaaccctcctgcacctcgaggcccagagcaccaagtgcgatgtccccatctcctggccttgcccacctcattgccctccatatctcctcatcacaccttcgattccccaaaccccataggtttctctgcctcccagactttgccccttattccttggatggcctagaatgccattacctgccatcctcccaggcactgcctgttgcaagccaggctcccattctcattcctcactcctagagggttgcatacagaccttcctattgcacccttctagatgggctgcttaggtcagtgtcacccacagacaccatgcacccagtgacagtctgtgagagcatgcagcctacccccatccgtgtgtggagctcagccttcataaatgagcatcttgaaggaatgggtattaaataaagtcggaataggtgggtactttgtaaacatgataaccaatagccagtttaatatttagtgttaaatattaatgacatctctaatgcaattaggaacaaaacaaggctatctgcactatgattattaatattctgcaagttctggtaattgcactaaacgataaaataaatgcaaacttaaatattatcatcatttaataaggtgattagggaatatgtttttgtttttgtttttgttttgaaatggagtatcactctgtcacccaggctggagtgcagtggtgtgcaatctcagctcactgcaacctctgcctctcaggttcaagcagtgctcctgcctcagcctcctgagtagctgggactacaggcgtgtgccaccatgcccagctaacttttatatttttagtagagatggggttttgccatgttggccaggctggtctcgaactcctgacctcgggtgatccacccgcctcggcctcccaaagtgctgggattacaggcgtgagccactgcacttggcctttttttccccgttgagacagagtcttgttctgtttcccagactggagtgcagtggcatgatcacagctcactgcagcctcaacctctcaggctcaagcaatcctcccacctcagcttcctgagtagctgggactacagctatgcctggctaatttttaaaatctttttgtgaagatgcgatctcactctgttgcctaggctggtctcgaactcctgggctcaagcagtccacctacctcagcctcctcaagtgctgggattacaggaatgagctgccgtgcccagctggtaatagattctttatcaaaactgttacaagttaattattagatgaacatcagaatatagtagcaattaatagaattcaaaatctcaggagggtgtaccaaattttagatgtcttaacatatttaggaaatgggagatttatcatcctgtaaatagttcacgttaggaaggttcatgccaaggaagttaacataggtaagatgaggacatttctattaaaaaagagtttcaagtaaaataaaatggaagacatttaagataattaagatgagcttttaatatacgaaatgctgccatcctaccctttacataaatttccagaaacctgggaattatatacttttttcttttctcattctgtatccagcatgaagtattgctggtttcatctcctaaatgtttctcagattcatctactcatgtgcatcctcccagttgtttgaaaggcttgttccccggtgctgtaaagaaatagcacttgaacataaatttaatttatttagtaaggccatttttacttgctgcagaaggggtacactcatcagcagttttgcctcgagagtacactgaacaaaggagacagggtcatttataacctgatgtatccaccctactgctgtgtctggtttccattaactggaacgggacctcacattctgtatttgtcccgattggctagcaacttagaactttttaaaagaggcaaaggtagaggggaacaaaggaaggaggaagtaacttgtggaatgttgagaaagataaaaacacttttaaataaggaagaggaacaggctatgacctaatgcttgcttggaccagtgtaagcatgctagggcaaatacttaggctaaattgtgggagctaagaacataaggtacattgatttccttattaccgctagcagatatttaagaatgttaacacagttctttgaataaattttgcgtctaaggaataaatactatttattcctaattagatggggaggaaagtctttgaagaggaacctttactttactttttacaccgccatagctataattgagatcctcaggatcttctttccagactgcctccattcttcacctcttggaacccgtcgttttgacttgtcactagtgggctcaatctcaaaacacagagctaaccgtgcaacctctctgcttaatacctagggtggctcctagtcacccggccaagctgaacatagaacacaagatcttcattatctggcttctgcctattcctgggaccttacttcctgccattcttcaccttgcactttgagctctggtttcctgcatgtcatgctgttttatatttcagtgtctttgctcatgctatgccctatgttgaactcccttcccactttctttgtttagctaattctactctaagatacagctcggagattatctcctcctggaaaccatttctaagctccatagttaggctctgtggcctccgtgtgctcatattacaatctgtgcatttttctttcttagcaccaactgtattaaaattaagttaatctgtttttatggtgctcccttcctcctcacctctccctttgagcattagctcctcagctgtggtcactcctcagcagccatgataattagcatgttgtctggcacatattgaacttcaatggaatatgaacgtaataagatgtttatctgtcttgctaaatgttttgaatagtattgtgctttctaatatggtaagaacagtagataagtaggaatggcttgtacctctgcctgttggaagatcttagaattgtcctttttctgtgatacagtctagatcaaacatggttgcactttgctataggacttcaccaagggaaacttaaaaatctgtactgtctgtaataggactataccaaacaaatctctggctttatcagtgctctaagaccagcattctgtatattgattggattgtcgtataattgggggtaatgatttgaactctttatgttaggccataggctggtataagttattcttctgctatagtaaatccttatgaaatgttttatccatctggttcttccattgtggaggtcctcctctatccctggaggagtttctgtggcacaatgaatttgtaattttgaatggaatgtttcttggaacactaagtaacctcctaaggggacatcagaatgctttattgaaatattttgcacctatttcaaaaggtagagactgatagcaagtacaatttaagttaaaaaaaaattatatggttgatttttaaggaattattaattttttatgtgtgataatggtattgtgattgtattttttgaaaaagattaatcttttaaagatacatactaaggtatttacaaattaaatcatatgctttccggaatgtacttcagaccaatctggggttggaagagtaacgatcagagtagagatgaataaataatatattgattatatatgtgtaattattgacgttgaaagatggatacattgggtttgttacactagttcctctggttttgtgtttctttggaaaatgtcatttatacttcttactgtgaataataagcattttaatactttaatattgtaaaagttagattcttgcatgtaagttgtgaaggaatacagatatggtgttgaattctttaattttgttagctcaatgtagttgttaatgtgctttcttgagtagtttaaggtaacatggagtgatggaaagaccactggatttggagacaaagataaattttcatatctcaactttgacatcccatgaccttaagcaagtcatttaacctgtctcagcatcactttctccttctgtagcaatacctatcttagaaggttatttttattttattttatttgagatagggtctggctctgtcacccatgctggattgcagaggtgtgatcttagcttactgcaccctctgcctactgggctcaagctatcctcccacctcagcctcccgagtagctgggactactacaggtgcatgccaccacagccagctaattttttttttttttttttttggtggagatggggttttgccatgttgcccaggctggtctcgaactcctgggctcaagcgatccacccccccttagcctcccaagtgctgggattacaggtatgagccactgcacccagcctcagagggttattttgagaattaagtttgataaaggttaaaatcacttttaaaactaaattaccatacaaatttttgttttttaatcattttcttccttcttattctatattattaatcatctaaccatacaaatgtaaatcaattgagcactacttttccttttacataataaatgagaacagctagatatatgtggtaaattgaatggatgaaatttgtttattggggctagcactggtgatggaaaaggttcatgcccaattagaatacagagaaggtagagctaggatttatgaaagaagatcacacaaccacagaaatggaaagcataatagagaaaatggagagtagtcttattttgcctcttaagtcctgaattccatcatttattcttaaatagtatgtaagccctttgaagcaagagtcaaatctggacaaaattgatgttattaagtcttttagaaagatgtagcatcatggttttatgttttgcattcactgacgtcctgtgaacacgaaacaaatttaaggaggtaaagaggataatagtcaagtgcaaaatctagtgtggaagagaagttaaaaattaaaagaaaaattgaaatgacatgagtttgcacagaaaatgagaaattctagctaaaatgttcactctattagcaaaaatgaaaacacgtcagttaaggatagtagtactgtgtctatttgaagtttattagaaacatattttctttgattatacagctagataggctctcagaagcataaaggaaactttgtatgtgggatgaattttaatggaggggtatgttcttggtttttcttctacatgtgggtatgttctttgttttcaacccaactggtaaacaaaggaagtaattctattctctcatagtgacagagaggatatgaaattactttctctgttactatttaatgatcttctaaaaaatttataaaccaagctgccctattttgcaggcataaatctatatttgattcaggtgttagagatttttgccagaatattaacttattttctaataaaatacaccagagcctgaatctatctaagaattaatcataaactagagtgtttgggacattatttcaggtattagtcactggaataacttttctaagatagtctctcctgtagggcattctcactacatggacttcaaggacagccatgtagccagcaagcttccagtttgctagtattgtttcttatgacaattatgtaaaatgcctttttaaaaacgtgtaacacttacgatgccattcaatctatagctaagttttgtgggatgccacatcatttggatcaatggttccagtaaaatgttctgtaaacttaaatccagaagatcagtcatttgtggtgaagttatttatttgaagaagatacttctcagttttatatgaatattggcaaacacttttatacttccgatttttaaatgttgttcacatgaatagccagttctgccttattcctaatttcccggccagcaacccagtcatcctgaactgatggtgctgtcatgtgtgaccatttcctcacttccccctcagtgaaatgatgcgccatcattagtaatccattgtatagtggcgtgtaattttttttacccagtactctattggtggacatttaattcatttgtggtttttttgctgctgtgaatatcctttcatatgtatcttcttaaatttgtgtaagtataccttaagatcaattcttagcactgaaaatgcttgagatataatttttaacataatttagaatgcttaaattaaaaactttttgtaggaaaagaattattttacaaataaaaatatcttttccatttttttaaataatatttcttagaaattcattggtttcagtttttgacaaataaagacaaccagttcaggtacttcatctagcaaaataatcctttaataaaaatcacattttgactgggcacagtggctcacgcctgtaatcccagcactttgagaggctgaggcaggcggatctcctgaggtcaggagttggagaccagcctggccaacatgatgaaaccccatctctactaaaaatacaaaaattagctgggcacggtggtgcatgcctgtaatcccagctactcaagaggctgaggcagaagaattgcttgaacccaggaggcggaggttgcagtgagccattgcgctccagcctgggtgacagagtgagactccatctcaagaaaaaaaaaattacatttttatatatcttttgttgatttatttatctttatacatagaatatgacaataacttcataaaatcttaaacagatatactcaattttttcttttatgaaatatctcattttcagaaatacaattctaaagggcagttttcatttttggaaggcaaaaataggctttattaattgtgaagtgacatataaagaaacataaatatagctgtttaaggtttctgatttaactgcttatcttactatgtattttagatcttctctcctgtatctaattggcttgtagtctaatattgtagcaaaatgttggaggtttacctgcattattttgcatagatccataaagtgaagatggggccagccatggtggctcacacctgtaatcccagcactttgggaggccaagatgggtggattgcttgaggtcaggagattgagaccagcctggccaacatggcaaaaccctgtctctactaaaattacaaaaattagccaggcatgatggcacatgactgtaatcccagctgctcaggagactgaggcacgagaatcacttgaacccaggaggcagaggttgcagttagccaagattgtactgctgcactccagcctgagtgacagtgagagactgtgtctcaaaaaaaaagtgaagatgagcaagcagtagccattggctaagtcatttgaattcttaaaaaaaaaaaagatacctagatagaaaacttgaaaattacctattggaattggctacatatatctgcttgttctaaaccagaagtctgctttgaacctttacaattggctcagtttatctttgtccaggcttttagcttcatcaggtacattttctactttacaatcccattttaatttatggctctaaggacccttgaaattttgcagactgaaaaacagcactcacaaaaacatgttaattgatctaccactagatatacagagtataatcatatttgaatgatattagggtgggtggtggtttaattcacatttcttataaaagcactgattctcaaccctaacttgtactttagaattacctggggctttaaaaaaatacaggtggccagacatcacccagagggtggagttcagcgttgggagttttagaaagtgctccaggtgagctctgctgttgtacagccagcattaagaacaactgctctattggagtggctcaaagctcattctagtaaggagtaacttaatgctgttccaaaaattaaaacatttgatgagcttaatcagagcttctcaaagagtgatatgtatgccactggtggtacataaggtaactttactcacttttagattttaataatttcatatttgtttaatgtgtattagaacggggttcccaacccctgggccacagaccagtactgttgtagcctgttaggaggtaagctgcaggtgggcaggacgagtgagcattttcacctgagctccgcctcctgtcagatcagcagtaccattagattctcataggagtgcaaaccctattgtgaactgcacattcgagggatccagattgcacattccttatgagagtttaatgcctgatgatctgtcactgtctccagtcacacccagaggagaccatctagttgcaggaaaacaagctcagggctcccactgattgtacattatggtgaatgtatagtaacaagaggaataaagtacacaataaatgtaatgcacttgaatcatcccaaaacaatcccctgccacccgtccatggaaaaattgtcttccacaaaaccggcccctggtgccaaaaagattggagaccgttgtattagaatatacatataagtatcgtatcaaattcacagtttcatgagtactgctttggatgaagctccatttttttaaaatgataagttaaagatagtgtgccaatttaaaggaaatttgccaaattacagaaataattaaacgaataggtagttcctacatatggcagaaatcatgaagatgctgaagaaacacaatggcaactttggtgaagggcaccctctaaaatttaggatttgaatccaaagtatcagtgtttttttctcccagatatgtttacagtgacttaatccttctttttcaattcagggacagactttcaaaattagtatttctgcaaatttttgaatcattgttttctaacttagtttcttgacacctagttctcttgtgaaaatgtgtcttacagatcaagaatattttgttcctctatttttctagggtataagtggacatgtggtggtaagaagaggaaggagagtgagtgtgtgttgtgtgtgtatgagagagagagcgagggatggatggctggatggtcagaggggctgatgaacaggtgactagattacttggatacctgggtagagaacaatattaataattgtagggcctcactttcctacatactcatcttctcagactctaaggaagtccagaggtctgttacaactcagaattgtttgggaaatactgctttaggctctttcactagtaacgtggattgctctgggccaattaaaatgagctccacataaagatatttagctatcctgacctctctgagcaggctcagagaaattcgaataggcaaattacctcttgctacaaataactgcttactgttttatcaggaatgtatataaacttcagttatagaggcagctgccctgaacaagagtagccgcttaaattatattacgggaagttaaaaatactgtgatgcagctgtaatgttatgtttaaatgtctgtcctgtataattttgtagaatggaagcttcttgcctagagctggccttggaaggggaacgtctatgtaaatcaggagactgccgcgctggcgtgtcattctttgaagctgcagttcaagttggaactgaagacctaaaaacacttagcgctatttacagccagttgggcaatgcttatttctatttgcatgattatgccaaagcattagaatatcaccatcatgatttaacccttgcaaggtaattaatttaagcttttaaatattcttccttctgaaattagctattactttaaaaaatatttctattcaattaacaaaaactaacttaatacatttaatgagttctacttcagtaacatcgcttttcaaaactaacctttaggctgaacacagtttaattgaatgaatagtagtgaattgaccctagagtttaattaaatggatgaaaactaattacattcaaatccagaaatgtaagttttaaatatttatttaaagtaggtttcaaagccaatgggtttttcttaccttaagcatgtcagtttgtcctcttggaaaactgtactctggctactttatattttaacaccatttgtattttaataccatttggttttttgttttttgttttttgtttttttcaggactattggagaccagctgggggaagcgaaagctagtggtaatctgggaaacaccttaaaagttcttgggaattttgacgaagccatagtttgttgtcagcgacacctagatatttccagagagcttaatgacaaggtaataccgcagcattagatggtaggcctaatattttcattcaaagggctttgcattttaatactatttaattattctatagtttattttaaaattaataccaaaaaagaaaacatttatagactaatagaagtaaaagaaaaaaaatttaatggagaaaaagaaggaaatagtaagaggtctttcataagtaattatttgattggttctgtatggagagccaatataaaaatttttttcccttgtccgtaatactaaggatattacaaatatatatgataaacctgacctctgttttcaaaatgtaaactttgctgatgtcttcatttaggtgggagaagcaagagcactttacaatcttgggaatgtgtatcatgccaaagggaaaagttttggttgccctggtccccaggatgtaggagaatttccagaagaagtgagagatgctctgcaggcagccgtggatttttatgagtgagtaggggctgatatgggcagtcatgtaggcccatctaagccgtggatctgctgtacgttctttattcagtagtaagtttttaagtttggcaaagattttaaagttatgaactagcaaaatcatcaattcagttgcttaaatgttacagtgttatattagtagtaatctgcagctttcatttaagttgcagaccagtgccacttagtggcaaaagcaagaaatgtcaatggttggtctgttatttagagtaatttagtcttttaccaatagaatttcatagaactacttaactataggggttccaagattaactctgtgcttgaccctgggcagaaacctatctgaatagtttaataaagtgttcccagctatttcctataattgctcttcatcatagatgtcatccttaaaatgttgcacattatggctgtaagcttccctacatttttttctgataaaaagaattagatatgtaaatcacatacataaaattgttctgcaaacttattttttcatcactttttgcgatcccttagggaaaacctatcattagtgactgctttgggtgaccgagcggcacaaggacgtgcctttggaaatcttggaaacacacattacctccttggcaacttcagggatgcagttatagctcatgagcaggtacagtggaaagccttggagccagatcatttcctccatcaaagttctgaacagtgattagatcattcttcagttttattttatctacatctaattaaaattgtttgtttcagcgtctccttattgcaaaagaatttggagataaagcagctgaaagaagagcatatagcaaccttggaaatgcatatatatttcttggtgaatttgaaactgcctcggaatactacaagttagtctaatatttctgtagataaatgtaaaatgaatactcagtcccattaattcataggctttaggtttaaaatctgattgtagcagaacttttggcatctaagcctcaatttccttatctgtaacagaatatatcaatacttcattttggggaatgctgtgaggattgaatgaaataatatactaaacacagtatctggtacacagtgctcaataaatattattgtacataagatttaatagcagcagtatgacccctttataatattggtttttatctttaaaagtaattgtttttaaatgaagttttcaacctttaatatcttttaaacctgtttagcatatgtggtgtatattgtgtatatgctttatttcactcagttatgggttagaagagaggccaaaagaaagccttgtaacaaaaatatttatagtctataccagtgatcactgaatttttttctctaccttcccaccctcttattgagcagttctccctttaccctctttctgcctatatttgactgtcactgtaagctgagtcccccattcacttacctgaagcatttacaatcccagcttcttctgtggcaggatctctcttatcagtagatttgagacatagatgatagaaagtttagacagcttcaagttgcctgatctgtgctttctagattgagttttccctagttagtggggattgaagcctcttacagattttgggtagaaggcagtttgactaaaccgaagacacagtgattgatttgtattttgttaaagaagccaatatgagacagttctggataatttgtcatcttcataaaaaaggtaaaattgttttaggcctatctaaaaaaattaaatagcattccactttgctttaaacatcaactaatggttaatatttgttggttaggttagttagatatgaaatagcctcccaaataaaatatatcactgtgtactatgtgaaggagtatatattttgattttaaatataaaaatttcctatatttaaagccaagggatatagagaagtcttaattattaaatggtgtatctgtgttaaatactgaaaggttctattataaaatggatagtggctatttgactaaagaagcatgaatataaagtaatgaaacttagtttttttcctcccaataagcaggctagaactcagaactttatatatattccaagtcgttggttagaaatatttttagaactcttctttagattttttttttttttttttttttaaatacggagttttgctcttgtcgcccaggctggagtgcaatggcacaatcttggtgcactgcaacctcggcctccccggttcaagcgattctcctgcctcagcttctgagcagctgggattacaggtgtctgccaccacgcccagctaatttttgtatttttagtagagacggggtttcgccatgttggccaggctagtctgggactcctgacctcaagtgatccgcccacctcagcctcccaaagtgctgggattacaggcgtgaaccaccacacccagcctggaattgttatcagggccaaacaagaaggctaacaatgtagatccatatccttccggatacaaagcagtagtttggtaaacctatgttagtaattgaatttggttccagaaagatttctgatcatttacaaatcaactgtaccatcaaagaataatggtatgccagaaagcattatgccacaggatctgaaagcaattccaaaagtctttcaaaaatatttgaaaagacaggcaacattagaataagtaggtagcctcccaaggtgacagatttgaaggtatcatcattaaatatgtaactttagatttgtttgcttaaaaaaagctatcacgttaccgcatagtaatttgtcatatagttataagtgatatgaagtaattatactatttgacagaaataatgggagggtcatttaaattactgaatccaaaagcatctataggtttaagcactgataataacacattaacatttatacagcaactactatgcacaagatgctattctaagcactttatacatattaatttaatcctcacaaaaatccttcgagatatttcccccattttatataagaagagactggtatacagagagattgagtgactttgcccttagcttagtaattggcaaagttgggatttaaacccagtctagctccaagatctatgctcttaactgctacgctagcttctcactggcaataccacaggtagaatttgggtaatgtttggatgtagtattcagtatttttcatgagttggtgactaatgcccgatacataagaattttacctaagtggtgactaatagcctacacataagaattttacctaaatattttaaattttgacaatgcaaaggtgacggtatgattgaaaacagatgtcatgtggaaaaaagcctcttttagctattgccaatactaaagggaaagtttttttaaatgttaaagatattatgttaatctctagaacctcttgattttatgtttcaatactcctttactttgatgaattgttaggattctcaaatttattctaaaagtcttgaatcttctttctgtgtttcaaaaacgtcttttcattttgtctaaaagtaatggagaaagtacgggatatgaatattaggctctcagagatttaaagacagcagaaagcagcagagaggaaaaatgagagttttgttttgtgattcttaaagcccaaactgagaatgatcattatataagaattaatttcttcttgtaggaagacactactgttggcccgacagcttaaagaccgagctgtagaagcacagtcttgttacagtcttggaaatacatatactttacttcaagactatgaaaaggccattgattatcatctgaagcacttagcaattgctcaagagctgaatgataggtatgttttacgtctttttaccataactaaggtaaaatatagatgcattattgaatccctagaatttttcctttgtttcttttcctttgttttccttaaaatcccttttaaggaattttctttcagtgatatcctctgtatatcattgtatgaagggctagtctgtgatagaggattagtctggttccatatgcccttgacccaagatcaatgactaggtcccaaactcaattacctcttcagaagtcttcctggtgaaaccccgtatctactaaaaatacaaaaattagccgggtgtggtggcgcacgcttgtaatcccagctactcaggaggctgaggcaggagaatcgcttgaacccaggaggtggaggttgcagtgagctgagatcacgccactgcgctccagcctggcgacagagcaagactgcatctcaaaaaaaaaaaaaaaaaagttttcctaactacataagtgtgggaattgtggtgaacttagagataatgtccagtgtgaagggggcaactgctacccaactccaactaattgttgccagccaggaatgaaaatccgttatgtccacatcttcctgttttttaaagagaagctggaagtgctgagttttatatgaaatctgatttttaaatgttagtggctaattcagtttttttgttttactgtattaaaaaacattattttccagcatttagtctgtgatgtttgctttagaagatcgattttgtttttacctcagtatgagagagaacttttcgatgcagatgttcaaaatgaagtatgctacctcaagaggtagtgcgttctctctccctgctgctcaaacacacactgaataattacctggtagggctgttatagaaggaaaatagggtagtggaccagaatacctatccttgagatttattactttataatgtatttcatattttaaaagcatgttttctatgttgtaatacttgactgtgagtttagtattatgtgggtattcttttttttaatctgggtattctagtatgtctataatatcatgatagtatgttatttatatgaaagaccaaatcaatccaaagcattctttatccctttagttcctgctagatagcttttattctatacataggacctcttttcaaataactgcatgttcgctttgaataacgttttagaattggtgaaggaagagcatgttggagcttaggaaatgcatacacagcactaggaaatcatgatcaagcaatgcattttgctgaaaagcacttggaaatttcaagagaggtatgaaactaaaaaaaatgctgtctgtgctattgtaatttacaaattagaggttgggggagggaaccctatttctctagattgatcatgtggctgaataataaatttgattatatatcattctcttggcataagaaccccagaaagcattttgaggtacagatcacagttatgtttgtattggctttcatgtaggaagacaggaaagtaaggccgggcatggggaagtggaaggagagtactaaaatatgcccctactctacccgcatctctacatggagaagtagcatggtattgaaggaaaagcatggttcttagaattaaggactgcttcctgttgtagttctgccacttactggctatttgagcttggaaaccttttctgagcctcagtttctctcatctgcataatgggaataataatatctaccttgcaaagtgttataacgattagagctaatgtatattaaaagtgcctagcaaaatgtctggtgctggcttaataaacattattattatactatgggaataaaatattctaagaaaattttattcatataccaagttaatgtgtccaggataatctacattattacttagtatgattccagagaacaagagcaatctaatgtttagagaactaaagaattaaaagaatacaattagctgtcctattgtgatattttagaagcttgctttttctttctgtattctttaagacaactattaatggaaaaaaattttcattcattcatagtctcataattctaatataactattttcatttctctatattttcttctagttttaggttcactacatttacaaataatcttcaccattctttctctttaaatactactctaaaatataaatgtttgtgttgtaggttggggataaaagtggtgaactaacagcacgacttaatctctcagaccttcaaatggttcttggtctgagctacagcacaaataactccataatgtctgaaaatactgaaattgatagcagtttgaatggtaagtaataggacttttaaaacccaatttttttatcctcaatatttagattaaagttatttatcacaaatttggcatattcagagagaatatataacatgggaagttcaacttattacacttttttgctgtacacagctctgtttgtaaatatatattacaattatatattttgtatataatatatatataattataatatataatttataagtgtaaaacaatattttatagtttttaccatgaacttaggaatggtgatggtattgttcttttcttttgtaaaaatacatttaaattctctatctctaagctcattcaaaaatttgtaaatgtgaaggtgccaaaattttaaaatgttattgtttatcctttttatctcatatcgttttacgtatctgttttctgtttagttctttttcccccatttcatttccaaggtgaattttcttaggacttttttaaattcagaaaatctaagatactctctttatttttctttctttttttttggtggcaaaacctatctttaggacaccttccttaggtgccgatttgtttgacatttctatagcgaggaaatttgctataatgtctctttttgagtgaaagaaaatctacttttaaagaaataaaagggataagattaggatcacatttttaaatttcatcagtatgtgattctatatgagatcattttcctaagcttgagaaattctcagtctaaaaaaaactactgacaaatattttgaattttaaagtcagtgataaatctacctttactttttccaatttttttctttaaactcaggaaaagaaattagtggctagtcatctgatttagattttcaaagaacatttagtgaaaagttctgaagtgtgaaccgtataataatttgtgactgcgtgctttgtggttgaatgatgggctaagacgtttttctgtgctgaactttcaaataggttatgccgttaagagctctcatctttaaaaagcaaaaacaaacagtcgcttgtcttcatagacccttctagctgtagacctgttcctttgttcgctcttataacaaaacctgaaaagacactaatattcattgtctttacttccttgcctccctttctctcttcaacccattcccgttgggctttgccctcaccatgtctctgagacctccattttaccaaatatatcattcagttttcacatgtcagcttacttgatttttctcagcaatatttcctatagccaatcattcccttctgagaaaactttcttcatttggcctccaggattactctgcttttctggtttgccactctcgtctttattctcttctctcctcttcttcatctttcctctacgtttgtagtgctcagggttcagttcttggacctcttcttcctaccttctttccctccctattttccatctctctctccttccttcttactgattttatcctttttccttctattctgtgctttaagtcagtgcttccaatagaacttttctgtgatgataaaaacgttttacatctgccatccaatgtaaaagccactagctacatgtggctgttgatcactagaaatgtggctactacaagagggagtgaatttttaatattacttaactttggttaattaaaatgtagagagccgcatgtggctactggctattggacagcacagctctagataatctcatccagttacttggcttttatattgtctatatactgattattttcagatttatatttccagccaaaatttctctcatgagtttgagactcatttgtttaaaattttccattgtcatgccatatctaattggcatctaaaacttagcatgtccataatgttttctcctaaacatgttcttcctgtaccccaccctatctcaggaaatagtatcaccattcactcaactaatcaggccaaaaaactaggggtcatacttgttccctttctacttttatttatttattttattttattttatttttaaagacagaatctcactctgttgcccgagctggtctcgaactcttgtcctcaagagatcttcccacctcagcttctcaagtagctggccttgttccctttctttcactcacttctacatcaaacctatcagaaacctgccttcaaaatatatccctaatctctcctacagtgtactctgcaacaatcttagtataagctaccgacagctcccagcagagtcctagcctaccaatgatttctcttacttcgattctgcatctctcacacttacttttccacacaggagccagagtgcttttttttttttttttttctaaattaaaaaaatattttggccaggcacagtggctcacgcctgtaatccccaacacttcaggaggctgaggcaggtggatcacctgaggtcaggagttcgagaccagcctggccaacatggcaaaaccccatctctactaaaaatacaaaaattagccaggcacaggggcacagacctgtagtcccagctactcaggaggctgaggcaggagaatcgcttgaacctgggaggagggttttgagatggaatctcgctctgtcgcccaggctggagtgcagtgacggaactataggcacgacctcctaggctgaagtgatcctgccacctcagcctttcaaagtgctgggattacaggcatgaaccatcatgcctggcctcagagtgctcctttagaatatacgtcgttcctctgttcaaaacccttcagttagttcccatcacacctagaacggaatcctcagtcctcaccatggttgaaaggccctatgtaatctgaacctatctcttcagcctcttttcctgccactccacctcttgctcactctggctgtatgaagacaggtgttttttggtctcttttgttcattgccatctccccagtgtgaggagaaaggatttgtaagaaaacttgtctatttctggtgttggctcaaggtagaaaaaaggagccttcgctaaaaatcttaattcatgaattcataagcctccctacatactggtttggaatttgatttataccatctgcacagtctaagaaaccctaatccattaaagcacttttgggttagaggtgttcctagagacttagcagaagtaagaccaaatagtttctgggggaaaggcatccttgattccaggtcataagcgtttcacaacaaaaaaattaccaaatatgtaaagaaacaagccaagatagtaaggaaaaaaataacaaaattaggtcatcaagttcttcagatgttagaattatcagatatagaaaataaaatgactgtggttgaacgtttacagaagtaacaaggaaatgaaaacaagagaataacaaaaatgttaggtagactgaaaaaaaaagctaacatttattgagtgcttatgatatgccaggcactgatttaagtgctttacatgttttaactcatttaattgtaacaattctagtagttaagtttctgttatccttaatttacaggtggggaaatggaggcaagagaggttaggtaaatttcccagggttacctgtgtagtaagtggtagagatgggagttaagcttagtcactctggctccagaatccgtcttatgtgatagttatgtcttaatgtgatgttaacacacctcaataattgataaaaatcagtcaggagtcagacatcagtaataaagttgagatttgaccaacacaattaataggcttcatctaatgcaatattttgcaaactatgtgtctgacccattcatgagttataaaatgagtcttatgagttgcagttagcattaaaaatacacatacaggggccgggcgccatggctcacgcctgtaattccagcactttgggaggccaaggcgagcggatcatgaggtcaggagatcgagaccatcctggctaacgtggtgaaaccccgtctccactaaaaatacaaaaaattagccaggcgtggtggcaggcgcctgtagtcgcagctactcgggaggctgaggcaggagaatggcgtgaacctgggaggcggagcttgcagtgagccgagattgctccactgcactccagcctgggcaacagagcgagactctgtctcaaaaacaaaaacaaacaaaaaaaacacaggaggccaggcgcggtggctcacacctgtaatcccagcactttgggaagccgaggcacgtggatcacgaggtcaggagatcgagaccatcttggctaacacggtgaaaccgtgtctctactaaaaaattagctgggcgtggtggcgggcacctgtagtcccagctactcgggaggctgaggcagaagaatggcgtgaacctggggggcggagcttgcagtgagccgagatcgcgccactgcactccagccgacagagagagactccgtctcaaaacacacgtgcgcgcacacacacacagccgacagccagactccatctcaaaacacaaacacacacacgccggggcagtggctcatgcctgtaatcccagctcttgggaggatcacttgagcccaggagtttagaccgacttgggcacacagggagaccgccatctctccaaaaaattttttaattatccgtgcatggtggcatgagcctgtcatcccagctactcgggaagctgaggtgggaggatcacttaagcccaggagtttagaccgacctgggcacacagggagaccgccatctctccaaaaaatttttttaattagccatgcatggtagcatgagcctgtgatcccagctactcgggaagctgaggtgggaggatcacttgagcccaggaagtcgaagctgcagtaagccatgatcatgctgttgcactccagcctgggcaatagagaaaaaccaaaaaactacacacgtatgtgtatgtatgtatataaaactgttgtgtgaagattttgttgtatgtttgtgtatgttctaggtatatatgtgtattttttaatatggggtcacaccttaaaagtgaaaaccactgctttaatggaaatatattgacctaactggtcaatttccattatttttaagtattcatgaaacatttacagaaaactgacaataaagcaaatctcaacaaatttaaaaggatttgtatcacatctgtatcacacatgctctgagcacggtgcatttaatttagaaattaataagataatatataaaacattaatctgaaaacataacatttctcagtaacttacaggttgagaaagaaatcttaaagttagaaagtaacttaggactgaattataaaaatattgtttcaattttgtggcatgtgacttacattggtacttagagcaaaatttatgttgtatttaaaaaggaaaaagctggccaggcgcggtggctcacgcctgtaatcctagcactttgggaggcccaggcgagtggatcacaaggtcaagagatcaagaccatcctggccaacatggtgaaaccctgtctctactaaaaatacaaaaattagctgggcgtggtggcatgcacctgtagtcccagttactcaggagactgacacgggagaattgcttaaacccaggaggcggaggctgcagtgagccgagatcacaccactgcactccagcctggcgacagagcaagacgccatctccaaaaaaaaaaaaaaaaaaaaaaaaaggaaaaaggctgaaagcttaataccatctagcttaaaaagtaaaacaaacaaacaaaaaaaaacactgaaagaaggcaaaaattaaaaagcagaatttaataaaattaaaacagtgttttctttaagtcaaaatttggttccaaattgtttagtttaattttgactaagtctacagaaagagggcataataaatatgcagagattaaaaagagattctgaataacgttatgacaaaatatttgaaaatctaggagaaatgggcaatttctggaaaaacaagttaccaaaactgttccaatggtaaaatgtaatgtgaatggcatgctaatggctaaaattataaagaaattcgagcagtaatttaaaatcttcccactaggaaaatacctggcctagatgattgtacaagtgaggtaaaccagccacttaagaaaactaattataataccttacacaaaaattttataggcaactgaataagtggacatacttttatcaatctttctgagaaccataaccttgatatccaaactagacaagaacaatacaagaaaagtaaattaccggccagccttacttgtgaacataagatataaaaatctttacaaaatattagcaaagcaaatccagtaatgtattttaaaacaaacggggagccgggcgcagtggctcacccctgtaatcccagcactttgggaggctgaggcgggcggatcatgaggtcaggagttcgagaccagcctgaccaacgtggtgaaaccccgtctctaccaaaaatacaaaaattagccaggggtggtggtgtgtgcctggaatcccagctactcaggaggctgaggcaggagaatcacttgaacctaggaggcagaggttgcagtgagccgagatagcaccactgcactccagcctgggcgacagagagagactccgtctcaaaaaaaaaaaaaattcaagtggattcaacattagaaaatcaattaatgtaattcactaatgaacatagtaaagagaaaatcacccaaatatccaaatctattaaatctatttcatatagaactaatgaaatagttctatttcattagaactattaaatgaaaatattccatttataagacacagtagcagattggagaaagaataaaatccaactacacactacttgcaagagaaatatctaatataaggatataataaacctgaaagtaaaagaatagaagattcatcatgcaaaaactaaccaaaagacagtcagtatagctatgttaatagataaaatgtactttaaggcaaagggtcttactagaaatgaagaaggtcggctgagtgtggtaggtcacgcctgtaatcccagcactttgggatgccgaggctggtggatcacttgagatcagaagttcaagatcagcctggccaacatggtgagaccccgtctctactaaaaatacagacattagctgggggtggtgcagggccctgtaatcccatctactcaggaggctgaggtggaagaatgtcttgaacccaggaggtggaggttgcagtgagccgagatcacgccactgcactctagcctgggcaacacagcgaaactccatctcagaaaaacaaaaacacaagcaaacaaacaaaaaccaaagtaaatgaagaaggtcactttacggtggtacttaccagtgattaacagttcaattcaccaggaagatgaatgcattaaatgtgtctgggcttaataggtgtttataacaaggcctcaacgtacataaagcaaaattgaccaaagaaataggaaaatctacaatcataacgggaaattttaatacatatctcttagtaattgatgggtgataaaccatactcaagtgggaagacaattttttttttttttttttttttttaaagacaggctcttactctgtcaccaggcggaactgcagtggagtcatctcagcttactgcagcctctacctcccaggctcaagcaatctgcccacctcagcctcctgagtagctgggactataaggcacatgccaccatgtctggctgatttttatatttttttgcagatatggggttttgccatgttgcccaggctagtctcgaacttatgagttcaagggatctgcccacctcagtctcccaaagtgctgggattacaggcatgcaccaccgtgcccggctgacaaaattttataaaagatttcagttcttctcaaattgataaaaattaagtgcactgccaaacacatcacaattattttgtggaacttcatgaagttattcataagtttatatgaaacaaaaaagttctgagaaataccaaaacattcctaagaatatgaaaagtgctttctttacagatataagtaataagacagtgtgctgttggcataaagacaaatagaccagtggaatcgagtagagagcctatattcctcacatatatggaaaataatctcacataaaaatgaattattgatggattaaggatttcaatgtgaaagacagatttagagcagtaatagtgatgatgcaggagaggtgcagtggctcacacctgtaatcccagcactttgggaggttgaggcaggaggatcgcttgcatccagcagtcaagaccagcctgggcaacataggacccctgtctgtataaaaaaaaaaaaaaaaaatggacatggtgttgcatgcctatagccccagctacttggtaggctgaggtgggaggatcgctttgagcccaagaggtcacctaagctgcagtgagctgtgattgcgccactgcactccagcctgggcaacagagcaagacctcttctcaaaaaaagagatcgggggccggccaggcatggtggctcacacaagtaatcccaacactttgggagttgaggtgggcagatcacttgaggtcaggagttcgagaccagcctggccaacatggtgaaaccctgtctctactttaaaaaaaaaaaagggtgggggggacacggggcggggggcaaaagtgatgaacagtacacaaatagcccataaatatatgagaagatatttaacttcatctcatcagcaaacatcacagtggagtactggtagaaacttatgaggtaaacaaaaattactaccagtattcaaatgatgcagggtaatggaaactcttgtgtggtattgatgggatagaaattggtataccctgaagtacaatccagcaacattctggtgaagttaaagatgcgccaactggatgatccagctgtttcactcctgttgtgctcccagttatatactgctgatacccaccaaactagaagaaatgcttgttcatgtacactgagagacgtttccaagaatatctgtagtgtgcttatcatagcaaaaaaattggaagcaacccaaatatctgtcactaataaaatggatgatttcctagtccactctacagtctgttatttttgagactgtgtggatagtataaaccagttattataaaaaagcctttgccaaaaacagcaatgaaaatgaattaaggtatacatggcaacttggatgaatctcacaaacataaggtttctcaaagatggttgcagaatacatacagtatgataccatttataaatgtttcaaaaccaatatagctctaaaaccaatatagtttcaaaagcaatatagcacatgctgtattgctaagaaatacatacatttgtaatgaaaatgcataaaagcgcagggaagacaagggaaattatgaggggagttatacaaggggagtttaatgtgtttgtaatgtttctttttttaagctgggtattaggtatttcttatgccttttaaaatattgcctaatattttaaaacattgaatggatatggaaattctctgtatttaataactttattgaaaaaagtttaaggactcgtttacttgttttctgactggcagtaagtctgtcatctaatgagatcttaaaatagaaaggggtaacctagaaaagagtaacagcatagtagtggggatgctattttgattcttttcacgcaattgaaggcctacagccttttccttctgttataaggaataaactgctctacagattgttatttttgaaactgtgtggatagtataaaaccagttgttataaaatgcctttttcaaattaaggggtaatgtagtaaccagtgttagtttccaaccaaaatgtaacttccttacatcaaagcattttagaggggaatgtatattctatttttgtgtagctggtatagaaaattattattcttggaagaatacatatttgtacaggttttctcgtttcatatgggtttgtgtatcagattttagaactgaataatgtaatgatgctgaacttgtactcttaagggctccctggtttatttgaattaattttttttaaacaaaggtgtacgccccaagttgggacgccggcatagtatggaaaatatggaacttatgaagttaacaccagaaaaggtgggtggcaggttttatgttttaaatttcatgaactattataaaatgttttagtaatttttaatttaatgaaataatttaaataaggcttgccctatataggtatcactttaaaatttgcctgtaaaaaaaaagtcagaaaaagtatagtgcaaaaagaatgagtaccgtatgctgccatctgtttaagaaaaatacatgcatatatttcctttgtagattcctaaaacattctggaataagatataagaaacgggctaacaatgatttcttctgggaagaggactgagtgtctgggttaggctagaaatactttatataccagtttgaactgtttgaatcatttactatgcaaatgtattacttttaattaatagaagatcaggaagatcaaaaggacaagcttttttccccaactacatagcaacattattgccaagataaatgaaatttatgatcaagaggagagttgtttttctggctgcattcttgaaaagcatttttttttaacaagtactttgtattgaagatacatcttccctaggctttttcttgcaggagaggggtgcacagtaaaagggaagggacttcataattagaaacaggttattgaagaaaacatcaaggctacttttttccgtttcctttgaactgaataattacattgtcaaaataggctctcggccgggcacggtggctcgcgcctgtaatcccagcactttgggaggccgaggtgggtggatcacgaggtcaggagatcgagaccatcctggccaacatggtgaaaccctgtctttactaaaaatacaaaaattagctgggtgtggtggtgtccgcctatagtcccagctactcgggaggctgaggcaggagaatcgcttgaacctgggaggcggaggttgcagtgagctgagatcgcgccactgtactccagcctggcaacagagcgagacttgtctcaaaaaaaaaaaaaaaaaaataggttctcattcttttatgtatatttttatttcttttttttcttttttgttttttttgagacggagtctcgctctttggccaggctggagtgcagtggcgcgatctcagctcactgcaccctccacctcccaggttcatgcgattctcctgcctcagcctcccgggtagctgggactgcaggcgggcaccaccacacccagctaatgtttgtatttttagtaaagacagggtttcaccgtgttggccacgatggtctcgatctcctgacctcgtgttccgcccacctctgcctcccaaagtgctgggattacaggcgtgagccactgctcctggcctttctttattttacttattttatttagccactgtggtatatttttaaaaatgcttttataaaataccttcattacagcaactttagaaaatctgaacacagaaatcaagataatcagtaattctgcctcctgatggtaactgcagttattttggcatctattcatctggcattttcatatggatattatagacactattttctaatatgtggtgatctatcaagaacatctttccagctggacgcagtggctcatgcctgtaatcccagcactttgggaggctgaggcaggcagatcacttgaaccccagagtttgagaccagcctgggcaacatggcaaaaacctgtctatacaaaaaaaaaaaaaaaagatagaaaaattagctgggcctggtgtcacatgccatgcctgtagtcccagctacctgggaggctgaggcaggagtatcgtttgagcctgggatgcagaggttgcaataagccatgattgtggcactgcactctagcctgggtgacagagtgagaccctgtctctgaaaaaaaaaaaagaaaaaggaacatctttccatgtcattaaatattcttctgccctatcattataacaataacatatgatttttcaatagtgatagtttatgtgtgaatagtcttcaaaaaaccaaaatctaattgtgtgagaatcatatccaaaatatttttattccagccattcacagagttatttggaaactctagtaatttttaaaggactttgtgattttcccaaatgtccagctcttctctgtgagtggttctcaaatataaatttgttaaatccacaaattatttttaaaagcttttaaaaaggccatttttgtctactttcttcttttaggaacatactaataagtagcaaaattaatttgctttcttctgcctacctatgtagtggtactaacagtgttatgtaagaagctgaccagattcaaccttgtaattctccaagagccaagtgataaaattctatccttaatgtaaaatatgtttaagtgtaattagttctttgtattggtttcttttcctcataataaagctgtcaaagaattcattatttcattattctcaacatagtaaagaagcatacataaggaaaaagggagacttctaggttaagaggcttcctgggagagtgtgcagtgggagggaacttttgagacttggatgcctgaacttggatatgtgaaaatgtctttactaacctcacatttgataattttgctgactttagaattcttggttagaaataatttttcttcacagtttttaagacattgcttcgccctgtattcttgttttcagtattgttgagaagttcaaataaatatataaggaacatttttaatttttcttcttgggttttgggtgcagttttatgttctcacatcaaggaccattttccttttctctaaacaatagaccacgaaatccactgtagtaaataatttccccttataacctgtatgtgaaaaggaatcgatggcttggttcacttactagctacatgttttaaaaacagcaacaaggccgggcgcagtggctcacgcctgtaatctcagcactttgggaggccgaggcgggtggatcacgaggtcaagagatcgagaccatcctggccaacatggtgaaaccccgtctctactaaaaatacaaaaaattagccgggcatggtggtgggcacctgtagtctcagctactcaggaggctgaggcaggagaatcatttgaacctgggaggcggaggttgcagtgagccgagatcgtgccactgcactccagcctggcaacagagtgagactccgtctcaaaaaaatttaaaaaaagcaacaaatgtatacacacacacacacacatatatatatatatatatatatatatatatatatatatatatatatatatatataaatgagttctcactatgttgtccaggctcaagcaatcctcaaattcctgggctcaagcaatccttgtgcctcagcctcctgagtagctgggattacaagtgtgagccaccatccctagctacatgtctcactcccctgtacatttatttcaatttgtgtctcatggggcacttttctggattggtggaaatgttctttgtattgattggagtagggtttatatggcttccaatcatagacttaaaatctgtgcatttgactgtaattttacctacgaaaaaatgtgtgtcactaaaattattacatagcatgaacctttagacttacttgtaaacatttaagactgaatgttaaagctgcaaatgtcagagctattgtatgtagtgcatatttttccactgtactcaataaatgttattttgttatttgtaggctgtcatgtatttaaaccagatctagacctttataaattggtttcgcctattgagaatttagtatggtattagtaaaaacagtaccgttttattttttaaaattactatgttttatatattaatttttatgtttaaaaattctacatacatccaaaaattccagttgtaacagatttttaagtaactcacgtctagagtaaaactttggctccttctctgaccattcatattttatttttacagagttttggtaaaccttgctttcttattcgtaggttcttaaaaaccagcattttaatgttttgataatgagaatccacagtatgcatttggtacaagtcttgaaaatagtgcaatatactaaaaaggatatttttaaagagatctaaaattcttcctctctcccccaatagtaaataagtgagtacgtcaggttaatattatgggaaaccagaagagagctggggatttgggggtgtttattcacctgccttccatttataattttgtaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagagggtacgtttaaactaagtttttgagtattgtgttttgagtaccgacatttgggttttcttgtattcatgctgaatttttagtaatttaaattagacatttaatataaaatatctttgtattcatatttccctatcttttctatcttcttcaaaattagaaatggtaattactgtcttagtagataagttgcttccttgtattggacagtaattatttctttttcttttttttttctcgagatggaatcttgctctgtcacccaggctggagttcagtggcgcaatctcagctcactgtgacctctgcctcccgggttcaagcgattctcctgcctcagcctcccgagtagctgcgattacaggtgcacaccaccatgcccggctaatttttgtattttcagtagagacggggtttcaccacgttggccaggctggtgtcaaactcctgaactcaaatgatttgcctgccttggcctcccaaagtgctgggattacaggtgtgaggcactgcgcctggccaataattatttatttgagtcactattgtttgcaaaaatactaccagttatttcactgcattgtctcccagtaaaaccaccctctactcagctcagaaggcagaacaaattaaattcagatgctcaaggatttctaaatattaatttagaatgaaaagtgtctgttagcatctacttgtattaatcacattattgaaactacaatgatagaattacaaacttttgatgaaaaatgagcctgggcaacatggtgaaactctgtctctaccaaaaaataaaaagttagccaggtatggtggtatatgcctatggtcccagagcctaggaggtggaggttgcagtgagctgagatcatgccactacactccagcctgggcaacagagcaagaccctgtctcaaaaaaaagagaaaaatgatcataacaatcagtttatttaatttatttagaaataaaaataccgtgggtttactgataatcagtatcagggaaatctcgaatccagctaccccataatctggtaaaaggatcaaagtacattacaaagaaggtacttcatattatcaaatccatttatctgccgggtgcagtggctcatgcctgtaatcccagcactttgggaggcaaaggtgggtagatctcctgaatttaggagtttgaaatcagcctagccaatgtggtaaaaccctgtctctaccaaaaatacaaaaaataacctgggtgtggtggcacacacctgtggtcccagctactcaggagactggggtgggaggactgcttgagcctgggaggcagaggttgcagtgagctgagattgcgccactgcactccaacctgggtgacagagtgagaccccatctcaaaaaaaataaaataaaattggctgggcgcagtggctcatacctgtaatcccagcacttcgggaggccaaggcaggcggatcacttgaagtcaggagttcaagaccaacctggccaacatagcgaaaccccgtatctactaaaaatacaaaaattagctgggcgtgttggcacatgcctgtaattccagctactcgggaggctgaggcaggagaattgcttcaacctgggaggtggaggttgcagcgagccgagatcgcgccactgtactccagcctgggtgacagagtgagactctgtcttaaaaagagtaaaataaataaaatccatttttccagcaatgagagcctttgcaaaaaaaaagccttttttttttaaattagagatttcttttgtcagcatttcatttatacctacacctttgtgtagtatcttttgtctcgatttctttccccccagtctgtggtattgttatagaatgcctcgatttttatcagtggtttcttacatagcttttctggggtagctatgactaataaaaggaaaaattatggggtatatagaaattcagggatatttttgtaggtctagagcaggactggaattcaaggaagccatgcctttgttcaaggtttggggtcttaactaagctcacttagctcaactgaaaatgcccatactttaggagccatatgtgttttcacattcagagttttgaattctaggcttttttgcccctaggaaaaagtcttttgttggtaattaacacatttgactgtagcttatgtatgtatcattcccaaatctcaaattcaacacgttaaaaacgtctctcagtcactcctgttttccttatcccagttaaagggataccatttactctgtccctaagccaggaaccccggtgtcatgcaagataccctctttcactaaccacatcaaatccactgtgtccctcagatctgctctcaccctcacccctttccaaaaatatctgctaccccagcacattgggaggccaaagcagacaggtcacctgaggtcaggagtttgagaccagcttggccaacacggcgaaaccctgactgtataaaaaatacaaaaattagccaggtgtggtggcacgcacctgtagtcccagctactcaggaggctgaggcaggagaattgcttgaacctgggaggcagaggttgcagtgagtcaagatcataccactgcacttcagcctggatgacagagcgagactcctcaaaaaaaaaaaaaaatctgctaccatgtcttagcctagtacttactctcttacctaggcttcaataggtacctgaactgatgtccctgccttcatttattatctctaaacaaaactgcttaaaattgactattgccagtgctcatcttatttcacataggataaagtctacatttgttagtattgaatacaaaggcctcttccctcctctatagctacccctgcccttcagttcataatcagttgaatactaaaaactttttggattgcatattaaccagtatgaaacatctctcacctccaaatgcttattcattcttaaggagccaacacaaatacatgctatgaaattttccctatttctcctaaaaattagttcctctctcctcctcaggcccgtaacatttttgtatatgtgcctctattataatatatcattatgaaaaaattaaaataattacttgtattaaacattatattcatcatttcagttttgaagccttccaaatgaagtataaatatagttcttgctctcctcacaaatatttttttgaagtttgtattttttcaggatcttcaaatctaagtataaaaaaaagaccttagaaatcactatggtaggaaaatacacttgttttctttcttagctcttacaaagagataagtgtacctaaattccactgcagaatgtttagaactgaatgtagagcctgaagtacaggcctgtatcaccagtgtttgcataattcagtatctgtagtggttctgttaagtctgtttctttagccttagaaatacaggaattaaaaaatgaagtgctttttgttggattaaaataacattttattaccaatatttgccatcttgtattctttttcaaaatgtcaatttttaatcctcatcctttaccttttgcatttgaatgcatcatgatgttcattgatgatctaaagataatactggaatattcaaataaactagacttcctctcaatattttagaaaatcagtgcagatactattggagatgaagggttctttgacttattaagccgatttcaaagcaataggatggatgatcagagatgttgcttacaagaaaagaactgccatacagcttcaacaacaacttcttccactccccctaaaatgatgctaaaaagtaagtcatctctgtttctcccccgattttaatagttctctttgatattcttgtggcttatttctgagaattgaattcccatcataagagatataataaatgagcctgaattcaggtatatctgaaatgctgttatttatacagttcaaacaaggttttttcagttcccttacgtatatctgtgtttttagtccaatgtgctttctactaactatattatactacctccctagttttctttgaaaaatctgttgtggaaaatgtgactgtgagccaggtgtggtggtgcatgcctgtaatctcagctacttgggaggctgaagtgggaggatcgcttgaggtcaggagtttgagactatagtgtgcaatgatcgcgtttgtgaatagccactgcactccagcatgggcaacatagttagaccctatgtctaaaaaatatataaaaataaaatctgattttattaatttatttgagacgagatcttgctgttagccaagctggagtgccaggccatgatcgtagtcagtgcagccttgtcctctactcttgggctcaagtgatcctcctacctcagcctcccaagtaactgggactacaggcacacaccaccatgcctggctaattatttttattttttgtggagatgaggtcttgctgtgttgtccaggctggtcttgagctcctggcctcaagtgatcctcctgccttagcctcccaaagtgctggtattccaggcatgagctactgtgcccagcctaaatataacttttaaaaataaaaatgaggaagaaaggtcgttatacataccttatgattatatataaaacgtcaatgcttcatatctggattaaaaaagaaaaacgaagacagactgaagagaaacatatggctaaggctgaggctaaggcctggctgagttagaaaggactaaaataggttacttatatttttctatttcagctaccaaaagacttcttgtaccatagaccaagacttgccagcagcacttaactgttagtttactaaatgatttgtatccagggcttggaataaaaaacactgtcctacacaacctggtctgagaaattatgtaagaaaaacagtttgttcaatttctgaaatctagtcacatatcttatagttacattttgagtgagcattaaatagagaaatatagtcaaatctgaataacgtccaagtgggtcatctgaagtactctggggctcattcttccctccagccaataaaaaccacacccatctagccaaagcccatcagtgtcagcgctatagcaggagggcagggcgggtcttgggactggcaaggccgaaaagatctaggtatataataaatgtgcctaggtttttttgttttttgttttttgtttttttttaatctttggctttcttcttctgttcttagcatcatctgttcctgtggtatcccccaacacggatgagtttttagatcttcttgccagctcacagagtcgccgtctggatgaccagagggctagtttcagtaatttgccagggcttcgtctaacacaaaacagccagtcggtacttagccacctgatgactaatgacaacaaagaggctgatgaagatttctttgacatccttgtaaaatgtcaagtatgtctgtatatttttttcgttctgcatacagctcagataccactgaaaacattggtagtgttataattctcattcaggaagggcttattttgtattagagagttattattgtccatcattcagtaaaaaattattgaacaccgattatgtttcagctgctattctaggcatcgaggacacacttgatttttaaaggatcttacattttaggagagacgtgtgtgtgtgtgtatatatatagagagagagtatatgtgtgttgtattaggtaattatgcttgctatgaagaactttaaaggaggataaaggggtagtgggtaagcaaaggtgttggtggtagggggagtgtctgttttaggtagggtggttagagaagacctttctggattgtcatttgaacagagacctgaatgcagtgaagcagtcagccatgtgagtatctagagaaagagtattccatgcagagacagcaagtcccctcttggatataaaagcttagccagttcaaggagtggcagatgtgactggcatgggatgagtaggggaagggaagagttgtacaaaatgaggatggagaagtaatcagggcctagatcatctaggcttttggaggccatgataaagtcgtgttttagatgtattaggaaggtactgggagtgtcctcaaagaggatcctggctactgatggaagaacgtagagtggcaagggtgttagtatgaaaaccagctagaaagattgtatggtgatgcaggcaaaaaatattggtgatatggactagagtggtaacagtgagaagtagttagcatagggctacattattagctattatatcagttatatattatggttagttggcaggacctcttaataaattgagtagagggtttcagggaaagagaatcaaggatgacttataccttgaataactgggaaatgaatggttctattcactgaaatggagatgactagaagaaaagcaagtttggagagaaaaagcaagagttctgttttagacatgttaaatttggtaaactgttagccagttcaaggaatggcaagtgtgactggtatagacaatgaagtagaggtgttaaataggcaatttgatgtaaaatctggagcccaagggagaagtaaatttgggagacatcagcttatagctggtattaaagccctgggaagaaagtacctaaagaataggacaggaagactaagccctgagcatttcaaaatctactggttagatggaggaagatgagctggcaaagaagcaacagccagagagttggaaggataccccaagggtgggctggggaggggtggggtgtggtgtggtggaaatcaagtaaagagtgtatcttaagcagtgctcaactgtggcaaatgttgctaagaacctgagtcagatgatgacggaactactagatttgataacatggagattatgaataattttgaaagatactgttccagtggcatggtggggacaaaggattgagtggggtgagaaaatgggaagtgtgaaaggggagatagtaaatatagaaactttaatgggttaaatggaccattagctagaaaataaatacaaggcaaatgtggggtttttttttttctttttgggggtgaaaacgtagtttatctacagatggaaatggtcaagtagagaagagtcagtgatgtaggtaagtctggggtaactgaagaacacagtttttgtgtaggtgagagagggaaagcagagtacggatttggagatgggagcaagtaggaattctctcgggctgcttttattttctcaccaaagaaagaagtagtcatcagttaagattggagttggggagcactataaatttgaagagaaaggaagtgggaaatagttgacttagagaaactgaaactagggggaaagtattaagaacactgtgctgtgctaagaacccacctgaggttcagtcactggaagtaaaactagtgagtgcaattgtgtattttatccagtcatggccagctgcttgaggcacagagataaatcaagactgctatttttccaggagaatgggattcaggggagagaatggtagttgaagacatgtgccaggaagtgattttaataatggacttaagaatctaggctgtaagaaggaaaataaagaaatgaacacttcataactcattctgtgaggccagtattgccaataccaaagccagacagacactacaagaaaagtactgaccaatatccttcatgaatccagatgcaaaatcaacaaaagcctacaatccaaatttagcagcgcccctgctgtaaaggattttacaccatgaccaagtgggacttattcccaggacgcaaggactgattgttcaacatgtgaaaatcaatcagtgtaacacataatataaacagaataaagggaaaaaacacatacaggaaaaaaatgacaattcaaaactctttcatgataaaaacttaaaaattagcaacagtaggaaactaccagaacataataaaagccatatatgaaacatgtaccgctgacatcatactcaatggtgacagactgaaagctctcctccaagatcaggaacgagatcagaatgcaggtttttgccacttctattcaatgtagtactagaaattctagctggagcaattaggcaaaaaaagaaaaaaaggcattcacattggaaaggacaaagtatcaataaaattgacagaggtaatcaacaagttcaacaaagtagcatgatacaaaatcaacacaaaaatcagttgtgtgtttatacactaacaatgaacaattggaaaagaaatttaaaattccatttaaaatagcatcaaaaagaataaaatacttagaaattaatcactgaggcaaagacttgtataatgaaaaccacaaaacattgctgaaagagatgaaagaaaacaaatggaacaatatcccatgttcatggattagaagacttaataatgttaacatttcgatactatccaaagtgacctacaaattcagtgcaatccctgtaaaaatccaaatgactttttcctcctacagaaatagaaaatatagcctaaaattcatatagaacctcaagggatccccaaatatccgaaatagtcttgagaataaagctttagggctcacatttttttatttcaggttattacaaagctacattaatcaaagcagtgcagtactggcataaaagacagacatatagaccaatggaatagaatacagatcccagaaataaacccttgcatgtgtggtcaaataatatgcaacaggggtgccaagaccattcagtgggggaaaagacagttttatcaacaaatggttctgggtaaactagagagccacatacaaaaagaatgaagttggacccttacctaataccatatgcaaaactcaaagtgggccaaagacctaagcatcagaactaaaactataaaactcaagaggagcatgtggtggcttatacctgtaatcccagcactttgggaggccaaggtgggaggattgcttgagcccaggagttcaagactagactgggcagcatagtgagaccccatctctataaaaaaatttttttaaattaatggcacacacctgtagtcccagctacacaggaggctgaggtgggaggatcacttgagcctaggagttcaaggctgcagtgagccatgatcacgtcactgtgctccagcttaggccacagagtgagaccctgtctctaaagggaaaaaaaaggaaagcctcatggcattgggtttggcagtgatttcttggttataaaaccaaaagagtgagcagggaacaacaacaacaacgtagacaaattggacttcataattaaaaacttgtgcatcaaaggacattatcaacagtaaaaaggcaacccaacataaaatacttggaaatcacatatctgataaaggattaatacccagaatatatagaaaactcctaaaactcaacaaaaaccaacctgattcaaaaatgggcaaagaactggaagaggcatttctatagagataacaagaggctagaatatgaccatgggagccaaatggctaaggccgaagtgaaggatgaggacattcaatcagaggaagtctaggaactaagtgaggaagtctaggaactaagtgcccaagtgttgggttaattggaggacattgaaattatcaatttatgacaggagaaatgaatgagccaggtatgtgtggaggtggcactcacttaggagggcagtaaataactgcaccctctgagggttgtgggcttaaatgttcagggatctatgtcttatcacagtccctaacaatgtagtgcatattcaaatatcagctatcacacttctattcttactcttgagctacaatgccagaaactatggtgtatacttgtaagtgcatgtattttttgacaagtagcatgtctaatataagaatcataatactcaaacttgaaagaaaaattcagagaccaggctcatgcctgtaatcccagcattttgggaggccaaggcgggtggatcacttgaggtcaagagttcgagaccagcctggccaacatggtgaaacccccatctctactaaaaatacaaaaattagccaggtgtggtgacgcatgcctatagtctcagctactgggaggctgaggctgaagaatcacttgaacctgaaagatggaggttgcagtgagccaggatcacaccactgcagtcctgcctggatgacagagcgagaatccgtctcaaaaaaaaaaaaaaaaaaattcattctgggctatttcttaacagatttaacagcctaagacagaggcaggcaaactttttctgtaaaaggccagatagaaaatattttaggctttgccgcccatatggtatctattgcaactgcccaactctgccatttagtagggaagcagccatatagatagtatataaacatatgtattgatgggaaaatgaaaatgacttcatttacagaagccggcactgggttacagtttgctgtcccctagcctaagacgtgatttttttaaggtagttcctcatggggtttgtacatatttctaaagatttgttaagttacacagttgatgcctgttagattataaccttgaactgtcatacttagatacagttgaccttgtcttttatccttgtgaccaattataattaaaacagtatgacttaacataatgcacgtactaaaccaatgaagcagctatacctatataagccattttaaaggaaaaattttatgcagtttcaggtttaaagattatttctttcagaaatcaggctgggaactaaagagaacaatataaaaacaaagattaatttctgagaagccccaaataaaagtttacaactgcgttttcttgttgtgactgagagatttaacatagcttggtgctttctttcccacagtatgtcttttaatctctctcataaacttctagggatccagattagatgatcaaagatgtgctccaccacctgctaccacaaagggtccgacagtaccagatgaagactttttcagccttattttacggtcccagggaaagagaatggatgaacagagagttcttttacaaagagatcaaaacagagacactgactttgggctaaaggactttttgcaaaataatgctttgttggagtttaaaaattcagggaaaaaatcggcagaccattagttactatggatttattttttttcctttcaaacacggtaaggaaacaatctattacttttttccttaaaaggagaatttatagcactgtaatacagcttaaaatatttttagaatgatgtaaatagttaaccttcagtagtctattaaggcattaatacttctctggacatgcgcgtttgagggtggaggggtcctgtaaggtgcttcatcgtctgtgattactgcttgggatgtgttctttggcagcttgtgagattactttacctagtgtttataaagtaggaagttaagtgaatcatagattagaatttaatactcttatggaaataattttttaacatcttaattgacaatggcgtttttttatacataaccatggatgtagtgggaaacaatgttgtttggtaaaaataatgtacttgatcaatgtaaaaaagtatataaaatagtcttactaaaaatctaggtttttttttcctccatgaaaatctgtttttttaggccaaagtcagtataaaagaaactctacttcttgggctgggcatggtggctcattcctgtaatcccagcacattgggaggctgaggcaggaggatcgcttgaggctaggagttcaagaccaacctgggcaacatagacccccgtgtctatgaaaaataaatcagcagccaggcgcagtggctcacacctgtaatcccagcactttgggaggccgaagcgggcggatcacttgaggtcgggagtttgagaccagcctggccaacatagtgaaaccctgtctctactaaaaatacaaaaattagctgggcatggtggcatgcgcctgtagtttcagctacttgggaggctgaggcaggagaatcacttgaacccctgggaggcagagattgcagtgagctgagaccaagccactggactccagcctgagtgacagagcaagactctgtctcaaaaaaaaaaaaaacagcaagcatgctggcacacacctgtagtcccaactgcttaagaggctgaggcaggaggaccacttgagcccaggaggtggaggctgcactgagctatgatcgtgccactgcactccagcctgggtgacagagcaagaccctgtctctagaaaacaagtatcttttgtgtgttttgggctgtttaaaaaaattatttaaaatggtctcttctgttccataatactgctgtaaaacaaacttttctaagttctaatataaaaacaaaaaacaaaacccatgtggttaggtcaagaacctaggacacataaacaaacagaaaacagatgaaaactcacaaaaattaaatatgaaagaaagatgtcagctagaaccttagttgtcattaagctttgtcttccttatcccagatattgaaggcagtttacaaggggatgataacaaagtaactaactaactgtagcaaaagacaagtatgggacagactgggacctggagtaacactggatcacagactgcaaaggcccacgcttggaacaagttgccaacttgtttcactctgcttgcttcagactgtgcacagctgggatgggatctggggatgtggacccctattctttcaaaaagtcattcaggtgatttggatgggcaaatagaactatttctctaatggccaatgttttttaagagtcataacctggaattaattacattaagtgctcagctaaaaaaaaaaaaaaagttctaaattacaacctggattacattatgtttcatgtatactataaggtatgatgtcctggatagcattttaaaaactcaggtaagtttcatggggttcttataagaaaattcagttaagacaatataccaaaccacaacgtaaaaagtttgtgtatacaaactttttgtattatttgtacacaaagtacaaatttgtatttgtacacaaagtacaaactttgtgtattattttgtgtatacaatagttcttacagcctgtaaacattcaacattattccatttaaacattgtttttaacagctgtctaccctgttctgattttcctaaaagcttcacactatataggctgggcacaatggctcatgcctgtaatcccagcactttgggaggccgacaagggcgggtcacttgaggtcaggagttcgagaccagcctgaccaacatggtgaaaccccatctctactaaaaaatacaaaaattagccaggcatggtgatgcacatctgtaatcctagctactcgggagactgaggcaggagaatctcttgaacctgggaggtggaggttgcagtgagccgagattgtaccacctcactccagcctgggtgacagagcaaaactctcaaaaaaaagtaaaatttcaaaaaagcttcacaatataaaccttaattttaatgacatattggctagtcaataaacaagtcttatctcatctcatctcttttctgataacaaacacccgatgtgttcaatttgctttcatatttaagtctttcctgaattgctgtcatcattcaacaacagttgcatgtcgccttgctagctgtcaaagtagacttcatccccaaatggatatctgtaatgaaagaatacaaaggtgaaattttatttaaaaattttttaaaagaatttggttttggattaaaaggcatgcaagcagcattaattccactcacagttacagtctatcacctggggcattcactacttttcagagtcagatcacagttcaaaagacagctctcaccttgggggcatattccccaagtcagtgtgaacatgtcttgtcccaagaggacactttatacgcatggatgttcacaaatttattctaaactgcaggtgtctgtcaggattcatttgttaaacatgtcctctgtgttaaaaatcctaaaatccttttgcatttcttagaaaaaatcacgtttctgatgaaattctaaagatgtttgcaatattaaactagaatatattaacatgtataattttgagacaaggtcttgctctgtcacccaggctggagtacagtggctcgatcataactcactgccacctcacgatcctcttgcctcagccctccaagtagctgggactacaggcgtgtaccaccatgcctggctagttttatttttagtacatagccttgaacaactgagcttaagcgatcatcctccctcaaccttccaaagtgctaggactgtaggcatgagccactgcacctggcctaaaattacattgttacaggcacgtaagtaacacttcctggatccaaaaatgtgtattctgcatttcaacaactgaacttaagcgatcatcctccctcaaccttccaaagtgctaggactgtaggcatgagccactgcacctggcctaaaattacattgttacaggcacgtaagtaacacttcctggatccaaaaatgtgtattctgcatttcaacaactgaacttaagcgatcatcctccctcaaccttccaaagtgctaggactgtaggcatgagccactgcacctggcctaaaattacattgttacaggcacgtaagtaacacttcctggatccaaaaatgtgtattctgcatttcatattaaaataaaaaagcaagtgcttgggatacaaatatctgcatgaaaatttaaagactttattcctgactggtatcacttttagtaagcagttgaacataacttgtagtgtgaatatggttaaaacaaaggacacctgatgtctgtgaagtctgctaaggacaggtacaaaatttatgcattgctttttaaaaagtttaaaatgaggaatgcttttgataatcagaaagactaatgtaaagtgctgactgatgtcctgtctgcagttaaggaagacacccaactctcttcttcctcatcatggtattctctatgtatagatctctaaaaatgcaaacttcctatggacaagacaatatgatttgctataatatgaattaagatatggtaatatctaatagtctccactgctaggattctgagtaacacaaaaaataggttttataaaaagcccatgcacttcaattggtgggggaaaagaataaagtcattttcagtcgactgactctgtaaaacagattaccaatataacaagctatgttatctaaattgccctggcagtcttcagttttctctaagtaaacaaagtaaaaggaacaataaggatgcaggcgtagtaatagctgtggaaaagatgaaactacagccacagtgacctgtgggcagcctgcgtagagataagctgaggtgtcagtcagactgatcctggtaacgatactccatggctgcatgaagatgctggaggcatcaagtgggtggccttaactctagtggattcactaggcaatgtaaattggttagtgggttcccgtaagtgcctgtaacaataaaatttctttttcaatgtccccaattcaaactggcctccttaactatccagaatcagtgatgcctgtcatctgttcatcttaaaataaacacttcttactttatgggatgtaaatatcaaagagaagatgaaatgaaaagcttttacatatataacgtgtttgttaattctaattgtcagtaaaaatgtgaatgttgaagttgaaa

SEQ ID NO: 504 - DNA, 98812 bp, Homo sapiens
agcgggctggcttcctgaacggccctcgcctcttcaccaccagggccgtccaccagaagtttctaaacgggtgagaggcgacaacgcagtgcagctgggttaaaggaaggaggctggtttatcctccgcacttacttggtactcgatctccagcgaggccttcaggggcatgggctggtagaagcactccttctggccggcgggaagggtaaaggtgaagtcgctatcgagggaaggtgtgaagccggccgccccaggcagcagcaccggaggcagagcggccagaaggagcacggggaagggcagccagatcttgtcgcccatccctgctggggcgatcccgggctgaaagaggcgtcaggtactgttgtctccgctccgcgtttcctctctggactcctcgtggttgacagggaaatctggagtctgaagaaactccaggtggcggccgcggcggcggcgaacactccctccgaaagagaagcgcagttctccaaagggtagggactctgggcggggctagcagtcctattccgcaaccgcctcagtctcggccccctcaggccaggcgtgagcgccgcccgcctctccccctgacggcctccggttcccatggcttcccccaccaatgggcatcatggcggtaattgtgggaaatgtagtcccgggcgggctccgctagtgggctcgggcgcgctcgccgaccacgatccccggcaagccccgcgccttcggcggcgcctcacgcagtctgcgccggggcggggcagtgaccgggtaggcgcgtcccaacggctcccgcggcggttcgaattctgtgctgccggggttcgctggttctccgagttgtgtccgaggcttccacgcgcaggggcccgggaaagggtcagaggcttcctaacgcagactcgagtgcgaagcgcgcagtcgccgggtgggtctctccccagcgacgatttgggtggtgagcgactgcgccttggcgtggggaaaccggcttacctgggggagttctgttcctttccctcccggcaccttggatgcgctgggactggtcctcgtggttgctgagcatgctgctctgaacggttgtattttatttgatgaaaaataggaggccgggcgcagtggcttacgcctgttacctcagcactttgggatgtcgaggcggaaggattgcttgagcccaggagttcgaggccagccttggcaatatggcgagccactgtctctataaaattaaaaaaaaaaaaaaaaagaggaaactgtcacttccgtcccccacccccgcccccgcttctttcagacggatgtaagattagctgtgtcaagcgatcttgagacaggagactactacataaagttatgacttctttccaaaatgaggaatctttttcgactacagcccattgtatcacatacatagggtataaaagaacacttgtccttcgtttgatgggtgtgcgtgtgcaaacctacaaacacattgttaattagggccgaaagatgatgttgttaaggtcggtgagtaggatgatgtgcttttctaggtatgcatagtcagtgaagatagccttttttgggtaactactgtaaattgaagttaaggacattcatttgacagtaaatgtcccactaggaaaatgaaaacattttagtatcaaatatattcattgctactgcagaagagttagggagttctttcttttttttttgagaccgagtctcactctgtcgcccaggctggagtgcagtggcgcgatctcggctcactgcaacctccgcctcccaggttcaagcaattctctgcctcagcctcccgagtagctgagattacaggcgctcgccaccacccccggctaatttttttgtatttttagtagatacggggtttcaccatcttggccaggttggtctttaacttttgacctcgtgatccacccgccttgacctcccaaagtgctgggattaccggcgtgagccaccgcgcccggactgggagttatttcttgcatggcaatacacagatgttgaactaaaacctgatttaagatgaaatatatagtaccaaatggtattatagaatttgcccaattttctctacccttttctccttcaccatcctacagagagctagagatgttgaataggtaaagcaggatggggacctgatttattgacttgtctgcgagagtcttgtcacttaagcagaagcaaatttgtggaaacaaaaaagggaaagaggatagaaccagtttgtctattaagattacatagtatctcatttaatttcctgccactttctttccataaggtgggagttttctttttaatcttcctccctacatctgagaatttttgagtggggaataaatgtaacataccattctaactggatgagggaaggaaggacagtttagtattcgttaattcattcaaaatattgagcttctctaagtacattgcggtcctgaacgtaatgcacaggacttttaaccttttggaacttgggatgggatcagaatgctaagaagggcgttgaaggagatgctacagtgaaaaaggtaaatgggatctgaaagaggaatgtaattttaagattgcgcagaaagctctgtagtagtggagattataaagctttagttttttattgtattaattacaataataaaatgtgatgctttattgtgatttttatatgcaaagaaatttagtagtttcacaaccctagagatactcatccactgaagaaacaaaagcttttcttcatttctatgagttgacctgccaaatgttattttgatccctgtggttgtgacttgtaaatgtgtctttttaaaattttataactattgggcgtaggaggaggagacagcttttatctggtaataaattcccttctaacaaaatatgaatgtaatgataccatttaatcagatgtccagtacttgtaatgtaattatgaaagttcaaacacctcatattgaaattgatatgtaatatgtaataaagctacaatgcgacataatttaatggtctttgcatcctaatgacttggattcaaatcttgatttcaccatttacagtttgtgtgactttgagcaagttatttaatgtctgattcttagtttccttaacatgtaatgaaaataattaacaattgttaggaagatcaggtatgcttacaaaagagaactataataactagaccctggctaaaatgaaaaattcattcattgaaattgtattgaattcctttatggctttacactacagataaattcattattattgattttttgttttgttttaaaccaccatgaaagatttcacaacatttaaaatagaaaactaatgagttaaattctattcatgtgagtattttgactgaaactacagaatctttcagacaaggtacaagaaattcattttttttttaagaaatggaatctagttcatcagactactataataaagacaatgaagaggaaagtttgcttgcaaatgttgcttccttaagacatgaactgaagataacagaatggagtttgcagagtttaggggaagagttatccaggtaagtaagtaaaatcacatatagaattcactgtgccttaaatacatcaatgtaaaatgtgtggatttcattatgatgtattgtttctaacctgcctctggaataagaaataattttcttatactttttaatgtaactttcagtttagggaaaaataaggaatattagagaagcctctttgcatattaaaaacactttcagtgtattagaactcagtataaaatatatattttgggctttactaattttttatgatttttttgaatcttaagtaatcttagcgtagaggctttagaaatacagtttgctagtttaaaagtaattatgatttatttaaaatttagtggaaacattgccttatgttcataactgtgaatctgcttagcagcatttcaggttttctattttcttatttaatgtatagcaatttgtagtgaataaactatccaagaactgaaatatgttttttcttttttctctagtgttagtccaagtgaaaattctgattatgcccctaatccttcaaggtctgaaaagctaattttggatgttcagcctagccaccctggacttttgaattattcaccttatgaaaacgtctgtaaaatatctggtagcagcactgattttcaaaaaaagccaagagataaggttattgtttttagacctatctagttaaaagaagttttggttttaggcctgtctacttaaaaaaaattttttttaattttaaaattaaattaaagaaaaaaattttttctttaaataccttattcatggtttccataatcttttactatggtactcaagaatttaaatataattgttctttttatgttctaacaagaaagtagttatcttggtgtattactctacttttaaacttacatatttattacctttttgcagttaaatgtcttcttaagtaaattataatccccttgattttaacactacatcttatacataataggtaatcaattgtttattaagtagttaaggtatacccaccatttaaagcctggatcaagtactttggatagtatggcactgttctcttttcattatctattttgtcaatgatgttagagatctttgcttggtctgaaactctcttcctttttcttattctatcacatatttatctccctgcatttatccctcttcctcactcaactcttttatctccttttacactctcttcctattctttgttcccccgactccctacatgtatatacacagatatggttgcacataatctttttggatatgtatttgctctttccacttcggaaagccaaccattaagagctttcctttttgtaacgaatctgcttaatgaagctgtctgaatctactttttagaaacaaattcaaattccatgtttacatggtatgtaattctaagaaatttgatctctatcctcattcaaattgctgatcattcttattgtatatgtgccttaattgggaaaacaataatgataatgccgatcaaagacaaaaggctaatctagtgtgtaaagatctcctagaaattgagaacaaaaatatcagtaacccaatgggcaaaagacatgaacggaaaaagaaataaaagtgatatccaaactaatgaaaaggtgtccaatttcactcataataagataaattcaaagtgaaactatacctaagtaccttacctagttcttacctatagaattattaaacattcaaatgtttgaggtgttattttattggtgatattgggtacgggtacattgcctagtgggaatgcacagtgatataaccccaactgagatgcatttggcaatatttaccaaaattacaaatacatttaccttgacttggaactcccacttctggaaaaacgatactgtagacaccctgcaggatatgaaattaggcattgtttatcatatcaaaagattagaaatagttcaagtatccagtaatagggggttagttgaataaactaatggtttattcatacaatggaaactatgcagttgagaagaaaaaaggagtttgtcaatgtatttattatggagagattgccagtgtatattgttcaagtaaaaaaaaaatgcaaggtgcagaatgttatatttaatgtgctagtttttgcataaggagaggagggaagtgggtaatttatattgcttatgtatgcatgtggaattaccagaagactaaacaagaaacttataaaagtggttacccacctattaaagatgggaagagacttctgtgtatactttttcttttatatagtttcaagttttgaattgcataaataaatcactcaaaataaagttaattaaaagaaatgttttgaaaatcacaatcctcatgaaaattaaatgtattgtaaaatatatataaaaagaatataataaaaatatttatacagatgaaataatattttacctattatccattttgttggtggtggacatttgggttcttcctatttactatctctggacaatgtagctatgaatagttttatatctgcacgtgaaaaagtacaaaagtttttatcaggtttatgtctagggatgatattattggttcttagcatattcaactttgctggataataccagccagtttcccaaagtgcaccactgttttccaggttatacttgtatgtacttccaccagcagtggaagagagagtattgattgttccacatatccttgtcaatactcactaagtattttaactcattttctgagctgcttcgtcattttgttaataattgctcataattttccattaattacatgtaacccttaattgaaataattgaaaatatatttgttctttttcattctttcagatgttttcatcttctgcccctgtggatcaggagattaaaagccttcgagagaaactaaataaacttaggcaacagaatgcttgtttggtcacacagaatcattccttaatgactaaatttgaatctattcactttgaattaacacagtcaagagcaaaagtatgtatcttgaaataagtttgccaacagaaaatagttgttattttaagatttataattggaaaaatattccttgtattgccacattgccttaatgtgttatgggaagtaattttcattataatactatagtatcaacatgttgtaaaatcaatattgtatgaattatatctgaaaatgattgaagggaactttacagtttttgcatttagataagtcagcttcttaaggtgttaagattaccaatttgtgtggttttattttttatacaaaggaagtataacttacttatcttcccttttaaaataacacattgtcattgttgaaaattttaaaagtagcaaaaagaggaagaaagatcacccagagtttccacctagaaaccactttaccagtttaatacgtagttgaatccagactgttttaaatagttttggtgttttctgttttttactttatatatagtctgtgcattttctgatgcatttacatagcttttccattgaacattttttatggtagcattatatttcatgtgattatatcataatttagttaataattcctgtatttcagtggtttcctatttttttactaaatgattggtattacacaaaaaattagaagaaaccaaaatgtccagtaatggagacatagtaaattatggtatacccataagatagattgcaacaaaacctttttttaaaaaaatgaggcaaatatactagtactaagatgcaaagttgtttgacttgtatggagcattataaggtttaaatgatataatatatgtagtcacttaaaacagtgtctatgtgtagtcagcactcaaaaacaattacctaatatatttagtggcagaaaaacattacagagcagtacacacatgtataatactcttagttttcctctttataagaagtgtgcatgtgtctgtgtgtgtgtgtttgtatgtaaatatatatacatgtgatatattaaggttagaaactatgcttcacactgttgataatttcgagagagactggaaggttggagtgaggctttcactatttacttttataaacattgtatacatacattatatgtagttttaaatagaggagttatgggaagactttatttttcttttctgttttttcaaacaaaacaaaatgctattagggattatttcagcacaggaaaaacaaaatgcagcaatgaacataaaacttctttggtgtttgagattatttctagggtagacttacagaggcagaatgaccaaattttagggaaataatgtttttcaagcatttacatttggttcctcatcttttcttggtcactttgagggaaaaatgctgtttttcttgatttcttacaaaatgtaccttttcagtatttctttgccatttagatttctttgtgatttgtctgttcattttttctgcttatttttaaaatttttcttcaactgtagataatctctctttttaaagtcatgattgcttagtgatttaaagtaagaaaagagacataaagataatttaataactacgaactaatagcattttgaacctttctttttaggatataaacataccagtggttatgtgagaaagtaagatactagtattgtatttctcagctcagcattttcaaagttgttgaaatattttttagggaagccacctatttcaggccatgtatgagcttttgatgttacatatatgcccactattgagactgttttgcagaaatcaatcaatatattcataacttacgtctggcaatggttgtacttactcttctggagcctggcatcctgctctttctgagctttttgccctctacacctgctgtccaactgctaccctgggacttctctttggtgttgttctaggttggagctactgtttcctgaattctattttttgttatttcctagtttattctttctgtatttggagcatatcttccagttacttccttgcctgcctgaaaatgtcttaatttcttcttcactcgtgattaaattccagtttgaaaattatttaatgtcagaatttttagggcattactcccttctatcttccagtgccactttgaaaagtctgttgccattgtgaattactttttagcatgtaatctcttttttccccccatttgtttgtttttcactttatggtagatggtagttcttaggaccttcccattctggtgttttaaaactgcacaacaagttgtctttgaataggcctttattactcatattgggtatttgagagccctttcaggctggaaacttgtatcttttggttctggaaatttttctgtttcttaatttttatttttaatttttgtgggtacatagtaggcgtatatatttctggagtacattaggttttttgatacaatcatgcagcataataatcgcatcatggagaatggatatccatcccctcaggcatttatcgtttgtgttataaacaatccagttaaactcttagttatttttaaatgtacaattaagttattattgactatagtcaccctgttgtgctataaaatagtagttcttattcattctttctatttcttgtacccattaaccatccccacctctccccaccccaacaactgcccttcccggcctctggtaaccatccttttactctctgtgtccatgagttcaattgttttgatttttagatcccacaaataagtaagaacatgtgatatttgtctttctgtgcctgacttattttacttaacataatgatctttagttccatccatgttgttgcaaatgactgattcttattcttctttatggatgaatagtactccattgtgtaagtactacattttctttatccattcatctgtgatgaacacttaggttgcttctaaatcttggctattgaacagtgctgcaacaaacatggaagtgcagataccttttcaatatactgatttcctttcttttgggtatatgcccagcagtggaatttctggatcatatggtagctgtatttttagttttttgaggagcctccaaactgttctccatactggttgtactaatttccattcccaccaacagcgtatgaagattcccttttttccacattcatgcaaacatttgttattacctgtcttttgaatgtaagccttgtttttttgtttttttttgagacaaggtcttgctctgctgcccaggctgaagtgcaatggtgcaatcacagctcagtgcaaccttgacctcctgggcacaagtgatcctcccaccttaacctcccaagtagctgggactacaggcacgtgccaccatgcctggctagtttttgtattgtctttttgtagagatggagttttgccatgttgcccaggctgattttgaactcctggactcaagcgatccacccacctcccaaagtgctgggatgacaggattgagctaccgcgcctggccctgtgatttttatttaggaggtattctcaacattattttttgcacttctattaaatcttttattttggctgtcatacttttttcggtttctgaagtttttttttgttccgattgttttgtatttcataacatactaatgtagtattctctcttagcactctgaagatttaatgatttttttttcatgtttgctttactttcctttttcttttgtttaggcctctgacttttatgttagaagcttttgggccgggcacggcggctcacgcctgtaattccagaactttgggaatctgaggtgggcagatcacgaggttaagagatcgagaccatcctggccaacatggtgaaaccccgtctctactaaaaatacaaaaattagctgggcgtggtgatgtgtgcctgtagtcccaactactcgggaggctgaggcaggagaattgcttgaacccagaggcggaggttgcagtgagccgagatcgcgccactgcactccagcctggtgacagagtgagactccatctcaaaaaaaagaagattttttcaggtgttagtattttagctattcatatttaagagaaaggcatttaaatgcagattggtggtttgttgtccagtggactttatttctgggtgatggttagggaggtggttcttttgtagggaaacacctgccagcccccaaacagtatcagtatgagatgtttttctttccctttttttttttttaacataaactcaagattttattgtcttcataataaaacaaaagataacacttagaactgggtcacttggctctttctgctcttacctcctcccagttgagaaagcttgcatcttttaatactcagcattctcttagatctgcagttgggctcagtgcactcaagccttagcacaatcttctttgtagtttcagcctttttctggaaaatctacttagtctgcccaccataaccactctgcttcctgtcatatcgacactttccctgggcatacagagaatccttgcccttcttgtactgtgtcactttctagggttggtgcttgccacacttcttacagaaagtcctgcaggttttaggaatgttcaccatgtttgcgggagtgctatcagcaaggagattttttttttttttttggagcaattgagtttctccagcaaagaatcctttagtttctcacctgtgggataacccaaaatgaaattgagtagtaaggtggggctaaccgttttatattaattcccttgttacagctgtacttcattcctgctcattactcttagtgtctcacagtctcaagcttcttctgttcagtttcttctgataataaactttctgcctctttcctagtatgccaacaccttgctattggtgttctgggagtgggaaaaagaggatgactgttacttgcagatactttgaactgtatccctggtttttcattgggtcctcacttctgccctctacagtaccttgtgccttcatgttctaaacttctttttcagtgatagttatcttattgatactctcttctataccatttagattgtgggttcccaccctgctatagtagttgtactctctttattatacagattgtagggttattatgcttttctgtatttagattcttcctagtaagcatgtattctataattaggtttttaaatcataaaaattcaataaatattttcttttataattgtttatagtttgatattttatgtttaattttctaatttatgtaaaataaatcttgctagatgcttatcaatagagattctattttctcccctaaataactcttcagttataagttgaaggtaatgccaggagcttacatgccaaggctggcttataatgatgatatgcccatgtaaatgttgatcaaaggaatagatgggaagctttatatctgaccaatgatttgggagccctattgaacaccctcatctgacaggaaaaaaactaaggaccaagtaggttaatttattttctgaaagtactataaaagttgtttttatgttttaggtttctatgcttgagtctgctcaacagcaggcagccagtgtcccaatcttagaagaacagattataaatttggaagcagaggtttcagctcaagataaagttttgaggtaaatatactttttatagctctcaaagttttattttctacttatacattttattatatcttgttaaatcttgttccccacacccaataaatttacagtaacctaatggtgttcagctgtcttagaacttgttgaatctatttttagtcaatcataactcctcttggctgtaggttgcatgtagtatataggggctaaaaagactaaggtgagatgcctatttacatgcttttatcaaacatgaattagttcatttcttcacctacatagaagtatatactcagtgtttcaaagggagttcaagaaataaaatgtaaaggagtcagacacttttattatttttacagaaagggtctcactgcgtcacctaggctggagtgcagtggtacagtatggctcactgcagcctcagcctcctgggttcaagtgatcattctgcctcagcctcccaaggaggtgggactacaggcacgcacccactgtgcccagctaagctttttattttttattttgtagagacagggtctcactatgttggtcaggctggtctcaaactcctggcctcaagcagtcgtcctgcctcggcctcccaaagtgttgggattgcaggcatgagctgccatgccttgccatcaggcactttataatttattctcttctgctttgaataaaatgggaaatatatgcatattaaataacatattactctgagtgattccgaaagtatagttaaaggaccagcagtagtagcatcacctgggaacttgttagaaatgcaaattctcaggtcttatctctggcatactgaaccaagttgggaggggtttcacaagttctgcaaatgatgctgctgcacactgaagttgtcttttatgtccatcagagttttgtaattttctttgtaatacatatattattttaaatttgtaggtattttatatttttggcaattgtgaattgttcctactttgttcattgctagtgtatgggaaggttaccgacttttgtataatataattattttgtaattggtagctaatggtattatcagcaaataaaaaaaattttgtttctgagtcaaagagtaggaaaaagaaagaaagaaaaaaaattttgtctttccttttcagcatttatactacttattaccttttcatatttgctttttgcagtgggtagaactgtcagaaaagttgttggatgtgggggtgataacagtcatctttatttagtttctgaactatacaggaatgcttctggtatctgactataaaatacgatgtgagttattacttcagatatatttatcatctggtggaagtattcttttattctttaaaaaactcttaattaacaagtgatgaatatgcctttttctctatctctttttgtatattgtttctcttaactcattgatttaaacaaatataattcctaatattaaattattcttgcatacctgggataatctctttagtagtcttaaacaaagtatcctttattttatagagaggcagaaaataagctggaacagagccagaaaatggtaattgaaaaggaacagagtttgcaggagtccaaagaggaatgtataaaattaaaggtggacttacttgaacaaaccaaacaaggaaaaaggtatgtgtttttaaagcaaatacatgtttttgaaagggaataaaaggaaatattacctatttaaaattctagttaatttttgaagtgaaaaaatttcagagatttggcaataaattaacttaatgttcttttttatctattaatttttttaaattttccattaaaatgtttatatgtggaatttatgttattagcatcctggattgggcttaatttctacaaaactgataacgattatcagtttaatgatacttatttctgaaattaagttctatggcctatttgaaaccagtacactgagtttaaaatactaacagggaaaaagcctgtaaattaatattacctctaataaaactaaataaaatgttgaatgaactctttaaaagaaaattttgcctcatagagaaagaaactcaatgcctgtgaatgtgtgcttggatcttcctttagaaatatataaatagtacaaaaatatctattttgtataaattatatcttgagatcaagtcttttaagtagctctgtccaaggaaccattaactctgaatgccagttcacttttaaactgataaagatttaaattttttgagtttaaactaataagattttataataaaataggattatagcagttgttatacagtataaagtcataatctgtactaagcaattttgcaattttgcaattttgcaatttgcaatattgcttagtagaaaatgcgtaggttttggagttagaaaatttttagattttacctctcattggctttgttaccttggccaaatgatataaccttttgaaatctcaggtttttttcatctgttaaataaagatgatattatcttgatatggatagaaatgaagagtaaatgaaaaaaagaaatgtacctcttaaaaaatactaacaatttaactattttataaactttgtggttaaatactctagaattcacacttcacttactcagataagctttgcacgtggttagttaaaatagtgagataataatacatgaagaccacattcacaatatagctgccaagaaaaaataaagaggaagagctactagtttcctctatgcaacttagataagagatgacttttaggatagagtattgactttgttgttgttgttgttgtttgagatggagtcttactctgtctcgcaggctggagtgcagtggtgtgatcttggctcactgcatcctccgccccctgggttcaagcagttcttctttctcagcttcctgagtagctgagattacaggcatgcactaccacacccagctaattattgtatttttagtagagactgggtttcaccatgatggtcaggctggtctcaaactcctgacctcaagtgatccaccctccttggcctcccaaagtgctggaattacaggcgtgagccactgcgcctggctaaatattgactttggcttcacaaagtgagtaagtgggggacagacacattctgggcagcatgtgcaaaggtatagaagtataaaagggtattattgctgaagaactcttaagtaattttatgttcttataagtaaataggtgtagtgggagatgagacaagaaagacaggctggatccagactgtaaatggctttgtgtgttataccaaaggatttgtattttaacctggaaagcataaatagccaattgagatttttaggtagaggtatgacatgaagactcttggagctttttgaagaactaaaatgaatattgactttctgctatggtttgaatgtgtccccccaattttttgtattggaaacttaatcccaacgcaacactgttgggaggtggggcattttagaggtacttaggtcacaagggctctgctttcgtgaatggattaatgccattataagagggcttgacagagggagtttgttccttttttcctttctgtcatgtcagaataaagtgttcctcctccttggaggatgtagcatttaaggcaccatcttggaagcagagagattaggccctaccaaactgccagtaccttgatcttggacttcccagcctccggaactgtgagaaatacatttctgttttttataaactacccagactatgatatttattctagcagcacaaatagactaagacacattctgagattgaaagatcagaaccttttcaaggactattgggtggagaagattaatcataatggattaaaaagccagtgtaaagaaagggagagattgtttagctttatgctgtttgtaagagattacctaaaacataaggacacagaaaaattgaaagcagactggatgcggaggctaacacctgtaatcctagcactttgtggggccgagataggtggatcacttgagctcatgagttcaggaccagcccgggcaacatggtgaaaccccatctctacaaaaaatataaaaattagcctggtgtggtggcacacgcctggagtcccagctactcaggaggttaaggtgaaagggattgcttgagcctaggaggcagagattacagtgagccaagattgtgccattgcactccagcctgagtgacagaggaagattgtgtctcaaaaaagagaaaaaaagaatggaaagaaatgtttcagataaatactcaccaaagcaaagttgatattactatattaggatcacacagaatagacttcagtgcaacaagcattaccaacattaaaatgactcatataatgtttaacacttaaccaagaagatataaagactctaaaccagcaagatataaagactctaaacttatatgtatctaataatttagtcccaaaatacataagaaaaataacacaatttcaaggagaaaagaacaaatctgtagtcatatggggaaaattctttatacatttatcaggaattgttaagtaacaaaaaattaaggcttgaagtgttgaataagacaattaatattcttgatctaatggatgtgtatatggaaccatgtagtcaacagtttgaaattgacattctttcaagcagatgtaatctgttacctcactatgctagaaagcatgaatttgaacaaattccaaaagattgatgtcgtatgtattatcttctgcaaccacagttcagttaagttagaatataactccttgaaatcctgtatgtttggaaatgtaaaaccaggcttactggtgttcattgacctactggtgttcattgaccattgaataaattagaaaacctttagaactgagtgatataaaaaatgcacatcactgcatgtaggctgtacctaaagacactcttagaggaaaaaatttaaccttatatacatgtattatatcatgactgaaaattaatgaactgaaatagactattgtgtggtcaggaaaaggaggacatcagaagaaagaatgaacatcaaaagaaaatagaagtaaggaaataataaagataaggatgaaatggatgaatagaaaacagtgaaacaatataaaggattaccaaaacctaaatgtggttattttcacaatgaacaagaaaatgggcatcagacaagattaataaaggagaaaaggcacaagtgttgggattggcaagggactcccaaattacagatttagctataaatcggtaagcaataagaaatatataagaaataaggccaataactgaatcattttaaagatgatacatttgaaaacttagactaaataaaattctcagcaaaataaaatttaacaaaactaactttaaaataaatgaaaaacctgaataaatatatgtgtgtgtgtgtgtacatatatatgtgtgtgtgtatatatatagctattagggttatcaaatcagtaattaaaaatctgcccacaaataactaaactagtcaaaacaatggtgacaaaaggaaaggaaacatcaggcccactacagcccatgatgactaaaatggaaaagactctcaaaaacaagttatggcaaggatgtggaattgaaactctcctgcatttcttttcttttcttttttttttttttttttttttttgagacagagtctcgctctgtcgcccaggctggagtgcagtggcgcgatctcggctcactgcaagctccacctcctgggttcatgccattctcttgcttcagcctctctagtagctgggactacaggcgcccaccaccatgcctggctaattttttgtatttttagtagagacggggtttctccatgttagccaggatgatctcaatctcctgacctcgtgatccgcccgccttggcctcccaaagtgctgggattacaggtgtgagccaccgcgcccggcccactctcctgcatttctaatggaagtgtaaattggtagaaccactttggaaaactgtttgtcagtagctgctaaaggtaaacataagcctgccttatgatccagcattcatttcaacaaaacttagtccctgtattaaaagacatgtacaagaatgttagagtaattttattcattgttaaatgttcatcaacagtgtaatctataaactgtggtatgttcacataattatacacatcagtaaaaaagagcaactacaactatgtaacaacatggattattatcacacatataatgctcagcagaagaagccagacacagtagaatactgtataattccatagcaaatcaaggataggcaaaattaacatatgttgttaaaagtccaaatggtgcttacctttttggggtaaagaatattcactgggaaggtacacaggggtgctggaagtgttctctatttgattgggttagtagttaagtaagtatacacattattataaacttctctcatttaggatttctgtactttactcaataaaaaattaaaatcaaataagaaaaactataagaaaaaatctacagaagatatgtatagtcttaatttttttttaaagaaatatggtattgctttgttacccaggctggagtgcaatgctgtggtcatggctcacagtagctcccaactactgggctcaagtgatcctcccacttcaggctcgcagatagttaggactacaggcttgccccaccacacccgactaatttttaaattttttttacacatgggtctcactgtgttgcccaggctggtcttgaactcctgggttcaagtggtcctcttgctttggcctcctaaagtgcaagtattataggcatgagccactgtgcctggctttaatgcatgttttaaaatgtatttggggtttgttttaatcaggtatggtaagatacagacacaggactgacatggagaaagaaatttttatacttacagatttctagaagtaggaggggcacaatatgctgttttgggatccttggggtgttgcttcacgagccagaaacctctgtggccagtggcacctttgcccgagttttactctggcccagtgggctcattctgcccactcagcctggcaggctgcgcttggctcgtgctaccaccctggatcccacacctgccaagggtgagctaggtgcagaatggcaaggggtgtgtgaacgaccatagggtccagccactatacatagccaggcatgccggctgtggtggtgtgagcagctccaggcgccagcacgggcgccagctccctgtgaggctgtggctggaccaggtatagcataagcagcttctgtggctgacaccagggaacggggtggtactggaagcttggagacaccaggaaccacagagccctaaagagggtgtcacagccctggctcgggaagctcataggtctgggctcccctgaagggctgtagctcttctctccttctcttgtcttttcttcttgttgcctgcaacgtagtgagcagggggcgtgtttcagccatttgtgttacagcattttaagccccaccattcagtgggtcctgagttcttgtcctgcatccaggaagaatgaggtaagcaaacaagtggagggtgagcaagagaagctctgttgagcgacagaacagctcagaggagacccacagtgggtagctcctctgaatggctacccccacctcatttgcgttctggtacatgtggacacagtcaatgcagcagtacccgatgtcaattgccaccttcacagcttcagttacctggcccaagggggacttgcaggtgcccagccccagtatgagcatctaggtgctgttgttgagcatgaggtagctggccgtggctgctgcactttacagacccccacctggaactgtcttattttattttatttttttttagagatagggtcttgctctgtcacccaggctagaatgcagtgttgcgatcatggctcactgcagcctcaaacccctgcgttcaagggatcctcctgcctcagcctctagagtagctgggactacaggtgtgcaccaccatgcccagttaactttttgtagagacgatctcactacgtttcccaggctggtctctaacatctggcttcaagcaatcctcctggctcagccttctaaactgtttggaatacaggcgtgaaccaccacacccagcacataacaattttagagatgttaaaaatgtgaaaacatggtaagactataggagattatttaaaaaaaaaaaaaaagcgagaacaggctggacacagtgactcactccagtaatccaagcacttggggaggccaaagtgcgagtattacttgaggccaggaattcaagaccagcccgggcaaaatagcaagaccccacacacacaacaaaaagtgaaaacaatgtgtctcttagaatagatgaactgtgatatatactatttgtgggtgtaggttaacatgaatgtacaaaataaaaaacaccaaaatcaggatagggttacctctgttggaagaagtcaggggaatgggatttggaagggacacataaggacctcaactttatttgtaatattttgtttgtcttctgtagccttttcagacaaagagtgaagattcattaaaacgtgattgggagtacatggtaatatttatccagactttttgatgtggctgaaatatgtcattactttttacaaattggaagtgaggaagagtagataagtgtaaagcggataagtctggcttgaaaagaaggataatagaggaaagcacaatacgtgggaaggtttttgtttgtttaagtgagaaatacaggtatcctttgatctgaacagtacctgtgcacactcaggaattgattatattcctacagattttcagagaagtcctttgttgtccttactttcctttatctgaaactttggagtcaaatagacgtacttaaccacatagactcagaaagttaggagtacttttacttgaacttgtttatacttgtggcaaaataaccaacagagagaatgaaaatacagaagctagagtgtatttctgaagggttaagagttaagatctagactataaatagagtaattcaccctggataagaggagggtcactaacctcacttacattagaaagaatatgatgggaataggtttaaatattaaaatatttttaggtgtgagagtgatattgaccaaatattctcaatgtattgtgccccaaattttcatttcattgcaagaagcataaggaactaagagatgaggcaacaaggttcggcttaaagagtggttggtggtggttgtgttttttgttgtctagatttttatatctggtatcaatagaagttaccattttttgaaataactatttgaaatttatttgacctttgcaaaggtcacagaatttactgagtatatttaatattctagacaatagactgattctgtaatacctaacctttgaaaatgtatcatccagcctcaggctatttccctaatctgtcttttccagatagggaaaaaaaaaattgccaacacataagaatttatatatatttcgacatttatgtttattattgttttgtgttttatttttcatattgatagagtgagaaaatttttgtagtatgatctacattcttcattttatactttaagcctaatactcctttttagtgcagagaaatttgtttctctccaattattccttataattaaagattactttggaacttaactcttcaaatgcagagcattcttcacttttattcattatctctttttaaattttagagctgaacgacaaaggaatgaagcactatataatgccgaagagctgagtaaagctttccaacaatataaaaaaaaagtggctgaaaaactggaaaaggtaaaaggcagttgtgcaaattcagtgttttgtattactgtctatattccaacagtaaaggtaggaataattaaaatatgtttatggttgagacagagagtaatttttatgatcttacaaaatcatttaaataaacaatttgtaaatgttagttaaggatgatgttcaccaacccttttattatcaggagaaacttttttatccaaagagggaaaagagtagagagaggagaaggaacaaaatacagagaaggatggaatgtgttaacagagactggagctaaagaagtagaaaaaagaaattcatttttatcacttcaatgaaaatgaagatagattatgtagctttcaactggtctccctcagtctgctactctgagaggggcttgcttctgcctctcggaaggttccttgaactgatttgatatagaaataatagtgagtttattacattcatttattatattcatttattatctttaagtaatatcacatggtaatgaaatgtgtatggaggaacaccacagttggatattcagatattgagctcaaaagagaggtctggtaaagagatactaatatgggagacttccatcttgagatagcaatgaaagcagaggaagtttatgattctgatccaagaaaggtagaaaggcagaggaaggaatgttcaggtagaagggtagagtaagaagatgggtgttcatttattaaacaatcatgaaattccttttacatgccaggtactgtgctagtctctgggagattcggtgatacataacacatgatacctatcctaaagagctcactgtctagtaagattgacaagtatgtaaacaaataatttcagtattttggaataagtataatatagaaataagaggtaggtgtggtagggtgggtgaaggtggcagtggttaataaactctggtgggcccaaagaaggcttcacagagtaggcaatgcttgagctgctaggctatctcaaagattgtgatatatctttgaacagtgttaaccagggaaaatgatcaaaatctatgttctaggaagctcaccctgatgtcatgtgaagatgcatttgagaggtgagagacaagtcaaggagactttaaaagacaaggcaagagatattgaagatgaaggagctgagtaggtagctatgagggatgttaaagttggggaatcagtgggatctagtgaccacttgaatgcattagaagcgggcagtatgagaaagaagaatataggatatttttaggttgctggtttgagtgactgctggatgattgcatcatgaatcaaaatagacagtttaagaaaaaaagttaatgagttctattttggaaatgtctgtagaatatccagttataggtaggcttttgtatctataggtctggatttagacatacaaatctgtactagggctgtagttttgagaattaacagtactgaattaaagtggtagaagccttggacattgacagagttcatatagaatgagaacaagatgaaagataccctgggagataaagaacaggtagattagcttttgaaagatatcgagaagtgatttaaaaaaattagagaatcaggaaagtataataagaaaagccaaggtgatagaacattttaaaaagaaggtggtgatcttcagtgccagatgttgcaaattggtcaagaagaatgaggactgaaccaggtgtggtggcttatgcctgtaattccagctactcagcaggctgaggtagaaggattgcttgaactcaggagttagaggctgcattaagccatgataatgccactgcactcaggcctgagtgaaagagcaagaccctgtctgtaaaaaatcagaaaaaaaaaatttagaaagatgaggaacaagacagggctattggtttttataatcagggagtcattggatactttgtagagagcaacttattaaagtagaaggcacaacctctgaaatgggagaaatggaaagggagggggtagaggtagctaacagacaattctttacatacggtaggtgaagaggaaataagtgtgtgtggtgggttgggagaggcagcgaatggaagggtagaaagaagctaagttaaggtgaagaagctgtggtaaagcacctaagggtatcctgaacatattagtagggggagattgaagatgctagaattataaggaataaaagatggcacaagggtctgaatgatatgcaagatgatagtccaagagcagaagtgagattcttttttttaatgaaataggacatttctttatgggaaaaaagtggataaaaacagaaaaaagttttaggtggaaggaaattgaacgattttgaattaaatgtctttggtctcataaattaagatgttgcttaagtgattttcatagcgtaaggaggataggagggattttggaaacttggggtgagtatttctcataatatatttgcaataaggaaagccaagaaatttgctaaacttttgagagaatatatggaaagaaaagagcagtcaggaatgatgagttaataaaaggaagcaaggaaaacaagagtggccagagtcaagtgtaatattatcatgacagctacatgataaaatattttagaggagaagttaccaacaatattaaatactgagatcaaggagaaagtctgcagttgattacaaagtggtcattcctttgcagtaaaactgtgagtatcacttggcagtgtaaaatattaaggtctcactaggtactgaaatcttttttttttaaattttattattattatactttaagttttagggtactgaaatcttaagtgtgaattagttaatcagaacgctgttttgagagctaaagagggtccttgtgggaatgaaatatcttagaagggatttttaataaggtgatcagtaaggggaggtagaagacctagtaggaggaatatgcttggggagaagaaggactttatggagaaggagagaagaatgtaagagacaggttttgtttttttacacttaggattatcaattgcaaacaatgctcagcaaagccctatagttaggtggatgtaacagggtaacaaaggaattggggcagatctacccaatcttctcctctcaacagtgtatcttgggtgcttttttctgttctacattttgggctgtggtttcgttggtaaattttgtggttcaaatttcaaaagtaacttctctggaatatttgcactgaaattaacctttagtaactcggacgcagcagctgtagatgaatttttgacttcagttgatgcaattgcctatctgttacaggttttctggacaggtagtagtgtctttttctctgtcctttgctactgcccaggaacttcactttgcttcttttcactacaaggctggggacttaaatgtatgaaattcttagtctactctcctgcttatttctgaaatcactactgacatttttagcttgaaacacctaaaacttacaaccacattagtatgtccacttaaattattgttttaggttcaagctgaagaagaaatattagagagaaatctaactaactgtgaaaaagaaaataaaaggctacaagaaaggtgtggtctatataaaagtgaacttgaaattctgaaagagaaattaaggtacagtattctgttgtagaaaaaggatttttgtgtggacatggaaaaaactgaaacactttaaaacacaatattttattgttgtaattataggcttacattatatagaaggataggcttcatgactgaaactgttttctagctatagagttagaattagaagtgaagtaaaatgtgttaatgctaataatatttgtaaatacggagacatactgatcaacatatttgctttgcatatatttagagaaaattaatagatataatgtccttgatgtataaccacattaactcactagtaaaatgtgtataatatccgatgttctaaaaaaaagtgtttttcaaatcataaaaaattacctagtccagacttctcattttataagtaaacagaagccccgagagtagccagaatttactgaaggtctgaaagatcgaagtcttctgactccaatgctctcttttagtacatcatgttgtcctctcaaaactaacacccatcaactttcagaggttaatattaaccagtctttatcacttcaaactgttaatttaaaaaaaagggggagcaggaagcaatcaatgactgatttgtctaattttgccatactttccttaaggtagtctgtttagtatttttgccaaggaggaggaagtaaagatactttttactagagtattttttagaatcggttatcgattgcaagatatacttttaagaaagaaagatgctgccaattacactatgatgcaatcctttatcacttaaaatttttatacttcatgaaagaattcttgtatttgtaattagatatgatttcttaagtcgttattttcatatttttcaaaaaagttattctcatatttcaaatataagtgaaataaattggttaagatatttttaaaacttcacatttggagtctaaccctctaaaatgtctaagtttttcctcacagtatctcccagtgtgccattaagacttgttgatgcagtatttcttaaaagaatccttgtaagaacagaaagtcattgatgctgggctcttaagctggttgtacaattatgtagagccagtttactttttctcctgttttaggaatccaaaactttgttgataatgtgaaatgctatgtcagggattttgaagttagatttcctgtcttatataattaaacagggagcagaaatgcttttaagacagtagggctgtccttccctaccatttactgtgagacactaggaaagttatataacctttttgtgcctcagttacctcatctgtaaataagaagtaataatagtgccaaccatataaagttgtgagtgcctggcatgcagaaagtaggtatttagtaaatgtgagcaggtattattttagaattaagcttcaaaaaattttaaaagtgagattaaataaatatgattaaaatgaatgcatatatattttattttcatttttattctcttttcttcataggcagttaaaagaagaaaataacaacggaaaagaaaaattaaggatcatggcagtgaaaaattcagaagtcatggcacaactaactgaatctagacaaagtattttgaagctagagagtgagttagagaacaaagacgaaatacttagagacaaattttctttaatgaatgaaaaccgagaattaaaggtccgtgttgcagcacagaatgagcgactagatttatgtcaacaagaaattgaaagttcaagggtagaactaagaagtttggaaaagattatatcccagttgccagtaagtatgtgtgattacgtaatggaaaagaagaattttactaaagtgttttagaaaagactatcattttgtggttgctttattagcttctaatttctttttctctatacttttagtcatgaatttctcttctgtctaaatctctattttttttcctgcacttaccattctacacttttccccagtttctcagatgccatatataagaatggcacagaattttttttaaacagctttgttgaagtatcatttatataccataaaatttgcctgttttaagtgtactaatctatgatttttagtaaatttataagttttgtaacaatcaccatgatccagctttgaaacatgtctgtcatccccaaaaggtattttggacccatttataattagtccctgtactcacttctacccctaggaagacactaatagtttttgcatctgtagatttgtcttttctggacatttcacataaatgaactcgtataatatgtgctcttttgcacctggtcttttgcattcttagagtcgttcatgttgtgatatcagtatttcatttctttttattgctaaatagtatttcattatatagatatgttatattttgtttatccattcactggctgatggacatttggattgtttccactttgggatattatgaataatgctgctatgaacgtttgcatacaagtctttggacatgttttcatttctcttgggtagatacctaggagtagaattcttgggtcatatggtgaatttattccaaactgttttccaaaatgtctacactattttacattctcaccagcaatgtatgagggttcctgtttctccacttccttgccaacacttgttcttgtctgtctcttttattataaccatcttagtgggtgtgaagtggtatcacattgtggtttttctttttttttgtttgtttgtttttttgacggagtctctcactctgttgcccaggctggagtgcagcagcatgatctcagctcactgcaacctccacctcccaggttcaagcaattctcctgcctcagcctccctagtagctgggactacaggcacaagggacggggtttcaccacattggtcaaacgggtctcgaactcctgacctcatgatcaacccaccttggcctcccaaagtgctgggattacaggcgtgagccaccatgcctggccctaatttacattttttttaatggctcatgatgagcaacttttcatgtacttattagaatggcatagaacttaaaattttttttctttttttgagatggagtctcgctttgtcgccaggctggagtgcagtggtgccatcttggctcatcgcaacctctgcctcccggattcaagcgattttcctgccttatcctcccaagcagctcaaactatagcacgcaccaccatgcccatctaatttttgtatttttagtagagacggggttacaccatgttggccaggatggtcttgatcttttgaattcgtgatccccctgccttggcctcccaaactgctgggattatgggcgtgagccaccatgcccggccttttatttttttgaaacgaagtttcactcttgttgcccaggctggagtgcaatggcgagatcttggcgcactgcaacctcagcctcctgggttcaagcgattctcctgcctcagcctcctgagtagctgggattacaggcatgtgccaccatgcccagctaattttgtatttttagtagagacagggtttctccatgttggtcaggctggtctcgaactcccaacctcaggtgatctgcctgccttagcctcccgaaatgctgggattacaggcatgagccaccacgcctggcctaaaatgtttttataataatggtctaccaccttttctcttttagtaatatttgtgaccatatatataaatgagattaagaagaaggtaagtaaacctattcaggaatttgtaatcaataggtgtaaaatgaaggaaagatcaggggaaactataggtaaatatattatggttggtttcagatatgaatgtatggtagactagatggtagacttaccaatgttaaactgttatgaactgtggaattatgaaccaaaaaaatctcagaaatcatctgattcaatactattttattggtgaagaaacctagacccaagaaagtaaataacttgcccaactggtaagtagtagaatttaaactagaacataagatcttagctcctctgatatctgctttcccaggatgctgtttatttgcttggatttttaatgtactgtttgcttttgaaattagaaagtaatcatatacagataacaattttaatttggcattctcatttgtgtatcaagaattatttcatatatggtcaggcacagtggctcctgcttgtaatcccagcattttggcaggccaaggtgagaggaactcttgaagcaagagttcaagaccagcttgggtaatacagtgagaccctgtctctacaaaaatgcaaaaattagctgggcatggtggcgcatgcctgtggtcctagctactcgagaagctgaggtaggaggattgcttgagtccaagagttcgaggctgcagtgagctctatgatcataagctccagtctgggtgacagagtgagaccctgtctctcaaaaaagaatcatttgagatatgattccgaatgtggtaatgtatgcttgatcgtttgtttcttgtagtgctaagaatgacacgattagaaaatgtgatttttttctacttctaggaggtgtgattcggttatagtttgaaggtagaagtcattaaatgctaaccttgctcctttttataactgtcttttaaaattctgtattatccaaacatacagaaaggtgcatatgctagtgtagcaccttatttgtaaaatttgggacacatattgtcttatcaactctatgtttttttagaataaaattttacaggtaaatcttctttgtgtaccttgtcagatcccaattatcttcctctctcctcagaaatggcaattattctgaaattcatgtgtatccttctcgtccatgttttaaatattgtcacatatcgatgcatctagaaatatatatatgttgcttagtgtttttatgaaaatactgtttgccactataatttgtttttcactcaatattgttatgagatgtatccatactgatttatgtgactcaggtttatttcttttaactattgtagttttccaattatcttaatatttcttaatgtatttatatattctcctattgatggacattaagttgtttccattaaattcatacagtttttaaaatttgaagttctgaataaaaaagcaaatgcatctcatttacataagtttacatatgtttgtttttaaacttgcagttaaaaagagaattatttggctttaaatcatatctttctaaataccagatgagtagcttctcaaacaaggaagaccgttgcattggctgctgtgaggcaaataaattggtgatttcggaattgaggtacaattttcagattctgcagttatagcaaatagaatgttttttattggtaattaagacccttaattggccgggcatggtggctcatgcctgtaatcccaacactttgggaggctgaggcaggcggatcacgaggtcaggagttcgagaccagcctgaccaacatggtgaaacctcgtctctactaaaaatacaaaaattagccaggcatggtggtggcacgcgcctgtaatccccactacttgggaggctgaggcaggagaatcacttgaacccgggaggcggtggttgcagtgagctgagatagtgccactgcactccagcctgagcaacagagtgagactccattaaaaaaaaaaaaaaaagacccttaattgaggaatttaaaaaatatacagaaaagctcagagaatattataacaggtatctgtgattccacaactaagaattgaatcttcttaaccaggattgattctccttaaaatttgtggtatttgttttaaatctgtttctccaaataaaaaataaaacattacaggatgaataatgccctttgatccttatgactagtcccatttttcccctaagtatccaccatcatgaattggatatatatttctctattcatttttgtatgtttacacacatgtacacaaatatgtaccgtatactgtgtgcaattttgctttttcactcagcagtatttaaaaaattcattcatattgagatagagtagattaacaaatggatttgtgtaattacttttaatagctgtataggattctgtcctataacagtgtcataatttatttgttcctttataggtatcttgtttctgttttctgttacaaacagtgctgcaaaggacatccttgtacatgttttcttatacatatatatgagagtttctgtagtatatattcctaacagtgaaattgctgggtcatacagtgtgtacattttcaattttactaaataccatcaagtttgtaaagtggctgaaccaatttataattctacagtggtatatgggagttttcatatcctgcctaaagagttgactaatattagaattctaattttttaaatcaacttgaaaggtgaaaaatagtacagtatgagtttttttatagaatctttctaataatttttcccttcttttcttttgtgccagaattaagcttgcaataaaagaggcagaaattcaaaagcttcatgcaaacctgactgcaaatcagttatctcagagtcttattacttgtaatgacagccaagaaagtagcaaattaagtagtttagaaacagaacctgtaaagctaggtggtcatcaagtaggtaagtatattgagttattttaataaattatattcagagttttggatgatagtttttttttaaaaaaacttttatttaaattttttttttaatttaagttcagggatacatgtgcagatttgttacataggtaagcttgtgtcatggaggtttgttttacagattatttcatcacccaggtattaagcctagtaccccttaattatttttcctgatctactccctccttccaccctccaccctctgatagaccccagtatgtgttgttcccctctatgtttccatgtgttctcagatgatagtttttaaagaacaaatttatcaactgtttggtttctattatcaaacatacttgataatctgttactagttgtggtctgataagacagcaaaagttatttcagaattattagactttgtatcattcgttaatgaagtaaaattgatatccaatagaacagtggtccccaacctttttggcaccagggactggttttgtggaagacattttttccatggaccagggacagggtcagggttggtttcaggatgattcaaacgcatgacatttattgtgcaatttatttatattattatcatattgatgttgaaataattatacaactcatcgtaatgtagaatcagtggtagccctgaccttgttttcctgcaactagaaggttccatctgggggtcatggcagacagtgacagatcatcaggcattagattctcataaggagtgagcagtctagatcctgcgcatgtgcagttcataatagggtttgtgttcctgtgggaatctaatgctgccgctaatctgacaggaggtagagctccagcagtaatgcgagcgattgggagtgggtgtaactacagatgaagctttgctcattcgcctgccactcacctcctactatgtggcccagttcctaatgggccatggactggtaccagtccgtggcccaggggttggggacccctgcagttaagatgcacccattttaatatacagtttgatacgttttgtcaggtgtttgtgttttaatgtttaactcttgttaccatcaccacagtcaagacataagacatctccaccaggatcctttgtactttttcccagttaacttttaggcttaattttctctctttttttttttttccaaaaaaaccacaaaacttttcttaaagtttagattattgattttagacctcttttcttttctcatctaagtatttaaggatagaaacttccctttaagcggtgctttgggtgtattccactactttttttaatgtgttgtattttcattttcattcagttcaaaatagttatctcttgtgatttcctctttgactcataggctgtgtgtgttttatttccaaatatttggaggtttttccagatatttttgtgtcattcatgatgatcagagaacatactgtataggacttcatttttaagaatgttttgagatttggtttattgtccagcgtatgatctatcttggtgaatgttccaagttgagaatactagtaattagaggtggtaataaatataatatgttatagattcttttacatcaagaacagagccaataaaaagtaaatagcctagaaagtgaaatattatagatgtagagaatttatgagaaatggctactgatgcaaatcttgaaggcaaagtgtatcttgtttccacatctgtgtgttctcatgtaatcatctacattatgctttttaaaagcacttctgaaggcttacttaccttggagtgggagatgtgtatgtttatagtggagaaggggcatggtcaagtaactacctctgataaccctcagtaatttttttgagacaggatcttgccatgttgcccaggatggtcttgaattgggctcaagtgatcctcacacctcagcctgttgaatagctcagataacaggtgccactgtgcctggctaccctcagtaattttttttaaagcatcactgaattctcattagctagtttggagagaaagacgatggggtcgggaaggattcactctttggagcttttgaacctgcttctgtgtgcagtacataaaaatgttcttaatgatctcaaactgtccaaataaattttatgattaccttcagtttaaggaaacagggcaacttaaaaaaaatttttacaatgatttctattaaaaaatggaatttaaaaggtggagaaggattcttacatttctggtacaaaggaatagtcttagctacctagaaaaatgagtgattcagaacttttctcctctttgttacgtatttaatttagagagcacattacttattctttgatttccttaatgaatgtctcattctctgtcccttttagtactctttagatcagaaactaaactttgtttatgactaaatctttcaactatttaagtaggtttttattcttgaagtcctattcagaacaattttccttttatgtttattagcagaaagcgtaaaagatcaaaatcaacatactatgaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaagtaagcttggaattagcttggtatatatgttaatttttgaactagaacaaaaggtattattttagggttttataaaaattatatgtttacatccagatttaaagtttttaaaaaatggtaccacataagttataaattgttttaaaattatatttggaaacctttgtattttaacttattaaaagttaaagttattaaaagtaggaaaaactgtagtgggtaaaagtctcaaatttggtggaaataatattgcattgcagcctattatttcttccatagtataagttaatatggttaatatacatttataaataaagactttggattatgctgttggaagaaaaggagtgataataaaggatttcaaattttagcaaaccccaaaccacctaggaagcctgtttaatatgcatatttctgggtcctgttccagcaatttctgattcagtatatatgggcacaagagtctgcttttttcttttctttttctttttttttttttttcttagagacagggtcttgctctgttgcccagtctggagtgtggtggtgtgatcatagctcactgtagctttgaacttctaggctcaagccattctcctgcctcagtcttccaagtatttgagactgcaggcatgtgtcactatgtccagctaagtttttttattttttatttgtagagacagtcgctgtgttgcccaggcttgcctcgaactcctggtttcaggtgatccccacctcagtatcccaaaatgctgggattactggtgtgagccaccacacctagccggaatctgtatttttattttttgtgtatttctgctgtttaaagagtctgtatttttaaacaactgcatgtaaacctgaaacaactacgcaaggaattacattctgaaaaggggataatgagtgttttgtgaatatcttgtcttcattttcactgaggacaggataagggtgcctcattaggtaattgtggaccaggaccacatgtgtatatcttatactcgatcttcaaaccagaggctgcagtcatctataggtacactttttaaatacctgctttctcagcttaaagtctatagccaaggctgaggaaaaagaactataagataggaacttatgttaataatgaagatggagatttagacagtttataactatggctaccagtttacttaggaaattgccaaatactgggattaataagttttttaaattacaaaaatagcacagtcttgttaatataaaaggggaaaaagaagaaaatgaaccattgataattctaccaccagaaataactgctgataacattttattgtacttatttcagtctttaacagctacgtaaaaatagattagggtattgtcctttttggatataggggtctgaattaaatgacttatgttttacatagatagaagaagtgatcctttgttttcagtatttgtttttcttcttaattgtcacttattttgtaaaatacttataattatgtgggttaaaaagttattcactttgcatcctaaatgtttataactgtaagtttgcccaatttacctagacacaatgtatttgaactttgaaagaggagcaggtgtttgatcttagaatgcaaaatcattacctttaaaaaataattttacatttatttcaatgtgttttcagatgacaaagaaatgttctcaacttttaactcttgagaaacagctggaagaaaagatagttgcttattcctctattgctgcaaaaaatgcagaactagaacaggagcttatggtaaaacttatctttgttcctacaaatttactgtgatttttaggcacttaatttgtgacagcacatttgttttagcatcattattataaaatatataggaaagtataaattctactaaactcttctgatcatttcttgtttatatttttaagttaataggcttatatggcaagttatccaagttttctctttttttttttttttttgagacagagtctcactccgtcgcccaggctggagtgcagtggtgtgatctcggctcactgcaagctctgcctcctgggttcacgccattctcctgcctcagcctcccgagtagctgggactacaggcgcccgccaccacgcctggctaattttttttgtattttcagtagagacaggtttcaccgtgttagccaggatggtctcatctcctgacctcgtgatccacccgcctcagccttccaaagtgttgggattacaggcgtgagccaccgcacccggccgttttctcatttttatcctaataggattgaagataatggtagttctttgatatgcttcttgatatttaaaatagtttaaatcttctcgtcttgataaagtatttttagccattttgttaaagtttgaagtataaactactgtggttctttaaagaatggagtatgacatatttaatggttgactaatgtacttttatgtaaaactgcttttcaattatactttttttttgagacaaagtctcactctgtggttcaggctgcagtgcagtggcacaatcatggctcactacagccgtgtcctcccaggcttccccctgagcgtccccagaagctatgaccacaggcgcatgccaccacatctacttagctaattttttgtatttttcatagagacggggtcttgccgtgtttcccaggctagtcttgaactcctggattcaagcgatctgcctgccttggcctcccaaatcaattatactcctttaaagtgttttgtgtttctaggaaaagaatgaaaagataaggagtctagaaaccaatattaatacagagcatgagaaaatttgtttagcctttgaaaaagcaaagaaaattcacttggaacagcataaagaaatggaaaagcagattgaaagagtaagtaatacatatttagaatatgagtgctgaaaagaaacttaaacattactagccccagcattttttattttgtagacgaggacacaaagatacacaaaagttagtggcaagagctgtaattagaatcccaatctttctgaataatttttcagtgctttaacagaatatagtatgccttctgtttcagctgtaatcattatttttgacattattaaagtaagagtaattctgtagactccatttccctaaaaatatcagttgcttgaagattgattgagaggaaaaagcagaataagagaagcactcttgaccttgggttaaaagtagaaaagaaaatttgagaccaaaaatgcaagacacagtaaaaaaaaatagatacagtagtccctgcttatccatgggagagacattccaagaccttcagtgaatgcctgaaaccacagatagtactgaaccttatatattttttcctatacatacatacctattataaagcttaatttataaattagacacagtaagagattagcaagaattctaataaaatcgaccaattgtaacaaaatactgtcataaaagttatgtgaaaacttgttctcataaaagtgtgttctctctcttatgccctagtgcctcctttgcactttttttttttgagatagagtctcgctctgtcggccaggctggagtgcaatggtgtgatctcagctcactgcagtctccgccttctgggttcaagtgattctcctgcctcagcctcctgagtagctgggattacaggtgcgcgccaccaagcctggctaatttttgtatttttagtagagatggggtttcaccatgttggtcaggctgatgtcaaactcctgacctcgtgatctgcctggctcagcctcccaatgtgcctggctcacgcagaggtgtgagccactgcgcccagcctcctttgcacttttatgaatgtaggttctgtgagtcatctttgagaacagcctagtttcgctgcaattgaagtcttgctttggatggtatcttttctccttagcttcttcatctctgctggaaatgtgacagcagctgcttcatcagcagacacagcttctccaataattttaatatttttcagtctaaccctattattgaatctgtgtaatcatcccttatttgcagtaaatgacttggtgtcacttgtttcaggggatctttgctgaagtcttaatatatactcaatattttctggtgcaacacattgcagtcagttggaacatgttttctgttaatgccttccacctacaaatttaatgccttttctattttaactaagcacttacgcattgtggttgtaacttttgtagtttgaggtacaactgccatacttgcatgaatttatttttcttcacaatttcatggatagatttattctttattgtagatcttagcaacctcagcatgcagttttttttctttcctcattaagtcaagaaccttcaccttttcacttaaaggaagcatgctatgtcttctctttgacatatccaaattggatctgcatccagatagcatcactactcttttgctttggggccattattaagtaaaataagagttccttgaacacaagcactgtgataccatggcagttgatctgataaccaagatggctactaagtgactaacgagcaggtagcttatacagcatggaaaatggatcattcttgtccagagctggacatagtgggacgtcatgagatttcatcacgctgctcagaactgcaattcaaaacgtatgaattgtttattcgtggaattttccatttagtattttcagaccagggttgactgcaggtaactgaactgtggaaagtgaaaccacgaataccacagggctgctgtaatttagatgagcttaacagaagaatggagcagacaagaggaaaaagacagtgaacttgaatgtagattaatagatattattcagtctgagcaacagagaaaaaattttttttccaagaaaagaaagatttataaaaatattgaacaaagcctcagagatatatggggaaggacctggaagatctgatattcttgtcttcagagtcaaaggagagaatgagattagtgcaggaaaatatttgaaggaataatgtctgaaaacttcacaaatttgatgaaggaaataaatttacaaatttaaaaaaatcaaagagaactacttctagacacatcaaaatccttgccaaaaactaaaacaaaaaactttgaaagcacccagagataaatgacactgcatataagggaacaaatgttaaaattactgcagatttctcatcaaaaactatggacataagaagatggaacaacattttttaaatgctgaaagagaaaaaaactgtcattctattttatatccaacaaaaatactctctaggaatgaaggtaaaataaagacattcttagatgaaggaccgcatagagaatttgtcaccagcagacttgttctaaaagagaatgctaaagaaagttcctcatggaaaaaaaatacctgagagaaacttgggacctcaggaataaaggaagaacaacaaaaacagtaaatatttggtaaatataggatttttataatatctatggcagttgaaagaagaaattataacatttactgatgaggtatattgatataatacatgtgacaacgacagtgtaaagggggaggggtaaaggggtctatattcttagtttctacattttgcctttttttcttcagccgttaagttcaggggtacacgtacaggaggtgcagatttgtcacataggtaaatgtgtgccatggtggtttgctgcacagatcatcccatcacttaggtattgagcccagcatccattagctattcttcctgatgctccctctctcccatcccactcccctataggcctcagtatgtgttgttcctccccatgtcttcgtgtgttctcatcattcagctcccacttataagtgagtacgtgcagtatttggttttctgttcctgtgttagtttgctgaggataatggcttccaactccatccgtgtccctgtaaaggaaacgatctcgttcctttttatggctgcatagtattccatagtatgtatgtaccacattttctttatccagtctatcactgatgggcatttaggttgattccatgtcttttctattgtgaatagtgctgcaatgaacatacacatgcatgtatttttataatagaatgacttacattcctttgggtatatacccagtaatgggattgctgggtcaaattgtgtttctgcctctaggtctttgaggaaatgccacactgccttccacaatggttgaactaatttacactcccatcagcaatgtaaaagtgttccttttctctgcaacctctccagcatctgttttttgactttttaataattgccattctgactggcatgagatggtatctcattgtggtttcgatttgcatttcttgagcgatcagcaatgttgagctttttttttgtatgtttgttgtccacatatatgtcttcttttgagaagtgtctgttcatgcaagtgatttcatttcttccttaaaaagagagaagctgaagacaatttggcaaaatacaaaaatctatgtaatttcaattatagtgtcacatgtatttaatatttaaaatgtttcaaaattttaaaatatttaatatgaaaattctgttttcatgtttagcttgaagctcaactagagaaaaaggaccaacaatttaaagaacaagaaaagactatgtccatgttgcaacaagatataatatgcaaacaacatcatcttgaatcactagatagactcttgacggaaagcaaaggggtaaaatcatccttataaaagtgctatttagaagttgactaatattttatgtctctataacttgcctttaaatctaatcaaatctgcatacttatacttttcttactgtttttaggaaatgaaaaaggaaaatatgaagaaagatgaagctttaaaagcattacagaaccaagtatctgaagaaacaatcaaggctagtatgctaatactttatttttctttctttccttttttttttttttaacagacagaatctctctcatttgcctaggctggagtgcagtggcatgatgataactcactgcaaccttgaactcctgagctcaagtaatcctcccacatgagcctcctgagcagctaggacaagcgtgcttcaacatgcctggctaattatttttttctatttggagacattcttgtggcttttttacttttctctgtaaattgtaaacattgtacagataaaaggcaattcagagctgacgatttgatctgactcaatgaacttagttcctttaaatgtattttctttagagcgaattatgatcttaattatttgatagttaatcatctagtttgcaggttatctagcctctttttgtcttaaaacagtttttataaccctaaaaattgttttaaattttagctataattgctacttattaacattaccaaaaaaaaagaaaattaccagaggaagtggaggaagagaaaactaaaagtgattcaattttgcttgtttttatcagttggcttgtaagattaattgagataaagccagaatttctagctaaaatacggctttctggctagtatatcttcatggttaaaaacatgggctttgttgttaaattgggtttcagtgtggcttcaagtgcttacccactcactgtaaccttagccaggttatttaactctttgaactttaatttcttcatccacaaaataggaatgacaataccctagaagagcattagtgtgagaattaaatgaaacagggtatataaagtgcttagcacatactgagttgcccgaagttttgtaactaactgctatatatttagtattttctcttgcatttttagtgttaaacgtaggtccaaatatgctatgacgtttattctgtcatatgtagcttgaatataaaagatttgctttaaagatacgatgttattttttccctattctgtttttaattcattttgtgactgtgtatgcccatgtagacatgtgtttattcataaatattcctgtagtattcaccaaaactcttaacatttaatgcaatgtcagttcatttccctgtgtaagaatagccccaaatttcattaatattaaaaaatgattactgtacagagattgtaggcatgaaatacttttattagataaaactcatgcagccacttaactcctggttttcattaaactacctaacgtaactgggcagtcatctggtgaggtatttccgtgtgttaatagccagatatgagatggaaaagaaatcagcaaaagaatgaagtatgatgttggattttattcctttaacatctttagcaggtttgctgtttggggaaaaatcaaaatgagtaagaaatatagaagccaaattcctatgatttaagctatattgactgattctacacataagttatttatagcagcaaaatagaagcctgaagtctacttctctcctgattatgtcattactaccttcctttcatgacttttgttcatgtctctcaacatgcctcaacttgttctctgcaaaagaaatatgaatttttttatctataggaaagttataagggtcagtttaaagttgtatcactaagctaaaaggttgatgataaaattctgaactggtaacaagaaatcagtaaattaaaccagttgttacctgctgttaaatggaaaattgaaaaggtgcttattagacttacagattttatttcttttgttttgttttcctcttattttctactttagattccccaaaacccccacaaaaaagtcttaaacataaaagaagagtttaccttctttttttgaagatgcatagcctagggccctatctggttgtctccagattgtgcacctgaggagcttctttggttcagcagagtggtgtttgtttttgttttgatttcatttatttatacacacacacacacacacacacacacacacacacacacacatttgcaagtggtttgtatacaatgcaagatgtttatctgtatgagattcagactttcaaactctgttcaaataagaaattcaatagagtagcggatgttttgggtttttaattagttttttattagctataattgatttatttctaatttattttttaaaatttcaagcccacaaaaaattgaaaaaatagtctactcctcacctagattcactctctgttaaactctattaaactctaggtacactcactttatctctctctacacatacacatgcatgcatgcttgtgtgtgtccctaccaacccacctcccttttgccaaaccgcctgagagaaggtacggatgtcataatactttacccctttaatacttaacatgcatctcctgtgaacagagaatttcttctgtatggccacaccaccactacactacagagaaagtcaacattaagttagtaatatcattcaacattgtccgtactaaaatttccccaattacttaaaattgtcctttatagccttgctactcaaagcatggtctgtgaactagcagcatcagcatcacctggaagctttgaagagtatctagccatgccccagacctgattcaccccagtgaatcaagtgtgatgacacaaaatttaaggagacactctcaggattatataccttatttaatttgatgactgccagatctcattattttaagggcatacattttcattgataattagcaaactaactttggggtgagtctttgaggccatgtgaatatcctgttcctcaataaccttataatcaatggctttcatatctaatgatgaatcttgcccaaatgagttattacactgttaactattaggtagtgatattctgacagaatcataggttttatttattttctctgtgtgaaggatgatacaagtcccaatgcccattctctttcataaaaaagaaaatttctaagtatttataattttcataaaacaaatgttaattagtcattcagaattacagattttttagctgttaatgatttcatatacagactataagggtggtgttcaaaaactgtgtatcttataagattccctttttagaaataagagtggcaaagataatttcatgatgtagaatagaatctgcaagagagaatgtttttctcgttttttcatctgctaagaaatctaagatttctttcactttttcaagactgcttactagaacattattagcattaagaggaagaacaccattgagaagctcaaatttacaataaagaaaacaaggagcaagacaagaatcttaatagatgagatgtggagcatgtatgcaatatgtgcgccttgaacgaaaagtaccaaatttgagttgctctttggtattaaggtagtaaagcagtggcaactatatgaacacttggaccaagttaaattgctgcctttctgaaaatattttcactgtttcaaagcaaagaaggtttcacttctttttttctagctgacaaattattttcttagtaacttcagcatttcaaaatattctcacttaaggccaggcaaggtggctcacacctgtaatcccagcactttgggaggccaaggcgggtggatcacctgaggtcaggagtttaagaccagtctggccaacatggcaaaacccactctctactaaaaatacaaaaatcagcaagacatggtggtgcatacctgtaatcccagctactcaggaggcggaggcaggagaattgcttgaacctgggaggtagaggttgcagtgacccgagatcgcaccactgcactacagcctgggctacacagcaagactttgtctcaaaaaaaaaaaaaaaatctcacttaagcatcattaacagtatgctagtttgtactcactttcctatttttcttattcaaggaggcttaagaagtaggtttaaataccacttaccttttaaagaaaagtttttagagtgtttggcctacaggttcttgacagttggccctagtttatcttgtcaattgtggctcccaaataaccatttcctacaaattcatcttcttactaccctaggcttttgccaacttctcaccactccctttcgcagggccttgcttctgagcatactcccttttcctggaatgcccttctaaacttgtccaactcttgtttattcttcaggattccataccttggttttctctttggtttcctcatttgcaatgaagaattagtttactcaataaatatcttctataatggcattttatatcctaagtaggactgtatattcactatttgaagcagtcaggtaacattaggagataaatctgtaaaatattgagtatatcgttttgtgttttttttttttttttgctttttttcctgcttaggttaggcaactagattcagcattggaaatttgtaaggaagaacttgtcttgcatttgaatcaattggaaggaaataaggaaaagtttgaaaaacagttaaagaagaaatctgaagaggtaaattaacatttactttatatatagcatatatttcaagtgattttttttaagaagcatgagatgtaggacaaaatatatatatatatatatatttcttttgagacagcgtctccccatgttgcccaggctggagtacagtgtcgcaatcttggctcacttgaacctctgcctcctgggttcaagcaattcttgtgcctcagcctcctgtgtagctaggattacaggtatgcactaccatgcctggctaatttttgtatttttagtaaagatgggatttcaccatgttggccaggctggccttgaactcctggcctcaagtgatccacccacctcggcctcccaaagtgctgggattacaggtgtgagccactgtgcctggccaaaataatatcttttatgtatctgatataaaaaagtatttccaataaaatgtaaattccaattttattttctttaaagagcaaacatttcaatgcaaaatagaatataccttaaaattctaattcttttatttttagggaatcagaagaataaattattaatattacagtcattctaatataatattacatgacaccttgaacattgttttagatttagaggtttaaaattcttcaagaatttttcattttgtttttgttcttgttgtctgtaggattgagaattaactttagaatttcaacttttttaagataagtttctcagatactgcattggaaaccttttttttttttttttttttttgagatggagtcttgctctgtcgcccaggctcggctcactgcaacctccacctcctgggttcaagcaattttcttgcctcagccccctgagtagctgggactataggcgcatgctgccacgcccggctaattttttgtatttttttttttttagtagagacggggtttcaccatgttgcccaggctggtcacaaactcctgaactcaggcaatcctgccaccttggcctcccaaagtgttgggattacaggcatgagccactgcacccagacttggaaacttttcttgaacatcttactcatctctgtatgctcaatttgtagcactttactttggttaggcactcactaaacatttgctcaaatggataatcgtaatgaagaatgtatttgttagaatttataatgtatatattttaaggttaaaatttatttttagaaatcgttcccaatgaatcttcatcaaggttgacttttggccactcattgttgctcacgcctataagcccagcacttggggaggccaaagtgggtggatcacttgaggccgggagttcaagaccagcctgggcaacatggggcaaaaccccatctctacaaaaaaattaaaaacattagccaggtatggtggtgcatacccgtggtcccagctactcaggaagctgagatgggaggatcacttgagcctaggaggtcgaggctgcagtgagctgtgatcacgccactgcactccagcctgggcagcacagcgagaccctatctcaaaaaaaaaaaaaaatatatatatatatatatttatttatatttacatattagtcaagatcgatttgactatatcagaaaggtccaatgagaaaaacagaagcctttatatcttttaaatagagcaaatttatacagagaattagatacacaggtgatgaaagggtagagaagccaaacagtataccacagtgactcagagattattataagcagggacccgctaccattgttaaggttagaggaacatcaggaaaagatggtgtgatcatagtctagaagcagggctgcctatctggagctggggccaaagaaaaaaggtctgtccaataggaactggggcaatagaggaggagcactgcagctactggccattcccattggccaaacctatttgtaatctagagggcaaaggaggccaagaaatgcagtttcctgcaatacacagagcagaacaggggaaagccataggtaaatctaagagtaaataatgtagttgaccagcactccagacttaggtgcatcaagtaattatatagccttagaagtttaaaaaaaaaaaaaaaaacttcagatttaatacggtcatgtcttcttctgtctaccttcccttatgaaggtttttatagcatctttgacaggcatatatttttctactccaatacatagaaactaaatcatctaaactgtatgtacttggatttttaaaaataggaatgtccttttttttttttactatgatcatctttaaagtagtatacaaaatacattattttggcatttattctactgcccatacccacactccgcttcataataaatagacttggcagagatggaatctacctggaggtaggcagcatttgtaacaggagaatctgttgagctttagactttgcattcatagaaacaacatcagagactagggtggataacagatatttacacacaaaataaatagaacgattttttttttctttttttgagacagggtcttgctttgtcacccaggctggagtgcagtggtgcaatctcggctcactacaacctctgcctcccaggttcaagcaattctcctgcctcagccttcccagcagctgggattacaggcatgtgccaccacacctggctcatttagaatgatttttacaactggaaatacatacctaggctcaaactgaattagaaaccagaagtggtaatcaggtatatttgaccagactagggagtaagtaaattagaaagatttgcaagctcatttattgccgctcaatccttagctcaactgcacatgcattggcttgcttacttaaaaggtcatctgtcacatgttcatgtgtattgataaaaaacgtggagaagaatccaagtactaactgttgacttatttgcctttacagcaaattatgtcttacagagaaaattctttctaatgttggttaatataattaacaccttgtaacagcagagttgtgaagttttcatcatatatagctacattttagaaaatctgatttgagtaatagtgcatccattccgttaataataggtgatattataaagatgttcttatcttttaaatcagggaatatgccccaatcatataactcactgaataattaagtggccctagggcatataggtagaaatttagccagttgtaaaaactacatgttgattacccgttgcaaaaagctaatatatgttcctctgagcttttgcctcagccacatattcttttccggatgttgaaataaatatatttatgatgaaaataatactttggggttctgaatttttggaagatatttaatttcatattaaaatgtttttaacaatgcttttaaaataataaagttatgtgttcatgcaaaattacattgtcaacatgataaaagaaactcaatacaaagtagatgcgactaagcctaaatgttttctgcataaagattttattcaataaaatcagtcgtttcattgataaatatcttcatttaaatggatggacttagattttgagaagctggcatcatatttctgcattatattttatttttaagcaacaattatgagactttctgctttgggtacatagtgatactagataaagttaagtgtaaggtagattttatcatctaaattctactttcttatttacttcaattataaaatattaagtactctgggaatataataatacattagtagaaaatatgatgtaaaaacaatttgttctgtatttacttttaaactaaagccaactggccaggcacggtggctcatgcctgtaatcccaacactttgggaggctgaggcaggcagatcacaaggtcaggagatctaacacggtgaaaccccatctctattaaaattaaaaaaaaaaaaattagccgggcgtggtggtgggcgcctgtagtcccagctacttgggaggctgaggcaggagaatggcgtgaacctgggaggcggagcttgcagtgagccgagatcgcatcactgcactccagcctgggtggcaaaggaagactccatctcaaaaaaaaaaacaaaaaactaaagccgactggagttaaaggtcagtacaatgaaatgtcagtgtaagtttgatagatatatgttctattttgtaaatatttgtgataactaattttagctatttcaatatatgtaattgaaatgtcagtgactagattactgaaataaaattttgttgttattatgtggtaaggctttgtgttttggttagatcttatttttttcttctgttttgtcttattttaatattttgtccatttttttctctgaataggtaagtatgaaacaggatgttccaataaagaaaaaaagagtatttaaacctgtcttgcaggcaagtcagttctatctaaaataaaccagtgcagaagtgtgatctgcaggtttggtcaggagctaagagagaaaacaaaacaggtgatactgacacatatttacactaaattattttcatgcagacagaattaaacaaaacatatttgcatgaaaagggattataattcaggattagagatcagttagttgcctgtgatatccagggttacttcgagtatacaacatcatcatataattaagaaatctgaaatctcagagcttctcataatgagcaaagaatatttggccctgaaggccttaatgttcacctgctggatagttagaaaaaagaagcaagtcgtgattctcttccgctatttactataaggagtttaaatttccttttggaatgatatttactggaaagattctttgctttaaaggaatggctttattttccttcacttaaaaaatttattatataagcaacaacaagaaaacttctaaagaacatttacctacagcccattctctaatacttcagttttcatttttctgtttgcatgtatatttttcaaaattatattaatgaaatgtgattttttaactttataaatttttatgttagctgtctttttaattattttaaatggttgcacattttaaatcacattgacaatcatcacttattaaatcttccattcactttggtaggagatgaagaatattataaaatatattttaaattatgtttcattgttgatagtattttaaaaataatttctgctggcatatttttagaatttggattactaggacaaagggaatttatttttcttcttaataggtgctcttggataaaagtatcttaaagcaattttggagaccatcatattcaagtcctaaatatatagagtaattagtgaaatttcttagttgttattgtcattcctttatgtgtttttttgtagcataaatattcagcagtgctttgctgggatattattatataaacaacagcaataatagcaacaataacaataaatagcaccaaacatcatatagtgcttttatggctctagtttattattagaaagggtgaaagaatcaggtgaagtgcagataaaaccatggctgcctatgctgttccctccttctgggagaggtcagacagaacatgctcctttttatagcagtaaaatgtggcaatatctgtttctgcctagggaagcctatttatgactcaaagttcagggtttttattgggggcttgtcacacaggaacaatgaccagcctacaagtatcaaaaattccagaattctaaaggaaggcatgtttcagtgccccagccaggcaaaacaacctcatcacttaggaacatttttaaagccacatttccagacaccaaccaagagcaatcctataagcaagcccttccagtacatctccccattagaaaaatgaatactgtccttccaatgacaaactatagacatgaatgcaattgtcccacatgacaagtggatggttatctaataaggaggacagctttgacattttattgccatttatttgaaacattgcattgtattgagagatatatatatatatttgccaggtatattgtttacagaaagagctaaagataaaaaatcacagtcttcaagagacttctgagcaaaacgttattctacagcatactcttcagcaacagcagcaaatgttacaacaagagacaattagaaatggagagctagaagatactcaaactaaacttgaaaaacaggtatatattattagcccaagattgttttatttgtatgaaatagaaatttttaaaatcatgaatagatttttcgttagttttttaaattgctgtttggccagatgccgtggctcgtgcccataattccagcactttgggaggctgaggcaggcggatcacctgaggtcaggagttcgagacgagcctggccaacatggccaaacctcgtctctactaaaaatacaaaacttagccaggcattgtggcacatgcctgtaaccccagctactgaggaggctgagacacaagaattgcttgaacccaagaggtggaggttgcagtgagctgcaatcgtgcccttgcactccagcctgggcgacagagtgagactccgcctaaaaaaaaaaaaattgctgttaaacctcaaggattttgcattataagaaatactctatactgatattgtaaaataaagttctattcctatgtaatctgacctccatctcttataccatgattatatgtttgctgttccatacaatttataattcatgtttctttattcaatctctcttcttgtacctaatctgaatacctataatttttcctttttggatcaggacatggtatgtgatattccttaaagaaatggcaaagcagtgcactaaaagaaaaatcccaagggaaaatacccctgaaagttctaaaattaaaaattattacttacttgaatgtaagaattctagagaattttatactagaatctaatctttttcctttaattcattactgaatttatctgaattctttagatattttacattcttattttgttttttctttgaaaagaaatcaaatttacagtaatgtgtaaattagaaaatgatcgtcccctgtaatcttactgtattttccttttttgtcattttttcggtcttttatctacttgttctgaagtcctcctcagcctgtccagtggaactaaagtatcttcctctcactacatttaaacacatcaggcaggtattctgtattttttttttgagacggagtttcactcttgtcacccaggctggagtgcaatggcgcgatctcagctcactgcaacctccgcctcccgggttcaagcgattctcccacctcagcgacctgagtagctgggattacaggcatgtgccaccacacccagctaattttgtatttttagtagagacagggtttctccatgttggtcaggctcgtctcaaactcccttctctggtgatccacccacttgggcctcccaaagtgctgggattacaggcgtgagccactgctcctggcctctattttttttcaagagacatcttcctgtgactctccatcccttttgttaaaatttagacctactgcttgctatgcctactatacagcttcatcctgaagcatttcttcttctcatctatgtttgattcccactgcctacatcctttgtcattgactctggttcttgcaggattgattatgattcttgttcctaactcacttctataatggttgtatggttttttctgttttgttttgtttttttttaacaagttcacttttttttcttttttttctctttttgagacgtagtctcactgtgtcgccaggctggagtgcagtggtgcgatcttggctcactgcaacctctgtctcccaggttcaagtgattctcctgcctcagcctcccgagtagctgggactacaggtgcgcaccaccacatccagctaatttttgtttttttagtagaggcggggtttcaccatgttggccaggatggtcttgatctcttgatcttgtgattcgcccacctcagcctcccaaagtgctgggattacaggcgtgagccactgcgcctggcctcatttgtattttttatttggtgattttctttgtgatcttgttttaaaagattttgtgttctcattagcttcactgaggtctacagaagtttatatctaaaaatttcttcagtatttggagtaaatttttgacttggtattccttttctgcctttcattcatattacactgtgcataggttccattttgcatcttcagatttctctatttaattaagaattgagtaggtggattttccttggttcctttccctttttacctgggtactgttttaattttcttcttgaaacttgaggtggaggggtggatattaatggggttttcttgttttgttttgttttgagaccgggtcttactttgtcacccaggctggagtgcagtgacatgatcatggctcagtgcagcctcaacttccctgggctcaggtgattttcccacttctgccttccaagtgcataccaccatgcccagctaagagtgtgtgtgtgtgtgtgtgtgtgtgtgtgtgtgtgtggcttttctttttttttcttttttttttttttggtagagacagagtttcaccatgttgcccaggctggtctcgaactcttgggcttaagaaatccaccctccttggcctcccaaagtgctgggattataggtgtgaaccaccgcacctggcaagatattaatggtttatgatctatatttagttcttcagtgagggattttagaagaacgggggatatgcaggtcagagttgagaggttaactttgagaccacagtcatataaatattcatgaagacatggagtgactgaaattacctagggagagaatatagaatgagaagcaagaagattgacttggacagatccctgagggatgtgatacatggaagccaaagtaagtatttcattaaggaaggaatgaatgttgctgtcatgggctactggaatcagtgtcaagtaaaatgaaggttgggaaatgtccattggaattagcaacttggaagtcactggtgttgtaatccctgtttctgtggaatggcctctggctatgggttgaagaatgagaagtgagacagtgatacaacatgcatagaaaactttgagaagttgggctatatatgggaggaaataaagggtagtaggtagagggaggtcaaggtctgaagaaaagctttttacagtgggaaagtcttttaacatgtttaaatgctaatattaaaaaaacagtagagagactgaagatattggaaagaggagatagtagtatgaagttcctgaaaaaatgaataggaattgaatccacaacacctatgaagcagtttgatttatataaaggaggaagaatacctcctttattgtagtagaatagaggaagaatgaataggaacagattcaagttaagatgggagcaaatgcaaattagcatttgaggtcatgtggaaatctaggaatctattgagtgagccaattcgtgaagaaaagaaaggagcagtatggtaagagaagaaagggcatttcaaatggggacaatgaaaaggggaatatttactatcattttgttcaattattttaacactttagtgttatgatgtggccacttccctaaatagtaatatgtatgtgaagtatctttattattagaaagtaagccttgctttttatattttccaaacattacttcttggtctatatgttgatttttatgatacatcttgaaactgataagctaggttacatatttataaaagtatttttcttctgaatttaaaatgtttactgaaaactgctttacaaggtgtcaaaactggaacaagaacttcaaaaacaaagggaaagttcagctgaaaagttgagaaaaatggaggagaaatgtgaatcagctgcacatgaagcagatttgaaaaggcaaaaagtgattgagcttactggcactgccaggtaaaatgtgaatatgttttatttaccttcccacttcaatatcagtggtatctgagttttgaaatcagataatgttcagtggagcatttgcttgaggaattaatgtctccatagtctgtgttcctattgcattttgtttgtatttccttcatatctctcattatgctttttactgtattacagtttaatgcttttaaccttcctactataagtttcttaaggcaaggatcatacctggtttattttagggtcttacacaacaactggcacagttccttatacctcataggcactcagcaactgttaattgtgaataacattaaaagttgtaggcaaaaatgtaaatgtactcacatagaggaaactttcaggcaatccaattatataggggaagaatgacaatataaaagtggttctcagccttgagtgaatattaaaatcacctcaagagcttgtaaaaaaacatactgatgactgggtcccacttttagattaaataaaacctaaagattctgatttaatttggctaggctggtcccaggcatcgatacttaattggtcaagaaaggaacccatgagctgaaagcagtacccagcctcttcagatctcttctactttgttgggaagaattgacataatttataacataatcagcccacccttctaccaacaggagtcaagagtgaacttaggcactggcactaaaaccacatgtccccaggttccctctcctccattgacaggggtcctttgtgctcagaggagcaacttgcttcctcagatgtctgtcaccctctcagcagggttgagggcttcccaagtttaagactaagaccaaagtatttcacaccttctttcttccattgacagatgttctactcactaacatggcctcaccactggtgtccaccttgagtctgtgaagactgactgcattatcactttatccttgtttatgccagataccacaagaaaccctagatttccaggtcagctctcatatctcacactaattcccaaaaaactctccacacattctgtttctttctccaaccccatcccaacttctgaaagacttctactgtgccttttgaacttcataatccattctctgtattcactactttttcttttctcttgctgtaatagaaacctggccctcccctaaggacattgcttcttcccctgtagccttctaaagtaaaaaacttttccccatagctcttgtaccacagggtccaggcaaggtgtgaagtatatactatacttggtgaacctcatgccatcagaacccttactggtgctgatttctttagacggcctgacttactgttgccctctccagcatcacttctgtcattcttcttggggatttcagtacacctctgaagctgatccttctgacaccttggcttctcatttttaacaatttctgtactctagtgatcctgatctttaacatacctcagccacttactcccatggaatttatcttgtgctgaaaatttaaatcaaaaccaaataacattttttggtagaaattttctaaaatgtatattttcttggggtttttactttctctgggtatctcagggttatcattatatacatcatgctaaaatgtagtgataccctaatgaaactttgaggcatatacagttctgttttttataaaatgtctgtaggctgctaatgctttttgagtccttgtatattttctataattttcccctaactcctttgctgacaagccatctgctcatggctctatgccaatctcttttgattattcttttctaattatctgttttatatctactttaatattagagctaattggtcaagctaaaaattatttacttgggattttagaaatgtaaaagtgtcattagcactcatctaatctagtacttaattggtctatggacatatttgaggatctggtaaaaagctttagcttgtcttctatacatagatgtatacatgtacattatacatgtataattttgcatactgtttcaggggttttatagttttccttaagtttactcatggacttccaattaaaaaactcttgaacaaatccaaatttgttgaagttttatctagaaaagaaatgctcctacttgcaaactcaatttagaaatttcaaagatcaaacaacagaaagtgttgacacaaaggaacatgaactcttcctaccattgagggtaacattaacaattgtttaattagtaaatatcactttagaattaccaacaaagggacttaaaactggctcttagtatgttgatttgtctgtaggggagctgccgtattagaataagttcaggactgacaaagttagtaaacctggccctatcactattaacagctagttgtattatctcagacaactcacctagtcttcagtttcctcctctgtaaagcagggaagttgcactagtctaggaatctctagttccttttaaagctaaaaaaaggatagaaccaataataaaactgagtaaaagcaattgacttggctctccagtgagtaatatggtttttatggtgaataatttgattgtttggcttatttattttctttgttgctaataacaaaaattcctagatgaatgaggtccttggatattttcaatacatgcaaagctaaagttaaatgtggttagagtgaaaagaatgctaggcttgttaaatattaccaggtagtagtagtaaagttgtatttagtggtatgtaatgtgtaaaggaatagtttttagttggagaatttttaaaaataggtgatttaaaattccaactagatattttgctgatatttgtccttatataacttgcaggctttttttttagtcagagacaagttagttggttaagtttctaaattacctgttttattatttgtttttaattaggcaagtaaagattgagatggatcagtacaaagaagagctgtctaaaatggaaaaggaaataatgcacctaaaacgagatggagaaaataaagcaatgcacctctctcaattagatatgatcttagatcagacaaagacagagctagaaaagaaaacaaatgctggtaagcaagtggttagatgagtatagctgcctatgtatttgtacttaacgaagtgaaataatgtgagaatttgagatggtggggctggaagggaaaataagtggtattttgcctctcgtagatgaatataattgaatattcttaatatatacaaagtttgtaataaatggtttacatatagttataaaattattctctcctcttaatagtaaaggagttagaaaagttacagcacagtactgaaactgaactaacagaagccttgcaaaaacgggaagtacttgagactgaactacaaaatgctcatggagaattaaaaagtactttaagacaactccaggaattgagagatgtactacagaaggctcaattatcattagaggaaaaatacactactataaaggatctcacagctgaacttaggtgagttaaataataagaaattatatcacagttataagtccttggataatacaataaaatatgttgttgcattctagacgtctaaatttctcaactgtctttggctcactttggctcatcccagccagcctatcccatgccttatctaactaattcagctgtctttgttggccgccaaaactttcatcctcagtctttagaccattttatactagccctagtggtaaaaaatcattgggcatgcatacagcagtggctaacagcaggaggatattaataatgataatattgttctttgtattaagtccttattttatgctaggactacgccagggacttcacatatgatctcactcatttccttacaacacacctattagaaacatatatcacctttttaatagttgagaaacctgaggccttgagaaaaataaaatgccccaagtcatacaggtagtagagtctagagaagggagttaaacacaagtctgtccaactctaaagtctgggatcttagattagcagtataacataaactgttatgctgacacacatgtatagtgagtggaggtgtacagccagattagagccaaagtatgagaaataggttcagaaaaggaaaatagaattacaaattaggatgtaaaatgtgaaataaaagaacaggataaagagcagcaagataacccagaaacttagatactgtaccacagaattcagtgtagggcctccttctcttctgtatccacaaactcatccttagtaaatttcatgtagctttaaatactatgtgtcagacacttccaaacccatttctccagtattgaccttttcctgtaactccagattcaatatccaactagttgttacctccattcggatatttttaagaggcatctcagacttagccaaaataggactcatattttctcataaccctacccttctcctaactcagtatcatgcagttgctcaaaccacaaatatataagatttttcttgttctctctttccatcccttttttcatccagtgtattagcaagccatgtcaactttatttccaaaacatatatatatattttttttcagacagattcttgcccaggttggagtgcagtggcatgatctcagctcactgcagcctccacctcctgttcaagcaattctcctgcctcagccaccaagtaactgggattacaggcacctgccaccacgcctggctaatttttgtattgttaatagaggcggggtttcaccacgttggccagactggtcttgaactcctgacctcaggtgatccatccacctgggcctcccaaggtgctgagattacagacatgagccactgcacccagccccaaaacacattcttaaatccattgatttcgtggcctcttttctgttatccttagcacaaagcatcatctcttacctggtctgttgctgtggcttcctagctgggctctctgcttacaatcttgaccccctcccaacaatccattttccaaaaatagatttaagtttattatttaaaacataaattagaccaggcgcggtggctcacgcctgtaatcccaacactttgggaggccgagacaagcagatcacaaggtcaggagtttgaaaccagcctggccaatatggtgaaaccccatctctactaaaaatgcaaaaatcagccaggtgtggtggcaggtgtgtgtagtcttagctactcaggaggctgaggcaggagaattgtttgaacctgggaggtggaggttgcaatgagccaagaatgagccatgatccattccagcctgagtgacagagtgagactccatctcaaaaaaaaaaaaaaaaaaaaaaatagatcatattgcttacctacttaaaccttctaatggctttctaaaaccttcagaataaaatccaaactccttcacaaatgaaaataaaaactacattgatatatcacttcataccaaggatggtcatttttaaaaaccaaaaaatggaaaagaacaagtgttagcaagtgtagaaaaaaaatgaaaccctcattcattgctggaggggatctaaaatggtgcagccactgtagaaaacactttagccttcctcagtaagttgaacgtagaattaccatatgactcagtaattccactcctagttttgtactcaaaagggttgaaaacagatatctaagcaaaaattgtatacaaatgtttacaaagtaagccaaaaagtgaaaacaccccaaatgttcatcatcagatgaatggataaacaaaatatagtgtcttagtccgttttcatgctgctgataaagacatacctgagactgggcaattcaccaaagaaagaagtttaatggactcacagttccacgtggctggggaggcctcacaatcatggtggaaggtgaaagacacatctcatatggtggcagacaagagagcttgcgcagggaaactccgctttataaaaccatcagatctcttgagactgattcactctcatgagaacagcatgggaaagacctgcccccatgattcagttacctcccactgggtctctctcacaacacatgggaattcaagatgagatttggatggggtcacagccaaactgtatcattctgccccggcccctcccaaatctcatgtcctcacatttcaaaacaaattatgccttcccaacagtctctcaaagtcttaattcatttgagcagtaactcaaaagtccacagtccaaagtctcatctgagacaaggcaaatcccttctgcctatcagcctgtaaaatcaaaagcaagttagttacttcctagatacagtgggggtacagacattgggtaaatacacccattccaaatggtagaaattggccaaaacaaaggggctacaggccccatgcaagtctgaaattcagcagggcagttaaatcttaaagctccaaaatgatctattttgactccatgtctcacatccaggtcacactgatgcaagaggtgggtttccttggtcttggcagctccacccctgtgactttgtaggctatagcctttctcctggctgcttccaccggctggcattgagtatctgtggcttttccaggctcatggtgcaagctgtcagtgcatctgttattctggggttctggaggatggtggccctccctcttctcacagctctaccaggcagcgccccagtggggactctgtatgggggtgcccaccccacatttcccttccacactttcctagcagaggttctccatgaagccctgcctcagcagcaaacttctgcctggagaaccaggcctttccatatatcctctgaaatctaggtggaggttcccaaacctcaattcttgacttctgtgtactcacagattcaacattgggtagaagctgccaaggcatggggcttgcaccctctgaagccacggcctgtgctctatgttgtcctttttccgccacagctacagtgactgggatgcagggcaccaagtccctaggctgcacacagcgtggtgaccctggatcccacccatgaaaccattttttcctcctaggcctccaggcctgtgatgggagaggctgctccagagacctctgacatgccctggagacattttccccattgtcttggggattaacatttggcttctcattacttatgcaaatttctgcagccagcttgaatttctcctcagaaaatgggattttcttttctatcacactcaagtcacctctggagtgctttgttgcttagaaatttcttccaccagatacgctaaatcatctctccgaagttcaaaattccacaaatctctagggcaggggcaaaatgccaccagtctctttgctaaaacttaagagtcacctttgctccagttcccaacaagttcctcatttctctccaagaccacctcattctggactttattgtccatattgctatcagaattttggtcaaagccattgaacaagtctctaggaagttccaaattttcccacattttcctgtattcttctgagccctccaaactgttccaaccctacctgttacccagttccaaagtcgcttccacatttttgggtatctacagtagtgccccactttactggtaccaatttactgtattagtgagttttcacgctgttgataaagacatacctgagactgcacaatttacaaaagaaagaggtttaatggactcacagttccacgtggctggggaggcctcacaatcatggtggaaggtgaaaggcacatctcactggtagcagacaagagaacttgtgcagggaacctcccatttttaaaaccatcagatctcatgagacttattcactgtcacaagaatagccaaggagagacctgcccccatgattcaattacctcccactgggtttctcctaaacatgtagaattcaagatcagatttgggtgggaacacagccaaaccatatcatatagtgtatccatacaaagaatattattcagtcataaaaacgaatgaactactgatacatggtacaaagtgcatgaactttgaaaacattatgctaagtgaaagccagacacatgttgcataattccatttatatgaaatattcagaattggcaaattcatagagaaagaaagattagtggttgccagggactaggggaagggaaaatggaaaataagtgctaatgagtaggaagttctttgtgggggactgatggaaaaatactggacatagatagtggtgatggttacataacattatgaatatacttaatgcttctgaactgtgcactttaaaatggttaaaatggtaaattttatattatatgaattttaccacagttaaaaaaatccaagttccttatcttgaatacaaagccttatgtggtctggttcctgtccttgttcctgacatttttcttatactttacacttaccaagttttcttctaccatggaaccttggccatagctgtttctttttactggaataacagttacatggtcagcttcttcttgtccttcacattacttcagagagaagccttctctgactacccactctaaagtagccacccagtcactacctcatcatgcagttaatgctctaacatagcatttaatattatatttttcttacttaggtgtctgtcttttcttctggacctattacaatgtaaactcagatcagagacatttatcttttttactattaaatccacagcacttagaaccctggcatataggaaacatccagtaaatatttgcaaaataaataagtgaatgaaaacatgaaagatgtaaacagtgaaatcttaagttctagctaacagatgaattgtggaagctccgctatttgcatagatagaagttagagttttctttaatttcatactatttttagaatattagttttagccttgtgttatatacctcttgagacttttagaagaatattaaaaacaactcattaaagaagttcaaaatcttcttttaaaaattagtacccttatcagtactatttcatatttcagactggaaaatcatatgaagattttcaagatcaacattttcaacctttgtcttatcagaacttagagtttcaaattattctctgatcacaggcttcactttggtaaaagccttaaaattgtgtcagtattaagcattttataatataaggttatacataaattagggtttaagagggcttagaatttgtaatatttttatattagatttaagtgcttttttatatgtaaggcatcgttttgagtaacatcctcatgagaaatactatggttaaatgcctcattcaattgtaatgaagtcacaattgttacatgtaaaagactttgaaacactcctttgatctgtgtatgaaaaaatgtggatatgtatttttaaaaattcttataatcattcaatcttggagtcctgggagtgttttagcaattagcttaaattatctgtaataccacagtgtgagttaacttttacccttttagaataccctttattaaattaattgtattgatgtcaatctttttctttatctattattccttaaatttgaccctttcaatctgacttgattgcatatattattttgcttttaatttatagaagaggtaacctggttgacctaactttttaaaattatactcttctactatctgctttgatctttttcctttgataaattgtagagaatgcaagatggagattgaagacaaaaagcaggagctccttgaaatggatcaggcacttaaagagagaaattgggaactaaagcaaagagcagctcaggttgatttttcttgattatattttaatggagttttctgttatgacacagtcacacaggatttgagaggtcaccaattttttgtaaaatgggcatttttatagcatatcttttctctgcacatagggtttactaaattagagatatgtcatctctctttatcttgatatttttctagcaagtagattttgaaaatgaggattagcttagtatctgagccttttgatctcttatattaccccgtatcagaagaagctaagtgttggaggaacaaaaatatttggaaggcgttatttagcactttttgtccagcataaaatgaagtctgaattatttgtcatttatgaacacaactatattttattgtttctataatgtatatgggattgaatgtcactatgtattgttaaaaaaaatgcatatggggctcatgagccagtattagtaaacaatgattatttttcccatttaaaaaataatttgagtttatactaaagcaaagagcattagtatattagctatactaatgagtttatacttgttatacttgctataaacaattacaaagcctattctaagcatacaagtttttatatcagaataaaattgaacaacagtttaaggttattttttaggttacacatttggatatgactattcgtgagcacagaggagaaatggaacaaaaaataattaaattagaaggtactctggagaaatcagaattggaacttaaagaatgtaacaaacaggtaaattattttaaaattacgtattttaaattattttttaaaaaattcaaactgtaactaaaaacaccccttcaaatagtgggtgttttttgttattgttgttttgttttttgttttttttggagacagagtcgttctctgtcacccaggctggagagcagtgacacgtgatcatacctcactgcagcctcgagttcctgggctcaagcaatcctcctgcctcggtctccccaaagctttgggattacaggcgtgagcgaccacactctgtggatctttcacttctttgattaaatttcttcctagatactttatttttttgtagctgctttaaataggattgccttcttgatttctttttcacattgattgcttttagtgtatagaaatgctactgatttttgtatgttaattttgtatcttgcaacttgactgaatttatcagttcttttttagtttttgtttttgtttgtgttttgagacaagatctcaccctgtcatctgggctggagtgcagtgtcatgatcatagctcactgccgcctcaacatcccaagctcaggtgatccctccacctcaagtctctgaagtagctgggactacaggcgtgcaccaccatgattggctaattttttaattttttgtagagatggggttttgccatgttgcctaggtaggtctcaaactcctgggctcaagcgatcttcccccctcagcttcccaaagtgctgggattacaggcatgagacaccacgccagccctgtttatcagttctaatagttttttggtggagttttcaggtttttccaaatacaagattatatcctctgcaaacaaggataatttaacttctctctttccaatttggatgccctttctttctcttgtctagttgctctagtcaggactcccagtattatactgaataatagtggtgaaagtgggcatacttgtcttgttctatatcttagtggaaagactttgagtttttccctattcctatgatattaactatgggtttgttgtaaatgatctttactgtgttattttccttcttttttttttttttttttttttttgagatggagtcttgctctgtcacccgggctagagtgcagtggcttgatctcagctcactgcaacctccgcctcccgggttcaagcaattctctgcctcagcctccccagtagctgggattacaggtgcccaccaccacgctcagctaatttttgtatttttagtagagacggcgtttcaccatcttggccaggctggtcttgaactcctgacctcatgacttcacacacctcagcctcccaaagtgctgggattacaggcgtgagccactgcgcccagcctgttattttccttctatacccaatttgttgagagcttttataatgtgaagatgttgaattttatctgatgcttttcaataatgcttttaattttaatatgaaattattatatggtttttgtccttgattctgttgatgtaatgtatcatgtttaatgatttgtgtatgttgaaccatcttggcatccctgggatgaattccacttggttatggtgaatgatcttttaaaaatgtctttgaattcagttgatagtattttgttgtggattctgcctctgtgttcatcagggatattggcctgttgttttctgtttctgttatgtccttgtccggttttggtatcagggtaatgctggccttgtagaatgagtttagaagtgggccaggcacggtggtgcgtgcctgtaatcccagcactttgggaggtcgaggtgggcagattgcctgagctcagttcaagaccagcctagacaacctggagaaaccccatctctatagaaagtagaaaaattagccaggtgtagtggcatgtgcctgtagtcccagctattaaggaggctgaggtggaaggattgcttgagcctgggaagtagaggctgcattgagccatgagtgcacaactgcaccccagcctgggcgacagagtgaaaccctgtctcaaaaaaaaaaaaaaaaaaaaaatgttccctcctcttcaattttttgaaatagtttgagtagaattggtattagtttttctttaaatgtttggtagaattcagcagtgaatgtatcaggtcctgggcttttctttgatgggcgactttttattactgcttttatctcattacttgttattgttctattcaagttttctgtttcttcatggttcaatctcagtaggttgtgtgggtccaggaatttatccatttcttctagtttttccaatttgttggtatgtagttgttcataacagtctgtagtgatcctttgtatttctgtggtatgagttgtaatgtttcctttttcatctcattttatttatttggattctctctcttcttagtcatctaaaggtatttgttaattttgttcatcttttcaagaaattaactctttgtttcatttatcctctgtattgttttatagtctcaatttcatttatttttgctctgatctttattactgctttccttctaataatattgggtttggctgttgctattccagtgtgggaaaggcagttcaagaccaacttgaacttaccttttgtagagacagggtcccactatgttgctcaggctcacattcttatcagcacatggaattatccagaatacataaatgtattatgtattatccagaatatgtaatatgttaggccacaaaataagtctcatcaaatttttaaaggtagaaatcctatcaaatatattctcaatgcaattctaaaagcatcattttcagtaatatgtccaataatattttcaataatgcttttaacatgcacctttaggtgcattgtttgtttgaaatttttgtatttttttgatgtaagcaattattgctataaactttcctcttggtactgcattcacagtagcccgtaggttttgttatgttgtatatccatttttatttgtttcaagacattaaaattttttttaaaatttcttcactcaccctttgttcattcaggtgcatttgtttacattttatgtatttatataatttctaaagttcctcttattattgatttctatttttattccatagtggttagataatatatttgataggatttctacctttaaaatttgatgagacttattttgtggcctaacatatttatgtattctggataatattccatgtgcagataagaatgtgagcctgggcaacatagtgggaccctgtctctacaaaaagtgaaaaaaaattagccaggtgtgatgatgagcacttgtactcccagctacttgggaggctgaggcgggaggatcacttgaacccaggaggtcgaggctgcagtgagctatgattgtgccactgcactccagcctgggcatcagagtgagaccctgtcaaaaaaaaaaaaaaaaaaagaaaagagagaaaaaaaagaatatgtattcagtaacagtgggtgaaatgttctgtaaatgtcagtcacaaaatgcctccttggcctagtttgtagttgaactctgatgtttctttgttgatttttttaatctggacaatctgttcattactgagagtggggtattgaagtccctgtcgttttattgcaaccacctatttgtcccttgagatctattaatgtttgctttatatactcgggagctttatatgcctgggtgcatagatatttataatttttatatcctcttgctagcgtgacacatttatcattaaatactggccttctttgtctctttctactgtctttgatctgtagtctgttttgtctaagtatagctatttctgctatacttttgatttccatttgaatggaacatctttttacattattttactttcagtctatgtgtgtctttatgaagtgaatttcttttaggaagcatatagttggatttgttttttaatccattcacccactctatgtgttttaaatggaaaatttagtccagttacattcaatgttattattaataggtaaggatctgtgcctttctgttacttgtttcttagttgttttgtaactcctccctttctttcccacttactgtctttcattgtggttaaatgattttttctggtagtatgattaattggttgctgtttatttttagtgtatctctcacaggtttttgctttgtggtgagacttatagaaaacatcctattgttataacaagctatcaaaaactgatatcaactgtgatagcaaaaacaaaaaaaagtaaaaacttgtatactttaatctccttctccttccacattttgaatttttggtgttccaattaaattgttatattgcctatctctgaataaattgttgtaattattatttttaataattttgccttttagtcttactaaagatataagtggtttacacaccatgatttcagtgttggtgtaacagtcacattagtggcggtttttcttttaagtttgaagtattccctttagcatttcttgtaggacaggtctagtagcgacaaatttcctcagcttttctttgggaaagtgtctcttcttcatttctgaaggataactctgcttggcacggtattcatgattgacaggttttttttgttcaacactgagtatgtcatcttactccctcctggtctgtaaatttctgctgaggtgtctgctaccaggcatactggatcttccttatatattatttgcttcttttctctcactgctttcaggatcctgtgtttgtctttgatctttgagagtttcattataatatgtcttagggtgttattatttgggtttaatctggttagcgatctttgacctctttatacctgcatacttatatctttcctcaggtttggaaatttttcttttgtttctttaaaaaagctttctacccctttgtctttctcagttccctttttaactccaataattcaaagatttgctcttttgatgttgtcccaaagatcccataagctttgtttattcctttttattccttttttcctcctctcactgtgtagtctatttatctatctatctgtctgtctatctatctatctatctatcaaactaattaactaactaacatggggtctttgttacccagaggtggagtgcagtggcacaatcatagctcaatgtagccttgaccacctgggctcaaagaatcctcccacttccgcattgtgagtagctgggattacaggtgcatgctgccacacctggctaattaaaaaaaaatttattttaagtgatggagtttcactatgtgactcagtctggtctcaaactcctgggctcaagtgatcctctcagcctactgagtatctgggattacaggtgtgagccaccatcctcagttctgattatatattttcaaatagtccatcttcaagctcactgattctatttgacccattctgctgttgatgctctttatttcatttttcacttcatttattgtatttttcagctccaaaatttttgtttgattttttaaaaattattttattctctgttaagtttttttgataaatttctcaattgattccctgcgtcgtcttagagtttgttgaacttccttaaaatacctattttcagttctttgagagatcacacatctccatcacttcagggttactctctggtgcctaatattgttcatttggtaaggttgtatttctttcaatgttcttgatacttgtagatatgcaacgacatctgcatattcagggactgggtatttattttagtctttgcagtctggcttagtttgtgcttgtcctttttgggaggcccttccaggaatttaagcaaactggcttttgtgttccctgaggctgtgatcactgcagctgttgaacactagagaataatctacatccaggcttgctgcaggtcttacaagggcttcaaggttgacatggctttctggcccacatggacctgggaaggggtcaagttgcgtactaaggctgtgggaatgcttgccagggacccaggtccagaaggctgtcctggtggcccagatgggcatgtttcccagcaaatcttttgacaggtgagatgagtctctagttgcaatgagaggggctggagttgagactggccctcttgggatatattgtggaatggaggctgaagagcccagtctcagcttagaggggcacacatagcccagcaagctccttcacaggatatttccccaacgacagtgtgaggagctagagttgagactgggcccccttggcatctgctgtgggatggaggctggagaacctatcttgttggcccagacagggccagcaggtctcagctcagatggaatagttccctgtctgcagtgggaggtgctggagctgagatttaacccctttagcatctgctgtgggacagaggctggagagcctatctcattatttcagaggtgcatgtgtctcccagcaagtccctgcacagacaggatagttccctgattgcagcaagagagtcggggctgagactgggtccccttgggatctgctctgggacagaggttggcaagcctttcaaggaggcttagactcctaggcagcaggataaggacaggtctccctttgggtctgtgtgtgagtagctctgagctgggacctttgctgaggggagttggagcagagtcaccaggcaattttccggtccactgctgagactgatgtcagcagggagagagcctttccactaaggcactagtatgcatgattccttatggaccccttttcagatggttgtgcttgtaggctcaaggccaaatggggctgtagccaagtcccttggggacgtgggctgtttccaggcttgaacccagaagcaagcttggcatatcagccacctgggtttctgtctgtgctctcaaaataacactcccacatcttcgtctctaccaggatttcacaaactcctacctgaatcctgaggctcctgcaaagaggcttttgactatagaaaggtgcaggattctttttttattttattttattttaaattaacagtgtttatttacctctaagtattgttgagagactggggtgaagacacaattttcattttgtaatttacagacttctataagctaaaacaaaaacaaaaaagtcttctctatttaatataatggtagaatacaacttctacttttatttattttaattttttaaatttcaatcgcttttggggtacaagtagttttggttacatagatacattttatagtggtgaagtctgagagggtgcaggattcctgttgttgtgggggaatatgagtgggttaccctctattctgcctttctggtaatgtccaagaacaagaatttttgtgcttatttccaggatacgattgccttaacctatttatattttgcttttagatatgagtgtttaaagcttgacttacttggaacacagcattgattaaattacatttcattaattttactgatactgcttatctgtttaaaattcagatagaaagtctgaatgacaaattacaaaatgctaaagaacagcttcgagaaaaagagtttataatgctacaaaatgaacaggagataagtcaactgaaaaaagaaattgaaagaacacaacaaaggatgaaagaaatggagagtgtaagcaaattatttccacctaaggaacaagtggtagtctctgttgagtgaaatgaatctttatgttttaaactggttggttttaatatacagaaactgtgccataactgtttttaggctagttttttgtgccagaaacctgttagtttctttgaccttttaaaatatttttctgatggtctaggtataggcaaagacagtgtcttatttatctctgtatacaggcctttgcatggtatctttcatatagtaaatctacaatatatgcttatttggttgacaaatatttattgagaagctgctatgtaatagaattgaggagtcagctttttttttttttttttttttttttttttgagactgagtctctctctgttgcccaggctggagtgcagtggctcaatcttggctcactgcaacctctgctttccgggttccagtgattctcctgcctcagcctcccaagtagctgggattacaggcacctgccaccacgcctggctaatttttgtatttttagtagagatggtgtttcaccatattggccaggctggttttgaactcctgaccttgtgatccacctgccttggcctcccaaagtgctgggattacaggcgtgagctaccgtgcccggccgaagagtcagctattaataagatacagtgttttgtctgttaggaactccatcaaaagaatggataaataaataattgtacattgagaccaagtgcactgagttgccagatgaagtttgatgacttcatatcatcagtatgcatgtgtgttgactggtgaattcattcctccacttgctcttttaaaaagtgaatttagggtcaggcacgatgactcacacttataatcccagcattttgggaggccaagttggcagaatcatttgagcccagaaattcaagaccagcctgggcatcgtagcagtgggacccctgtctctacaaaaacattaaaaaactagctaggtgtggtgatgcatgcctgtggtcccagctacttgggaggctgagatgggaggattgcttgagcctgggaggtcaaggctgcagtgatttgtgatcacgccactgccctccaatctgggcaacagagcaggagcctgtaccaaacgaagaagaggaagaagaggaagaagaggaggaagaggaagaagaggaagaagaaggaggggggagggatagtggggaggagggggaggaatactttattagaaatttaattgagtaatataaaaccatttcagtgggagtagcagccccagtgacaagttttactttcacagagagtaagaccttaacccagctgtgtggattaaatggtggattttaattatctataccaatatattctctgtctttgacatagataatcaaatgttaacttctcttttctctttatgttttctgtcataaatgttacatttaaaatgataaaagattatatggcttgtgtatgttacagtgatgtaatatatatcaataagagtcccaattatggtatttttgtcattttctcattagatttttttcttgaatatcagtttcacagtgggtgatactcattgtatgttaaattttaacatactcattgtatgttaaaggatttagttggaaggtggaaatttacgtattaagcaaaatcagaataagaaataggttatctatatatttcattctgaaacctacaaataccttatgcttttcaggttatgaaagagcaagaacagtacattgccactcagtacaaggaggccatagatttggggcaagaattgaggctgacccgggagcaggtgcagaactctcatacagaattggcagaggctcgtcatcagcaagtccaagcacagagagaaatagaaaggctctctagtgaactggaggatatgaagcaactctctaaagagaaagtaatccctattttaaataatcttatgtatctgaaatcttacaaatattagcattttttttgaactgtagaatatagttctttcaaaaatgaactgtattgcacaacagtgtgaatgtacttaatcccaccgaattatacacttaaaaatggttaaaatggtcaattttgtgtgtattttaccacaattttagaaaataatgaactgtgttatatatagataactttgtaatataaccaggaagtccttcagaactgagttttggctaaactagttctcaaattgagttataaagcacttttagacttttaagtgagttcgagctcttacttgaagaaaaaataaagctaatcttttttgagtaaaaatttttacatttgtagtgactcttaaaaatgaaaactattggcttggcacggtggctcatacctgtaatcccagtactttgggaggccgaggcaggcggataagtaagtcaggagtttgagaccagcctggccaatatggtgaaacaccatctctactaaaaatacaaaaaacaaaattagccaggcatgatggtgggcacctatagtcccagctactcgggaggctaaggctggggaatcgcttgaatcccgaaggcagaagttgcagtgagctgaagtcgtgccactgcaccccagcctgggcgacagagcaagactccatctcaaaaaaaaaaaaaaaaaaaaaaaaaaaacatgaaaactatccaaatttgtaactattaaatttgtaacttttaggaaacctgtagttcaaaacccttggttgataaagtaacttggaggtaaagtgcttttaaaaagcaaaaatactaatataaattttatttttccagtatttggtaggaagttaactacttggcttaaaaatatttacattggtatacttgggttaattatttagactttaagaaaaatgtgtttattgatgttgcaaaaaaaaaaaattcagctttccattgtggtttccatggtttaattcaattccataggaactgaattaaaatatttttacctttaattttggttaagcctacctatgttgttattcacatttctggatggttagaccagtaaagcatacatagagaatgtttattagagatatattatacatttggggttctaggaaaaggaaagctatctacttttatctcatttctgcctttatcaatagtgtcaaagtatagtacaattggtttttatttgataagctaagctcactttaaaaagtgaattaaagttaggaattttttaattgacagtgttttaaatacttattttaacccaaaactaaatatatattgatatgtttttcctttgatgtagggccaaaccttggttctttttgtatgagtcatttgattagaattctacctagtctttctcacataactagactcctacctggtctttcaccacactatattccatcatctatagtttccaattctgctttctttaaagtggaggaagaattaattaaaagacattaattaaaattaaaataattaaattaattaaaattaaattaataaaaattaattaataataattaattaaaagacatttgtaagtgaaccatgttatatttttatgggacctcctaccatattttataacaattttgagtgtttctaattggatagcaaaatgttcatgacttacttattaagctggttcaaaacatataacttagtttttggataaaaactttgcatttgcttatttcatcatgttcataatctataataaaattacacaattaaaattacaagcacagttagctaaattagcataaataagtttgaataaaaacacaactgactcttgataaacagacaatatatatagtgagcaaaaatatacaggcatacctagcagtagactgttatctgccagagttcagtgtcctgaggttattattaatagttcattttatagaaagcattggttagtgaacatctattttatgatgacagcaaacaattatattaatactctcccattaatagtctctgaaatgtctagattttaaagcatactatttagtaagttaactttgtgtctgtgtttatataatataaaaaattaaactacttccaataatgcactggattagtttagctataataaccaaataaacaagttttatagcttttactcaatatgtcatttttaaggatgctcatggaaaccatttagctgaagaactgggggcttctaaagtacgtgaagctcatttagaagcaagaatgcaagcagaaatcaagaaattgtcagcagaagtagaatctctcaaagaagcttatcatatggaggtaaagaaaaatttaatttgttttgttagtgcccactaaagtaggttgacctatctggacaaaagtatgagtccagctcttaagtgttcattattgaataatacattgtggtcttcatttctggtagcctaaacatacagctttcactttaatatactgtggggttaagagcttgaattcctgagccaggcaacctggttctaaaccctagctcaccacggagccacctgtatcaccttgggtaagttacttaacctgtgtctaaaatggatataataatagtatctacctcatagaactgtggtgaatattaaatgaattaatatataatataaaatagcatttgtaaaagattaactggaaatatttaataactgatataaaccgtttcatgtgatgtaaatctataatgctttgcaattttcagcatttcttcttataataacttagctagagagataatactagagcctttttatctgtcagcatgtcttgagccttcacagaaatgggcagtattattgactagaatagcatttttcatctttttaaaaactacatttaaagatattacccaaaatctctgtatatgatttaaataaattacttacgtttagtgctaataaagcgttttttctaatacggcaagggttgcaaatatttatgttaaactccattcaagggagtttggtgacatttttgtgagtgattggtagggcttgtggggaccatgtcttgcttaaatacatttagaatcatatctctttgaaagcattgtgcctgccaaacaaaacatatttacaagctgaatctaatcctaaggctaagaatttgcaacctttgatctttagcgacaaacctgaatgaatgctgttggactcagcataattatataattgttattaacagctcagcttagtaactatcagtaataattaggcgctttcaagtgtttgcccttaactactcattacactttcattatatggcctctgttctgtttttaagtataattatccaattgtttcttttagttttataagccacctgaaattataaatagattgtacataaaataaattgtaaaattagttcagtattgctatctttttaaaaaagtgatggggtctgtgttgctcagactggcctcaaattccagagctcagataaccctccccactcagcctctaagtagctgggagtaaaagcacacgccagccgggcgcagtggctcacacctgtaatcccagtgctttgggaggccaaggcaggtggatctcttgaggtcaggagttcgagaccagcctgaccaacatggcaaaaccccgtctctactaaaaatacaaaaattagctgggtgtggtggcgcatgcctataatcccagctactcaggaggctaaggcagcagaattgcttgaacctgggaggcagaggttgcagtaagccaagatcgcgccattgcagtcaagtctgcgtgacaagagtgaaactccgtctcaaaaaaaataagtacatgctgctgcattttaatatttaatattactatttaatatttgatactaatattttgtctataatattgaagtatatatttttacctgtttggaagttgataaaaatttacttttaaaatatatatgttgtttgaatataaaaatgagaggatatggtattaaagtaatagagagctagaaaagaggatcaataatttttaacagttttttttattatactttcttttttttttaatacattaagttctggggtacgtgtgcagaacatgcagttttgttacataggtatacacatgccatggtggtttgctgtacccatcaacctgtcacctacattaggtatttctcctaatgttatccctcctctaatcccccaccacccaacaggccccgatgtgtgatgttcccctccctaggtctatgtgttctcattgtttaactcccacttatgagtgagaacatgcggtgtttggttttctgttcttgtgataatttgctgagaatgatggtttccagcttcatccatgtccctgcaaaggacgtgaactcatccttttttatggctgcatagtattccatggtgtatatgtgccacattttctttatccagtctattattgatggacatttgggttggttccaagtctttgttattgtgaatagtgctgcaataaacatacatgtgcatgtgtctttatagtagaatgatttataatcctttgggtatatacccagtaatgggatggctgggtcaaatggtatttccagttcgagatcaacagtattttttaatatataggtttccaaattgtcagaaaatcacttaataataaatgtaaaactcctgacttattggaggagaatgagattgttttaacctttaattgtgaaaaatttaaatatatttaaaaatagaatagtataaatagtatatacatcctcatatttatttttgaacgttaataattttcaatgcatagccaatttatttcatccataaatacattgaccattttctttatctaaaagagaatacttttgagaatgaaaaggaatgctatagtaattacatgagggtaccaggcataaaacctagacagtcctaagcattctcggaagtgtgtcaacatacctttaacctttgaaagcacagtgctttcaaagagatatgattctaaatgtatttaagcaagacatggtccccacaagccccaccaatctaagcaagacatggtcccccaagccacatcaatcacccacaaaaatgttaccaaactcccttgaatggagtttaacataaatgttaaacccattcccaacccatcccccatattcacatattatttgaagcaaattttagacataattatttcatctgtaaataattatgtagacataattattctatattcaataagtatcttgtattagtccattttccattagtccattagtccattttcacactgctataaagaaatacctgagattgggtaatttataaagaaaagagctttaattaactcacagtttcacatggctggggacacctcgggaaacttacaatcatggcagaaggttaagggaaagcaaggcatgtcttacatggcagcaggagagaaagagtgtgtaaatgccacacttttaaaccatcagatctcatgagaatgaacttactatcatgagaacagcttgggggaaccacccccatgatccaatcagctcccaccaggtaccttcctccacatgtgaggattacaatttgagatgagattcgggtggggacacagagccaagccatatcattccaaccctggcccctcccagatctcttgtccttctcacatttcaaaacacaatcatgccttcccaacagaaccccaaagtcttaactcattccagcattaacccaaaagtccaagtccaaagtcttatctgagacaagccttccatctatgagcctataaaataaaaaacaagttagttacttccaagatacaatgggggtacaggcattgggtaaatgctccccttccaaatgggaaaaatttgccaaaacaaagaggctgcaaggcccatgcaaatctgaaacccagtggagcagtcattaaatgttaaagctccaaaataatctcctttgactccatgtctcacatccaagctacactgatgcaaggggtggactcccaaagttctgggcagctccacccctgtggttctgcagggtacagcccctgtggctgttttcatgggctggcgttgagtgcctggggcttttccaagtgcacggtgcaagctgttggtggatctaccattctggggtctagagaatggtggccctcttcttacagctccactacccagtgccccggtggggactctgtgtgggggctccaacctcacatttctcctctgtactgccttagtagaggttctccatgagggctccacctccacagcagacttctgcttggacttccaggcatttccacacatcctctgaaatctaggcagagcctcccaaagctcaactcttgtcttctgtgcacctgcagacttaacaccacatggaagctgccaaggtgtggggcttgcaccctctgaagcaatggtctgagctgtaccttgaccccttttagccatgggtggagctgaagcaacagcaatacaggtcaccccgtcttgaggctgcacagagcagtggggctctgagcctggcccacaaaaccattttttcctcctagatatccaggcttgtgatgggagaggcttccttgaagatctctgaaatggcctggagtcattttccccattgtcttggcaatatttagctcctcattacttaagaagatttctgcagcgagcttgaatttctccccataaaatgggtttttcttttctaccacatggccaagctgcaatttttttttaacttttatgctctgcttcccttttaaacataagttccaatttcagatcatctctttgtgaatgcatatgactgtacactttcacaaaagccagatcacctcttgaatccttaaaaatttcttctctcagagaccctaaatcatctctctcaacttcaaagttccacagatctctggggtgggggcaaaatgccactggtctctttgctaaaacatacaagatactctagtttccaataagtttctcatctccatctgagaccacctgagcttgcacttcattgtccatatcactatcagcattttagtcaaaaccatttgacaagtctgtaggaagttccaaactttctcacatcttcctgtcttctgattcctccaaactgttctaacctctgcccattacccagttccaaagtcacttccacattttcaggttatctttatagtagtaccccactattctgataccagttttctgttattagtccattttcacagtgctataaaaactgtgagtcaattaaacctcttttccttataaattacacagtcttagggctggtgtgagtgcctgaggcttttccaggtgaaggtgcaagggctgtcgctggatctaccattctggggtctggagaatggtgacagttgcagggtaatttataaagaaaagaggtttaattgactcacagttccacatggcttgggaggcctcaggaaaattacaattcttatgattatggcagaaggggaagcaagtcatgtcttacatggtggtgggagacaagagagcaagaggggaagtgtcacacttttaaacgatcagatctcatgagaactcactatcatgagaacagcatgggtgaaaccatccccatgacccaatcacctcccaccaggttgctcctttgacatacaggaattacaattcaagatgaagcctggatggggatacggagccaaactgtaacatagctctaaaagataagggctattttttggaacagaaccacaataccatgatcacacctaaaaattgacagtgactccttaatatcatcaaatacccaatcattgttcacatttccccaattgtctcaaaaatgtctttatagtttatttgttcaaatcagtacccaaatagagtccattgcatttggttaattaagttcttaagtaaattgaagattatggattcctttgttccctttttcctctagtattcattgagaaatcagatgtttgtaactataaacagaatttactttttttaaagaaaaagtaaataaaagtagaaagcattagactgttgtcgaatccagtttccttccatttttttattttttttcttttccaattctggggctatatagatgatttcacatcaagagaaccatgcaaagtggaagatttctgctgactctcaaaagtcttctgttcagcaactaaacgaacagttagagaaggcaaaattggaattagaagaagctcaggatactgtaagcaatttgcatcaacaagtccaagataggaatgaagtaattgaagctgcaaatgaagcattacttactaaagtaagtaaacatataaaagtaataaagcatatctatgaaaacataaatgtctgacttatttacctgtcttagtagtttatagaggactatatgaccaaatattggcctgtttgaataaaaaccatttgatttagaagatgttgaatttaggaaattattaagatgatgtacatcttattaccgtagaagatataatttataaatgttcaaatataaactcatctaatcataatgtttagagggttttatacttgatgtacctaaaaaaaggtagaaacatttttcaaaatcagcaaagttcttttaaaatcataaagtaggccgggcgtggtggctcactcctgtattcccagcacttcaggaggccgaggtgggcagatcacttgaggtcaacaagggcaaagacaattttttgagagccatgaaggcatcattatattatggctcactacaattacgttcacaacagtgaccttctttgagtcttaagaaaaagttgaattaatttaatgtattcagtgtactatatttaattgtaaaagttatgtgttaaactgtaacttaaataaaatcctacttatatgagataccacatatcaattatggctagataatgcagaataggaaaaagaaaaagactgcagctgtgtacagtcctattctgtgccaactctacaactgttttgttaattgtgattttaagaatgtgaatgtaggatttacaacaaaaaattggcactctagccactttaaaccaacaggctttaaaccaacaaagatcaaaagagaccaagaaggccattacataatggtaaagggatcaattcaacaagaagagctaactgtcctaaatatatatgcacccaatacaggagcacccagattcataagtcaagtccttagagacctacaaagagacttagactcccacacaataataatgggagactttaacaccccactgtcaacattagacagatcaacgagacagaaaatcaacaaggatatccaggacttgaactcagctctgcaccaagcagacctaatagacatcgacagaactctccactgcaaatcaacagaatatacattcttctcagcaccaaatcacacttctgccaaaattgaccacatagttggaaataaagcattcttcagcaaatgtaaaagaatagaaatcaccacaaactgtctctgagacaacagtgaaatcaaattagaactcaggattaagaaactcactcagaaccacacaactcatgaaaactgaacaacctccttctgaatgactactgggtacataacgaaatgaaggcagaaatgaagatgttctttgaaaccaatgagaacaaagacacaacataccagaatctctgggacacatttaaagcagtgtggagagggaaatttatagcactaaatgcccacaagagaaagcaggaaagatctaaaattgacatcctgacatcacaattaaaagagctagagaagcaagagcaaacacattcaaaagctagcagaaggcaagaaataagtaagatcagagcagaactgaaggagatagagacacaaaaaacccttcaaaaaatcaatgaatccaggagctggtttttagaaaagatcaacaaaattgatagaccgctagcaagactaataaagaagaaaagagagaagaatcaaatagaggcaataaaaaatgataaagaggatatcaccactgatcccatagaaatacaaactaccatcagagaatactataaacacctctacacaaataaactagaaaacctagaagaaatggataaagtcctcgacacatacaccctcccaagactaaaccaggaagaagttgaatccctgagtagaccaacaacaggttctgaaattgaggcagtaattaatagcctaccaaccaaaaaaagtccaggaccagacagattcatagctgaattctaccagaggtacaaagaggagctggtaccattccttctgaaactattctaatcaatagaaaaagagagaatcctccctaactcattttctgaggccagcatcatcctgataccaaggcctggcagagacgcaacaaaaaaagagaattttagaccaatatccctgatgaacatcgatgcaaaaatcctcaataaaatactggcaaaccgaatccagcagcacatcaaaaagcttatccaccacaattaagttggcttcatccctgggatgcatggctggttcaacatacgcaaatcaataaatgtaatccatcacatgaaccaaaccaaagacaaaaaccacatgattatctcaatagatgcagaaaaggctttcaacaaaattcaacagcccttcatgctaaaaactctcaaactaggtattgatgggacatatctcaaaataataagagctatttattacaaacccacagccaatatcatactgaatgggcaaaaactggaagcattccctttgaaaactggcacaagacaggggtgccctctctcaccactcctattcaacatagtgttggaagttctggccagggcaatcaggcaggagaaagaaagaaagggtattcaattaggaaaagaggaagtcaaactgtccctgtttgcagatgacatgattgtatatttagaaaaccctatcatctcagccccaaatctccttaagctgataacttcagcaaagtctcaggatacaaaatcaatgtgcaaaaataacaagcattcttatacaccaataaccgaccaacagagagccaaattatgagtgaactcccattcacaattgcttcaaagagaataaaatacctaggaatccaacttacaagggatgtgaaggatctccaaggagaactacaaaccactgctcaatgaaataaaagaggacacaaacaaatgggagaacattccatgctcatggataggaagaatcaatataatgaaaatggccatactgcccaaggtaatttatagattcaatgccatctccatcaagctgccaattactttcttcacaaaactggaaaacaactaccttaaagttcatatggaaccaaaaaagagcccacacagccaagacaatcctaagccaaaagaaaaaagctggaggcatcacgcttcctgactacagggctacagtaaccaaaacagcatggtactggtaccaaaacagagatatagaccaatggaacacaacagatccctcagaaataacaccacacatctacaaccatctgatctttgacaaacctgacaaaaacaagaaatggggaaaggattccctatttaataaatggtgctggaaaaactggctagccatatgtagaaaggtgaaactggatcccttccttacaccttatacaaaaattaattcaagatggattaaagacttaaatgttagacctaaaactataaaaaccctagaagaaaacctaggcaataccattgcctaggcatgggcataggcatgggcaaggacttcatgactgaaacaccaaaagaaatggcaacaaaaaccaaaatagacaaatgggatctaattaaagagcttctgcacagcaaaagaaactaccatcagagtgaacaggcaacctacagaatgggagaaaatttttgcaatctactcatctgacaaagggctaatatccagaatctacaaagaacttaaacaaatttacaagaaaaaaacaaccccatcaaaaagtgggagaaggatatgaacagacacttctcaaaagaagacatttatgcagccaacagacacatgaaaaaatgttcatcatcactggtcatcagagaaatgcaaatcaaaaccacaatgagataccatctcacaccagttagaatggtgatcattaaaaagtcaggaaacaacaggtgctggagaggatgtggagaactaggaacacttttacactgttggtgggactgtaaactagttcaaccattgtggaagacagtgtggcgattcctcaaggatctagaactagaaataccatttgacccagccatcccattactgggtatatacccaaagtactataaatcatgctgctataaagacacatgcacatgtatgtttattgcggcactattcacaataggaaagacttggaaccaacccaaatgtccatcagtgatagactagattcagaaaatgtggcacatatacaccatggaatactatgcagccataaaaaaggatgagttcatgtcctttgtagggacatggataaagctggaaaccatcatcctgagcaaactattgcaaggacaaaaaaccaaacaccgcatgttctcactcataggtggaaatcgaacaatgagaacacttggacacagggtggggaacatcacacactggggcctgttgtggggtggggggaggggggagggatagcattaagagaaatccctaatgtaaatgacgagttaatgggtgcagcacaccaacatggcacatgtatacatatgtaacaaacctgcacgttgagtacatgtaccctagaacttaaagtatttttaaaaaatcatataaatcaattttagatgaagtagtaaaaaaaaaaaaaaaggaaaataccaaaatatgcgtgttaaacttttattttgtaatgcattctgtggttatgacagttttagttatgaacacagtatttttgaaagctactttaagaatagaaactatcagagtaaaactgacaggatttagaaatatatatcttatggatacctttaagaaaaggcaaatgtatttgaagaggagactactatacttacattattaagcttttgaaattaaaatatcatctctttttttaggctttttggttttttagtgtatgtagtctcattcctaggatcccaaagttcagtcagaggacccaaatgaaagacatgaaaaaaattgaaatgaaaagtttatttaacaaggattgatttattaaaaatttatcactttaagtttttgaaaaatttctaatgcactaaagctttcttgtaatgagaacacaaaaagcagaatagcttatctatttattccctactggaaattctgaaaggggtctttttgtgtctatatgtgttagattaacaaaagatagcgtacctctacatctttgcagagaaatttttaggtgtaagatttcaatcttgaatagaaattgatattgtcattaacaccaaaaatatatatataaggagaatctagttttaatggaatttcttagaataagcatatttcaaaggaatatgtgtaattttcccaaagtgaacctatcttaagtaaaggttttaaacagagcttggaaaactctcaagaattataaacagaattcctatagtgggacaaaggttgactttctaaaagtctatgattttctaaggagttcattcatttaacaaaaatgtattgagcacctactatgtaccaatttatctgcaggaatcagaattaaccagattacaggccaaaatttctggacatgaaaaggcagaagacatcaagtttctgccagccccatttacatctccaacagaaattatgcctgatgttcaagatccaaaatttgctaaatgttttcacacatctttttccaagtgtacaaaattacgtcgctctattagtgccagtgatcttactttcaaaattcatggtgatgaagatctttctgaagaattactacaggacttaaagaaaatgcaattagaacagccttcaacattagaagaaagccataagaatctgacttacacccagccagactcatttaaacctctcacatataacctagaagctgatagttctgagaataatgactttaacacgcttagtgggatgctaagatacataaacaaagaagtaagactattaaaaaagtcttctatgcaaacaggtgctggtttaaatcaggtatgtattttatacactgtaaactgtaataatttgtttccaaagaatatcattttattacttggaagaaaattcatatatttaaatgaaaaactactaatatttgaagaaggaagattttacattttatacattaagtaaaatcaataccaaaagacattttctctattgcatggtgtgagacaatacggggaaagagagaggcagagggagacagaacaggaagtagaacgaaaaataggaagatagacatgaaagtgcttaaaaataaaaaaattaaaaaactgaaaaaaagaaaaatggtaagaaatatgcagtgagaggaatccagagaaagtaggttctgaggtgaatgttctcataacttcgtcataatttactgttcatttgggctctgtatgtcaaaataagttattgctggctatcactgatccttggaaagttgatttactgaattagccattatttaaaagcatgaataaggccaactgtcctcatccttataatttttcaccctaaaatatttatattcatctttccttcttttgtcccttttctctttaaaagaaagatatatccctcttcttttttagagagaaattcttgaacatgtactttcaagcctttaatatgcttgcctgttttgcttctctgcttcctgatttaatctgtatcttcaggcttctttatttccctcttcctttcatttccagacatcttaaattcatacccactctaagctgggtgcagtggcacatgcctgcaatcccagctatccaggaggctgaggcaggaggattatttgagcccaggagtttgagacaagtatgggcaacatggagaccccatctcaaaaaaaatttttattcattctatttctccattgttgctacctccttactacccttcccactttgtaacttactgtatttgtctcttgaatattaaatttactgttttcttgaaagtcacaaaaaactctttgtataataaacaaatttagtatcctctttttcttcagcttttgtagatttaactgtccattcccccttttgatattttctcttctcttgacttttatgatttaatatttttctggtcctcttcttattttgaactaattactttctcacttttctgctcctcgtattccttatgttccacaatataggatttaatctgtagtttgagaatggaaataatctcctttagataatgtcagctttttaaaaaatgcctaacatcattttcaaacacatcaagatagctttggtggcctgaacagttaaaaactatttttttggaatagatccaagacaaagaaaaattgttgagtgagtttttcttcataatacttatttttgctggcttaagtatatgtctatctacttgtttattgattgtctcccccactgaaaatgtaagctctgtgtggagagggtatggtcatttcgcttatttctatatttctagtgcctggtatatagtagatgctgaatgaatatttatgaatgtatcaagtggctaaataaattatatacagtaaacacaactgtagttttaaatgctagatttcatcaggctgtgctggccaaaatttcacttttagcatattacttttagcacccaagaagttaaagattcagtaaaggtaactgagaagtaatcagtgaaatagaagagaaattaggagagtataatatttcacaatgtatttcaaggagggtgagatcaattgtgtccagtgttgctaagtaaagtgaaggttgattattgactatcatatttggtaatgtcgaggcttttatgaccctcataagactggctttagcctaacaatgggaatgaaagcctgttgtagagtgggtttagcatagaatggaaagagaggaaatagaaacatcaagaatagacaactctttggataaagagtaaagcagagaaatgagggagatgtgatgtcaagggagagttttttgttttgctttttaacataagagagaaaacagctgttggatattgataggaatgatccagtagacagggaaacagccattcaagacagagcagaaggagtaaaatccttaaggtaggcttaagaaatgggatacaggagagcagtagaggagttggtcttggataaaaaggggcagttcatccactgtggtgggaaggcaggcagaatatgggagcacagaaacacatggaatggaaggtttgatagtgggagagaaatttctttatcaattgcttttcttttctttttttttttgagacggagtctggctgtgttgcccaggctggagtgcagtggcgcaatcttggctcactgcaagctccgcctcccaggttcacgccattctcctgcctcagcctcccgagtagctgggactacaggcgcccgccaccacgcccggctaattttttgtatttttagtagagacggggtttcactgtgttagccaggatggtctcgatctcctgacctcgtgatctgcctgcctctgcctcccaaagtgctgggattacaggcgtgagccatcgtgcccggccaattgcttttattttcttagtgagataagaagcagggtttttagttaaggcacagtaagatattggatatttaagaacagggaaggtatgtgaaatggttacttactttggagagtaggaaagcataaacagactagcaaagtctagtagaattgccagccagatagttctgtcatgtggaacaaccgtgcaagatacaggacatctggcatcatttgtttctgcctgttgtatatcagcagcagcatgtccctttctcccctatcacaatgacaaacaaaaagtaccatcacaaatttctagaatgttctgtagaggatggtactgcaccctttaagaacctctgctctactccagtgacccttgcagtcatagatatgcaagactctctttttggtaaaaatcgcacctaatttatgcaggataaatttgataagtacagtgacagactgtgatcataacaatacatagcctttactgtatgtcaagcaaatcctttacataaattaactcatttaatccttataacaaccccctgataggtactattatctgaatagtaccaaataatagtacctaatagttctactgtagtgggtactattattatccttatgatatgaggaaactgagtccctgctcttaaccactatatataatctttacataattgtattggtattttcttcagtatgtctaattacatagtttggtcttgcagttgcttagccaattaaggattaagagtaggagttagccaggcgcggtggctcacgcctgtaatcccagcactttgggaggctgaggcaggtggatcacgaggtcaggagttcaagaccagcctggccaagagggcaaaaccccatctctactaaaaacacaaaaattagctgggcatggtggtgcgcacctgtaatcccagctgctcaggaggctgaggtggagaattgcttgaacccgggaggcagaggttgcagtgagccgagactgcgccacagcactccagcctgggtgacagagcgagactccatctctaaataaataaataaatagtaggagttaaaagttactacataacagatagaataatttcttactctgtaggtttttgcaatatatatttgaatttttcaagtcatttcacctattcaattatcattgaagatcaatgccaaattaaaatattcaaaatactggccgggcaaggtgcctcacacctttaatcccaacactttgggaggccaagcaggaggattacttgagactaggatttcaaggacagcctgggcaacatagcaagacccgatctctacagaaaaataaaatgaaaaactagctgggcatggtggcgcacatctgtagtcctagctacttggaagctgaggtgggaggattgcttgagcccagttcgaggctgcagtgagctattatcatgcaatgcagcaagaacccatctctaaacaaaacaaacaaacgtagcctattgttaaacttaaagattggattcttaaaatcctatcaaagttatattctgtataaacatagttttcttgattgtcaatgatactctactgagttttaaatgcattgaccactgtcaatactcataactttaagctcacatggaactcctacagcgcatgagcctcagttgcattacctgtggtagtgaccacctcatagtcatttatatgtatgttgcattaataaatatatactactctgtaaaatttaatgaaagagatgtatttttatttttttgaggcagagtcttgtgctgtcacccaggctggagtgtagtggcacgagagctcactgcaacctccgcttcccaggttcaagcaattctcatacctcagccccctaagtagctgggattacaggcgtgtgtcaccatgcctggctaatttttgcattttttagtagagatggggtttcaccatgttggccaagctggtctcaaactcctggccccaagtgatctacccaccttggcctcccaaagtgctgagatgacaggcgtgagccaccgcacctggcctgaaagagacattttaaattgggatgtagagccatgatctgtagcctagttcaggtcctcggcttatttcacctgccacttaagtatgacattgcattggtctcctatttaaaagcaggattttaaaactcttttaaaccaaataaattattatttaaataaagaaatccagtatgtcaaatagattcaaaggtagtttatctgattgggggtaggatatgtctgacctttacccagttacttaaatctactcatggctgctcatgcaaaagctccagagcagccctggattaatcattaaggaaaataagcaggagcataggggactaaggggaatgccacagagttgtttgccctagctatcatcctcttaattcgttcactgccacacttgactttagtagaatttttagtaactgtctttatctgccagttcaaatttaatctgcactattaaaaaatcattttctttggtatgatgagtgacaaaagtttaaaagtttgatttgaaagtgtcatcaggtattacatttgtttctttacacatggtgtgagtttcaaaaccagctacctgggtctggatagcatttgactcatcagctgattcgtctaaaggactcttaagcaattttttaaagcagtggtagggccaggaggcgccattgttgggctgtgcagagggtatcagctggcctaaatccagctctgcttcagaaaagtgcagttttaaagtccactggtacaatgaaaagaatgtggaaaccgatacatgagaagtgtttaataagtgttagctcccttgtgttgcagcccaaatactattttcctaatggttaagtacgttggcacttccattgagagtaaagcctcttaacactgaagtattctgctttcagactaacaaaagcttcagaactcaaaaaattacacctgtacacaatttagaacacaatatcagcaagttcagagacttcatattaactcctattctaatcctgttttggattagagcagtggaagtgttgtgaatactgattaattagctaattcaccatttattaggaatttataaaaagttattacttctatttctcttatttgtaagtagttttcaagatatggtacatatatcatgcagtaagatgaaaaataagaaattaggaaattagctatagggaaaacaaagatgaaaaaaaaatgttaaaccaggagtacaggtaatacctagagacatgataatattttcaaattcacaccctcagtaaagatgaaggtatgacaagaaaatttggcccatatttttttaaatcccctgggcctttttcctctatttttctactttatgttaaactgcttttatatgcaaataattgtgtaggggtgggttgcccctacacacctgtgggtgtttctcgtaaggtgggacaagagatttggaaaagaaaaagacacagagacaaagtatagagaaagaaataaggggacccggggaaccagggttcagcatatggaggatcccgccagcctctgagttcccttagtatttattgatcatctgtgggtgtttctcaaagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccctcaagcatctgtttaacaaagcacatcttgcacctccctcaatccatttaactctgagttgacacagcacacgtttcagagagcacggggttgggggtaaggttatagattaacagaatctcaaggcagaagaatttttcttagtacataacaaaatggagtctcctatgtctacttctttctacacagacacagtaacaatctgatctctcttgcttttccccacataattgtcttttgtctctgtctgctctttttttcttcttttaatcttcctttttcattgattttttcatgtagctattcatcatccttgtttattgtgctctcaaactataacatgacactgatgccaaaatgttatatttatgttccttttttcgagttttaaaattagtttaaccccatattcacacccacctcatcaagccagaattatttgcttttattttttattttatttattttattttatttttttgagatggagttaccctcttgtctcccaggctggagtgcagtggtgcgatctcggctccctgcaacctccccctccaaggttcaagtgattctcctgccttagcctcctgactagctgggattacagacgctcgccaccacacccagctaatttttgtatgttttagtagagacagggtttcaccatgttggccaggctggtctcaaactcctgacctcaggtgatccatgcacctcggcctcccaaaatgctgggattacaggcagtgagccactgcacccggcctgcattttatattcatgtggttcattattgactttttatgattcatatttttcagtagactaaatatttctcactctcgctttaaattatactcctgttattatggtagacttttaatgctaaatcagtttaggaatatttcaaatattaatctattattttgcattattctagggagaaaatgtgtaattcaaagaagatactgatgtgttgaaaaaatggaatttttggtactgtgctgtttacttattatatgtagctcatacttcatagaagctgttattttgcttttgaataaattttatatttcaatattttaaaagaaagcccttctaaaacttaattatatttttaaagaaaatttattattttatttattgttttttggcttaaacttgctgctttcttttgctttttatataaaaatcattgttaaaatgca

SEQ ID NO: 505 - DNA, 191501 bp, Homo sapiens
ggcgcggggcggaacagatcgcagacctgggggttcgcagagcgtgagtctgatcccccagacccaattctaccgcacccggctctgcaaggccaggggagggccgcctccacccatacaagtcccgggtttccctcccgccccggggagggcggcgattccacccccagggctgcgggaggcctggagggtcttccggggctagctgtgcgcgcgcccaccttccttgggagccgaggggtcagccgagtggtgctggggcaggaggcttgctcctcccctaaaccaggcggagtgctttgtctcttcagctctgcctcctgtcagcactaactgcattattctgcccagtgtagtcggccggttccttattatctgcgtgaacttagccatttacttaacctctctgtttcagcgtattcataccccgtgcccaccccatcacctcatgatgcccccgcctctttcgctctgctccagtccgtctggcctcgctgttgctggagaggccaggtcctgcctcagtgcttttggcttggctgtttcgtttgccacggatgtctttctttccccagatatcaacatggcttgctggtcattcgcttcaggtcttcaagtcttgggtcaaatggtggcttctcagtgaagtcttatttgaccacactaaaaattgcaccatctcacccccattgtccttttcttgctcgattttgtttttaccccatagcacttaacaccttacaacaagctatatattttgcttatttcagtcattcatttaataactattcgcacctatttgtgtgccaggctatgtgtgcccccactgcatgggggcaaacatctctgcccttgtggagcttccattctaaggggggagataataaacacatttataagtaagagagtatgtcagataagtgtatcatctcctgtcacagtgagttaaaatctggtgtttaatctccatgattagactgagcttcctaaaactggagtggtagctgattttcacctccttgtccctgatatcttgagggagatcaggatctctcaggcccttcctgctcaaaacataggacacacttgacttttctgatatcctttcagcgccagtggggagatgttgaagttcaaatatggagcgcggaatcctttggatgctggtgctgctgaacccattgccagccgggcctccaggctgaatctgttcttccaggtaacagcctaccctgccaactttgctcacctgtgtgtgtccttggaatctccttgtcactcacctttgcttttatttatttgtttatttatttagagtctcagtctctcaggctggagtacagtggtgcaatctcagctcactgcaacctccgcctcctgggttcaagcgattctcctgcctcagcctccagagtagctgggactacagccgcctgccaccacacccggctaaattttgtatttttctttttagtagagacggggtttcaccatgttggccaggctagggtcgaactcctgacctcaagtgatccacctgccttggcctcctaaagtgctgggattacaggcatgaaccgtgcccagcttgcttttattataggaccagggataatattttaggggaaattctgttttgttttgtttgaaacaaggtcttctgtcgactctaggcctgtgccaccatgcctggctaattttttaattttttgtagggatggggtctcactgtgttgcccaggctgatatagaacacctgacttcaagtgagcctcttgccttggcctcccaaagcactggggttataggtgtgagccactgcacctggccctctatttagagttttatatgcactgattcttttggaaaaaagacactgtgcagaagtagatagctgaacttgccttagaagggagatcttttcatatttctcacactttacacttctgtactaaagtttattcattcattgattgattggttgcttgcaagacagggtcttgctctgtggctcaggctggagtgcattggcacaatcacggcttactgcagccttgacctcctgggctcaaacgatcctcccacttcagcttcctgagtagctgggaccacaggtgtgtgccaccatacctggctaatttttgtattttttgtagagatgaggtttcaccatgttgcccaggcaggtctcgaattcctgggctcaagtgatctacttgtcacagcttctgcaagtgttgggcttacaggcataagcccctgtaccagggcaagtttgtccttttattgaagaaagaaaaataaatgaacaaagatgctttttaaaactacaatttctgtgggtataatcctattcattttcattgcagggatgtttattttttaagattttttttttttttttttgagacagagtcttcgctgtcgcccaggctggagtgcagtggcgcgatctcggctcactgcaggctctgccccccggggttcacgccattctcctgcctcagcctcccacgtagctgggactacaggcgcccgtcacctcgcccggctaattttttgtatttttagtagagacggggtttcactgtgttagtcaggatggtattttttaagattttaaaaaaagttttgatgaataccacacctgtttaaccctcattcctctcaagatacacatttctgtcaccccagatgcgttaaaacttaatatcataagattacttccaaatagatttttaattcttttgtttctgatgtatgtggaacactggtgaagtagaaatccttgtttgatttatgtattcgtaagtcagggggacaatagagaccatgaagatttagaattgaatcccagtcccagcactagttagctgcattactttgggtgagtcagttaccttttctgagtccatttgctattctttaaaataggttgtagcctgtaatgccagtattttcggaggctgaggcgggcggattacttgaggtcacgggttcgagaccagcctggacaacgtggtgaaaccctgtctctactaaaaatatagaaaattagctgggcatggtggtcgcatgtacctgtaatcccagctacttgaaaagctgaagcaggagaatcatttgaacccgggaggcggaggttgtcgtgagccgagatggtgcactgcactccagcctgggcgacagagtgggtaagactccatctcaaaacaaaacaaaacaaaagaaaacaaaaaaaataacatagaggttgtagtacctaatccacagggttgttgtgaggattagatgagatattcgatttaaagcacttagcaccttgcctggctcttagtaaactccttataaaaaatggtaattattgttaatactcagcatagaatagtattagttataatattaatactaaatttgtttccttaatagtaattatatttgggaaggtagttatgtaggatacctgtaagatgatgaatgatgaagtattcttgataacttttttttttttccaaaatattggtattgggtgtttaaacagatgagagtggaaacaaattgaaagcttaggtttttctgtgggaccatccccatcagcattttaagtcttgacatatctttcacaaatgaatagtctgtctttaaccttagatggctggagtgctgccacgtttcagcccctttatcatgctactttaaaatatctccaacttgctgggcgtggtggctcacgcctgtaatcctagcaatttgggaggctgaggtgggtggattgcttgaggtcaggagttcgagagcagcccgggcaacatggtgagcccctccgtttctactaaaaacacaaaaaatagctgactgtgatggtgtgtgcctgtagtcccagctactcgggaggctgaggcaggaggatcacttgagccctagaggcagaggttgcagtgagctaagattgtgccactgcacttcagcacttcagcctaggcgacagagcaagaccctgtaaattaaaaaaaaaaaaaaaaagaaaaggaaaaaaatttccaacttattaagggcttatagtgtgctgattatgtaatagttatggcttccaatgtgtctggcatagaactggcatgtttctgagtatctcacttcagcctcatgacagaggtaaggactatttttaatttaaactttaaataggaggcaacaggccaggtgtggtggctcacacctgtaatcccagtactttgggaggctgaggcaggtggattgcttgagtccaagagttcaagactagcctgggcaaaatggtgaaaccccatctctacaaaaaatataaataattagtcaggcatggcggtgtgtgcctgtagtcccagctactcaggaggctgaggtgggggcatctctggggccccggaggcagaggttgtagtgagttgagattgcaacactgcactccagcctgggcaacagaacgagaccctgtttctaaataaatacataaataggaggcaacagatatagacagatatggaggtaggtaaggccttgcccaagatcatacacgttgggttttgcagatgaggccaagatcagactccatctttggttggtctgactccaaaggctgaccacatagccattgggccacagcacctgtgcacgtcagaatttattaagtatatcttgtatttagtcattataacaggaagacttatgggtaaaccctcagttcatctctttttaatgctgagatccccctgcccagtaaagctattattgcaagtatagtatatacctatcatttgccttgagttatcaggtaaggatgctgtttgttcttttcccatatagtgctgtttgaatgaggttgagatacagtagcaattttgttttccattcaggtgagtaccttagactgagtgtcattttgtcttttttacttctactcaacaggatttcctgacatgttcgaggtcagtgattgtcagactttctgagccagcaaaatttcccaaattgctgggtagacacaggttttccaactttttattttgccaagtaaggatatataaaaaaaaaataaaaagaaagacctattattttctggcccttgtatttcataaagggcattttaagaaacaacaagacaggaagaacatcatctcagaataaaggaccatttttaaatttgaatacatttagttttataaaaaagatatcatgtggtgttcattttttctcatttcactgcaggctgttgaaaactttgttaagaaccagtactatatttgggaacccctgctttaattgatctaaactcttgaagaatagaagaaacaaagcattttatttttctgagttactggcaactattactaaagtgacagatatggtggccttgaatgcagtgcttcccaaacctgattgaggtctgactctcttggggaccagggtctcattctgttgcccaggctggagtgtggcagcacaatcttggctcactgcagcctttacttcttgggctcaagtgatccttctacctcagtctcacaagtggctaggactacaggaccatggcactacacctggctaatttttttttgtttgtttgtagagatgggatctcgctgtgttgccctggctggtcttgaactcctgggctcaagtgatcctcccaccttggcctcccaaagtgctagtattccaggtgtgagccacctctccctgctggggaacttgttaataaaacagattctaggctacagtctggaaaattctaattcatttggttgtgggggaggggggcataggaccagagaatgtgtttgtttgtttgtttgtttttcttaaattctccagtgctgttgtgattcaaatgcagccggtctgtttctgttatcaagtgctgtgtaacaaagcactcacaaagtttaaagcaacaatgatttattttttcttaggattctgtgggttggctggactcagctaggtagttctgcttcatcctgtgatgtcagctggggtcacttgtggggctacattcagctgggattatgtctgggactggaacatgtgggtgctgactgctggctggggcaccttagtgtttctcacatggcctctcttctccatgaggtctttcagtagtatagcccaggactcgtaactttttttttttttttaagacagactgtcgccctgtcgcccaggctggagtgcagtggcacgatctctgctcactgcaacctccgcctcctgggttcaagcaattctcctgccccagcctcccgagtagctgggattacaggcacgtgcctccacgcccggctaatgtttgcatttttagtagagatggggtttcaccacgttggtcaggctggtctcgaacttctgacctcgcgatccgcctgcctcggcctcccaaagtgttggaattacaggtgtgagccactgcacctggctgactcgtaactttttttgtaagtaataaatattttaggctttgtgggtcctgtagtctctgttgcaaccactcaacttggccatggtagcacaaaagcagctaaagacaatatgtaaatgatgggtgtagctgtgttccagtaaaacttataaaaagtccgtgggctggatttggtccaagggctacagattgcacacccctggtctagcccaagcatctgtgcatggtggctggcttcccaaaagtggaagctgctaagctgccttttttttttttttttttttttttgagagggagtctcactgtgttgcctaggctggagtgcggtggtgtgatctcggctcactgcaacctccatctcccgggtgcaggcaattctcatgcctcaacctcccaggtagctgggattacgggtgcctaccaccacgcctggctaatttttgtattttggtagagacagggtttcaccatgttggccaggctggtctcaaactcctgacctcaagtgatccacccgtcttggcctcccaaagtgctgggattacagatgtgagccaccgtgtctggccgcttgacaagcttcttaaaggcactgccctgaactggcacagtgtcacttgtgtcacattcttttggttgaagagagtctcagagatggcacagattcaaaggcaggagaaatagactccagcgcttaaagtaaggagtagcatgtgcctacagaattggaggaactgttggaggccatctttgaagagagaccaccactatccatggcttggcacgtgggaatcactgctctataccagggttgcagactcatgtctttgggggccaggcagtgagtataaatgagtcaagtgggccagttggaagatggagtcagacctgcagtgaactcccaaacacatctgctaccgggaggggcagcattactcagctccagctcagcgtcatcaggcaggaaggcgaggcagtgttgccggatgtgccagtgtttcaaaagaagccagagactccatttttatttttttgtatggaatctcctgattttgaaatattggcagataattcaaattatcttaaacactacaggccaaacaaaacatatctgtgggctagagacagtctgccagtttgtaactatttctccagatcatgagtaaatttggctttacgatggtcactcagttcttattactctaggttgttcaaatgaattaaaaaagctgaaattatatgaataaacccctgggcacacatgaaagaagtgaaaaacccattgtttcctattgtagaaacatggaagcatgtcagagccagaggatccagaggaaatattctcactagcctcagaccctcaggagtgagggagcttttcttgttaatggccacgcttgtgcagttttccttcccaggtgctggtgaaagaaacccacagtcttggaatcatggaagtgataccataatgactgtcagttgacgttgctttaaagaatgaagccacagaattgtgctgttagcatgtcgtgagcagttagttgagttggtggcttgtaatttactctgtgtggatgttattgatcaaagcttttcattattgacagtgtctccatctgctgtttgctgtttttaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtgtaagtttggggaactttttcttgaaaactgtcctgagagagaaaaactagaaagatgcttgaggcagaatgagttactggttgatagtagtcggtaagaactctggttctatataagacagatccaggttcaaattcaggctgcacctcttatagctgggagaccaggtaagttgggcttcttggttgcaagcgacaaacttaattcaaagactgaatttaggccaggtgcaatggctcatacctataatctcagccctttgggaagctgaggtgggtgaatcgcttgagcccaggagttcaagaccagcttgggcaacatggtgaaaccccatctctacaaaaaatacaaaaattagctgggtatggtggcttgcacccgtggtcccagctgctgaggaggctgaggtgggaggatcactggagcccgggaggttgaggctcaatgagctgtgattgtgccattgcactccagtctgggtgacagagtgagaccctgtgtgaataaaagagtgaatttattggctcatgaaactgagaaatccaggaatgagttaagttttagctttaggcatagctagttccagagacctcaataatatcccgtggccctgtccttatactcactcagggctgactttctattaggcagagtaggcacggtgcttaggatctgtgatatttaattttaatgaatttaattacttttaattaactgaattaaattttaatttgttttaaaattataggaaaaatgaatataataatgtataatgattctggattacattcatctttatactaatgtagtcataaaatataatttttgttttttttggagacagagtcttgccctattacccaggctggattgcagtggtatatcatggctcactgcagtttcaaccttctaggctcaagcaatccttccaccccagtggctgggactacaggctcacactaccacgcccagctaatttttgcttttttctctgtagagatagggtcttactatgttacccaggctggtttcaaactccaggcttgaagcagtcttcctgcctcagcctcccaaagctttgggattacaggtgtgagccaccatgcctggccccataaaatataatttttgaattcttttttgtttttaatggaggaaggggctgaggaaggcaaaagtacctagggcctatgaagtcatatattggccttgccttcaccctgtttctgactttgcttgacttccatgtgatgaggcagttggctgttagtgtcccagtttcatactcttacattagtgtttttcaaccagtgggtgatttgacgttttcggttgtcagagctagttgggggtggtggtgtgtgagtttggggggaagggtcctactgtcagttaatgggtgaggccagagatgccaccaaacaccttacagtgcacaaagcagcccccataacacagaattatgtagcccacaatgccaacagtgctgaatttgagaaaccccaccttgtacaacattgctgtgcaaccaaccaccctaaatattactgacttaaaacaatagtcactgtggctgggcgcggtggctcatgcgtgtaagcccagcgctttgggaggctgaggcggcggatcacttgaggtcaggagttccagaccagcctggccaacatggtgaaaccttgtctctactaaaaatacaagaattagctgaatgtggcagcgggcgcctgtaatcccagccatttgggaggcagaggcaggagaatcgcttgaacctgggaggtggaggttgcagtgagccaagatctcaccattgcactccagcttgggcaatgagtgagactctgtcttaaaaaaaaaaaaaagttattgtattacctcttgtgtgtgtaggttaattggactcagctggggattcctctgctctgtattacattggccaggattgcagtcacctggggctctcctgggctggaatgtgtgagagggcttactcagtgtttggtgccctggcttggaggctgggcccagctgggcctctctctcttcatgaagtttcagggccttttgctgtccacatggcacctctatgtggtctccaaatcagaagtcaaggaactacagcctgtgatgcctattttgtaaagaaggttttactggaacacagccctacccatgtgtttgtacagtgcctatggctgctttcacatcataacagcattttatttcattttatttatttttttttgagacaaagtctcactctggctggagtgcagcagcacaatcatagctcactgcagcctccaactcttgggctcaagcaatcctcctgtctcagcctcctcagtagctagtactacaggcccatgccaccactaatggctaattttttaattttgtgtagagatgggaccttgtgagattgcctaggctggtcttgaactcctggcctcaagaaatcctcccaccttggcctcccaaaatgcttggattacaggcatgagccactgtgcccagcccacaacagcatttgagtagttgtgatagagaccaaatggcctacaaagcccaaaatagttcctgtttggcccatttcgaaaaggcttgctgacctctgagctacatggtctctctagcaggacagcctcgacggtagctcaggtttccaaaacacaaaagtggaagctgccaggctttcttaggggttatcctaggagggacataggatctctttgactgcattttattgtttgatgcatgctctggggctgctcaaattccacctgagaggaaactacacaaggtcatgaatcccaagaggactggggcattgggtgctatttttggagactggctaccacaccctgcccaatggtaatcttcccttatctagattaatacaaccccagggaagattctaacttggctctgctttgggtcatttgcctccctggaggtgaggtgttgtgatcggttttgttggaatgcccaaaggggtcagggcagtgtgattaccaggacctcatggaatgggggatgcgtggttatgcaaaggagccggggatgctgggtagaaaaaaaatcagcatatgttcactatagtgctcttcagtattttacatgtactttgttctcagttttctcatctgtaaaataggaataatgtatatcctttttttttttttttttttggagtcttgctctgttgtccaggctggagtacagtggcacaatctcagctcactgcaacctccgcatcccgggttcaagtgattctcctgcctcagcctcctcagtagctgggactacaggcgtgcaccaccacactcagctagtttttgtatttttagtagagatggggtttcgccatgttggccaggctggtctcaaactcctgacctcaagtgatctgcctgcctcggcctccgaaagtgctggaattacaggcatgagccaccacgcccattgggaataatgtatatctaatgaggctgtgttggaattgaatgagttaatgcacagaccagatttgtcatgttgcctggcccataggagacaataaatggtacccagtattaataactgtgaatgtcaacaacatttaatatattgtatatcttcaaaatgtacttgaggtatttgttcatcattctgtttttgtttgaataagctcgtgccttctttttgtgaatatttaaatttataagtagcgagtgggaggggaaggaagttatgtgatgaggctagcttactgagccatctgcaggcaccttcattagtcttgagactgtcctctggttacttaacagcagtgaattatctagaatcatttagtgatcagaagacttggtttagtggaatgtagatttttttctaatagacccctcttccagggaaatgtttcatatttttgaagaggtttcctggggagtgtttaagaggccatgattgaaaatgggtgattacattagtgtgttttctattcctcccctttttgagtttctgttttggaatgtaagctttgtttttctacgtggagaagggtccctcagctgcttctgcccaggttttttgaatcttcctatagggatggagattttctttggggactgttagagaaaatggaatagagtgtagctctgaaggagaaggatgtctccagcagaagtacctctagccttgggccaagggagggaagggaagggaacgagcatctgggaaccagggaagggatttttgtctttcttaattactcttacatccccagtgcccaaaatagtgtctggcatatgttaagtccttagtaaatacttgttgaatgagtgtatgctcagtgaacaaaataaatggcaaacattaagcacagtatcagataatttgtgtaaaaaatatacagcagtgttatactaaaacttgcacagaggccaggtgcagtggctcacgcctgtaatcccagcactgggaggccgaggtgggcagatctttgagctcaggagtttgagaccaacctgggcaacatgctgaaaccctgtctatacaaaaaatacaaaaagtagctggggcatggggacgcacatctgtggtcccagctacttgggaggctgaggctggagaattgcttgaagctgggaggtggaggttgcagtaagccaagattgtgccactgcaccccagcctgggtgacagagtaagaccctgtctcaaaacacaaaacaacacccccttcaaaaaaaatccaaaaccaccaccacaacaaaaaaacttacacagaaaagtgttgataattgtcaaaattgggctgttattggcaatttgacagtagctgaattactaccatttgagctatattcactatagataagatcttcaatatatttacaactttagtactaatgggaaaatgataacttttgaaaagttttttttttttcttattgcaaacaatacacaatacaatgttaaatatagaaggttaaacgtgcatctgagtctgtttgggctgcgataatagataccttagacttggcaatttataaacaatagaaattcattgctgacagttgtgaagactgggaagtccaagatcaaggcgccagcgaatctggtatctggtgatggctccctgcttcaaaaatggcgccttcttgctgcatcttcacctggcagaaggggcaaacatgagtccttcagcttctttttttttttttttctatgtttaaaacttttggtccggcgtggtggctcatgcctgtaatcctagcactttgggaggccgaggcaggtgcatcatgaggtcaagagatcgagaccatcctggccaacatggtgaaacccccccgtctctatactaaaaatacaaaaattagccaggcatggtggcgtgtgcttgtagtcccagctactcaggaggctgaggcaggagaattgcttgaacctgggaggcagaggttgcagtgagccaagattgcgccactgcactccagcctggcaacagagtaagactccgtctcaaaacaaacaaacaaaaaaaacaaaaaaaaacttttattttaggttcatgggtaaatgtacaggtttgttatgtaggtaaacttgtcttggggtttgttatagattatttcgtcacccaggtactaagcctagtaaccaatagttattttttcagattgtctccctcctcccaccctctgtcctctagtaggctccaatgtctgttgttcccttcttagtgtccttgtgttctcatcctttagctcccatttatatgtgagaacatgtggtatttggttttctgttcctgcattagtttgctaaggataatgtcagcctcttttttttttttttttttttttttgatacagagtctcgctctgttgcccaggttggagtgcagtggtgcgatcttggctcactgcaacctctgcctcccgggttcaagtgattctcttgccttagcctcctgagtagctgggactacaggtgcgcaccaccatgccaggctaatttttgtattttagtagagatagggtttcaccatgctggccacgctggtctccaactcttgaccttgtgatccgccggcctcgtctttttcccaaagtgctgagattacaggtgtgagtcactgcacccggcccaatgtcagcctcttttttagggaagtgatttaatcacttccctaaaagtcctacctcgtttttttttttggttttttcttttttttttttttttttttttttttttttttaggtagagtcttgctctgtcacccaggctggagtgcagtggtgcgatcttggctcactgcaacctccacctcctgagttcaagcaattctcctgcctcagcctcctgagtagctgggattataggtgcctgccaccacgcctggctaatttttttgtatttttagtagagttggggtttcaccatgttggccaggctggtcttgaactcctgacctcaagtgatctgcccaaaatgctgggattacaggcgggagccactgtggccagcccctgcaagtcctacctcttaatagtattacactggggattacatttcaacatgaattttgtaggggcgaggggcacaaacgtttagaatatagcacatcacatacatagtgagagaaaaatccctcaaaatcttacctgagacaatcactgccaacagattgctgtatagtgtgccaattttgtttgtgtgtgtgtgtgccttaaaaatatttattatggaaatttaaaaacgtaccccaaggtggccaggtgtagtggctcacgcctgtaatcctggcactttgggagcccgaggtgggtgtattacttgaggtcaggagtttgagaccagcctggccaaaatggtgataccagtctcctaaaaatacaaaaattagccgggtgtggtgggcacctgtagttccagctactcgggagaccaagtcatgagaattgcttgaaccctggaggcagaggttgcagtgagccaagaccatgccactgcactccagccagggtgacagagtgagactccatcctagaaacaaacaaacaaacaaacaaaccaactaaccaaccagagaaaactccctgtctgtaaggagtatgtgttctaatggatactgagccatcttgttctgtttaacatgtgcctaatgttcttttatatgggcggacttgtaggttgtttcaacttttctgttgatgaacctttaggtggtttctgattatttttgtgttacaacagttttcatcattcacatctttgtatgcatcttttttgagcacatgtgcaagtatttctgtggacaatggatgattcctagaaattgaaagtttggattactgtgttccaaaaaaggaagcaatacacccagctatgttggcttttgctcttgggtccagatgattatctgacaaagttattctctgattgcattttcttttcttttcttttcttttttttttttgagatggagtttcgctcttgttgcccaggttggagtgcaatggcgcgatctcggctcactgcaacctctgcctcccaggttcaagcgattctcctgcctcagcctcctaagtagctggcattgcaggcatgcgccacgacacctggctaattttttgtatttttagtagagatgggatttctccatattggtcaggctggtcttgaactcttgacctcaggtgatccacccgcttcagcctcccaaagtgctgggattacaggcgtgagccacagtgcctggccctctgactgcattttcacagtgttttgggtccttatctctacctcagtacctcaatattcagtgcccactgggcccttagatactgcagctaaaagtgcacaggggtggagtgatgtgacggttttggggtcacagaagcagctggtatagagagaagttgtgaagttttttttttttttcctgagacagagtctcgctgtatcccctaggctggagtgcagtggcttgatctcggctcactgcaacctctgtctccctggttcaagtgattcttatgcctcagcctcccgagtagctgggattataggcatgtgtcaccatacccagctaatttttgtgtttttagtagagatggggtttcaccatgttggccaggctggtcttgagctcctgacctcaggtgatccgcccacctgggcctcccaaagtgctgggattacaggcctgagccattgcgcctggtcttttttttttttttttaagtaatcataggcttgaatgtagcctctcatctgttcaccttaataatccaaaagcctttagataaagaaatggagatttggaatggcttctcagaattccaagagagtattgtcatggttttgcctgcaaagcaccgtggtctgtctccttgtgcagttgagaaagctggtggtcgccactgacaggcccagagttattaagttggacactgctttaagcaactttgtaaacaatccaaggcatactagagaattaggagagattggctttgtgtatgagcaataacaaaatcaagttcaatccagcaagtttttggggaattataattcaaaactcaaatacttgatctggaagaaacttggaaagagggaaggaagacaggcttgttacagcattgtcagggtaaaaggaaaataccgtgcagcttttaattttgcttcttcatggcattccccatgtaggtgccctagatttgttttttacagtggtcacgacttcatgtggatccacccaccactcttgcctggttccccaagggaccaagggaaggtgtattcaggatgattgctgaagtgaggggtggggtctgtggctgagaagactctcaataccgcggcactcattataagcctctgacacaggagatttcaactccacccgtgcaacaaaggaacagggtgggcaagagtagttacagttgcaggctgagtgcgatggttcatgcctgtaatcccagtgctttgggaagccaaggtgggaggattgcttgagtctaggagtttgagaccagcctgggtgacataatgagaccctacctgtacaaaaaaattttaaaaattagccagattggtggtgtgcgcctatagtcccagctactctggagaatgaggtgggtgagggtcccttgagtccaggagttcgaggctgcagtgagttatgattctatgatttcaccactgcattccagcctgggcgacagagcaagattgtgttcttttttttttttgagacggagtctcactctgtcacccaggctgaagtgcagtggtacgatctctgctcactacaacctgcacctcccaggttcaagtgattctctccctcagcctcccgagcagctgagattaaaagcggccgcttgtgtgcagctaatttttgtattgttagtagagatggggtttcatcatgttggtcaggcttgtcttgaactcctgacctcaggtgatccacccgcctcgccctcccaaaatgctgggattacaggcgtgagctactgcgcccagccatttgtgtctcttaaaaaaaaaactaagaaaatgaaaaaaatgacattggccaattcattaaaatgccactcactgactgtggtatgaaatggctttccctttgatggaccgagtctgtctcattgtgtgagccacttgcagggctgagtatgactctggaatgtagctcctaaccttatctgctgcccagccattgaaatggccatcccttccagttcccagaagattccagtgtgtgtttgggattttaagacagtctcttggtcttcagtgtggcatctttctgccggattttccaggataattttgattataagcattgcattgcccttggtgtgtaatgcctgtgtatgatgctgttcccttgtaacgtgcaggattaaatttttgggtcagccactgctgctccccttcattcctgcaggtcattagagtcatcgtacatttagcgatgtctcagatcagtgtatctagagtgttaataaacatgttagattccaaatctactgtccatttaatccatacttcatacgttgaggatctctgactgaaagattagacttggaaaaataataagactgtatggtaagaaaactatagttgcaaatccatttggacatgtagtatgtcagccctgcagagcagatgtcagaaccccatttagttctctgagtgctaagcccttctgcccaccacgctgttttttttttttgagatggagtctcgctctgtcactcaggctggagtgcagtggtgtgatctcggctcactgcaagctctgtctcccaggttcacgccattctcctgcctcagcctcccaagtagctgggactacaggtgctcaccaccatgcccagctaattttttgtatgtttttggtagagacggggtttcactgtgttagccaggatggtctggatctcctgaccttgtgatccacccgcttcggcctcccaaagtgctgggattacaggcgtgagccactgctcctggcccccacgcctttttttttttttggagacagagtttcactctgtcacccagattggagtgctgtggcacaatctcagctcattgtgtcctctgcctcccaggttcaagtgattcttgtgcctcagcctcctgagtaggtggaattacaggcgtgcaccacaacacctggctaatttttgtatttttagtagagatggggtttcaccatgttggccaggctggtctcgatctcctgacctccagtgatccacttgcctaggcctcccaaagtgttgggattacaggcgtcagccaccatgcctggacccctctgcccctttaagcactgccacatattagatctacgaaggctttatggatacaatccaaggaagatgaaccttgggctagtgggataaaactaagcgcatgtagttagaatggaatgatctggaaaccaggtcccaagttggtctaaattagactcatgttgactatgtcacactgtaaaccagtctaaatgctaataagcatgcttgaccaaacactgccctgcagccttcagagaggaagaaggaaaacataatttgtatcctctctccctattttctgagtctatgggattcaaattgtagctgccatggaaactgtactttggaatttctagagcccttaattttaacttaacatataaaaacacttttgtactgattttataattattcatgatggatgagaaagtgaatgtctttgacagtgagggaagctatccgaatgctattttcttttttttttttctttcataaagatgcatatatttgcatgctttatttacctggggctaactcttgcatcttttgcagattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtaggaggattttaacatcatgcttttccactttctgtaccggagtgttcattgcaaagacgataatctgctgcactggcgtctaggatcaagcacgttttcctctgtgactctatatttaattatagttggggcaaaaaggtctctcatgttcttagctcatcttcttgaactgatgttggctaattttgaaggctcacaaattcctcttgatgtatcatgtttctatcgttgtaatttatttcagaaccaaggtggccttttagctaatgaatttaagatgatcttttatgaccattagctgaggactcaggatatacatatggtggggtgaatcagattgcttttgtacacgctttaggtatttgtgttgtgggcatatggatttggttttaaaacaggcctttgaagaaatcaaataacattctttgttatgtggctagggagttgcttgtttgagagcaggtagaacgttatcttttttgttgtggtatttttctttcttttaaacaaggctactgtctctagacatattgattcatttgctgtgttttagagagatggccgtcagccttggaattcagagagtaatttattacttacagacattttagtgcacatgatatgtctgataatgtacccagctctgcaggaagcttgcaaaaggaatagaagtcccatggttgctattttcagtgtttaaaaacaaccttggaaagtggaggaaaaatgcaaatgtataaagcaggtgcttaccagctaaagtatcacagaagtgggagagcaattagcaaattaattaacgatgatgtgaggggagatgttgtgggtgagcaagggacagttagggacagttctcaccgatggggggaaatgtaggttctcggcagagagaagtgatgagaacatgttgggtagaagtgtgacattctggagtactagaatgctatgcaagtgtgtgtgtgtgggtgtgtgtgtgtgttcagtggttcagaacagactgggaaatggcgaaatgaggacatttgggtggggagggggaaatgggtgggaaactcaagaacctttttttaaaaaattgtggtaaaatatatataacataaagtgtaccattttaaccatttttaaatgtgcaactgagtggtattcagtgcattcatgatgttgtacaaccatgaccgctctccatttctagaatttttctatcatcccaaacagaaactctctatccattatacaatacctccccattcccccaagaaccagtttttgaattgcagtttactttgtgaggctgttggggattatttaggcctctggaaggaggaggttgggatcagagtctggccctgtggacttcaatgactttgtgtggcctccaatcagagaagcagcggagggcaggaagctgcttgtcagaatctgagagtgatgtggcttctttgtttagcaataaaatgtgagcacataatagaaaggaaaagtgacaggacatggcagataatttggaagagaggagtggaagatgctcactcagcctcccagctcctgagaaagaactgtgtctcatcagttcatactacctgagcatctgttgtatctggtgtgtttctaggtcctggagaagaggcattacgtgtagccctgaccttgtgatgcttatgtttttgatgggaaatagtgcgtgtaaaaagaaaataatccaacaggccacacggcaggcaaacaatagagatattcaaataggtataccttcctccaggtgaatggcctgaaatgaccgtgtggaagtgtgggctgggggcttataaaattatacacatacaggcgctaactaaagccgcctattcattccttaagaggatgcatagaaaagaaaagtagggtccttaactgagccatttggaatttaagggcatgagagaagccagcacaagcagtgaagggaaggaaaagaagtgcccgagaggagggagggatgctgttctgcagacaaggcctgccgcctgggagaggcccgcacgcccacccagggttctctgacagctggaaggggtcttcagagactgtttatattttatttatttatttatttatttattttgagacagagtctctgtcacccaggctggagtgcagtggtgcgatctcagctcactgcaagctccgcctcccaggttcacaccattctcctatctcagcctcccgagtagctgggactacaggcgcctgccacaatgcccggctaatttttttgtaattttagtagagacggggttttacctcgttagccaggatggtcttgatctcctgacctcatgattcgcccacctcggcctcccaaagtgctgggattacaggtgtgagccactgtgcctggccgactgtttctactattttagagagagggtctcactgtcatctgtgctggaatgcagtgatgcagtcatagctcactgcaccctcaaactcctgggcttaagcgaccctcccgcctcagcctcttaagtagctgggaccataggcatgtgctgccacacccagttaactttattatttatttatttatttagagaatgagtctcattctgttgcccaggctagaggtgcagtggcacgatctcggctcactgcaaccccgcctcccaggttcaagcgattcttcttgctcagcctcctgaatagctgggattacaggcacctgccaccacacctggctaatttttgtatttttagtgcagagggggggtttcaccatgttggtcaggctggtctcgaactcctgaccttgtgatctgcctgcctcggcctcccaaagtgctgggattacaggcgtgagccaccgtgcccggcccactttattattttaaaaacattgttttatttttatttttttgagacagagtccgctggagttcagtggccggatctcactcactgcaacctctgcctcctgggttcaagtgattcttgtgcttcagcctctctagtagctgggactacaggcgggtgccaccatgcctggctaatgttttttgtatctttttagtagagacggggttttgccatgttggccaggctggtctcgaactcctgacctcaagtgatctgcccactttagcctctcaaagtactgggattacaggcgtgagccactgtggctagcccccagctaactttaaaaaaaaattttgtgggccgggtgcagtggctcacgcctgtaatcccagcactttggaggccaagcagggcggatcacttgaggtcgggagtttgagaccagcctgaccaacatggagaaaccctgtctctactaaaaatacaaaaaattagccgggtgtggtggtgcatgcctgtaatcccagctacttgggagctgaggcaggagaattgcttgaatctgggaggcagaggttgcagtgagcttagatcacgccactgcactacagcctgggcaacaagagcgaacactccgtctcaaaaaaaaaaaataaattatgtagaggtgggatctccctatgttgcccggactggtcttgaactcctggcctcaagtgatccttccatctccccctcccaaagtgttgggattacaggcatgagccacccctcctggctgagactgcttattttatttatttttaattttttttgttttgagactgcttattttaatggaagcttcaggggtcagacggggtcagacagagtcattggtgagcaagcaaaggtgtagactgttcagttcagccttccttggacaccttttatgtgccagacaaaagaaggatcagcatatcaggtgcagtaaattattggggttatgttggtgtttcccaaatgtgttagatttatccctggtagtgttaaatctcatgattttaggtagtatatggacaacctatgtaaaaacatttaatagtttaatattaactagcatatcaaaacctgtgactttgctcacgcctgtaatcccagcactttgggaggccaaggcgggaggatggtttgggcccaggagtttgaggccagcctaggtaacatggtgagaccctgtctctaaaacaaaacaaaacaaaacaaacaaacaaacaaataaacaaatcccctgtaacttgttctaacaataacctaaacaattttttatttaaaattaaataaaaaaattgaaacagtaaccatttttttttttttttttggagacagagtcttgctttgtcacctagtctagagtgcagtggcacaatctctgctcactgcaacctctgccttcaaacaattctcctgcctcaggcttctgagtaggtgggattgattacaggtgcactccaccatgcccagctaatttttgtatttttagtagagacggggtttcaccatgttggctaggctagtcttgaactcctgacctgcagtagtccacgtgccttggcctcccaaagtgctgggattacaatcacaaatttatagaaaagttgcaagtaccatgtagtcagggttcttaagagaaatggaaccagtaggagatagatatataatcatctcctaggattataagttgacacataagactaaccgtcacatacagtataaacaactttttttcttaaaccatttgatagatacacacacactgatatacatagaatatatatacacacacacagaatgtatatacacatagaatatatgtgcatacagaatatatacacagaaatatatatgtacacatgcatagaatatatttacatatatatgcatatatataatttatttattttaagcagttgatttatacagtttttgtttttgttttttttttgagacagagtctcactctgtcacccaggctagagtgcagtggcgagatctcagctcactgcaacctctgcccccgggttccagtgattctcctgcctcagctccacaagtagcacaccaccatgcccagctaatttttgtattttttttagtagagacgaggtttcatcatgttggccaggctggtctcgaactcctgacctcaagtgatccgcccgccttggcctcccaaagtgctgggatttcaggcgtgagccaccacacctggctcccataatgtcttttagaataaaacgatcgagttgaggatcacacgtgacacttaattgtcctgtctctttagtctccttcaatctggagcagttctttgatttttcctggactctcatgaccttgacaattctgatgattataggccagttattttgtaaaatttgaatttgtctgatgttgcttatgtttagatttagggtcttggtctttggccggaatatctcagacaagatgctctgttcttattgcatcagagcagaagactctctgtttcagttgatcacatttatgttgatgctcactttgatcacttgattaaggtggtgtcagttatgcctttctacttgtagggttactccttcctccttcgtgattttatttattttatttttcttagagacagggtcttgcttggttgcccaagctggagtgcagtggtgggatcttggctcactgcagccttgaactcctgggctcaagtaatccacctgccacagcctcctgagtaactgggactgtaagcgaacaccaccacacccagctactttttgtattgtagagatggggtctcactgtgttgtccaggctggtctgtaactcctggcctcaagcagtcttccggccttggcctcccgaagtgctgggattacaggcatgagccactgcacccagcctcctttgtaattaaaaaagtattttatggggagttactttcaagtgatggaaatattttatatctatgtggacttggattttcctatttcagtcagtgagttataatccatttctgtcactagttttatacttaaattgttcccaacttggccactgagaacctttttaggttagcttttgtgtccttttcacatgtctccaagattcattgaatactttcctgctttctggtatagcaagatgttcaggttcttttggtacttttactttctctgccctggctctggcatcagtcatttctcagaggagccctgtgcctttcagtggacaatggtgtttagaggccaagatctggacattgggtgttttcattgctaccggtgtgtcactactcccagacccctttcagtggacagcactaaggaatacacatacgtatatacaatatatccacctacacatgtgcgtgcactcacacacacacatatacattacatctatatttgtgtatccatgtctatatattgaaaattgtggctgggcacagtggcttatgcctttaatctcagcattttgggaggctgaggcaagaggatcacctgaagccaggagttcaacaccagcttgggaaacagagagagactctgtctctacaaaaataaaaagggaaaaccatgagttcacacccgtgcccccagttccaatccaacttcacagggttcattttagttttcaccctttccatgtttgtaattctcttctctgacattatacccttaatatgtttacttattttatgcatctgtatgcatccaatctactgtctttgttggtatcccacctccccttggtgggtccagataatctgctctgggttgccctttcacgtggatgtcttccttaccctgtgtgggcctgtgatactgggctgcccccacacatgagtgctgccctcctcacgttgcttgggacggcactgtgtcctgggccaccatgacttttctcataactagcgtggatgcttaccttgttccacaccagtgaatggcttcaggaagagaagaggaagagaaaaatatttacatttaaagaaaggtagtttaaagaaatatgttaggtaaagaattgagcaggtaatatacggagctggcaaaaattgtgaccaaagtaggtgaatgattgagatttatgcaattctgggctaagtgacagccccttccctttcccttcccttccccttcccttcccttttcttccctttcccttccctttccttccctttcccttccccttcccttccctttccttccctttccctcttcttccttccttccttctgttttcttttcccttctttcctttgcctttttttttttttaaagctagaaacatcagtttaggcataaagacagaggaaaaggcttctttttcctctcacagttctttataattgtctaagcagtttcttttttccctaggtttcattttttgaggaagagcggaacatattatctcgaagcacaagcccgtggatcccccaattacagtatgcctttcaggacaaaaatcacctttatctggtgagtctttacatctgtctctctggaattagcctagcactctgacactcagatgcctgtggtagaactgaatgttgttcttgcccatgtggtctcattcatgcaaagactttcttaccttacaggtgtctccctggtttcctcgttataaagatcaagagctaacccatttagaaacagcctcattgggctgaacgtggtggctcacgcctgtaatcccagcattttgggaggccgaggcgggtggatcacgaggtcaggagatcaagaccatcctggctaacacagtgaaaccccgtctctactaaaaatacagaaaaattagccgggcatggtgtcgggtgcctgtagtcccagctactcaggtggctaaggcaggacaatcgcttgaacctgggaagcggagcttgcagtgagccgagattgcgccactgcactccagcctgggtgacagagcaagactctatctcaaaaaaaaaaaaaagaaaaaaaaagaaacagcctcattgacagttggatattgtagctgtggctttcaggcaataatagggaatcatttattggggaatagtctgtcattatgtataagataatcttgctttaatttttaaaaacttcctgtgttagcttgcttaggattaaaaaaatgataatagtgcatggttgttataagaaaatgcaaacactgcagacatgcatgaagttgaagggaaagccccccattttcttttccttttctttttttttgagacagagtctcgctttgtcacccaggctggagtgcggtggcactatctcggctcactgcaatctccacctcccaggttcaagagattcttctgcctcagcttccctagtagctgggattacaggcacgtgtcaccacgcccaactaatttttgtatttttagtagagatggggttttaccacgttggccgggctggccgcaaactcctgacctcaaatgatccacctgcctcggcctcccaaagtgttgtgattacaggagtgagccactgtgcccggcctctccgttttattttctaatcctcctccctaggggaagaaatgttaaatggttacataagctttccctttctgacccttaactgtgctctgtaggagcatggtgggggatgtttcttttcttttcttctttttttgagaccaggtctcactttgccacccaggctggagttcagtggcatgaacatggctcactgcagcctcgacttcctgggctccagcaaacctcccacctcagcctcccgggcatacaccactgtgcctggctaatttttgtatttttagtagagacggggttttgccatgttgcccaggctggtttcgaagtcctgagctcaagagatcttcctgccttggccttccaaagtgctgggattacaggtgtgagccaccatgcccagctccggtgggggatatttctatatccacatgtgtatagtttactttataaaaatggtatgttactctgtgcttggctctccagcttgctgttgcctttcaccagtgtatcccagacatcctttcttccttgtcagtaacgcaggtctactttattctttgagcagtggcataattttccctgatgtgtatatatcataagttagagaatgctaaaattcattttggggccttgtttaggttcttgagggattaaattcctaaatttaacaagtgtatcctggaaacaatttttgttcctgattcagcccttaaaagaggactatcatgttaccttgaatggagataaacaggctcacgtaagagaaaagggtaagagggatgaactcccacttatcttaaacttctactggcccgtttttggggaatttgctgcttttattcctgacctaaaataaataagtttatgtgtcttggtttcatattagttgagaacccagtgcctggagagaagttttccttgtcctctgagtgaggacattcacatatgaatctattggcagactggctttgactgaccacacgtgccttcagaaccaatgccacagctcttaggtttatggcctgaaacaccctttccttacatattgccttagaaactttccttccttgagacatggggcatggaaccctcaccttcacagatgaccttggtgtgtttctagggttgctggtgttccaggacatctgttgcagatgcagtatttaccttgtgctctctgcatcataagcagcttctcatgtttgaatgtattaacagacttttaattttttttatttttgagacaaagtctcactctgtcacccaggctagtgttacccaggctggagtgcaatggctcaatctcagctcactgcaacctccacctcctgggttcaagcgattctcttgcctcagcctcccgagtagctgggattacaggtgcatgacaccacgccctgctaatttttgtatttttagtagagacggggtttcgccatgttggtggggctggtctcaaactcctgacctcagatgatctgcccgccttggcctcccaaagtgctgggattacaggcgtgagccactgcgccttttcttttcattttttttctgagatggagtctttctctgtcaccaggctggagtacagtcatgcaatctcagctcactgcaacttccacctcctgggttaaagtgattctcctgtcttagcctcctgtgtagctgggactacaggcgtgtgccaccgtgcccagctaatttttatatttttagtagagacggggttttgccatgtgggttaggctggtcttgaactcctgacctcaggtgatccacccgtcttggcctcccaaagtgctggggttataggcgtgagccactgtgcccagcctcaggcttctttattaagaagaagttcgggccaggtgtggtggcttacacctgtaatcccagcaatttgggaggccgaggtgggcagatcaggaggtcaggagatcgagaccatcctggctaacatggtgaaacctcgtctctactaaaaatataaaaaattaggcaggtatggtggcgggtgcctgtagtcccagctactcgggaggctgagggaggagaacggtgtgaacctgggaggcggagcttgcagtgagcccagattgtgccagtgcactccagcctgggtgacagagcgaggctccgtctcaagaaaaaaaaaaaagacgttcccttgaaacaacagggcttttgtttgttttggtttgtgtttgtttgttattgttgttttagatacgtatttttttctttcttttttttttttaagtgatgatgtctctgttgcagtggcatgatcatagctcactgtaacctcaaattgcagggctcaagtgattctcctgcttcaccttcctgattagctgggacaacaggtacaaaccaccatgcctagcgaatttttaaatttttcatagagactagggtctcactatgttgcctaggctggtttcgaactcctggccccaagtcatcctcctgccttggcttcccaaattgttgggatcacaggcatgaatcaccacacccagcctatttttagatattttaattcgagctctacaggaggtttagaacactagcttgtgaagataaacttcattttcaaggccacacagaatctaagtggtcctggaattaggaagggctttgattttttggaccaaagttgagagtccacagttttctggtctaccttgcactgctccataaactcatatttcttttctctgagctgaagagctccccttcttggtgtctagtctcaggcaacttattcttaaaagtaagcattattgaaatgctttgggattttcacatcatcaaggtccattttggtagaggcactgacagattttgagtgttctgtgtgaaggaactcagttgaggatttagtggtccatgtggcaggctactgctcagtagcttcagggaaaccactgcttgcctcccctgtggccagtgaggatgatcagaggagtcccagcaggaatgcccaaatgtagttttcttacatgttgatgggagtgcattgtttcatgtctaaacagttctcaaatcacatcttcaggagggtactatctgggcactttgataatttctcactttgatgtcaccgttcttattaccatcacctagttttgtcatagtagaaataactttcctttttctgtgtgtgtgtgtgtgtgtgtgtgtgtgtgtgtgtgtgtgttttgagatggagtcttgccgtgttgcccaggctgtagtgcagtggcgtgttctcggctcactgcaacctctgcctcccgggttctcctgcctcagcctcccgagtagttgggattacaggcgtgtgacaccacgcccggctcatttttgtattttcagtagagatggggtttcaccactttggccaggctggtcttgaactcctgaccttgtgatccgcccaccttgacctcccaaagtgctgggattgcaggtgtgagccaccacgcctggcttttttttttttttttttgagacagagtcttgctctgttgcccaggctggagtgcagtggcgggatcttggctcactgcagcctccacctcctaggttcaagcaattcttctgcctcagcctcctgagtagctgggattacaggtgcccaccaccatgtccggcaaatttttgtatttttagtagagacagggtttcaccatgttggccaggctggtttctaactcctgaccccaggtgatccgcctgcctcagcctcccagagtgatggaattacaggcatgagccactgcgcctggccacctttgtcttcttagttgtggatttaactgctgtggacatctgcttgggcatagccttcccggagtacctcttggattgggactgtctgtgggtttctgtgctaggacaggctcccagatgtaggaggcttccccaatgatctcaccactggcatcggcatccttagcttctactcagcttttccatctgccatcttgcaagatggaaggttgttttgtttttgtttttgttttttggtttattttttttgagatagagtctcgctctgttgccaaggctggagttcagtggcgcaatctcggctcagtgcaacctccacctcctgggttcaagtgattcacctgcctcagcctctggagtagctgggattacaggcgcgtgccaccatgttcgtttaattttttgtatttttagtagagacggggtttcaccgtgttagccaggatggtctcgatcttctgacctcatgatccgcctgcttcagcctcccagagtgctgggattacaggcgtgagccaccgtgcccagcctaggagggttcttaatgcagctgttttttggagttctggttgcctcagcacactgctacttgggtcaatgacatttttactcccttgttttgtagctcaattgggtattactgatgggattttgtaattattaatattttcttgtctccattttcttctcaagtactttgttgcttttgagtaaaatgcttgctaagggtatagttttcacataaaagctcaaatttagcatggaaattaagatatgctcatacgtctgccatcccttatctgtaattctgaaatacctagagttctgaataacctcaaattcttttgttacttgtttatcagcaaaacctgatttgaactcagtttttggcaaaacttgatccaagctctcttaaggctctttttagtctttattcattccctttagtgtgacttcccattttgctataaaattatgagtgtgtttgattacaaggtgatgtcccagaccctactgagggtgttacataatataaactgtatgtatggctgggcgcggtggcttatacctgtaatcccagcactttgggaggccgaggcgagcggataaccttagttcaggagttcaagcccagcctggccaacatggtgaaaccccgtctctactaagaatacaaaaattagccaggcatgatggtgggcgcctgtaatcccagctactccttaggctgaggcaggagaatcacttgaacccaggaggtggaggttgcagtgagccaaggtcatgccactgcactccagcctgggcgacaaagcaagaatctgtctcaaaaaaaaaaaaaaaaaagtgtgtgtaccactttacctttctaaaatctgaaaaattctgaatctggaaacccattctgcttcaagataaatggatcctagatttatatcggtaccgtacagtcctgaaattccatcctatctattggccacttttacatcaacaaacctttgaagtttggggaaacttacatatcacgctcccttggcagttgaacattatttatttattttgagatggagtctcgctttgcccaggctggagtgcagtggcgcgatcttggctcactgcaacctctgcctcccgggttcaagcaattctcctgcctcagcctcctgagtagctgggattataggcatgcaacaccatgcccagctaatttttgtctttttagtagagacggggtttcactatgttaaccaggctgttctcgaactcctgaccttgtaatcttccctcctcggcctcccaaagtgctggaattacaggcgtgaaccaccacgcctggccctgaagatacattttaaatcaatgaaaaaaacaacaggattctacctcctatggtatatccctcctggctgtctcttctctccagtcttgcctctgctgtgtgggtttcaggcatccatcttctctactctgaattactgtgataacctctgaagtattttccctgccatctgtctggcccttctcccaggtcttccacatactgcagccaagtcagcccgctgttgaaacccttcaagactccctgctgtcctctggatgaagtccagactcttccacgtgacttaccaggcctttcttgcacttgtccccagccacttactgtttctctctttctaccttaacatcctgaacttcctttggttctttgaccttgcctctgacctttttccatgctgttcactctttccctgttcaccttgctaactcctctttctctttctgggttggatcagatttcacttcttccagaagcccttcctagaccctatacttctggaatggcgccttttgactgtacgctcattgcaccctgtacttctcctttatgagtgggtgctggtctgtcccactaggctacttcatccataaagggagagtagagctttaccaagtcaatgcttaagcaatatttattggatgaatgtgtgattaatttcatagaaatttgatgtgcattcaaatttacttattgtattacggaacttgcattatattctcagtggagttattttctttcacgtgtgtaattcaagatagactcagtgagattttcaaaatttggaatgcagtgcaaggaaattgaacttgagttcttttgcattttgatggttaaaaatttcccatttgtggtgacataccacaataagccagtgaatgtggcttattgttttctggtctatagaaaattgtcgcaaactctgtcataatgtctggttctatataacaaagctagtcctgtattctgcatgtggctgatggaaacagtgctctgttgatctggttcatgaagaaatctgttcaattctgcataacagatgccttcatcagtgtccttccatgaaggagctgatcttcacaaagaacacatagttttgcatcccaccacttgcagtatttttttttttttttttttttttttgagatgcagtctcgctctgtcaccctggctggagtgcagtggcatgatctcagctcagtgcaacctctacctcctgggttcaattgattctcctgcctcagcctcctgagtagctgggattacaggcgcacaccaccatgcctggctaatttttgttgttttagtagagacggagtttcaccatattggtcaggctggtctcaaactcttgacctcatgatctgcctgccttggcgtcccaaagtgttgggattacaggcgtgagtcactgtgccctgccagtattgttttgtctaaattatttgtgctgatgtttttcctactgtggttttcttcagattacccttgctctgagcctgcaattgactcatgaacttcttttccatgttctaaccttacaatgacttccttgtgttcactccaaatgtttttccctggttgcatgtagagatgtattagctaaggtacatgcttagctgctgtatcaaagagaccctaatgtacaacccaggctggtagagcagctctgctgtatgtgttaattcagggacccaggttccttccatgttgtgactccccccttccttaggatgttgtcttcttttacatggctgaagttgggccatttcatgtctctgttccagctgcctggtaggaaaaaagaacagaaattcagagtaagcaaattctttttctatagatggatgcggaagttggacacatcatttcctctcacattttctcggccagaacgtagtcatgtgactgcacgtctagctgctaaggagactgggaatttactgtcggctgtgtggcctctgtcaagctaaaattcttattactgtggaataagggaaggatggatttgggggcacaattaatagtctgtcacagaggctaaaacagctgcttttggctgggcacggtggctcacacatgtaatttcagcactttgggaggccgaggcaagtggatcacttgagatcaggaatttgagaccagcctggccaacatggtgaaaccctgtctctcctaaaaatatagaaattagccgggcatggtggcgggtacctgtaatccgagctactccagaggttgaggcaggagaattgcttgaacctggaaggcagaggttgcagtgagccaagatggtgccactgcactccagcctgggcgacagagcaagactccatctcaaaaaaaaaaaaaaaggttaaataaacagctgcttttgtaggtgatacaaggtacagctaagctttgaagccaggcctgtagtttcaccttccatattcttactcaaggcattatacttctggatctgaaaccactggatctgatgccctgcttgggatgagttctttatattatcttgctttcaacccacacctgtgtaattttatgggcagcgtttgtttcctatataggaacaatttgaaagtgggctgtttctaggctttcatgaatagcaggctatgctgtcattgggaatctggagggagttaatgaacacaacttcattgtttactttagtgaaatgtggcagcttatgatagttttgacagtgagacatgtgctgttttgatctctcagctaagattatctgatttttcaggcatgtctcaaaactcaccaggcctgctcacatgctgctgcttctgaagccagggtttggaaaccagctgcccatcagaatgaggctgtgacttagaatattggttcttgttttattaccattccttgtttggtctctccagagtcactggccttttccgcttcaattttcttatcggtgaaatgagatattaattcctcttattgacttcaattcaattgctgagtgtattgttgcctttgggaggttctttgagttttctgtgcctttgaaatagttgtttttttttattctggtgttttgaggcatgtttcaagtgagtgcatttacacttctaccattttaggagccacaattcagttatgttgtcccagcttgcttggccccatccccagagtttctgattcagtaggtctggggtggggcccaataatttgcatttcttcttcttttttcgagacagagtctgactgtgtcatccaagctggagtgcagtggcacgatcgtagctcattgtagcctcaaactcctgggctcaagccgtcctcccacctcaccctcctgagtagctgggactataggcatatactaccatgccctgccacctttttaattttttgtaaggatgggggtctcactgtgttgctcaggctggtcttgaattcctgggctgaagtgatcctcctgcttcagcctccccaaatgccggcattcctggcatgagccactgcacttggccaagactttgcatttctaactagtttccaggtaatgctgctgctggtgtagggacctcattttgagaaccattgttctatagctgtagctatagttagtttctggttatagcttcttccttttgtcccttcagtaatagtgtacacatccgaaatccctgtccttgctctttcaggcccaggcatggtatctggtcctcttctgttgctagccctggggtgcttcatcatcccaagtttatttttcttctcctaacctgaacctttgtaaatagccccttccctaatgaacgtcctcaattccctgttttgcgtgtcctgtctgtttcttggcaagactctggatgattcagtactcaatgaggatttttcgcatagatggatgaaacaggctgggtttcatgttttctaagataaaggtgcttctctctttttctcttggtcactttgaccaagaagaaaataacagagtttttattctcaagaagaataatatcggggccactctgctcagaggccactctgctttgaggaccccttctctcctccctcatgccaaagatcaggaacattgggcagagcggataacgatgccgccagcgtcattacattttcacggcactttcagttgtgctgagcgtgcaaacatttcaaggagacatttctaagaggtggctagcacagcatgcctctaatgccctatgtgaattggaatagagtactaaagaactgttcaatattcaccccatccccgcatatgcaagcatgcacgtgggttcattgtatatgtgtgtgtgcacgtgtgcacagacacatttgtccttcgtttcaaatgcaacacaatggatggaaattgccttcctggtactggggtatggatgcaaacaccaacagagaagcagccgctacttccaaactgaacacatgtgagatttgccctttaattagcatctgcagctgctgccatcagaagggtctgtctctgttggcctgaaagtctttgctttaaaagagcaagtccattatagctccaagccaggctcgtctgtcagctgctgtgctttctctgccatcagcggggttgccacattgttttgggctgtttcactctaggactctttcctcctcctgtgcccccagcctttgattaccatgccttggtgatcctcatttgggtgacctgcagctgctcattgtgtgtgcaggagacatctccagtccttgtaaggagggaagatcactggcttcagtgctgatggactggttattttccagccctttgtcgtcagtgatcttgtcttgatatgcagaaaggctccaggtagtcactgaaaaaaatataagcagcagaggtgatggctatatgaaagtcacgtttcatcaagggcattgctgctatggaaactttcaattcacttggagtagggagccatattggttccacagcctcctcagcagtgggtcccaacacagtgctgggctagctgcctctgaatcaccgcagtagctccttttactatagattcctgggtcccacccatggaatgtgatccatgaagtctggggttattccctggaatcctttaagctccctaagtggttgggatgggaaagagatatgctttatgttactatacttcttcttattattattttaaaattcttgccgggcgcagtggctcacacctgtaatcccagcacattgggagaccgaggcgggtggatcacttgaggtcaggagttcgagactggcctggccaacatgatgaaatcctgtctctactaaaaatacaaaaattagctgggcatggtggcgcatgcctgtagtcccagccactccggaggctgaggcaggagaatcgcttgaacccgggaggcagaggttgcagtgagccgagatcgtggcactgcactccagcctgggtaacagagtgagacttcatctcaaaaaaaacccaaaaaaacaaaactctttttcattataccggaacgtcagctttatggagtcggggattttttctgttttattcactgctgtttccctaacatctagaatagtggctggcacgataggcactcaagtattgatttagatgagtctattttattttcttttaaatttttaatttttattagaggtggggtctggctttgttgcccaagctggtctcaaaactcctggcctcaagcgattgtactgcctcagcctcccaaagggctaggataggcatgagccaacatgcctggcttgtcttatttttaacaagcacttctggtgattctgatggacaatcaggcttgggaagttctaacctagaggacctacagttgtcttggggtagaagccaaggctatcctggtttttagaatcagtgccttactgggcatctctgaagagtaaaagtcagggacagagttacatttttggacaaaaccagatgctgtgaatggactcttggtcacaacctgggtggcgacttggtccttaacttcttcatcattttctgctgaccctgttctttggttcacagcaagtcacctgataagaagactcaaagactgctagtttgttactttagatgatgcttttggaacctcttggtaccattttaacaatccaaacgtattttatgaaagcactcaagtcctgggtctttattgtatctttaagctctaacagcatgatgattgaataagctgtggttggccacacacaagccatcttccccatggcctccattcatactagaatgagcagctataccccagtagtatagttttgggatatgggtaacatcttgggatagccacatttacttagtaaatgtctggcttacattctcctaatggtgcactgttggaatttttggtgtggtaacctggaatagtgttggtgggtcaagtttgattagcatctttgataaggacccggtctatttagaggtttgtcattgagtgtgtctgttttggcctcatgttgtgaagcatgctgtgtagcagctgttgtaatttttgttgcttgttttctcaatcaaccctggttttgaagaaatgggaagttgttccactcttagactgatctgacttgggaggggattttcagttcaggaagttggatcttctgaatggaagcaaagaatacatgtctttttgccactttacaagctggctcttgttttctgaactattttactggtcattgcaaatagaatgtcaggagtagctgccaaatactaagttgtgttcagtttgtcagttcttaagagttgccggtggctgctctgctatgcgtatgactttctcagccttaaacttacaagccatactgtttttttcacatctttaatacagccataggaaatttataactgtggcgtgtcgtcataaatatgcattgttcttattttaagacatttcagtactaaaagtataagtacttctgttattatctgtgaatttctttcctttttctttttttggatatttaagaccttttcgatgtcaatatatatttaaaacagacatataaattagcattcacccacatacccagggcctatggagaaccaggttgggatgagtgggtgagctacaggcagccaggtggctcctgtgggctcctcgaggactggggtgagtaactaatgtctgctaggaacttgggggaaagaaggtgtgtatgttaggtgctgcccccttctaagtgttcctcttgttcataattttttttttttttttttttttttttttttagatggagtctcgctctgttgccaggctggagtgcagtggtgtgatctcagctcactgcaacctctgcctcccgggttcaagtgattctcctgcctcagcctcccgagtagctgggactacaggcatgcaccaccatgcccagctaatttttgtatttttagtaaagacggggtttcaccatgttggccagggtggtctcgatctcttgaccttgtgatccgcctgcctcggcctcccaaagtgctgggattacaggtgtgagccactgtgcccagcccataaatcaaaattttttcagcaattgttatacaagtggaaccttactcttcaaatgcaattgtccagtgtctggcttaatgtctgctgttgtcagaaaccatgtgaatggagtagattcccaggttataaggagcccccagggaggatgcgcgagtcactggcttctccaggggtctctggtttggggttgccttggtgctgggcacacttcctggagattttactggaccagcctgaggcctttggggctctgtgcagatgctctacttctgacttgtctagagctttcttctaattctggactaaaagcaagcaggagtttggaggatgatggtgagaattcacatccccgagttggcttttggaatgcagtagtttgtgagatttagtgttttttttaagaagtatattcagatcttgcctttttcccagaaagcatatgagacaacttccaagacatttatagcatggctaataaaatgggaaatcagggcgaaggacaggagaactcaataagggttaacatggctacagcgattgtctaaatgggttctttttgctggccagagcagaaaggatcatgcagtaaagtgggggggaagaaagggaattgaatggtaggtgaagacttcatgttggtgccaggcactgtgccaggccctcctaggaccttgtcttactcaatcctcacacagtgctgcaagaggattagtcttatccctgttttagagaggatgaaactgaaaggcagcgaggtgaagtcaccagcaggaggctgaagccgcccaggctaactggccttatagctacctagggactcaggaatatcacacctgtttatcatcaaaaggagaaaggatttcagttccttggggtagaagagtttctttttgctaatcaaacattttacttgaggcttcatattcttcttcaagatttttttcctgtgtatgtaccaacacatgtaataattccttgtttatttcaaaaaaggggttgtactttattctttacaagatttcactttatattgtcatggacaattttccatggcagtatgaataaatggaatctgtttgtttttaatatctttgtcttatcccattgtttacatatgtcatattttagccagtctctaactgatggatagctgaatgatttccatgtttttttcccctgttacaaacaatactgcaaggaatctatttatctttctatttatctgcaaactattgtaagtacctgtaaattgttagaagtggaattactaggtcaaaggggatattttcacatttaaattttgaatagaggctgtcagttgccttccacactgactataaaaggaaaagattgtatcacatttattgcaagccttctgtattctgctgggtgctgaggggaatacagaaaggatataagagtggttgccctctaggaatatccgtctacactgtacctaatcctagggaatgtctggggtgtcaacttgtgggtgggaaagtgggtggatttaattcaactgttcaagcttgccttgcaaacactgtgcatggtgtctgggactagtctttcattatattgattcccctgggtaacagatgtaatttccttagggcagggacttcatcctacatgacttacagcgtgccttacacatcttctttgctttgtggagaccttgttattataacacgtcaggtgatattcgaggatctaattgaggcattccctatttttgggtgtgtgaagaattaataactttggcattctatacaggtcatggaatatcagcctggaggggacttgctgtcacttttgaatagatatgaggaccagttagatgaaaacctgatacagttttacctagctgagctgattttggctgttcacagcgttcatctgatgggatacgtgcatcggtaagtgagactctggtagcatttttatgctgaggattttcctgtgtcgcataagagttcctgcatggaaatgagtggatgagtgatttcaagatcaagataacgccccatccagtttttagccagtctaccaataactggctgaaagcaaactttccaagatggaggacatttcagcttgcttatccagcagtgcaatagatctagaattgtaatgtgctcaagtttgctagtaatatctattaatgtagctaaataagactgggaactcttgcatgagttctttgggttatatgatagaagaactgaatttggtttgcagaaggaaatgtcataccacatagtagtgtaagaccatggagctgtacttctctaactctgcccgttagaatttacaattttttttttttttttttttttttgagacagagtctagctctgttgccaggctggagtgcagtggtaccatattggctcatggcaacctccgcctgctgggttcaggtgattctcctgcctcagcctcccaagtagctggaattacaggcacgcaccgccatgcccagctaatttttgtatttttagtagagatggggtttcaccaggttggccaggatggtcttgatctcctgacctcatgatccacccaccttgtcctcccaaattgctgggattacaggcatgagccaccatgcctggcctacaaaatcctcagttggtaagtggttcttcatgtcttcattcatctgatgttttgtgtacatctgagaatgttgtgggaatacaatgattgttagtccaggaatcacaaaatttgagatagagtctcagcttttccattgcctagctacatgaccttgggaaaatttcatagctccttttggccttagttttcctcatgtgaaatgtgtgtctctaggagaaataatccattgaataatatgtgtttcatttctcttccttttctttctctcctatccttccttgctccctctcgccctttttctctttccccctctctccctctctctctccttccttccttcctttcggttaaattcattttgcaaaatgtatgctaataatttatatccaccaatagaggaggtctatataacagaatacataaacaaagatttttggctcaattgagattctaggttagcacttgcttgctgattgggatggaggaggcaattcatggtcctgattttcttacagagacatcaagcctgagaacattctcgttgaccgcacaggacacatcaagctggtggattttggatctgccgcgaaaatgaattcaaacaagatggtaaaaaatggaataagatagcttaatagagtttatactaaaaagtattcttggtcctcctaagtttgggaagtgttgggataaaatggtgaacaatgttttggagcctttggcagtgtatgggggtggggacagggacacagaaccatttcccagaccgtggcacctttttatttatagtgcctgttaataccctccaagacatttttaggagcattgttatagtttggttagaaataaaggaaaatgcttattttgtttctctcttcattttccttgcctgttatagactgtcttttgttatattatcttttttactttaaaatattttgatgaaatggaaactcctgcatgtcaaatcctctatttcctatgcagcaaaattgaaattaatcactggagcatttgaaccaaatatccttaagtgttaagaaccaagtgctcaaaatatcatttttaagtcttggatctttggtagaaattaaactgtattccacatgctaagtaggacggcaggagggtagctactgagatcaagagtgagactactttaggaaaaagatgacaaagtaaaaaaagattagagtttaaaaatcttctaataaagttggtatgtactaaaatatgaatttggaagtcaactccgcaaaaaaggataggtctaagagaaaatcgacttaggttttaagactgattttacaactgagccatttggtgacctagacaaatccttgggaacttgatcttttatactttctctagaaaaaactgatgctagtgaaaatgcataatttaagaggttagagaagctgctcttcaaaatgccccccaagtctgagagttaaatcctttacataaaggacaatatgtaaaattttctttttcttttttctttttttttgagacggagtctcgctctgtcccccaggctggagtgcagtggcgcgatctcggctcactgcaagctccgcccccctgggttcacgccattctcctgcctcagcctcccgagtagctgggactgcaagcgcccgccaccatgcccagctaattttttgtatttttagtagagacggggtttcaccgtgttagccaggatggtctcgatctcctgacctcgtgatccactcgcttcggcctcccaaagtgctgggattacaggcataagccactgcgcccggctcttttttttcttaaactgcttccagaaaagtggatattattaggttgatgttaagaaaaggcttggagttgcattaactttttgctttctagcatctggcctgtctgttctgcagacctgagacctacttgagataattttcttggtgttcaggcccttggaaaaataagttccctatgttgtccagtgtcaaagtttctcaacctcagcactattctttttttcaggttattttcttgtaatctgttcacttgatcattacattaagaattagattatattgctataactacaaagcattttatgttttaaaaattatgtacaatttagaaacaggcatgaaaacttaggtattaaatttagtggaataaagcacagaaaaaaagttaaaataatgcagttttatcacttaggattaaacatttatatgggccgggtgtagtgcctcacacctgtaatcccagcacgtttggaggtcgaggcgggaggattgctggagtttgagaccagcctgggcaacaaaatgagacctagtctctacaaaaaatcaaaaaattagccagacatggtagtacatgcttgtagctccagccacatgggaggccaagacagtaggatcgctggagcgaaggaggttgaggctgcaatgaccgtgtttgcaccattgcattccagcctgggcgacagaacaagaccctgtcttaaaacaaatttatatgctgcattcgtgaaattaaaaaaaaatcatggatttagaaataaattgaagcaaggtacattgacagtgtaacctcagcactactgacattttgatctgaataattctttgttgtgggggatgcgctgtataagatgtttagctgcatccctgactcctacctcctagatgccattagcaccctcccctccagatgtgataaccaaaaatgtctctagacattgccagatgtgcctggggtaggagggttgggggaagtggggtttgagaacccttagttgatcatgcctgcagtaggttgagaagcatcagaaagctaattaattagacaggaatatgtgtttgcagtaagaaaacctcagcaaactaatcaagttccaaagttactgcttggtaaataaataggaattaagaataagaccctatctctgtgtctggggtcattctcttcggagctcttggtggagagacagggttcccagtttcaattttttagtgcttcagactgcccttttcagttataattgtaacaaccttcactccaggtggggagcctcccaggtttatttacaacaaggctcaatctctgattattttggtcaaggagatatgacactctataccacacacttgagaatattgcctctctttttctcttgagcttttagggttggaacgtgacaggcagataaggaattttttgcattaagtgcaaagtcctttttcttatagaagagcaataatctgcacactagatcaagtcaagtgtggatataaaattataatttttggggggatatttttaatagtggttttgggttaaacatatttcctttaaatgaaatgtctgtaggcctaaagtaggttctaaatgttgcctgtactcatagtataccatataaaatataatccacatttactggaactaccatatattacttaccccaaatcaatcaatcccttccctatcacccccacgtaatatcttcgtattttggatacctgtgaatcttagatctgttcagttttccattatccattgtcttatttcaagcttctcattcagaatgttgctttggagtattttctgttagtaaacacagggcctagtgactctaggacctgctgtgtgacttaggtcacccacttcactttattagaatctcaaagaatggtgaacagctgagttccaatctgtctcatttggctctcatgaaaacagtcataaggagattgtagataaaccacattatatagcatagtaagtgataatcaaccccatttggcagttgcaaccccacaagagatagccctttttagatttgtgtaggagtgaaaagctttattttccacaagaggaacgacatagtaagaactccttttccccctgcttctgcaggtatatgcttatgccctaggcaacttgatgggtaaagttaggtttaaatagttttatttgtaagctcttctcttctcttctcttctcttctcttctcttctcttctcttctcttctcttctcttcttttctttcaagacagagtcttgctctgtcacccaggctggagtgcagtgggcgaccttggctcactgcaacctccgcctcctgggttcaagagattctcctgcctcagctccccgagtagctgggattacaggtgcccgccaccatgcctggctaatttttgtatttttagtagagatggggtttcaccatgttgaagcattttatggaaaggggttaggaggaggaagacattggttttctttcttcctcatctgctttttgttagtgaaagaacctgctaagctaactcttttctttctccctccctctctccctctttcagttcttcccccctttccttccttccttcctttcttttccttctccccctttctcccaaaatatggcagactcttctgtcccctagtcattctcatatagtcttctgaacttgtttattttcttccctgttaatacagtaaaaattaactaagttggccaggagtggtggcacatgcctgtaatcccagcactttgggaggccgaggcgagcagatcacctgaggtcaggagtttgagaccagcctggccaacatggtgaaaccctgtctctactaaaaaaaaattgtaaaagttagctgggtgtggtggtgcgcacctgtagtcccagctattcgggaggctgaggcaggagaattgcttgaacccaggggctggaggttgcagtgagccaagatcgcgccactgcactctagcctgggcgacagagcagtctttaaaaaaaaaaaaaaattaactaagttaagtagtacttgggccctatcagatagtgtcctcctgcaggcaggctgggcccctactacagtttcacttttaatatctcaccgagattagctgactgaattgccaccagaggagagtgaaagcatattgcaaaatcataatcaggacatgtgagattatgtgttgaacaggtttaatgtgcttgggggtcagtgactaatgggaacttagcagtcattaactgtcattaaaaatgtttgttaattactattacacacttagagatttgttaattaacaaagagtaatgcctttgctaatcactattatgcacttaagaggaagccagtgggtatttttcccttcatagctttctagtacaaattaataaaatttagaaaattagaaaatgattgtgcataaatgtgtataatcatgtatctgttagggggcaaaaattagttggggaattatctttctttgataagtcttatcattagtttgaaaatggggcattggcaattcatactgtttggctgggttgtcctgagaaacactccccagtcaattctgtttttgcaactctttggttgtgaacaagtgactgccctgtgagctgcaaataaggagaactgaatattcctgaacagtctgtggcaataaaaatgaaatccagtaagtgcaaatggtatgtattcaacaattgcgtagttaggtcctgcaaggtaattagacataaaggataagtatttaatcaacaatatagtagcattttcattacctagtcaaatcaagatgttacagttttccttctcttgttttgttatttaaaaaatatctattgtggccaggctccgtggctcacacttgtaatcccagcactttgggaggccaagatgggtggatcacgaggtcaagagatcgagaccatcctggccaaacatagtgaaaccccgtctctactaaaaatacaaaaattatctgggtgtggtggcatgcacctgtagtcgcagttactcgagaggctgaggcaagagaattgcttgaacctgggaggaggaggttgcagtgagctgagatcgcagcactgcactccagcctggtgacagagcgagactccatctcggaaaaaaaaaaaatctattggttattgttggtgcattttaaccaaaaccctttagtttaaccctaacctgtgctgagctctttaacatttacatacatattaaaaaacagaatcagcccagatttcccaacatattaagtcttctccttgacttaagctactttcagttcttcaagcttaagtcaccctgtggttttgtcttaggccaaatattttcccctttgtctccccttctgtctatcaagccaagcctgcctgtgggttttggatagtgtgaccatctggctttcttgaaggggcacttacaggggaagttttattgcccaaaccggtggacaatccatgtcaggaatgattatatcacactgctttctgggtttagggcttggaaaaacctgtatcagagcgtgggccctagggaagaggtaaaaagagaggagagggaagaataggtctgtttcatataacgagaaagtctcatggcagaggaatggatgagattcaagttacaggctggaagagcttcatccagaatcagccccggggagaggagacctcatcacgtcctcactaaacattcactttcctctccacacccagttaaagtaaagcaaatttacttccttggtgaaaagcccagccttcaaggtatgtggacttacccacaaaatctcttggctcactcagtttcacttaccatcgtttaatgaggaaaaagttcttttgtaccatgtaactgctgacctgagagaagcccattatgatatagagttataggacagctggccaacacactatatagctaaaatcagggcctctctgttttgatggggagaaaagttagagaaggaatctttagacttcaaatttcatggctcagtaaaacgtcaaaataattttgaagaccaaaggggttgctagcttactaggctgcctagacaggggtgggtatgaggggaagaaagcctgcttctttcatcaacagcatatccagaaacaaaggacatttaaacactaaaaaagtcagaaggacaaattctcagaaaaaaaggacagtcctttaaatgggttacatttagctttataaaatgccctcctgtattgtcctaatctttctttgccaaggtcaagtgcttgggtgccattggattataagcccctgggtttctgaacggtgggggagggaaccacaggaacaagggttaggggtgaggaaaaagaactcattaaccttgggccctgggtggaagttaattatcatgtcttgccctgtgggtgggttgaagtaggaacgttaattccaaaggcagttttccaaatttttgaacttgagatttgtaatattatcttgccagttagccaccagttctcttctcttttttcttttcttttcttacagtctcgctgtcacccaggctgcagtgtaatggcgcaatcttggctcactgcaacctccgcctcccaggttcaagcgattcttgtgcctcagcctcccgagtagctgggaccacaggtgtgcaccaccacacctgactaatttttgtatttttaatagagatggggcttcaccatgttggccatgctggtctcaaactcctggcctcaaatgatccacccaccttggcctcccaaagtgttgggattacaggcatgggccactgcacctggccaactgccagttttctagtaatggttaggttgatattttagattcatttttagagtttattatcattttgctgttatcataagagaagttccatcatgtcaataacttgtattaggaaagacatcttccattcccggtatatccaactctcattcgtataactgaaggctgtgtgtatatcatcaacaattcttgcccttttgcccttggattgcattatatgctgtgtgctttttttttttttttaaattagtaaagcgtttgcatttcctgacagtgtgccacttgacagctggtttaagtgcctgggagaatagtaatcagtggcaaatcagcttgtgtctgaaatgtggctgttggcagtctacttgaggataattgaaagtttgctgtattcgttttattgatgggattctaggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccaggtaaagagtccttagaagatttcgaagtcacattgagaaacgttatttaaaaattgtgcgaatgaggctgggcgtggtggctcatgcctgtaatcccggcactttgggaggccgaggtgggtggatcacgaggtcaggagatcgagaccatcctggctaacatggtgaaaccccatctctactaaaaaatacaaaaaaattagccagttgtggtggtgggcgcctgtagtcccagctactctggaggctgaggcaggagaatggcatgaacccgggaggcggagcttacagtgagccaagatcgcgccgctgtactacagcagcctgggcaacggagtgagactccgtctaaaaaacaaaacaaaacaaaacaaaaaaccaaaaaattgtgtgaatgaatgtttctagaatgttgtttaaaaattgtgttcatgaatattttatacgtattgtgtgaatgaatgtttatagaatgttagatgttatttaaaaattgtgtgaatgagtgtttcagcagtggtggaaaataataatagcaaatacttatatggcacttaactctgtgccaaaggctattctaaacattttattaattgtatttcacggaatctcagctgccagtaatgataagactacaccattattttatgtactgctacggaagaaaaactgttgccaatgagtctatgatatttttattgattatagaatgcatcttgatttcagtgctgttaactgtgaataactgtgagtcttagaattgaggagatatagtttagtcagttagttaatcttcaaacaaccttgtgaggtaagtattattattttcatttatagatgaggaaaccaaagcactgaaggtgaagtaactggcctgaaataacacaggcagtctggccctgaagtccatgctcttgatttttcgatatactccttcttagtactaactgttgaatatggtattacaattgaatgaggaaatgaattagaaatacaattacatatagatatgtgttttactgtatatatatatatatatatatatatatatatatacagtaaaactattttctaataactgtgctttctactacattaagcctattttttttttttttttttttttgagatggagtcttgctctgttacccaggctggagtgcagtggcacaatatcggctcactgcaaccctgcctcctgggttcaagcgattttcctgcctcagcctcctgagtagctgggatcacgggtgcccaccaccatgcctggctaatttttgtatttttagtagagatggggtttcaccatgttggctaggctggtcttgaactcttgaccttaggtgatccgcctgcctcggcctcccaaagtattgggattacaggcatgagccactgtgcctagcctgtgaagctcatttcttaaggctctgataaatgtatatgttttagtttcaaccaaaaggaaaaggaacgtatttcctagatttttgtatctcacctaattttcatctttctggaatgcttaatacatatttttatgtacatacattatttgttattcttgagcctcctcttgagtgaaaatttccccttagatgactcttggagctaatttatttccttccctttagctcactcactcattcaatcattcaataacgagtgcgttatcataccaggtactgttaggtagcaggtttacagggatgagcagaagaagcaggccctctctgccttctttctttttcatcacactgaaatcacagcgcattgtgtgtgtgcaaaagtagagtgcagagggaacatgcagaaaggagttataggatagaaaaggtagccaaggaaagcagcaagaacagcatgatttgttcagggatctttaaatagctcatcattgttggacagcaaagggagagatggggaatgtggcaagatgagatgagaaggggagccggggtcaagccatggaggacgctgaacccctacaaaggaactaagcctattgatgtgaacaggccacttattttgggaacacgcctttggtccaaagggaagagggcacgaaacttccttctctaaaaaacaaaaaaaaagaaacttgcatatatgagaaatactttcttcactttgcagcatgagaaacggaatccctactaaggaaataattctcttattttttttggaacagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactgtaagtagggctgttttccttaatttgggatgttgggattatgaaacactcaagagagatctgagattgttctggcccaaagaagcttctgtaaattacataaataaaggctttaattatctacaggagtagtaaaggctaatgatgtagctgtctttgagtaataattctgccttaaaattgtttgtgtagaactgggtcatttatcaaactctgtgtttatgtggcctttagaatattatccctcagtaagttagaggcacagattaatggagtttgaaggttgtcacttggtttgacacagtttcttccaaaaaagtggatctaggtatttcattcacatatcaggaaaaagactcagattaggcaacatgcccaggttgttctgctaatggctgagtttaaacaaaaaccataaacacctccctgtgtttattcatttgtttccctcgataatatttgtctttgctcacaagcatgtaaaacctataatgtatatgcacagtagattcattcatacatcactttttataatcagttagtgcaaactgaatgaattcattaaaaacaaagacctggtttattatcaacagaaaccacacaatgctcttttttcttttaccagttggtgatcttttaaaaatccttttaattcttggatgtgttgttgattgaatgtgttctactgaatgatcagcacggattagagccagtaggaaagcagttatcctgtttgagtatgtgttttgtttttggtgatggagggaggttgggaaatggaatctgtttctaggtgtcaaaaccaggcttctgattggagatgtgttataattataattgcttgcaccttcagctaggacatagtatggtaaaaaatcagtattgtccagttgtaaaccattttgatggtttctctaaccttctgctgaaatatttaagtaggtcgcatttccataaatctttcttggcaaatgtttttattattcgggtggccacattgctttatttttctaaataaatagacatctccccccaaatctccaaggttcagaccttctaatcagtaatatattttcagggcattcttccttttatgcttttagaaagatgtaatagactttcttttagatgctgttcaagtacttaatcttttcttgtcttgcctttttatctctgtaatcttcttgaataagcagttaattttttttattcatgaacctgctgatcatgtctaagaatgtatctccacttaagtaagtcagtgaatggtgattacctgagtagagttaaagtagtcccccaccctcctatctgtggcacatatgttccaagtctcccagtggatgtgtgaaactgatgatagtactgaaacccatctaccttttttcctgtgcatacatacctatgttatataaagcttaacttataaattaggcataatatatttgactcccagctcccagtgtagtggctctgaagactcacaaaatgtatttgctttaaaaaattcttttttttttttttgagacggagttttgctcttgttgcccaggctggagtgcagtggtgcgacctcagctcactgcaacctccgcctcttgggttcaagcgattctcctgcctcagcctcccaagtagctgggattataggcatgcaccaccacacccagctaattttctatttttcgtagaaacagggtttttccatgttggtcaggctgatcttgaactcctgacctcaggtgatctgcctgcctcggccttccaaagtgctgggattacaggtgtgagccaccacgcctggccaaaaaattcttttaatttaagtaaatctttatttatttacttttgagacagagtctcactctgtgggccaggcaggaatgcagtggtgtgatcacggctcactgcagcctcgacctcccatgctcaagcagtcctcccacctcagcctcctaagtagctaggactacaggtgtgtgccatcacactctgctaatttttttgtatttgtagagacgcggtttcaccaggttgcccaggctggtcttgaactcctgagctcaagtgatcctcctgctttggcctcccaaaatactgggattacaggcgtgagccattgcacccagccctaattttaataaatcttttattttggaatagtattagatttatagaaaagttgcaaagatagtatggaagagttcccacatacccttcacccagttttccccaacgttaactcttttttatatttatttatttattttttgagacacagtcttcccgtcgcccaggctggagtgtggtggcacgatctcggctcactgcaacctccgcctcctgggttcaagtgattcttctgcctcagcctccgagtagctgggaccacaggtgtgcgccaccatgcccggctactttttgtattttcagtagagacagggtttcaccatgttggtcaggctgatctcaagctcctgacctcaggtgatctgcctaccttagcctcccaaagtgctgggattacagacatgagccaccgcacccagcccccagtgttaactcttacataacagtgtcactgtctaagtgtttgaaaaactatttgtcaaaactaatattggtacattattgttaactacacttcagactttttttggattttaccaattctcccactcatgtcccttttctgtttcaggaatcaatccgtggtaccatattgcagttagggtgtttatatttgatgggactggtcctagtttagatacttagtgtagctcagccagcaggtgggatcttcatgcccaccgaggattggtattgtgttttcctggtggttttatggcatttccgactatgcagagaggcatggtattaacttcagtgtctcctagcaaattttcctgtttttcaccaacctctgatccctgcattatttgcaatcaactcagagatttgtgattgaaaacattgcttgactccatgctctttaagctattttctaactaggtaactgtaacataaattatgcttttatctagcactgtttttcataaacacatgttgagtgattttcatcaaccgaaatacttcgaatcattaagtttcccaagttcatggatgctgcttaaatgcctggtggttccaggctgtcgaatatttctgccttctgcaataagagattgtcccttgttaaaagcaacattagcctttgtgcggtttcacccccaattcttctttttcttgttgtaaccaatgaaaggaagtactgcttaacacagcaggtaataatcttctaaaactcattatctcaagaggtggtcctggcaggatatataaatgcaatttaagaaaggtcttggcaaatttatgaatgacagaactgggagtggctaccgagagaaactaggatgcgcctttgctttgacactgaggtcaggcgtagcttctgtacactcctgggtcctgcctcttggggttgctgcaggcagcaccccatgaaccaggcatctgacccagttccaggatacttattcttccagcaagtcgaacactctgtgatgagtgactgccatgctcatgggtcaccaggctctcattattctgtttcatttccagcctcccacaagattggtttttcagctgcttatttattattatcattatttcaaggctgctttccaagtttcagtggggggtttcctaagcgtaccagctgccctggttgtgcagttccggcgatgtttcagatgctgggccggattctggctgtacccagcctgatctttctgggcttcaggaaagctgaagccaatcagagctcctctttcatgcctttgggattatgcttaccttgcctggcatcgtgtacctgctcccatccatgggaaagttttgctgtctggtactgtcttctatcaacatcttttaagatatcttcccccgaggcatcgtgatgtcaacggaaccagcacacttgtacgttttatgcaagactgccatatctcaacagtgagaaatgcataatggaagtggtgatcacggattatttcctaggacattatggctaatgcgctagagaactcggatggtctgttgcgtctgacatgggctttttctcttgagttgtctttcttttgctattctctgaaagaaacaattcttgccacatgatcctgatttttcaggtcctcagcatttgttagcagaaagtacactttgtttccatccggcagtgactcagtggtggtcccatgctgatgaaacgctgagatagtcttcttccaaataggtatcgttttgattgttgctgcttatttgctagctggccctcaatagtgacaatgaaacctcaagtgtataatatggttgctcaataatcctgagggaagacagtctttggtttgggggatagggattctgtgcctacttagcttcaggtgaaagtcttacaaatttttgtgtgtagaaataagcaccatgtacctccttgggttttttctttttttttctagtcctttagtatggtcaacaatattgtttagggagtacctattctgtgctaaccactaggcattcaagtatattacactatgctccttcaaaacacttctgtcaaatgtaaggattattatacccattttacagatgtggttactgtggtaacttggccaaggtcatagggcaagtgaataagggattctggatttgggtggaggtctgtgtgattccaaagcccatgctctttctacaatactatatatgcctttgcataagttattgttattagtaataatatttgtgatgatggcaaataataaaccatgtcacactagagagtgatttaatctctaggtctatttaagaacatttggaattgcaggaattggatttttttttttttttaagtgatggagtcttgccatctttgcccaggctggtctcaaacttgtgggctcaagtgatcatcctccctctgcctcccaaagtgatgggattacagatatgagccaccatgcccagcctagaattgcaggaatttttgaattgatgattcattctgatatttgaatttctacagtatgttaagtgcaatgtcaggtgctggtgctgtggctccattgatgaacacatttgggtatggccctaccttcattgaatttagagtctaagagcctaaccggtcttttgcttgaatagagctgtagtcctgttaaattgctgtacctccaaatggtgggaagtttaatgcttcgtaggcctcccctcactagtttactgaaccacatgtgcttgatttttttttgagatggggtctcgctctgttgcccaggccggagtgcagtggcgtgatctcggctcactgcaagctccgcctcccaggttcacgccattcttctgcctcagcctcccgagtagctgggactacaggtgcccgccaacacgcccggctaatttttttgtatttttagtagagacagggttttaccatgttagccaggatggtctcggtctcctgacctcgtgatccacctgcctcagcctcccaaagtgctgggattacaggcatgagccactgtgcctggccccacatgtgcttgattttaagcaaaatacagactataggctgtgacctggtgatctcttccccacatacagcatcctgctaacctataactctccccatgtctcagatctagcctgggaaaggacaatgttggatcgatggcccacttctaatcttgggatttctaatctcaagatgagttgagaagactcaggatgtgtcctgttttctgtttatttagaacagggtttctcagccttggcactgttgacatttggggccagataattctttgctgtgggggctgttgtgtgaattgcaggatgttgaacagcatcgctgtgctttctccatggataccagtagcaccctccccctgcagttgcaacaaccaaaaatgactctagacattgcccagtctccccttgggggctacagtcaccttcagttgagaaccattgatttagaagaattggccaggttattatcaggagagggaacatcacagtaatctgaatctctcaatactgccactgttactgttaacgaacagcaaaactattacgtggaggcagtaggaccttgctactcagagtgtggtccgtggaccggcagcatcggaatcatctaggagcttgttagagcttcagagactcaggcctactgagtcagaagctgcattttaataaggatccccaggggatttctgtgcatattagagttgtgaagccctgcaagaggaagaaattggatgctagcctcagagtttcttgctcatctttgtgggtcttcctcgttttgtcttcgggcttaaggtatggggaggccactttttggctcaggactcctatgggtgaatgggactgcttagaactgctgggttttaggccttgctttgaggaatttaaagcttttctcttagatggacattacatcgttcatatacttcaaaatggtggtttgacctaatctctgccttctgatagcaaaaagatatttccttgactccctgaaccccactttactgttgtcccatattggattttaattaagggtggaataagtattcttcactaacatgtttatacatgtatgatattaccatgccatttattgagtgcctagtatgtgccaggagctctgcaaagtgctttatgcttattattgttccatttattcttccccaaacctctgtgaggcaggtcctatcactagtccacaatacaaatgaggtcatggagcccgaagttggcagtggtaggaatcaaactcaggtctccctgactctaaattctctttgcctttgtttttttgaaaaagtggtatagcccatagcagaaaattcacattatacagaaggttatacggcgaaaaatgcctccttcccaccccacgcccaacccctctccctcaagcgaaccactattgtcagtttctcatagaactttccagaatattctatgctcctataacactagcacaacctatcctcttaacaacatctttatgctgcctcccaagaattcagtaatttttttttttttgagatggagttttgctctagttgcccaggctggagtgcaatggcgtgatctcggctcgttgcaacctctgcctcccacgttcaagtgattctcttgcctcagcctcccgagtagctgggattacaggcatgcgccactatgcttggctaattttgtatttttagtagagatggggtttctccatgttggtcaggctggtcttgaactcccaacctcaggtaatccgcccacctcggcctcccaaagtgttgagattacaggcgtgagccaccgcacctggccaaattcagtaatttttattggcaggttattttcccgcatcattgaaatgaatgaagcaatctttatacttcattcatttaagcatggccctaccatgcttatccttcgaatctgccactcagccattggtttctgataagcagtgctcttctcaaatgaaaaccccttatggcttttttttttttttaaacaaggccacaggtgatatcatgattttgacattattttttcatttattttgtttagtgtcctgcctttagaattgcattatctcaatggcttgtgcatttagtgtgtgtgtgtgtgtgtgtgtgtgtgttgtgtgtgtgtgtgtgtggtatgtgagcacgcacatattcgttttgggccctttttttttttttttttgagacagagtcttcctctgtcagccaggctggagtgcagtggcacgatctcggctcactgcaacttctgcctcctgggttcaagcaattctcctgcctcagcctcccacgcagctgggattacaggcatgcgccaccacgcctggctaatttttttgtatttttagtagagacgggtttcaccgtgttggccaggctggtctcgaactcctgacctcaggtaatccgcccgcctcggcctcccaaagtgctgggattacaggcgtgatgttttgggccttttaaagttcatcttgtttgtgtattcatttgtttggggccttttaaagttcttcttgtttgaggcttcctgtcatttgaagggttatctggtcatgttttgttttctaagctagttccatgaggatcatagatatgcttctctgttaggcttggttggcccttaaacttgtcttccttttggacactcacttacttcaggggcaggaggaagtgaggaagaggagttgggtctgtttggagtatcagcatggacgggaaggggagcaagagggatgggatggtaaagtagtgatggtagaaattcaacttactagaccaggagcgtgtgggcgccacctactaaaacaaaaaaggaataatgaagagctatagtcagtagctcttataatctcttatgggatatgtaggcaaatatttatgtgtctcttgggggctgttctgtttttagaaggtaaatgattggtaagaaaaaataggccaaaaagagctaaatgcttatgaattaggattataggattttcccccactagtctgaatttagaagctacttccagagatgtcaaaaatatgtaatattctactttattccaagataaattgagggcaacttattctagaaataattgcaatattaaaaatataacaatgaataaatagagaaatctagatgaaaggagtatgaggatagggaaataaagttagggttgaaagtaaaaacaaggaagttcctgttaagttgccaaaggaagaatgatttgggactctcagtctcccagtgaccaaagcagaaaggagaatataaacagttacaagagccccagtcgcatgaaaaaaaagtccagaatgctctgctcagaggagacccaattttctgaatactgagccctgaggaatttcaccactgggtttcccataaatgagaccccctgtgacctggtgggccccatccctcggaagtgtaccctggcatttccataggactgcttccttctgggcctcttagtgcaagccagcagtgcaatgccacatccaagtttggtaaatcaattctaagtgagataaattaatgccttttttgggggaagatgggaaacagagtgggtttgttggagagcccataaattggagtcttcaacccttaaattctcacttgcgggaaaacctttcacaaccaagcaaatgtggaaatgatttggccaaagattcaaaattatattaaacatctgggactatattcagcagccaactttctaatcaattctatgagtgtggtgattgcagttatgctcattttctgagggtgaagtttggatagaactaaaaagggcggttggcaggaatcaaaagagatgaaagcctcaggacaaagagttagaggcccaggtggttcatgactgagagtttggaaatgatttctggtgtctcacttcagagaaaataaatatagccaactctgttcatccgtggtgatggaacattcaactacagcactggcagtttgggatctaagaccacccttccagcacttcaaaattctgacttataaaggacacacacaaagaacagatagccagatagagaccaaaatacccactttattcttggcagggcaagcacccagtaagctctgatgcagggctctggtaaatttgcccatcctaccaacagagaagaatggtggcctcccctcatgaacggggtcggaggggggccttgccacaacagggggcctgatggaaataagggggacaagagtgttcggttggttgagtgcctgctatgcctgtgcctaggcagtaaaaggggaagttttaagtttggcccttactttcaagacatagtaattctaccttctagtaaaacatggccaaataaatgtctgcttttcatgagccagataacctccttcttctttattggaggagtgagtagaagggtgagactagccgggtgcgatgtctccaacctgggcgaaagagcaagactccatctcaaaaaaaaaaaaaaaaaattaagaataaatcttttcactgttggagaaaagttttgagaggctgaggtgagaggatcacttgaggccaggagtttgagactagcctgggcaacatagcaagacccctgtctctaccaaaaaataataataaaaaaagctagctgggtatggtggtgtgcacctgtaatcccagctacttgggaggctgaggtgggaggattgcttgagcccaggagttcaagcttatagtgaactatgattgcacccctgcactccctcctgggcatcagagtgagacactgtctctaaaaaaaaaaagttggagaaaaggatactaaagagataaaagggtactaaagagatcgggaaggcagcaaagaatgaatctagtctgatgtgttattgggtgtacgtaattcatggcggaaggtgctgaaagggaaggttgcctgggcctacagcaagcaggtgctgatgaactagctcctttgctattacttaaatgtgtcctggttgggccagatgtggtggctcacacctgtaatcccagcactttgggaggccaaggcggacggatcacttgaggtcagaagttcgagaccagcctggccaacatggtaaaaccccgtctctactaaaaatacaaaaaaagtatccaggcatggtggcaggtgcttgtaatcccagctacttgggaggctgaagcatgagaattccttgaacccgggaggtggaggttgcagtgagccgagatcatgccactgcactccaacctgggcaaaagagcaagactgagtctcaaaaaaaaaaaaaaaaaaaattcctggggaatatccaccagggtgaaaaattgggtatatccaaattcagctttgcaaagaaatgcactcatgactagttgcaatttgaaacgttcctcttctgagtatttctagcctatgtaggtgtttcacagattgctgagtacctagactgagagggagagaaaaaaacaaagtaaagctaaaatgttaagaagtctggttaaagtgcaatccagaagtgagggaaagcatctctaaaagtatgaatctttggggaaacataacttgattaccaaaaacttaatattaagcagcctcataggaacatggcttttgggtatggcgagagccagctagagctcacatctccattgaaatccaccaccagagaggttatctgcctagttgttggcagccagaccctggcattgtttagattgattgatggaaggctactttgggaatgctggcttccttattcattgactttaaagacagcattgtaaaaattgatcaccagcccaaatcaatgttaccctgaagtatttttatgactttttggggaggcaaagagatgggataatttttgatttatttaagtctattgcaaactggaactcctttgtcttctttttgaactaccttttttgtttttttgagagagagtcttgctttgttacccagactagaaagcagtgatgcagtcacagctgactgcagccttgacctcccagactccgatgatcctcccatctctcccatgtgcatcaccacacccggctaattttttgtattttttgtagagacagggttttgccatgttgcccaggctggtcttgaactcctagactgaagtgatccacctgctttggcctcctaaaatgctgggattacaagtgttagccaccaggcccggtcttgaacttcgtatatacagtgtgttgtgtgggcaagtcatgcctgaccacttcctagtgggaggggagaaactagagggcttgcctgaggctttaggcaatgtaatctgttctcttgggatcaattacttatgcatatttagtagccagctctatttgctgatcacctaatctgttctcttcgttcattcccatgagacttcgatatgggatatcttcctcttcttcccattgcagccttttctctcagagttgttcccatgataagaactcccatcaaaatctctgctctaacatcagttgtcagattttgccacttttttttttttttttttttctgagatgatggaatctcactctgctgcccaggctggaggcagtgccaccatctcggctcattgcaacctctgtctcccgggtttgagggattctcctgcctcagcctcccgagtagctgagattacaggagcaccccaccactccaggctaatttttgtattttttttagtagagatgggctttcaccatattggccaggttggtctcaaactcctgaccttaaatgatctgcctgtctctgcttcccaaagtgctgggattacaggtgtgagccactacgcccagccacattttgttacttctttctgtaacctgaatgtggaaaaactcactgtctttcctccactctcacaccataactgtcaacaccacagaagacttctgtgaccaaatatgtggtcaccaccaagcaagcagtaagttctgcagtggacaccactaggcgtcctccagttcagttctggcactatccgcctggagatagggctcaatcccacaggtggaggtctcagtccccaagaatgtcccctcttcaggcaccagttgcaagtccaggcctctggaacttctcgctgactggcttcaaattggggttcctgcagccccctctttgagttcaattaattggctagagctgctcacagaacttgggaaaacacatttactggtttattctaaaggacattgcaaaggataaagatgaagaaatgcatagggcgaggtatgggggaagggttgcgagcttccacgccctccctggtcgccctccaggaacctccacgtgttcagctatccggaagctctccaaactctgtcctcttgggacctttcatggagacgccattggataggcatgatcaacaaccatgtagaaatgggattgcacgaaaaggctatgatctaatcctcataggctgagtggggaatcccagcaaggcctgtttgttcagatccttctgtagcattcattcctccaggttatggggcaggaccccttctgaaatggggtcttctgacctacaatcagacaaggcagaggaaatttctttatggccagctccaagtcagaaaggtgggggaagattagagtcctgccttgagcagatgaaaggagggctggaggaggtcagagagagagagattctgtttttcaaggcctgcttctaaagcctaaagcacccctaaataacaaaagattgtaacaaggactatgggagtcataagccaggaaccgtggatgaaaacctatatatatgtatatatatatctcataataattcaaacctgtctcctgttaatcccatcctctctgtttctgttatcatttccttagtgtagatctgcctaagtgtagaatttgtagaatttgtcatgttgactattgtagacttgtcttttagagtttctagcactagcctcttccacccatcactattgagatgattgtatccgtctcagtactgacactaacccagcactctggttttacatctgtcaatccatcaagacttcactttcactttcttccctgcctcattattcactatgctcttgggccattgctctggcttctggggcttttctaaagtagcacttttccccactccagcccatgaagataccttttaaccagctcttgagattaaatcccctccgtgacactttcctgcaggaacttgcaaaaaagtactgcattccccactggcaaaacttgccatcagccagtttatgtattctctgcttttcacacccatatcttgacctctgaacaacacacatattctcctcttcatttatttcacagttctgtcttcataacattgataagtatgatcacattagcgctctagattttaagcaactggaagatagctatttttttggtactcttcctttaaatttgaacatagtgtctaattagtcaattaacatttttttaaaagggcgagggacatcatggtagagagaacgaagttgaacgtgtttttggttgaatattagcgcatgcccactgtattctaggcacagtcctgattcattatatcatcacacaataattatttatgtgccttcatcctttatgacacagtgctggctcttattcatctcccatttctgcaatccatggtgatgattaaaagtcttaggagttttacgaggctcagtattttttttttttaatatgctagttcttcatgaatacattgggtactctgaagcatatcatttcctgggtttcctgaagtggtatgttgcgtggaatggcacattaggtctaaataattatcccctatgtaaggttcttgtttttcattcattctcttaaaaaatagatattaaacattaaataaggacagccaggtattgtttgaggtgttagtgggctatgctaaaaaatcaaaggtgggaatgaggcagctggagctcaaaggagcatgttagaaggagtcccaagaggacaaatccatttggttcttctttccttgttttttttcgaatatttttgaggatgataatttttttcccctcaaaagcttttaatgaatgttaggattaaaaaagagagagagagaatttatagaagagaaattaactatagctcctaaaatagctctttgtttctgaaagccttgattctgctatctattttataactgaaacaaaaacaaaaacaaaaacaaaaaacaacctcaagaagttacttgtatagcctctgccactaaggagactgtgttctgatgttacctcaaacaggctgatttattaaaatatttaaaaatatatatggaaatatttttttctatttttttttttagtggcttttcccagtgaacaataggtcttactatatgatttcttatttgtcattagtgaatgtggtgggtatgtggcagctgggggagctgatgatttcataatactgtatcagaaatgattagtgtaggtacttattaacatatttctcagacagaacaatcttgacttttaaaacctcttcatttaattcaaacatcaagtaccctgtttgtggcctgtgttatgttaggtgctctctttacaagacctattttcttgctatttaattatatatttgcttagcaaatatttactctgcacctactaggtacctggcactgtgctgtgtactgaggtgccatgtgtacctccatcaacatagactcaagatcaatatgatttcagtgaactaaaaatacctttattgaagcaaaaaaaaatcacattttgtaaggatcaaaaaagagacattttatataaggtacaagaaatagaagaattatatccccaagatatatgtgataacatacttgttagtttttggacgtgaccagattttacacaatccttaaaaaatgcagcaaccagattttaaagtagttctctaatctctctttctgtgccccattagatgtatattggatcttctcattctgtctttgtcttttgacctctcatgttttccgtctctttgtctctgtgtgttgcattgtacacaaatgcttcttgaactgtggtgtgcacatgaatcacctggggaccttgttacaacgtaggttctgattccatgggtatggggcagggcctgagattcttagagaattaaattctaaccagctcctgagtggtggtgataatgccagtgtgtagaccatagcttaagtatcaaggttctatgtgattccctcagatctaactgctagttcactaagtttctcttcagctgtatctagtctgctatttaacatattcagtgaatttttaaccttaaattcaagaacaagactttttatttatggaagttcagtttggttcctttcaaatgtacctggttctttttcaaagtgtcatgttctttgataagaatttctactaatttaccttgataataaaaatttgtttcatggctcattttagattgttcttttatctgcagtttttggagggctaattctcccatttcttgtatctgttgttgcacccgtaaggtgtagttgttgatttttactttttaattgtgaatttatttctggtagggattggaaggaggttgttggggtgggggtggggtggggagaaaatcctgtgtgccctgggttgcaaaaacacccctacaagttgttctccacttgcatctgccagtgctccaagggctcagtgatcctggaccagtagtcatgttaatttcttgaattgtaacaggatactgtaaatgtggacactctacctgaggttactgcttctttctatctgctttatttccttcccactgaagggccctggacaagggtaaacatctcatcactttctgggtggcagaatatttccagttcccccacttctttttggcttaaggctgtggctttttcctctgcctgaatgtggccctaagaagcccttcttttcaaactttcctgttgtacttgaccgactagctgtctagaggtttatatccctagcttttaatctttgctgtgaatatcttacctgttaccagctagtatatttcacattgacttctctttccttttttttttttttttttttttttgagatggtgtttcgctcttgttccccaggctggagtgcagtggcacgatcttggctcactgcaacctccacctcccaggttcaagcgattctcttgcctcagcctcccaagtagctgggactacaggcatgcaccatcacatctggctaatttttttgtatttttaatagagatggggttttaccatgttggccaggctggccttgaactcctgacctcaggtgatccacctgcctcgccctcccaaggtgctgggattacaggcatgagccactgtgcctggcctacttcttcttccttttaacttgaagattatctgcccctttttctaatcttaaccgcattaagctggctttgagcatggcaagagttttatagatgaatcttattttatagtacaggatttcaaaatcataattatttcactgagggtggcttttactctccattaattatacttctcactcagaaatggaattctattttggtctcctaaagataaattagtatatagtggaaaggaattataaagttctgctaggaattaaatgatatgattaacacaaacatccacatggatgtgtctctgccctgtgcaggaaagatgaacattcagtacagattctgctctatgtcactagctttcaagacctgcaggttctctcctaagcatgcaattcctgtgagcagtagcaataatagcaggtcatatttgtggagtgattactgtatgctaagaactgtggtaaacacttttatatggattattttatttaaacctcctaatagtccattgaaatagatattgccatgttgaaaactgaggttcagagaggttaagtgacttacccagtgtcacagaactagtaagtggtggagctgggatttgaactgagattccagaacaattgccattaaccactttgcttccatattagtatcatctgcaaatctctctccataaatttcctcagtctttatctgagtttccttatttcaggaaggaaaacttctgtttttgatccttatgaaatacaatttccattaaaacttttttttttgctattaaaaaaggtaccggataattgaaaccagattggatttgagcctgtgttgatggaagtacacatgggatgtgggctgaagtgttcaatctaatttttctttccatcagctaatttttaaagtattaagcaagtagattctgacactaacagggaagatttaaattctcttgagagactggaggtgttaaataattttctggtagtgcacattttacatcttaaatcttcctcactctcccacctcatctcaatgtacctgaagctctgggaatgttcttttgtacttctcaggaacagccagacctctggcttcatctcctctcccctccacatccctttcctgctccaattacttcccagcgccacttggatgttgttgtcatcggggaactttggaaacagccagatttttttggagtctgtaagcagaaaacagactgcttgctgctcatatctggcacccagctttgtccagaaaacgaggagttaaaaagaagtctgggctgtgaagggctgtgacaactgtcctagggggagctctagcgagccctggcgggcagtgactcatgctgctctgtcactgggatcagcactggcccctggcaggcaggcggcagccaggtggggttccagccagagcacgcacgcacggagccgggagcatgcagcctgcactgcgggggatgtgatgctcggctctaactcgcctggctggcccgccacggacgcctcagcttgcaaccatggtaacgtttctggcgggggacacccccgggagcccaccgcgatgggcagcctcctggtgactgatggacgagtgtccacctcccagaccgagagcgcttagtaggtcggaggaagtggagaggatgtaacacgcccccagccgggagtgaagccctgaggaggtaggagccgcatatgtccatccgtgcattcccaccgtcagcgcgcaggggtgctgtagatcaccggtaggaactttatttggctggtgcttcattatgctgattaaactgcagtggatttgatgggcatgattgcgctggggaagatgcataatgaactaaaaaaaaaaaaaagtggttaataagatctcggagtcgacttgtccgggtatgaatgaagtagactgcagtggtatcctaacaggagttccagaacctcacacatcccttttcctggtccttcctcttatcccggttaatccacgaaatgtagaagttccatcttatttcaacgattagtgctaatcattaataatttagacctgtctggaggagggaatccataggtttaggtctcctagcatcctggcactagccagcagctgctctgtaggagccttctggaaacagcaggaaggagcggcttccccacgagttccccaagtgctttcgttggcccaagtgctttcgttggcccaagtgacctgtttgagtttgctcttcagtttaccccaggcgggaaggcagcctgtctgcgggttggtggccatgttggcagagaaggggttaatctcttgttgctgtaggagccgaggttgcgagctagattgaaagcaggcgctgcagtgccatcgccagcgccgaaggagtaagacgatcttctccgcaacagtgttgaatccggctgaaattttttttcctccccgcctcctttcttgtttttctttaaccagctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtaagtgaaaatttgactttctaaagggacctgcattgatgcaaggcttttggagccaaaggtggtggtgggggggtgggggaataggtggggggagtgcagtggagggaagctgctagtcacctgcattgggaaagcagtctacctgttagggctttgcgggggtagcctgttaatattctcattttgcagtgtgtaaggtacctgttcctgtctgtggtatgataattgtcaattgggtactttgggttagttttccaatctttggtcttctttaaaggggagagagtgggagatttccagcagtgcagatccccggtcaaaggagaaatgtgcaggagttaagatgagctgcccatctatctaaccatctatgtatctgtctctcaagtgggtggatgggggttgctatcttggctgtataaagaatcctaaaaaccttgtctcataagctagaggtttcctgatgggtttaactgagctgcaagtggctgaaccagagctctaacagagagatggtgctcggctcctctccaagtatgctgcaagatcagggatctggcagctgagcctctctgagctggtggagcgctggcagccagagaaagccccgttactgtgagccaccaggagggagtgtgatgtagccgagtcattgattcacagaaactgggcttcatagggggaaaaaaaaccaggagactagaaaatggaaatataaatatcactgtaaacctcttgatctggtaggtctttctccattctcataaaagctattgaaaaatgcattaacagagcacttggaattagagggtcgaggcttccaggagcctcctggaatttctgtaaaatgcagtagcttctgtggatgtgggaggtcagtatcttgcctcattctctcatgatacaatgacattctgttttcagaggagtgagttccccagaagatcttggactgatggtgttatttgccagccaccctggtccctgcactttcaggttctcagagggtaatgttgggttagttgctgcccacttaggagacgagcagaatttgatattcttcttggcagcatctttccctctttgtggtatttgtagcttagatatcgatttatagggatgttatgttggttcctggatggtgtctccctatgggtgctattttgacagtaacgttcctgaaaagatttcagagtgttgtggggaattgggcatttgatacgaaataaggttgtgggctgtgattgaatgtgagggaggtttttatgttgcaagatgttgaagtggtctttcttgatcccctctctgggggctgggtttcaaattcaggttggattttggtagtgttagatgtgcctctctgtctgatttgctccacaaccccaaagcaatctggatggtggtgggagaggcagagtgctaactagctgttgaatgtgccatcagatgggtttgaaacggctcagcaggattgggaggttttgccattggcatcaaagagcagggcagaagcggaggcctgatgttgaaggatgcatggttagtgggcagtataaccttgacacacgcagcacactgaaggtcacacgtcgtactggaaggacgtgtggagagttctagttctggttagcagtgggctggctgggtcagaatgcaagcttgcttgggtgttggtcagtgatctgaaagacgagggaggattcgagggagttagatttcaggggaaaaggcagaatgatatgggagatcttaggcattgcaattaatctgaagcagtgtgtgattaattgcttatttttcaggaagacttgaacgacatctttctgtttctcacagaaagctcagtttagggagctctctgacagggacatctcagtattaaggctgaggcactcgataaatatttgttgatttaatttacctatgatcctttcctccagaagtgtttatattgcttattgtatttgaagatgtgctatctcacctctggtagtttaaactatatccttagagcacaaaacgagctgctgttcctgacccaacagaatgtttaataagattcttatttcaaaaaaggtccatgcaaataaaactgtgtatttcttatttggacgatggcatcagagtattcctatcattggggaactttaacgttttttcaaagcttggcaacggggttggaatcagaaagattttctttcatcttgcgtcttgttatgtgttattgctattggacttggctactctgctgtaggcagccctgtgggtgatacctacaagcatcattttagaaattcatccacctgttggatgtagatgaccctggacatatcagattgtgattaattagaaatctaataaaagagaggcagtgatgaaattacttagcagctcctgcagttttattgacaaaatttacttggagagagggggagacattttctgggggtaccacctttgctgccagcgaccctgtgtttcttcctgagtttctttttcttttctcaccgttttcagcatcacaggtttttatttacacacattgattacctgtgctgttactcattcttcacaccactgaggaaattgcagatgctgctgtactgtgctaggtaaattgacctcagatttgttaccagtgaattgaatgaaatgttcagaggtggagctgaatgaacgaggagtttttgtggagaaattggcagtgagaatgatttaaattctgtgatagctcctcgttttttgggatccttattttgggaccccagactatttttaagccattgagtgcatcattattttaggctgagcaagaatcttgatgacagcgtttcaatggctgaggcgtagtgggagttccttgcagcttgagttggtgggagctggagagtttctagagaactaggtttggttgtctttggggtggggttatggtgaaattagtcttggagagtgagtagctgtctgatgcttcttttcctttttaaccagcaagagcccaaaccaaatccccaagctctgaatgcctggctgttcctctcagcctttctttgcttgaacttgacaatagtagggtagtaacaggaaacagcatgttaaagttttaaaaataaaatagatctcagctcttttccttcccattagcaaggggtacatttatttaggtttttccttctagattgaggcactgcctcatttaagttcttggtgaagccgtgcatttctgcaaaccataagtataaactctagaacgggggtgtccaatcttttggcttccttgggccacatgggaagaagaagaattgtcttgaggcacacataaaatacactaatgatagctgatgagctaaaaaaaaaaaaactcataaagttttaagaaagcttacaaacttgtaagttttgagccacattaaaaaccatcctgggctgcatgcagcccccggggccttgggttggacaagcttgctgtagaaggtaaaaatcagttggttttatgtttttgttttaaacatgctggttgtatgcttttggaagagttggggaacactgagggtaatgggatcttgatggggctggaatttgtgggaagatggtgtctgggtaggctgtttttaggaaggggcactctcttccttttgattcagagatttttcctttcttttcgggtggttctgaaaacacagcgatggatccaggcattcaaacaccatggaggaaggaagagtggctgttgccattgcttcccgagttttctgggaaccagtttttggtgcctcttccttgctctactggggcttctctgcatgtcagtttcttcaactgcgaagtggaaggacagcgatacttttcttacaggacttttgcggggatggatgaaatacgtaaaacacttggtctagtacctggcacatggaaaagccttggtaaatgttcactgttgttatttttgttattactaatacactagtccatgtatgtatagtgtcctcctatacacaccaagagaatatggaaaggactcagcaatgattaggtagtccaaagtcataccagattggaaaccaagcttcccaggccctgggacttttctgctagagacacttcacggttctgaccaactacaaagagttaatatgcagttgccaaatacctgttggtaaaaggtggatgttggggaggagtggattggggaacagaattagaaggtccagtcccagaatgggtaccttcccatcaagttgaacaagtcaaaacaggttatgttgaaacaactgagagaaagtaaagcaaacaccattgctgcagaatatcatggtacaaattggacatctttgggagttagcggagtaaggcaaaatccagtgagggacgcttaatgggtaatgccaattcacaattcttgttaaattacattgctgatcttccttggaatgtctgtccattcccccaagtagactgtgatctcaaggcaaggctgggtcttattcatcctggttttcctggagcagtaaatacttgtgctggaactgggcttataagcatactaatggaaagtaaaatatttgggttggttttttaaaaagacagtggatttggatcagtggagaggaaggtagagggaatttcaggtgggcagggtgctaacaacagcccatccttacagggcaccaactgtgttctaggctgtgttccaaccactttacacagatgaattcatttaaattgcacaaccagcccaagaggaaggtaccattattattctcattttggatgtgaggaaactgaggcgtggggagatcaaacaacttgcctaaagttatgtagctttgagtggcttagctgagatttgaaccctgtgggtataaacgccacagatgggaaatttgtgtggggtacccaggttcatgtgcttgttagaagtggaagctatttgtagagaatcacgaatgatgaggttggggcagggtgtgatgggagctgacaggcaggtctaaatgctgggattcattttcagtctctgtgtttattgagtaggtagacggtatagctcttggatttctcagattttttcctcttttcatttagagactcttatctggtgtgtgtgtgcccgcacacatacataaacccacgcgtatatactctttccctgaatgttcttatttgctaaagcttaagcttggcaaagagaggaaactgcactgaccttactctccaccatatcttcaggctgatcatacacaagttgcttaataagcatttggttaatccatctaaatcattcttatggctgcaactctcattttgttgatgactctactatctatgtctattcacatctacattttgtacttttgtttgcctcccatctgtcctgggatggctgataccagtggaagacagcctgaactctccaatcagtcctgtttcctttttatgaaatacttggaggttggaggatcttcccttaaaaagtgttttcctttctacatccagccaaaggctcttggtccttgtgcttgctacctagatccctattggaaagagtcttgcctgcaatttgattttttaaatagcagcaataacagagtcgtctctgctacacgaagacatgcatctgctgtatttcccagacaagttcaaaaaccttaactagcttctgcccatggttattgctctcaagtgccttgtgttgttcccatcccctcattatctggattagatgtttaacatttgcctgtgtgtgttgtgttggattttctcctctcctcttgctcattcaatttcttccttctcttagccaagcacagcttgttctcctacttgccttattctgttctctatttagactgtgcgtgcctgccttgcagccctggcaggaccattccaccgccttctcatttgtcttaaagatacctttaggaaatctaatccagacaatcctagcccagtcctgaagattaggctccagaagatctgtcaagtgtgttttttgctggcctacacatgctaatttgcatggttgcctgggatcccttaagaagacagtcattgactaaatggcgctacatgttcccaagctctgcgccagtctggcaactcttcctttgtctacgtgaatttctcctagttctttttgctttgcttgctgttcatctcctgacctctctccgacaaacttcctgaaagaagagcctgcactcaacacctcttttttccacctcttcaacaatactgaaatgactgtctcagaagccgttgattgtacctaaccaccaaatctggtgatttccatctcaccacgtgataccattaatactacctttcttcgagacaacgttctactttcttctcttctgtattatggacacttggtttccctcctacctctctgactgtcattctcactcttttgtggctgccatcaggctcttgcaatgtacgtaccatctcctcaagttccatcctcagttatctttctagttggttcttggtgatctcattcagttccttgactttagttcttacctccccatggcctcctcccatcgtacactgtgttcctcatcaccaggatgttttaccagtttctcaccatcccatcctctgttcccttcctacatagacagacccactcgctcactcagtaagccactaggtgctagttttggcttcttcattttatgtaagaaactaccaccttccctacccttctaggcaagaaagctgagtcatcgtaaattcttttctgcctcccccgccatcccatcagttgccaatttctccaagtggtgcctctaggatgccacttgcatccatacccatctttcttcctcattggcacccatcatggactcttgcttggtctggtgcagtagcctcctcagtgattcccttgcctctggttttcctggctgtaatccattctccacaaagggtggaattcttccaaagcataggttggatgatgtcattcaccggcttacaccttcaacagcatcccagtgtgctcataattaatggctgctcctgaacttggtattcagtcttggtatgccaagaccccagcctgccggctcatttgtgtctcctcatcccctactgaatcacttcaatagtgttgtctggccaagctgttcaaggctcattaaggacaggaccaggtcttccttcttttgcctgaaacagtgccttgcccctggcaggtcttcaatgaacatttgttgaattgaattagactaaaatggccagggattataccaattccttctgcacagtgtagacaactgctaatggaacctgttttctgtagagcacttcttgtgttcccagaactatgcgagtactttatgtgcattatctcattaaatcatcacaatctcactgtaactctatgaggtagctgatattatccccattttacaaatgaagacactgattcaggaagattagattattttcctgaggttctgaaggtagaaacacatctaagacttggagcaatatctggttgcctctagaccactgtactatctaccctgcctctaagagccatgactttgctagattatgcaggagttatggacttgtctaatagtaaaggtaaaagaattggttttaatgagaatctactcttctaggtactattctgagtgcctgacaagcattctcatgtagacccagcaataactcattattttacagatagagaaaatgatgatcatgatgcttgggttacttcttaggttcactcagctcacatctggcagagggtggtcaacttttccaagttttaacttatttatttatttattttgagacagagtctcattctgttgcccacgctggagtacggtgacacaatctcagcttattgcaacctccgcctcccaggttcaagcgattcttgtgcctcagcctcccgtgtagctgggattacaggtgcctgccaccacgcccagctaattttgtttttgtatttttagtagaggctgggtttcaccatgttggccaggcctgtcttgaactcctgacctcaagtgatctgccagcctcggcctcccaaagtgttgtgattacagatgtgagccaccacgcctggctcaacttttaactttagaactgatataaacatgcctatttttttgggactgactgtagcatacccattcaaagtccaggctttggaatcagacagacgtgggctgaactcagggtttcaccccttgcttgttgtgtgaatgagacatttcactgctttcagcctcaattccctcatctgtaaagtggaaggtgtaaggtcgcctatctgataggtttgccatggggatatgaagcacacttagtgttggtgccatgagtagaatgagtgttcatttcatatttgttaatgttatttaggtccgaggatgggtatggggtgctttggactctctttttctccctgcttccgccttataaagacatcttgctggtttctgcccattgagagaatccagctccacgtggggggcctgacagatgtcctaatatctccatctaattttttactctgaatggagtctgtgatgtatcacttcaacctgcactttctataaaatgctctccaggcttctggtaggatccagtgccagtgggaagtgtgcatgttcccagcctagatgtcacatgctcccacccaccctggaagcacttgggtatcccctggatgggtaagtctgtgtgtcattgtgccattcctgtctcagaaccaatgctgggcatctctacttgcaggtgctggaaagctttttcatgccagcatacatgcagcacacttctcattttggattcctttatcccacggtgacctttaaactggctgcctgggggcacagaagtactagcacaccattcacttatttattcattcattcattcattcattcattcactcaacaaatatattgttctagtccttaaggcacaactctgagcaagacaggtaaggtctttactctcaagaagctagcatttggtggggagaaacaaaggagaaataactactgtgcacatgtgaggcaattgcagatggtggtctgcagaattgggattgagactgcctgggggtggccactttagactgggtccgcaaggaaaggttctctgagctgagcatgagtatttgttcaagaaggctgagttgcatcccaaggtgacacagcttttaagcccacactgagcagctctgaggtcctaggggctgttcgagaacctgggatatagcactgactatgagacaaaaatccctgtcttcatggagcttacatgatgggggcagattcacattcattcatttgttcattaattcattaattcattcagctatttgagagcctactatgtgccaagcactttctaggcactggagaagtaacagtgaatgcaaaggagcaagcatccctgcccacacagagtgcattcttccagaatatcaataaggagtcggttagcaaaaataagtgggaagagtattccagagagaggaaaaaagggcaaaggccctgaggctgccactaacctatgggtgctcaatgaacagaaggcatgtttgggtagggggtacttaaggatacacaaggaacatggtctgagctgaggtcatcagggcctttaggtatggactttgctctaaattgcactgagtaggaagcttttgcaggattttgaatagggtcatggaatatctgggtcttatttcacaaagtgtgcctctgaccattgtgtggagggtggatagtgagggacaagagttggatccagggaggtaagtgtggttattgcagtcatccaggtgagaggcaatgaaattaacctgcaaagtgaggcactggcttagaggtgggaactgaattaaaaatcatgggactagctattcttttattaatagcatgatttttgataaatgattctggagctacatattaatcatttcaaagcaagtgctctaatttaactagagaccactgctggttgtgtgtgtgagtgcatatgtgtgtatgtatatgagtatgtgtggtgtgtgtcagtatgtatatgtgtgtatggtatatatataaatatatatattgtgtgtggtgggggagggggggtgccccaaagctagacagactctgactgtctttaggggaatagtgtttttgatatttccaggtgttcctgatgggcaccattgttattttattttatttttattttatttttgagacggagtctcactctgtcgccaggctggagtgcagtggcgctatctcggctcaagacaacctccgcctcccaggttcaagcaattctcctgcctcagcctcccgagtagctaggactacaggtgcgtgccaccacacccggccaccattgtgtattttaaagtgtgcttataaaattagttcagaggccagatgtggtggcccacgcctgtaatccaagcactttgggaggccgaggcgggtggatcatgaggttgggagaccgagaccatccttgccaacggggtggtgaaaccccatctctactaaaaatacaaaaaaattagctgggtacagtggcgcgtgcctgtagtcccaactactccggaggacaaggcaggagaattgcttgaacctgggaggtagaggttgcagtgagccgagatcgcaccactgcactccagcctggtgacagaacaagactccatctctaaataaataaataaaacaagttcacaaatttcggaatgctcaatcttaaaagccagtatatttttggaaacggaatgctgatgagttttttattttttgcagcatattacatcttgcagttgcatgtatttttagtgctgttggccagcactaaaggtggggccctcagctgagctaattttgagtcccctcattttggcttcaagtatactcattcttggttttcccaagaatatctgggatttgtgatctgtgttatctgtggtttggtgtcgtattttgcaggcatagggtcctattcctaagggaataaatggatggcttgatgcttaagcacgaacttaatcatcgcagtagtgattaaagagtattcaacatgtacacttgcttgtaggaaggagtacacattgtattctcttttgatatgcaatattttattcatagccctattaagtaattttttttaacaaagttatatggattatttacaggtacatcacgggaaaactgcattttataattttcactgaaatgttgaggttacatgtaaagcaatttttatgtcatatctgatacattttaagaaaacatgtcttcctgttacagcggtaatgaccatgcctgctctttcttctgtgtcatatgccattatccctattaatactctttgggcttctataattataaagcagatgtgtatatcagggagagatgttgatttcagagtaagtttttctagaaaatagaagctggaaaaaaaaggaaaacccaaacttggcttcgtgctcgaagagacagcactgctgtgtgtgggcgggtggctgcgtgcacccgctgctcagaagtgccttttctctccatggggataactggctgtgtatccgagatgtggccaggagtaggcaagcaacgtgtgggcaggctgcatgttcttttattagcatcttcattgtactgcatctcgtcgagcccagagcatgaactggcctgggtttctaatatctaccctgcttcccacctaattactcccctgaaccctaaagtgagggagggagagttgctcttgtggggtgagctttccctggggtggctgtgaaccaacctggcatgtggatgttcttgggtatccagagctgtcctggactcaggcttggagtcagcttcttagcactgaatgcagccagtcatggatggaggtcactgtatctcacatgttccgctctccctttcctccatgaccttgcccctctgagcctctgtagcacttttcttgagtgtgtccaaggccatctagctaagaagtagcagaaatgggatttgaagccatgactgtttggtgatagagcctcagctttgaactggggttctactgcctggcacccctgcacaaatcatggtaacgtggtaggagaacatagaggtatagggcaagcccctccttaatgccatgaataatacccatcttataggattgtggggaggactcagtgaagtaacccatgaagcactaaacacgtgcctgacacgtgctcaataaatgagcacttgtcctgatgacaaaggtcgtggcattaattctctctcctagattgttacttccttgaggacaggaattgtggcttccttaatggccactgcagcagagtttctcaagttggcactattgacattttgggctggataattcttgttgtgggagctgtcctgtggattgtaggatgttgagcagcatctttggcctctacccactacatattaatagcacccctagtcatgaaaataaaatgtctagacattgccaaactgcccctgttgagaaccactggtctgcaggtatctctcatggggatcacagggcttttatattctcttctctgtctctctctctccctctctgggtgtctctctctctcacacacacgcttagagaaggtggttaaaaaaaattttgttgaagtttgagaattttgagaacaaaggaaaaattttggaaggcattttaatgaacagatagactctgtcccattccatggtcaacagaatttcataattagatagtttgtttactgcaactctgcaccccattgcccatcattttagagttccaaccagttagaggatttttcttgcaaactttccttaaagcagtgatagtatcagctctttaaataatactatgcttgatgaagtggtacttttcgggataatttgagaccagccgacttgctgcttgaagaggacagggctatatttggtaataatatatatgtgataatatgtatgtaatattattataatgtaatatacaataatatttggtgtaactggtgactctgaggccagtctttgatcgaacctctcaagctatgatttacattatggtcaatgttagcataatgcaattatcagcaatcacttgctgttgctttgaaagtcagaaggatggctaataaaaatcttagaaaaagaaaacaggccgggtgcagtggctcacccctgtaatcccagcactttgggaggctgaggcgggcagatcatgaggtcaggagattgagaccatcctggccaacatggtgaaaccccatctgtactagaatacaaaaaaaaaaaaaaaatttgctgggcgtggtggcgtgcgcctgtagtcccagctactcgggagctgagtcaggggaatcgcttgaacccgggaggtggaggttgcagtgagccgagattgtgccactgcactccagcctggtgacggagtgagactccgtctcaaacaaaacaaaacaaaacaaaaaacaaaaaaagaaaatcttagaaaaagaaaataaattgtaatatttcagaatatttgttggggaggatatgtgtgctcaagaaatacatactgagaacttaccattgatgctagagattgaatttccccatgtctacatgaaaaatgaatagaatataaacattttaaattgagccatgtctatctgtattatatttcttttatagaaattcatggaaatggtatattttaactgaattattaacactggggacaataggctttaatcattatctaatacctgtacgttgttttgaaattcatagcccaccaccattaatttcaaaattgggttcttactcaaagagtgatgaaaaggcaccagtaccaaatggtctggccaaaatgctacatggaactaaatgctggggatggtcatacaatgagttttaagtggctagaccctaaatcagaagcactttcttctaattagcaccatggttcttaatcctttctgtacattacaatcactcagcagcttaatacaaatgttgcttcccggggccacactccacatctttctgactctctgatttaattggtctgaatggggcctatacatcaggtgttttttaaaaggtctccaagtgattctaatgtgtacttgcattgaggaccagggaaggtgtaggaagcctgataacctttactctccagcctcatcctccaatcccatgattgtttatgggattgttgctacacacccagcttagtcatagcattcttactctagcttttttttagatgcaatttttatttattcttaaagaaaaagatttctttagcacctttattctaaagagctcttaattgctgtgcttagaacttctaaacagtgagcatttgtcaaacatagaatagcagaatgaaggggttggacctcgggtgaggagggctgtcgcatggtctctttcgagtgccggcgggtgggggctgcacatctcctcgcttctgggcccattgataagtgacctaaaagtgcctttcgttttttttggtggggggtgaaaaagcaatctgttttgtacccacagcggtgcactttaaacaggaagccctactggggccagccttctatgtgtcattaagtttttcacgccacatcctacctatcatcatgcacccatgtcatcgttcttttaaagggtgccagttttttgcttaagcacaaggagctgtgacctgtgttgtcatccctgatgcatgtcatgcatgtgacttcatgacatgtgggtgacttttgatctctgaaggaccagggacccagtctgtggatcaccactctctccgtgggtggtttgggtcttgttctctagcccacccagccaggtgcaattaggaataaaggaaatagcaaaggaattttgctcaaggccatgccaagcatttcatcttatatgaaaaggaaaagagagagagtgtgtgtgtgttggctagatttaggtagaaaacaggctggtgagaagcgtagaacttggttaaaatttctagccaaaagtaagatttttaaaaagatttatttctggatccaatccctgttgcccatttctatgaataatcaccatttgttttaatgtgaataatagcacacagcaaattcagccccctgagttttaccattttaagcaattgctttaggcccgtgaggcatgtactatttatgaagttgcatgggtagtaatggaaaacacaacaatgacagtagtaacaggtgacatttgtcgaacacttgcagtgtgccaggcactgtgctgacagcattacatgcattatttcatttaatccttccaagaactctttgaagtaggttggtaattatggccattttacaattgaggaaactgaggttcggagatgtcaaataactagtcagtggtggggtcagatttttcttttttttttaaatttatttgctttttttttttttttttttgagacggagtctcactctgttgcccaggctggagtgctgtggtgccatcttggctcactgcaagctccgcctcccgggttcatgccattctcctgcctcagcctccggagtagctgggactacaggcgcccaccaccaggcctggctaattttttgtatttttagtagagacgaggtttcaccgtgttagccaggatggtctggatctcctgacctcgtgatccgcttgcctcggccccccaaagtgctgagattacaggcatcagccaccgcgcccggcctatttgtttttttttttaagagacaaggtcttgctgtgttacccagactggagtgcagtggtacaatcgtagctcactgtagccttgaactcctgggctcgagcgatcctcccaccccagcctcccacgtagctgggactagaggcatgagccactatgcccgactcatttttaaacattttttatagagacggctgggtgtggtacctgtaatcccagcactttgggagactgaggcgggcggattgcttgagcccaggaatttgagaccagcctgggcaacatggagaaaccccgtgtctacaaaaaatacaaaaatcagctgggtgtggtggtgcgtgcctgtagttccagttactggggaggctgaggtaagagaatcacttgagtctgggaagtcgaggctgcagtgacctgggaccaccgcactccagcctgggcatcggagtgagactgtctttcaaaaaataatttatttatttattttaaaaatagagacagggtattgctgtgttgcccaggcccgtcttgaacttctggcctcaagtgatccttctgcctcggcctcccaaagtgttgagattataggcatgtgccactgtgcccagcctgagattttgaacagaggagcatgatgctgggcgttgactcatttggctgtgagtgtggaaagctgtcactggagtacagcaagtcagcactatcaagccagcccttgtcattgccaggagctgcggggagagaggtgttttgcattgctgcagggaactgacctcttttagtcagggaagtagtttgggcagtagaaagcagaacttgcacctgctggtaagatctgagtggtcactgacaaccagctctgcaaccctgttaccagggcaacaaagatgggcccaggggtaatggtgggctctgccacatctctctgtgcataagaacctttggccacttgctctggccttgtctttcaccaatcccagtgttcatatccagtgtaccaaccactgagggcagctgtcctggaatctctctctcatctctgcccataattaactgcttctgggcacagtgcatgagttacatagatgagtgtgggtaagtttgccctttctgtggggggagcatccttttggtccactctcaggagggcatcctatgttatttttgtgatattttcctaagagttgtataagcaagtgcatcaagccaacttgtctaccccagctccctcttgagaccagcagaaactatttatcaactggcagtttacgtaacctctctgggcctcaatttcctcatataaaatgaggataataaatcgtatctgctcatagagttgctgtggggagtaaagagttcaaatgtatctgtcagtgaaggaaaaaagaaaaaaaaacaaaaacaaagagttcaaatatatctagcgttcaaacagaaccaggtatgcagccagtgcccaataggtgtatgagtttcctatggccaatgtaacaaatgaccacaaacttagtggcttaaaacaacacacatttattattttacagttctggaggtcagaagtctaagatgatgccaggcttggtggctcaagcctgtaatcccagcactttgggaggctgaggtggcaggatcacttgaggtcaggagttccagactagcctagccaacatggtgaaaccccatctctactaaaaatacaaaaattagtcaggcacggtcacgagcacctgtaatcccaactactcaggaggctgaggcaggagaattgcttgaacccaggaggtggaggttgcagtgagccgaggttgcagtgagccgaggttgcaccactgcactccagcctgggcaacagaacgcgaccctgtttccaagaaaaaaaaaaaagtccgggatgagttttactgggctgagatcagtgtagacaaggctgcactctctctggaggctctagggcagaatctgtttccttgtcttttccagcttctagaggttgcctgcattccttggcttgtggccccttcctccgtgttcaaagccattggtgtaacatcttcaggtctctgtgactccgatccttgcttccatcttataaggatccttgtgatttcattgtacccatccagatatcccaggagaatctttccatcccaagatccataacttaaatcccatctgcaaagtcccttttgccatgtgtggtaatatattcacagcttgcagagatcaggacatgggcatctttgggaaacgggaagggggcattatttgacctaacatcaagagcatgagatgtttttgtaaaatgaaacaaatgttgcagcttcctaatgcagcttcttaggcccacctgcaggcccccttgacgttggtttttctctacctaggtctgttgtgtcgggtctggactcccctgccaagactagctccatggaaaagaaacttctcatcaaaagcaaagagctacaagactctcaggacaagtgtcacaaggtatttatttccgcagccggcctccttccttgctccaggatcctcccgtccgtatatgccaagggatccgcccggggccgctgctggctctgagccgcctgatccgtagagagtgaggcgctcctgccttcgctgaagtcgcgcctccagcagctcagagggagatgaattcgggccttgctgttgctgtaaatcctttaaatctaaaccagaggaggccctggatttaaacagtccgtttctcagcatgacccagccagatgtctgcttcttccggcaggtggcctgggtcctcacctgtggctgagatacatcccatctgctttgagtgatgcgaagtctctcttcctagtcttttaaaactcctgcttatgtcactgcggccactgtgttgattacgctcaacgtctcttaacattcactgttcctgcccagaggcaacgctctggaaactaataagtcactgcttgcctgggactcctaagagtgcagacgaataaatatctccttgccctgtcctggatttgtcctctagatctttgcaaggagatggggggggatcaagatggatttgggataaaattaaagtgacgtctgcaaaaacaaaacaaaaacaaaagcaaacaggtgaaaaatgatgattgtggcttccttgctaactgggttagagaagtgatcaagtgtgaaccgggacttgaatgagaggagtgacttagcatttggtgactgtccttaacgaagaactgtgcgctcctgggcgaagaaacaatggtatttccatcccaacttaacttttggcgaattagccttagcccagaccaccaggtggtttcggaggctacttgagatgtgattgctcctaatgaacctccacgggcctttttaacctgtcgatgtgtttatttcagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtgtgagccttccctgaagcccccttcccttggaggtggcacttcctgttgtgtgtgtctcatcctgtttcatgatggctccatgaggcacatcacagccaatggcagagagtagagagagggagagcacaaaagcaagatctgtgttttgcagagtagtgagagccaggcgtaaggtccccaagaaatgagattggactcatttccagcagaaagtgcaggtagacggctggtaccatggagtctggagatgggagtaatccatctttgccgcaagttgcaaaagatcttaacatctcccatcccagcctctgtggtctgcgttgtgtctgacatgagcagccttgagaaccagactcccaactatgtacaagaaaacttactttcaatcttcctgacatcaaattttccattggccagaaccagtgtagtgacaagaaaatagccttgaaaacccagaccctctgtcattatttaccatgtgactttcattttttctttccttcacaagagtagactgtcttcttctccattgtcttgttaaatttttcattcaggtgttttttaatgtgcccaattaaacagtctcaagaagttgaatcacacatttctaaagtttttttcacaagggagaggaaatctatagaacgtggctgattaagaataactgctatgtttccattccagacttggctgcctttcagtggtgggtgaagttattcagctatgtatttcagatatagatttcagtgccattgaagcattaagggattcttatggatgaaaggtgtccaggaaaaataagccaggaggtagaaatagaccacttggagtcttaaatgacaactgggcagaggatatgaagtcattgctactttgaaagaggcatatgtactttagggcccacaaataactgtagaaaacactttgtagctatccacatggtggctgtaatagctactgggtcttaataggttttagtcctgaacatgcaagtaagtatctcctaggacaggtagatggtggcaggagacaggctgatgcagtttccggctggatccctaaggtcaccaggttgagatgatgtttcttgaaccaaggggttttacaggatggaaaccggagtcggcaaccaactggaagttgtgaactgtggtccgtcactcgaaactgtcctggtgtctgcgaagcagcttgcagctctcttaatgagtcttttcaaacaaagcaggatccacagggcatccctattaaaatttttgctttctgcagagcttaaagcgaagtttggagcaagcacggatggaggtgtcccaggaggatgacaaagcactgcagcttctccatgatatcagagagcagagccggaagctccaagaaatcaaagagcaggtaggcctgcttgcctgggagcacagcagcatctcggcttgcttggacctctaatttcaggagaggcgtgtttgagagagaaataggaagaaagggagagagagaaagggtgggggcagagtggaagagagacaggtatgtaggtcattcagaaacttcagatttctcataatttatatacatcatagaatgcttgttccagctccttttgaagctgataccccataatgtctgcttttaaaaataaagatgtaggtttagagcaagagtgggcagacttcagcctgtggggcaaagctggtccaacacctattttctatggcccacaagctaagaatggggttacgtttttaaacagttggaaaaaaaatcaaaagtaaaacaatatttcatgacatttgaaatttatatgaaattcaaatttcagtctccataaataaagtgttttttttttggaacacagccatgcttggtaatttgcatatcggccctggctgctttcaggctacagagtcagaggtgagtggttgttacagagaccatgtggcctgcaaagctgaaactacttactatctggcttcttacagcaaaagtttgccaatccctgctttagatggttaaaaacaattaaatgttttaatagcttctcagatgcacttttaagtttttgagtgaagccaggctaattcatagttttacttacataaagaaatattctagaagagaaatttgaaccattctggtcaaggtcaagtcaggattaacactgcctatctgagtgcagaaggctgtcccctgtgttttcagaaaggagaatcgagacctttaaaaagcccactcttttttttctttctaaacgggttttctttctaaatggctcatttttgtattgcctcattgtttcctttttagcatggatttttgtgtcttttgaaaaactgtaaatagagactttaatgaagagatggcaatgagcaattggagagctgaactatcagctgccaggcaactctcattcacttcagaaaatctaatggaaacactgatagaaatgaacatttctgtctctgggtagcacaaacttagccatctggctggagctaatgcaagaaacttctgcaaataactctatccattaattactctttaaaaaaagaattactgtctttggagttttgttggcatatttatcatctgaatattttaaagttgtgatcagttaatattctgttgcttgataaaaacattataaataaacgtgcataggacggaaaccctgtaaaggatcatcagatctctgaataatgcagtcttagaggttttgaaggctgcacattggctttgagaaatctgctttgacagttgactcatgctccttttatcaacatagtttttcatcctaaaagtttcaagaggtaggaatcattttctcccattagttcaacatacctggaaatttacttttggtgacatcctggggaaatgaaagctgtgtttggccaccagagggagcagctggtgtccatagattccttagaaacggaattatcaggacgttttgaaaaggtgtatgttggtggccgagttcaaagacacgtcttttatgattcataccacagttggcatgcatgtggagtcttagatttaatgactgctaaaagttccattgtggggaagaaacgtggtttcagatttgatttttcatcggaacaaggatttattttatgacttttggtaagttttgtgagagcaggatgtttgcagactgggagaaagcttttaatgcttgcagcaaactttcagtatttagtttgtggcatattgattttttctagacttgggatttattccctgatctttctcttaaaaatctaactttctatatcgctctttatttttttgagatggagtctcgctctgtcacccaggctggagtgcagtggtgcagtttcggctcactgcagcctccacctcctgggttcaagtgattctcctgcctcagcctcctgagtagctgggactacaggtgcacgccgccacacccagctaatttttgtgtttttagtagagatggggtttcaccatgtttgtcaggctggtctcgaactcctgacctcctgatctgcccgccttggcctcccaaagtgctgagattacaggcatgagccactgcacctggccggctcttcatttttttaaaaaatattttacttccacctagctaccccctctagaatatttagatttggtttaaaagaaaaacacctcaaagactcatgtgaaatttgattcctagatcattactagcaatttcagcttcttccttgctcccctactcaggaaaggagacaaaagtgtgggtaacacaaaagtcacttgtgttccatggtttctgagtgaattgcatcatacctgatccttcctccccacaaaattctgaagctccattcagaagacttgcgttaggtgggccttgaaacctgtctgcagttccccatcctgacctgactcacacctaccagtctttcattccatcctgagataccacagctctctctcagctgatcttgcaaacagacctgatgatcacctctcaggtttttcctgaagcagggatttggttagctgctagatttataggatttccttgaagtatcctgcacaatatcaaaggatccacaaatgagttagaattttcttttgatgcttgtaggagactgggtgccccgagagcttggagagctgacagagtggttgcctgattcctgccttcctccctcttatgtgctgacagctcagggaagagagatgttggggggaaggaacagacactctgtccttgctcttgacaaaacacaaaaattacattcccttctcgccgacataaattcaagaaagaaaagtgagcttgaggacaaaagatgctcaagatttggtgtccatgcctgtagccaggactggctttcccattagctctagcaggcacggtatctagggaccactttacttttagggtctcacaaaatgttttaattttttcatcagaagaaaaaagttgggcttaggtcaaagacactgttttcatagatgatgttaatatttttgtatttataggagcacaactgtaaaatgtaatttttaattttaatttttatggaggaaggcaagacaggctcagtgctcacagttatgaaagccataatatggctctgcttgagggggtccagaaaaaccgatattccatttcacatacagctcatgttctggcctgtgaattaattaattaattaattaatttgagatagagtcttgctctgtcacccaggctggagggcagtggtgtaatctcagctcactgcaacctctgcctcccaggttcaagcagttctcctgtctcagccttccaagtagctgggattacaggtgctcaccaccatgtctggctaatttttgtatattttgtagagatggggtttcactatgttggccaggctggtcttgaactcctaacctcaagtgatccgccacctcgggctcccaaagtgctgggattacaggcgtgaaccaccatgcccggcctgccctgtgagtttagataattgtgagcaggttataaagatctttggttatataatccagcattgcctgcttagtatgcatgacccaggaaacctgtgtgccccatgattctgaggattgaccttcaataacagtatgcttttgggtgggagagagtgaaatgagacccgtgttccattttgggctgttttttcctttctcctttacagataatagagggagaggtgtgcttgcatggaaaccatccaattttcataagagcagcacatcccctttaatatgctctggggggggggcgtcacctgctacaatgggataaaaggtttcctttataccctgttattcaaaaattgcaatttatcagttaaaagaatatccttgctcagtcgattatttcttgggagaaatattcaaatattcctcaccaattatttcttgggagagtggatctcagagatgttactgaatattgtgatttttaaagacattcttgattcaattccttgttcatttcgttttgtatctctctcgtcctcaccccacaagtcaccttggattacataaatgctcattcataatccttatacttagccttgatttttgctaacacagaatatttttatactttgtccaaaagttttcaaaatcactggccatttcttttggtgagcccagttctgagaaacttcaatgtaaatgttttgattttagaaatgcattttggaaaaggttgggctgtttggatcacttaaagggtttgctcaagggaacaggaaggttctttccttggaatttttctcacaagttattttgaccgaagccagtgttttgtgactcttccagatttcagggtgacttgcattgcaggagtgatgttacggtcatcattcagttttgagcccagaaaaattaatggtgagaaactgacatgatgagtttcaccttccagaattctttccactgagattttcaattaccctcttgtgctgtctgaaaggttaattttaaaactagtaccatatccaatttgtgttaggagcacatgacttctaaaggacaagtctatataaatgattacccttggcggaaaactacatgtaagcagtttatccttgttgtttaaagaacatcccttttggctctcctgtgttaggccttaaggttctgtgcatttcgtatggtgtgatttgcatgtgtgttcccggtggttttgctaatgacatatgctctacattaaaagtgtttttttttgtttttttttgtttttttgagacggagtcttgctctgtcacccaggctggagtgcagtggcgcgatctcggctcactgcaacctccgcctcccgggtccaagcgattcttctgcctcagcctcctgactagctgggattacaggcgtccaccaccacacctggctaatttttgtgtttttagtagagacgggatttcaccatgttggccatgctggtctcgaattcctgaccttgtgatccgcctgcctcagcctcccaaagttctgggattacaggcatgagccacaacacccggccaaaacagttttaaggtttaatatttttttctccctcatcttcaccctacacttctcacctttgcctacttggtgcctcattctgggtccatctttctactcccctcgtctctaggtctgtaggttgtttttttttgagacggagtcttgccctgtcacccaggctggagtgcagtggcgcgatctcggctcactgcaacctctgcctcctgggttcaagcgattctcctgcctcagcctcccaagtagctgggactataggcccgcaccaccacacccagctaatttttgtatttttagcagagacagtgtttcaccatgttggccaggatggtcttgaactcctgacgtcaggtgatccacctgccttggcctcccaaagtgctgggattacaggcgtgagccactgcacctggccaggtcttttctttgccagtctctcttcactgtgcatcttccctgtgtggttaatactcttccatcctcactgcctgtctattcttttcggagttcgaaagttctcttttatttcattgcctgctctttaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggtagtcagccaccctccaggagggtgctttttgggtaaaattgtacatgatcttagcaagaaaaaggagaacctagtttaatgagaaacaacctagtttgagaaatagtaggataccttggaaaactcttggtctttatttacagaagataacattattcttatttactattattatcttggtcacagagaccaagaaagtagtctacacgacttttttaggttgttgagatttcccaatatgttgtgtctttttaattacaggctaaggatcaagggaagcctgaagtgggagaatatgcgaaactggagaaggtatactttccatgattggttttgctattaatattttgggtagataacttttttcatgttattatcagtggcccatcattgatgaagagtattcttcatcaatgaatagagacctctcttcgaggcttattttgatagtccacctttgggtgaccacatatgactttatggctctaaaagaggtaaaagacagctcatttttgtcacacctgcccacagcaacaaacccagacacttagtaaaaagtataggaaaattgttattgttttaaaggactgagcgactttctctttttgccatttgtatgttgctggtcctacatgcatcatcaacatggagctttgcactgggacaaagtcttccctgagaggccactgttcttcctctcccttaataggttctggaaacccaaagaaaaagaccccatagaaacctcaagagaataggactgcaataaatgtagcaagatgttaatgctgatttgccttttgctttatttcctgggattttaattatagatcaatgctgagcagcagctcaaaattcaggagctccaagagaaactggagaaggtaagcccaaggtgatttttcaggaacttaccccccaccacctcctttccaaacatctttgccttgtcccagagcacgaaagatgaaagaaacagaattagtcacccagcgctgaggaaaatgaagggggagtgagcgattacctgaaaatatcagagttctgaatatagtttttccttttgagacatgtcagcagtgtttatttttaaaaaccaagctgtgtgagactctcaagtaaaagttctaattatactacgacagaacccaagaggcctgcatctctcgcctcagggggcctggcacctcatttatgcacatttgtaagagaagtagttccccacccaaactgctttctgccagcaggaggcctgccctgcagaaggctggaggagccatggggttgtcacgtgattgggaaggggcgtggatttggtttatagcatcctgcaaagtttgtgctaatggcccttttatttcattgtttaattatttaattaaaaaaaatttttttttgagatggagtcttgctctgttgtccaggctggagtgcagtggtgtgatcttggctcactgcaacctccgcctcctgggttgaagcgattctcttgcctcagccccctgaatagctgggattacaggcatgtgccaccacgcctggctaatttttgtatttttaatagacacggggtttcaccatgttggtcaggctggtctcgaactcctgacctcaggtgatctgcatgcctaggcctcccaaagtgctgggattacaggcatgagccactgcgcctggccaacttatttaacttttttgagacagggtctcactctgtcacccaggctggagtgcagggcatgatcatggctcactgcagccttgacttcacacgctcaggtgatcctcccacctccgcctcctgggtagctgggactacaggtgtgcaccactacacccagctgattttctgtattttctgtagagataggattttgccatgttgcccaggctggtctcaaacacctggactcaagtgaaccacctgccattgcttcccaagatgctgggattacaggcatgagccactgtacctgaccattttatcttgtttttaaaatttttattaattttttccctagcttcattaaggtataattggcaaataataattgcatgtacttatagtatgcaatgtgatgtatacacacacacacacacacacacacacatatacattgtgaaatgattaagtcaagccagctaacagatctatcacctcacattcttcttatattttttgtggtgagaacatttaagagcaattttcaagccctttctttagttgaacactggaaatgcttaatggaagggccagaatgaatgtggttgtgggacgtacctttggcattgagaatgtttgtgaatgtgtttgctggcttggtttaatagagttcctcctcctcctccttcttcttttttaaaattgtggtaaaaaaaaaaaccacataacattaaattaccatcttaaccatttttaagtgtacagttcagttgtgctaagtttattcccattactgggcaatgaatctctggaacgtttttgtcttgttacactgaaactctataaccaccaaatacgaattcctctcatccccctacctttctactttctgtttctatgattttgactactttatatacctcataaactggaatcatacagtgtttgtccttttgtgactggcttctttcatttagcgtaatgtcctaaagttgcattcatgttgcatgtatcagaatttccttccttcttaaggtggaatcatattcctttttatagacatactgcatattgcttatccactatttgctccctgcttccttattcttgagctctctaatgaaagctctcatggccctctttagccaaaagcttgtgagaggacacgtgtctccatctagaactctgctctccaatcaaagtgtgagggagccacaaatattacttacagatgtaatttaaaattttctagtagccacatttaaaaacagcaaacacaggccgggcatggtggctcacgcctgtaatcccagcactttgggaggctgaggcgaactcctgaggtcaggagttcgagaccagcctgaccaacatggtgaaaccctgtctttactaaaaatacaaaattagctggatgtggtggcgcatgcctgtaatcctagctactcgggaggctgaggcaggagaatcacttgaacctccggaggtggaggttgcagtgagctgagattgcgccattgcactccagcctgggcaagaagagcaaaactccgtctcaaaaaaaaagcaaaacaggtgaagtcatttgaatgatatgtttgttttaacccagtatatctcaatatttcccataggaaaattaacaaatgagataattaaaataaggagaaaattaatgcttagaggcaaatacattgatacctgggtagatcaatccatttagatctttctatttccattcattacgttgcatcgaatcgaagatgctaatgatggtcagatacaccattatcttatataccccaagaaagaaaaatgcatcaattttaattgtggggtggatttcaaattcagtgatgttaaaaaaagtgcaccttagaataatgaaatatagaattaaatgattgtgtatttgttttgacaaatggtaaattcagtattacctgctttttaaatttaggacactgtcactatctttttttttttttttttagattatactttaagttctgggatacatgtgcagaacatactgtcaccatctttttatatgaataaatttgcccacctatctccttttccttctctcttcctaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggtgagcagggaacctccagcccaggccccagcggcctcggcctttggctgtgcccaaggaaagaaactgccagaccatcacttgcttatgtttgaccaaagctgctttcccttctgaagatccctttgaaacctgagaggctgggaatcatttccccccaggggaaagaaagatttgtcatagcagcttcaagtagaaagatgtcttcatagaagttttttctttctgtttattttcctctgacctacccactaatctgggagaattttgatttttataggtaaaccgaagctccatcactggttttttctttctcttccctctgttttttccttgcctttcccctccacgatattaatagcatattaattttcaaggcttcacctattacctgcgcgtcaatgactctcagatctatatttttgggcctcttgtctacttcaaattctttgttgttgttgttgttgaaatcatttgtataattttaccagaaccacatgagtgccttttcgtaaaaaacttaaaacagtacagaagaatataggataaaaagcgattcttctcctttactcgtatctgcctcctctgccccttggtgtttgtcccacagaaggggcgtgccgtagttgatttcaccctcctcctattgctgggtcttttgctttttcctgtcacattcttggtgtgaacctcctggtacatgtctcttttgggccatcctcacccacattcatctgcatttcccccagctcccctaaattccaactgagtgcctgaatggtgcatcagatttagaatgagctcagtctcttccctggcaagctggtttcccttctcactttcctcatgccaggcagggccaccatcattcatctcgtcattccaggcttgaaactttggtgtcatttcgttttctctggaccccgctattcagtgagtccctccatcctataaatgcagccatacgtctcctgttcatctcctgcttcccatttctgtagccctccttgtagtccaagccctttcctcttggctgagaaaatctaataatttcttggccatctgcctccagcttctccttccttccagctagttcacacagtgaaagattcatggacctcaaggaccagatttctcagaattccctgccccatcccaaacctttcaggggttccataatgctcaggtgcacccctgagcctggtacctgaaaccctcaacctttgacctttctgcttttcacctgcccttccccttaacatgtgctgtgctgtagccattccaggcttctcttggggcccagactggctcttgactactgctgtgtttctgctagtgtgtctccttttgtctgaaacatcttccccctcctctcctgtccttcctcctgcaaaacaccatataccacccccctccagagctcacgcctctctgatgtctctgctcaactgtccaattaaaagtcctctttcctgcctgcaacctcctgcagcactttgtacctctttgctttatggttcttcctcctcttaacctatattatgattatttgtgtttatcttatctcctccaagggcaggaatgatgccatcttcctctgtattttccgtgatgcctaggtggcactttgcagatagtaggtgcttggtaaatatttgaatgaatgaatgcactcttgtaacctacacaactgagtacctagattatagaatcttattttctctgctgttgcttcgggtgcctgagacttttcttcctgactcgagtgtatgcttcttgagggctctttccctcggtgcaggtgttatgcccatagcggttactccattaaaactctctgattgattcatgatctacaggaacgccgccattctctggagaacaaggtaaagagactagagaccatggagcgtagagaaaacagactgaaggatgacatccagacaaaatcccaacagatccagcagatggctgataaaattctggtgagcaggaatgaaagtcgcaaagttaaaagataacaggttagagtttgcaaagggaagggggtaagaagaagaattaaccgccacaataagggaggtatctccaagtagatgaattgagtgaggtggtttcagcatatgccacatcgtagagtagtatgaataaccaaataacggacatttcagcactggtaacagatccgtaaatatcgttttttgctctgtttgctacagcctggctttttttttttttttagtggaacgtgcatctatcattttcaatacatttttaaaggcgtgttgacatacttctatcagcagagctttggatagctgtcaacttcgcattgccaatttaaaaagctgtaggggtttagacctttaagaccgaaattcagattcttgcttttagagaagaaagcaattagtcatacagaattgttttgctaggagtagtatttgtcatagatccatgttcacccactcactttctctgctacagttggttattattattattattttttcaatttccttagatatagcaggtctttttttagggtctgtagtcatcctgattctgtctcaggctctgatcaccaaattaacttgatcaaggaaggttcgggtggtatttgcagatgtgttgacgttttgcccctgccagggtggaagacagcacctttgaagggctctccttggacctcagtcccacagccagaaatttgacatcatgtttgagactcaaggatgacttggagtccattcctatcccacctgggagagagtctctgaagtcattggtcattcctctccaccctaaggaggcaaggtcgtgagcagggcacttcatctctctctcttcacatcacttctgggaaatgagtcaccagcaactattggaattccatagtggccaacttataggtctatacttaataccaaatcaaactgtttacaactttacatttctgtttgtgtgtatttataaatatatggatgttctcgaatcaacaggtaaaagaaaaatgggttaaattgttttgctaagacacccagtctttgtatatatgtctgcacacaaagacaaatgtgactgttagtctaccctttctgttctcttgttccgtcatcaaagtttctcttggctattgtcaagtgtttgaattttatcatgagtataaaattagatcccactgagatcccaccgctgctgtcccttgcttggtataaacggagtggttaactctcttgtggttgcaaagtgtttctctgtttaatggtgatgtgttcattcattcattcaacaaatatttaatgagcttctactatgtgccaggcactgttctaggagctggaaatttagcagcaaacaacagtatttgcataacaggactgaagagttgatccaatatatctagaaaatacctgtttaaaaaatgacaacaacaacaaaaaatgccaaactaccaaggagtcagatttttagaatatctgctcttcctaaggttcacttacaattaaaatggaggagtagagagttctgcattcttggattatgtgttataaactcccattcacaaatagaccagaaatttggtcttaaagttgtcagtctcagatacctgagttttttgatctaatcttagattctgatttccattcctgtgctatcttatgaagaccgaaactggaaaaaaaaaaaaaaaggatgattatcaaatgatttctaacataaaggaaaaataagcggatttcttcgtccgagtgtatcttgccacccgccggagtacctttgtggttgtgacttcatttattagaaggtgccttttgctcaagaaccctgtgcttaggctgcaaagtatctaggaggtgggcaaagagtggtccttagtaccattatgtaatgatgatgcctgaacatacatcgccaaatgtcattggctttaaaatatttgctattctgataagaactttcaaaacagataatggtacagtcagtacagtagagtccttggccttagtaaaagaagttactgcaagagatcgtttagccaagtacatatagaaccttttaaaatatgtttttattaatcctgtttattttcaactcttcaagatcacatctattgaattgcagtagatcttgtgcacctggtcttaagattgaactttaattgccctcagagcaaagccaatgcttggagactttagaatatcaaaagcttaatcactaacattttaagtgtgtgtgaatctcaaagtactttttcacctccattttatgaacatatcctatataatttcctcattcttcaaaaccctcataattgcttccacttcaaagaaaaatttcataatagtataaagagttgaaaacttggagtaatgacttgatattagtaattaactgatgggtccagattcataagaattaatatagatgcagctgtgcatttacagaatgttttagtgaattgaatgctgccttttgtaaggtcagtttataaaacattggcaaatgaactgcaattttcaagtgaattacagttttgtttaaaagctagaaacttggtcaggcatggtggctcgtgcctgtaatcccagcactttgggaggctgaggcgggtggatcacctgaggtcaggagtttgaaaccagcctgaccgacatggtgaaacctcgcctctactaaaaatacaaaaattagccgggcatggtggcgcatgcctataatcccagctacttgggagactgagacatgagaattgcttgaacctgggaggtgaaagttgcagtgagccaagatcgcgccagtgcactctagcctgggcaacaagagtgaaaatccgtctaaaaaaaaaaaaaaaaagctggaaacttaacaataaaagaattaagagaacattaaatgtaggctatttatattactccagattctcttctaatctttaatatgtctgtacatttttatgtcattattatcagtgtattatatgtttgtctttgtccccatttgcattgtatcatatgaacattatatcacatgcacatctacagatagtcacatatgccacttaccagtcagttaaaatcatcattcaaaacttgaagtgcttggatcataacattagttttcctttttagctagggttcttgagcaataattctgttaatgaggaaaatacaaagtatttttaaaaatcataatcatatattaaaatgacttttctcatttaaggctcaagatagtggtcagggctttgtcatgtactaaactttccagtgttgccttgttactcttatttctctatgcaaagatgaagagctgcctttgttcgacctgtcatactgacgtatttgtggtctcaggccttacagcccaccagctatgtgtgtatgtgtgtgcgaatacttggacttggaaaacccagggccaaggcgtggtggtttccttcccaagagccttaggctagtaatggaggaccagatgaccgttacctgtggtacctgtaccaaagtcatgtttcctgtgaatgtctaacgtgcattggcggtgtcctgccctctgcacacctgactgtcttttcttttgtgtctaggagctcgaagagaaacatcgggaggcccaagtctcagcccagcacctagaagtgcacctgaaacagaaagagcagcactatgaggaaaagattaaagtaaagacattttctgatcttccctggccttgctcctatagtaccatgtagctcccatctcttcctgggcccttgtggccatttcttgctggaccaaagtactgtttggggtgaataatgtccttattccatggtgagagatttcagggtgttacttatgtgaaggattggaaatctgaagttccaaaaaaaaaacctttttttttttttaaatgtggtcatcatttatctcaatttcatctttaaactgattttttaaactcattgtcatttaatccatgatcatttctataatcctttttcttttttaatttttgtgggtacatagtaggtgtatatatttatggggtacatgagatgttttgatacagacatgcaatatgaaataagcacatcatagagaatggggtgtccatcccctcaaacatttatcctttgagttacaaataatctaattacattctttaagttattttaaaatacacaattaagttactattgactgtagtcatcctactgtactctcaaatactaggtcttgttcattctatttttttgcagccattaaccatccctaccttccctacaaccccttctacgcttcccaacctctgttaaccatccttctatactctatgtccatgagtttaattaagttgatttttagatcccacaaataagtgagaatatgtgatgtttgtccttctgtgcctggctgatttcagttaatatgatgatctccaattccatccatgttgttgcaaatgactggatcccattccattttatggttgaatagtactccattgttgtatctgtaccacattttctttcttttttttttcccttcaacttttaagttctggggtacatgtgcaggatgtgcaggtttgttacataggtaaacgacgtgtgccatggtgattggctgcacagatcaaccaatcacctaggtcttaagcccagcatgcattagctattcttgctgtcttcctgatgctctccccaccccacccccgctgacagggtttgtgttgttccctgccatgtgtccgtataccacattttctttatccattcatccgctgatggacacttgggtcatttccaaatcttagctattgtaaatagtactgcagcaaacatgggagtgcagatatctctttgatatactgatttccttttctttcctttccagcagtgggattgctggatcatgtgacagctcgatttttctttggctttttctttacaattttactttgcctttaatttttctgaggcttactgtattgtgtctaaatgtggatttcttggctaggtgtggtggctcatgcatataatcctagcactttgggaggccgagatgggtgaatcacttgagtctaggaattcaagactagcctaggcaacttgacgagacccctggctctacaaaaaatacaaaaattagctgggtgtggtggcacgcacctgttgtctcagctactcaggaggctgggatgggagaattgcttgaacctgggaggcggaggttgcagtgagccgagattgcaccacttcactccagcctgggtgacagagagagaccctgtctcaaaaaaaaaaaaaaaaaaagtctgtttctttttacttatcttattctgcttaagatttactgggctaaatatatatatatgttatataatatatattataatatatattatattatatataatatatatatatttagagacatggtcttgctcagcacagtaggctcaagtgatcttccctcctcagccacccaagtagctgggactataggcacatgacaccatacctggctatttaaaaaatgttttttgtagagatggggtctcccgggcttttgagtagattcatatctttttatttattctagaaagttagtggtcattatatctcaaatattgtctcttcccccttctctcttttccttttaagaatttgattggggctgggtgcggtggttcacgcctgtaatcccagcacttgggtggcagaggcgggtggatcacctgaggtcaggagttcaagaccagcctggccaacatggtgaaaccccgcctctactaaaaatacaaaaaaattagccaggcgtggtggcgtgcacctgtagtcccagctacttgggaggctgagacacgagaatctcttgaacccagtgagcagaggttgcagtgagccaagatttcaccactgcactccagcctaggtgacagagtgagactctgtctcaaaaaagaaaaaaataaaaaagaatttgattgggcatcagttagatcagctccaatttagcctttttaaatattttctatttctttgtttctttgtgctacattttgggtagtttcttctgacatatttcccaatttgcaaattctttcttagctgtgtctaatctgctgttccattgaggttttttcttttctttctttcttttttttttttttttgagacaggatctcactctgtcacccaggctggagtgcactggtgcaagtcatagctcattgcaacctgggcttaagcaatcctcctacctcagcctcctgagtagctgggactataggtgcatgccaccacgcctgggtaatttttaaattttctgttgagttttaatttcggttgttatattttttacttctagacattctatttgggtcattcccaagtttgctagattatttaagacaatcatcttctgttctgtgcattcattttcaagcctaacttttctttctttaaatgtactgagcatagttattttatcatctgtacctgacaactccactatgtgaagtatttgaaggtctgcttctgctctgttgtttctcttggttctttgtcatggtgactgttttattttccttggagaattattaatggaaattctttgaggccttggatgaaatgtgtgcccaccttggtgggtggtcgggggctttcatttctgccttttcttgaccactgaggctataaaaactgaaacttaagttaatttgtttcagtaaaatatctcaggttaaacccttcttacctctccctgcttctgttttacttagtttttggcaatttcttactctcttgccaacttgtaggtgcttttgggaaaatgttttttatattttatctagcattttaaatcattttcaagagaagggctggcctgacatgtagcccactatgctattagaaatggctgccgctctatcaatttcctttaaaatcacatcccattttcatgatgatttggatcaagcctttaattcattcttatgttcttgagaatcagatgctgtttattatatcttgaatattgtcgcttcccttttccaaccagacattgaagggggatttcaatttttgtgatgatcttgttattgatttggttggtattctcaaagaattgagtggtcctttcttggagaatctaacacgtacatgctcacacagcatcatcaccatcaccaccctggcatcttttaccgctggcgttatttttggttgtttttcagtaaaagaaatataggaggccaggcacagtggttcacatctgtaatttcagcactttgtggggctaaggtgggcagatcgcttgagtccagggattcgagaccagtctgtgtaacaaagtgagacgcccttctcatcttgtctacaaaaaatacaaaaattagccaggcaggtggcacacatctgtagtcccagctgcttgggagcctgaggtgggaggatcgcttgtgatcaggaggttgaggctgcagtgagccacctttgcatgatgaaagtaaccttttgtgaaacatattctatgatttggtgatatattgatgttcctaccaaaagccatattctatcttaaattgatttagatgtctttagtggaatctcttatttcaaataaacattttgctccccttcttccccatatatcttgtttatctttctgccagttgaaccctatgaaagctaagagagatccgtatgttcttttatttatctgtttattgttttgagacaggttcttgctccatcacccagggtagaatgtggtagtgtgatcatagctcaatgaggcttcgaactcctgggctcaagcaatcctcccatcttatcctcctgagtagctgggattacaggtgtacaacaccatgcccagctaattactattttttatactttttgtggaaatggggtcttgctatgttgcccaggctggtctcaaacttctgtccccaagcgatctccacccgtgtcagcctcccaaagtgctggggttagaggcatgagccaccatgcctggcctagtgcatacgttcttgatagaggcttatcccttctagctcatacttacctcttattggtatccttcttgaccaaagttgaggtcttattttgagcagaggcatcctgaaaatgtatttcattgctttagcacctcataaaatataaagggcatatgtggtctagatattatgtggtctctgctaacttctagatggaaagaaatttgttttatagatcccaaggaatgtcagggaaagatctgtctttcttccctactggaatctttatgaaaccatttctttttagcctgttctgctttgtgtttcctgttccagcctctgtcaggccattttagtaataattatgatcataccctcgattctaccctgttcttgctcataattttagaatcatgctcagacatccaagagagtgggccatttctcatccttttgagcttcttcctttctctcatgaccctgttcccaccttttggtcttctcttccaacttccattctattttttttcatcagtcagttctagtttaaagacctctttgaaatctgttctttcctttctttctcctgtggactccctccccgctgactggctctttttagggacgtcgtccccatgagctgtgacagtcctttcacaatagacattgttggaaaggcagattttagccctctctgtgaccccagctctttcagctttattcccaggatcctgttgtcctccttgatgttgttggtgttctttggaaaagtcgaatggagcctctgtggtgaggaacgtagggttgtggtcaaaggcttgggcatgttctgatgtcgtcttcttttttccttcctttttgcttgttgttttggcaactcgtagggctgtgtgtgccccaaagaacattagatcaagttggcgattggtgataccattactgttttatgtttcctcttgggaacagtaggtgcttacagtggcattctgagcactgagaacacatgatctctcttcccctgggaaaggtttcttttcccagtgacttttttttctccccctagttggatcagaggaaagaaccagggaaagaggcatttttttctttcttttatgttgtctttttaatctgttgaccatccacctacgttattggtggccaaaagcctcttgtccctggttgtttctgagcatcatccttggtcacatagacttcccctgtcttcggcttctctccctcttgcacacagcccaggagtatctagaattaatctgtataaattaggagtgaggaatattctgaaaactacgggtgcactggcgaagaaaaagttgtccccaggtaatatctgcagattataagaaatttattctctaggtctggatctagagcaatcttgtttcctcctcccttctcattctggagtctgcctcattttgaatatatctctctggtctttgggctgctgattttaaaataagttcttggttcaagtcaacctgttacttgccattggatggtaatatttgacttttcaatcttatcctgattgataagcggactcccagtttttgccttctctttgccccagaatttggagacctcgggcctctcccctgcttttctcctctttcctagattttctcaagtgtccccgtttagtcttccctcctcagcttggctcctgagaacatttgctgctgcttttgtttttgtaggtgttggacaatcagataaagaaagacctggctgacaaggagacactggagaacatgatgcagagacacgaggaggaggcccatgagaagggcaaaattctcagcgaacagaaggcggtaggtagaaggagttgccaagccagtgttcaaaggagggtttttgaaatatgccaagaatcacccctgataagactctatttcacctggtgaaattccttctgttgaatcctgtggagttgttggtaataggaggctttctctgaaactgtttcctttcctaaaagcaactgaggtggtggctctggatggccagttttgtgtttttcaagaactcatgctgttctgctgtctgctaaaatactgtccttctaaatgcccctgacaaaatgtccagtggctcttggtcttcctgctcttttttttttttttgaggtggggttttgctctgaagcccaggctgcaatgtggtggtgcaatcatggctcactgcagcctccaactcctgggctcaagtgatccttccacctcagcctcccaagtaactgagactacaggtgcatgcccccatgcttacctaatttttaagttttctgtagagacgagatcttgctatgttgcccaggctggtctcaaacttctggcctcaagcaatcctcccatcttggtctctcaaagtgctgggattacaggccaccactcctggccctacacttctcttctttttacttgcctgtttgtctcttttctaatccacataggcagttgtttcagaaacttgttgcccctaaggtttacctgtggtgcttatttatctgcactccaccaagacttaccatatcagaatctctctcttttttttttttttttttgagatggaatctcactctgtcacccaggctggagtttagtggcatgatttcagctcactgcaacctccgcctcccaggttcaagtaattttcctgcctcagcctcccgagtagctggaattaaaggcatgtgccaccgtgcccggctaatttttgtatttttagtagagacagggtttcactatgttggccaggccagtctcaaactcttgacctcaagtgatctgcccacctcggcctcccaaagtgctgggattacaggtacgagccaccgcgcccgaccccacatcaggatctctgaggggagatcctgggaaattaaatttttagttagtacccccacaccccaattcttatgattttttaagttggggaaactttgctgtagagaagctgtccccaacctttttagcaccagggaccggttttgtggaagacaatttttccacaggggtggggggatggttttgagataaaaccgtaccacctcagactatcaggcattaaggcattagatttttttgttgttttgttttgtttttgagacggagtcttgctctgtcacacaggctggagtgcagtggcgcaatatcggctcactgcaacctctacctcccgagttcaagtgactctcctgcctcagcctcccgagtagctgggattatagtcatgtgccactgcacctggctaatttttgtatttttagtaaagacagcatttctccatgttggccaggctggtctggaattcctgacctcaggtgacccacctgccttggcctcccaaagtgttgggattacaggctaagccgccgcgcccggctggcggcattcgattctcattaggagcacgcaacctcgatccctcgcttgcgcaggtcatgattgggttcacactctgaggagaatctaatgccactgatcccacaggaggtagagctcaggcagtaatgctcgctcgctggccgctcacctcctgctgtgcggcctggttcataacaggtggcagaccggtaatggggtactgctctgtggccctggggttggagacccctgctgtggagtctagagcaatggtggctgggtgagaaggaatcactcagaaaatgacaaccctcgaggaggtggtgataaatgcgaatgtgcagatttgagttaagagacttgcaggcccaggtcacatgtagatgagatggggtttaacaaggcctgattactcccaggatgttaggttcttgaataggtccttatgtctgttttaaatgcaagccacttagccagtgtggggagatttcatcactgaaaaaacaaccaagtaccatccatttgagtggtaccatctgtgatcctcagagtacagactagttgagtgccttgttacctctagccaaattgccgtcatttcagatgaaacttttaccctggcccgcactgcccctgttactcctgttctggtgtgtgaagtttcataggtgccctgtgtttcagatgatcaatgctatggattccaagatcagatccctggaacagaggattgtggaactgtctgaagccaataaacttgcagcaaatagcagtctttttacccaaaggaacatgtaagtattcaaattctaactgccctacattattacactttggtctcctctcctgtggcataaactcccttcttctgtttgatggagctggagtggattgaatgacttctgtagctcagcccagccctcagatacttacgtcatcttgccctgtcttaagtggtctcactctgccacttttgagtcgggttttcttaaatgccttcaattaccatcacattacagagtgttttgctctctctaatgaggctatttataatttgcttgtggaaagctgcagttcttgttccctagacttgcatcctgtaattagtaagaggtgaaattgtgtgtgcccagttgggccatccatttagttgtcactaggttagaccctatggaaggaagtttggggttcagcaagggctgtgttccaggagcactttgagctgaatcttttcccccagagaattagaatctccaggatttttttcccccttaggtttctctcttcagagatctcccaaaacagtcccatcttaatctaaaccagcttagtaggctgtgttttgggtctttgagtcgttctaggttttgatacttctaagcagtttgctggagaggtgagggagatctgcagagaactagaaggaataccattctttctccttagtcctttttctccagggcctgccttcatgagttactggggtgcccttgtacattaatctaaggaggcccccttctgtccctacacagactcacagaagaaataaacaggcctgtcaaaggagtgaaatgttagtatctcttgcatcctcctggaccttacttaatcccatatgtgagggactgacactgagtggtgatgagtaaatggtccccacgttcgtcatgccgggatcatgcttatgaggccagatcaggagacagctaacccaggaatggccctagtccacttagtgaggagacatgtctaactccgtgtccgtctacctcccgtggaaacgggctcaaccctaatgagactgtgattttgtttggatcctcccaccacccccaccaggaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtgagagcgaggagtcatctcctgggaggatttgctgggcgattcgggctctgaacaagtcagctttcgagcacaaatcaatatctatacaagagacattgtgcttggtggttaagggggcagacttgaggcaggagaaaagggtctggaggcaaggaacctaaggccaattcatgctgaatcaaggaaaaacaccaaggtttatggcagggaatctgaggcccttgtgctaacctcttttttttttttttttaagagagtcttgctctgttgtccaggctggagtgcagtggtgcgatcttggttcactgcagcctccgcctcctgggttcaagtgattctcgtgcctcagcttctcgagtagctgggactacaggcgcctggcaccacacccagccaatttttgtagagacagggttttgccatgttgaccagactggtcttgaacttctgacctcaagtgatccacccgcctcagcttcccaaagtgctggggttacaggcgtgagccaccatgcctggccaatttgtgctagctttctaaaagagaaaacaccaggttctgtgggcagggaacctaaagcccattcctgctgacttcccagagctggatcgaaaggaaaacacgtggggctggaggcagggaacctgaggccaattaacacaaacttcctaaagctgaaccaaaaggaaaatcctcatcttcccacgccccagtagtgaaagatggaacaggctactctccctgcaatgctccaaaagatggaagactactctccctgcaaccccctccccccaccttccaccattgctcagatggaaaggaagagcaccttggatgggccgcgggccaaggagggactatcccttcatctgcatagggcaccagttcgcctcagcctgtaattagccacagaccgaatcctttattcagataaggagtaaccaataggaaccccaaaaggagtacttaaaacccagaaaactttgtaactgggcccttgagccacttgctggggccactcccaccctgtggagtgcgttcttgctttaatagatccctgctttcgctgcttcgttcctgtgtttcgttcctttgttactttgtgcgttttgtccaattctttgttcaaaatagacaacttagaccccaggccctccttctggtaacagactgggccatggggatctgggttagaattccacctccactccttactggttttatgacctcttactagttttgcaagctgcctcatctctctgctgggcttcagtttcttcatctgtaaaatgtcagtgataatgtatctcctttatagggtcctgtggggagcgtgtcaatttgtgcatctgtcaaatgggagcagagcaattcctcctttatcaagatgtaatgacagccccgtgacctagtcagagcttagccatggtggcccagtgctggtggcagaggtctgtctcataatgacggtgggagattaaaagacaaaaccaaatttaggtgtgattgatgaaaggtagctctcttcaaaaacataaggaggctgggaagagtggccaggttttggggaggaaaatacaacaaattgggttgtagacatgttgaggttgattgaagccataaggttacatttatgtagtcactgtatatttgtcagatgtctgctgtgtgccaatttgtagcctgggtctacagtggcgacaagacagacctgttcctgacacgagggcttttagcctagcagcagggttcgctggcaccagcagagacacaactggagttcaggatagtggttgttggaagctgaacacccaggctgggagggaagatacaatgtctcatgtaaaatagttgctcaaatatttgtgatggaattcttcaaaaagcagatgatctttcttaaggaaggtcctgttaagcagacagcggtctgaggtctaagccttgggtagtactcatgtttatgcatgtctttatttgtcttggagtattaaaatgaagtcagttctccaagggacagtaacaatgtgttatctcatgttttttaggggttgtcaaggtgtgaactcctccattaggttcacctggagtgtctggttttattttcattttttctagcaatggggtcttgctatgttgcccaggctggtcttgagctcctggctttatttatttatttatttttcttttattatttcttaggtcaggatttctcagaaggaggacgtctggctttaagcagtcctccctccgtggcctccaaagtgctaggattacaggcatgagccttaagccttaggcgatggtttaacttttatcatccaggctatactttcactcttctgtaagtttaacagcaagatcacgggagactcgcccttaagtttgagtctaaacaatccagatggacttctctagcttgggggccttgactggctgtctcttgccttccctttgcacaaatgttcctcttaggagcctgccctgctgctgtagctcatctgggctattaaagtgtcccagggaagctgttgtttttcacttgaatcagtagagccagcccctcaaggatggtaagagaaacttcaaacgtttcacgagaggttcaggctctatattctccctgggagttttgcagtttagctctaaatataaccagatcagtccctcttcttttggccacatgctgctactgagattgagggcagaggcctccacctggagtttgatccgccttaaaggacctgggccttcccccaactttgtgtgtgcagcgttagctcttctctagccaggtgtgtggagtcacaaagatgcaggctcccgggttcttccttcattgtatagcatccagctcccgctcctccccttgagtcactgtcacctgcctctcttggttttgccaaatggcatcggaagcattttcaggcttgctagtagaggtccactctgctgtgactgatggtgttttagtaagacagaagggtacagtgtttaccctgtacatggtcaagtgcaatggtcaggacacgtagggatgttgcaggaatacagcaacatgttacatggactcttgagccagactttctgggtttgaatgccagtcctgccttttaaaaagatttttatagctgtgtgacatttgctcagttacctaatctctcagtgccacagtttgcttatctgtaaaatggaggtaatagtagtacctcccttagtgagttgttctgaaaatgaaatgagttaattcagggcccagtgtgttgtgaggaccgtatttgctgctgtgacatcgtcgtcatcaccatcatcactagagagagataatagccatggcttcagctgtcactgatttgttaaggcctcctggatccaggttgccaatccagacctttcttttgagtttctgacccattgtcttactagtagactacttattagtagacgttagacatctccacttggatgtctcccgcagggctcaagttcaacatgttaagactgaatttcttatcttttgcctcagactggccctttctctcctattctgtcatagcaatggtctatttgtgtaattcacccgtccagaaatgtgggagtcatctttttttcttttctttttttttttttgaggcagagtctcgctctgtcacccaggctggagtacaatggcgcaatcttggcccactgcaacctctgcctgccaggttcaagtgattctcctgcctcagcctcctgagtagctggtactacaggtgtgtgccaccacacccagctaattttttgttatttttagtagagatggggtttcaccatgctggccaggctggtctcgaactcctgacctcgtgatctgcccacctcggcctcccaaagtgctgggattacaggtgtgagccattgcacccggctgggagtcatctttgactcccttatgtcctttgttctctgccccacatcaaattcaccactaaatcctgttggttttgcaggttacatcttttgcaagtgtttcttctcttcacccctatggcttcgggatgtgggtgccaccttttctagggaggagccttctccgaccctctgaagctgggttggaggtctcctttttatccccatggctttcagggcatagctcatcgcagtgtgttcttcttggcagtccccttagacagcaggctctctgagggcagcaagcatctctgagttgcttgacattgatctttaggaccacactgtccatgtttgtcaggtcaatagatgtgtcgtggtctccctcacccccatacctttggatgtcttgcttcccctgcctggaattttctttcacctcttacctgcttgtttgactcctgcatattcttcaacagaatttaacagatccagagttagctcctctacccacctgcggtattcctgcaacatccctacatgtcctgaccgttgcacttgaccatgatatatggtcatggttggttttcatttttctccccacttgaaggcagagactgtctttcatctccatattccattttccacagaaattgctgagtaaatttttgttaaatgaatgatgaaagattgaatagataggtggatggatgagcagatggagggaagaatgattaacttctaatgtgacattaaagcagattacctaatgaggacacatcagagaaagcgtgtttaaaataaatagaattcagtctgttgtttcatttacaatcgaattgaaaagatgtccttgttactaatatgttgttatttatatctgcttagctttaaatgtttttctaataagagtaatcatcatcattttcattagtgattcttgctgtgtggcttttccttttaaagtcttcccaggcatttgaatatatgtaagtaaggggtggttaggagatatagcccttacctgttcttactcctgttgaattcagagatgcatggaactcaggcccattttgttgcattttcctctcctctatcgagtgccgagaaggtggttccaagaccaggtttcagctgcaggttgagtagcaggtcatgtcttcactttctcttttgttcagaccaagcaagggtttatctctctttctctctctctctctgtctcaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggtaggtctggggagcaacatcttcaggttgctaaaggcctcagctaggatgagtgtggaactggcactgagtatactggctcacccttagaaattccaggagggaaaacatgatccacaaagatattcagtggccaggaaattggcttacataggctgctgcttcattggaactagtagatgagcttggttggttatattcaaacttttcttagtatcttgaatagttcctcctttacttatatattttccttcttttgaaaaaatcatcattatattttaaagtttggtttcagtttgtttaaaagtttgtttaccttggctttctactttagttttcaataatcatttaaaataataataataatcttatagtagtttttctaccatatttttactttttgttttagttaaccttactcatgttactttttttttttttcaagctgtagattctgcttcctgtcttttgtatgcatctggtatgaactggatgggaaaaattctactgaatgaaagattctttctctaaaagggacctggcttccttgttctttctgagagactagtttacttagctggagagtattctcaggaggtagaacttggagcgggggtgttactggattgaaaccttagttctttttagaagtctgaaatggatttttttgtggggccattttccccacatttgatcattcccacagagactgacccagaataacaaaactcacaaaaatctgatatgtgaaatgccaacttaacttgaagggggaaatgcaactgccaagttgactagggtactctgggtggccaatcttcacattttctttttcccattcagggaagtatacttagaaaatcccgttaatcttggaaggatccccggaggacctagactgtgagcatagaaggccaaatgaattttaatggctggtgtcagccaagctcatacatttctcatagtatcatactgtacccgccaagcagacaggcacacacctgcctgctggtcagggtgccctctcctgtgggccagtcacaatacagctgattgggtttagtgtttttttaataagccacctaaataggtaccttattcattctgactcaacttagatgctgtccccatttccgtcagtgaacatctctaaacctctctttgattggggttacttccgtggaatgaatggccatgtacattcattgcttacactttacctcgatgtaatgcacgtgtacatctctatatctctatctatctatctatctatctatctatctatctatctatctatctatatctatatatatttaacgtagtttcattcttagaagttattgcccattgttgggtttggggatcccagtatctgaaccaaactgggaatgtgatctgacagtgccagggtctgtataggaccagtccaaggtttagtggcttccagtatgtttgtgcatcctagattttctaggacttacaccaagttcagatattgactgcacatttaggttccatagtctctatgagaacactcattaaatgatgccacatcatgcccccaaaatttgctttggcaaaaaataaccacagtatgtctttgtgtatactgtcttgtttcacagtggactgaaaaccacttggaaagatgcaacacagtaaaacagaacaaaataagaaacaaaaggcaaagagaaaataagtctgtagaagaaaaaatggagctaggaatgaagttgatatataagagttcatgccaagaaggcttatagacttgctggagttgggagttgggtgggtggagagagacagataacatttcttagcttttaaagggaggcacctaaatttcaaccactattatatttaacgcaatgtatattaatattttcctcctgtacctatacccaacctctgaaagaaaaagagacatcagcaatttaatccatatttaataagcccttgctatgggcccaatgctgtgtctttagctttttctccccaggggattggtctgtaattcctcaaatccgtttatttcagagcagccgagaaggacacatttatcttgctgctctgttggaattgggaaggaggggtgactgtgtatcttatcctggccctgtttggaaggaagagggcataaaatagagcacgtgtcactgctctttatctatggggaaattagtcctttaaatcctttcttgctgctggttggaatgtgctgtgtctgatggctgctggaagctgagcacagcagcaagtcacgacttaatttagttagatgagatcactgcctcaaagcatcttcttaaaaaaaaaaataaggaaacaaacctcccttggtttagaaactagggctctgttgcttttgcagatgaagatgctgtggaaaaaacagggcttcttcaaatgatggcagaagtgccttcctccaacagctgtttgcaaacccatcatacggaaatccaaactccatttccatttgcttccattcagtttcaaggctgtgggcttttccttcccccttctcttgattatgttccataaacctggttatggacagcatgtgtttgttgcctgaatgggttagttgaatttgttctgaaaaacgtcttttccaagaaaaagcgaaaatggtcccaaaatgccatactttccaactttctcattgtttgagacctgagtggagaccctgcacaagcatcagtcaaatgaaatcagctggatctataatgatcgcctaggagatttgtgagtttcacagcaggctgttttgtcaataaaagggaatagtcaaatgtgctatgattgtttaattgtaagaggcagtcatctcctagcctgtgaaagggagcagttaccttgtttggcctccatccctgggccaaatgagatggagcacagttaaattaaagctctcgactgaagggtcttggcggtgcagctgggaggcctttgttgccgtttctaatgcttgcctcttctccactttcacttcacccatcctgtcaaatttaaacagaaacatgcttttaagatacttccgtacttattgctggaaaagagacatttcagcctgaacttgatatttaagactccatctcaagggagataatttgagtctgcacaccttatagcacacgatgtgtgatgtggtataagcatcactctgaagaggaccaccaggcaagaggcgtgctgtgtgctctgtgtgcaccggccaggcctcatgaacacattttgtgttttcactcctctgttcttttaccgattctgtcaagtgactaatgttgaataatcaagagttgaaagctagagacactaatgaaaggaatccttctccctgcatagcgtgatgatgggatcccaaagtcatcctctttgatttgttaaaatcatgagtcagtgcacgttctcattctcgtacataaatatcaagccctctgtttaattaattagtaagccatcggcatgatagccaagatgtgaaatcggggcatgtaaggtgacattcttgcctggtgcctgccttcaccctgaaagggggtgggtgcacagaagcctaaccgttctagaatcctgaccatggatcccagaaggtggtcagacatctacacgcttgtttcctttcttcagttctgcagatattttgctccctcaaggctacattgtagtttacttttctttcttcttcttgtaactttcctgaaaattaaggcataaatacttccaaaagaaagtatctctctggtcttaggggcagactggctgcaacctgtccgtccacatttttgccacccaactcctaggttagtggttcccaaagtggatctgtggactcctgggtttcccaagatcagatggttttttttccttttttttgagacagggtctcactctgtcacccaggctggagtgcagtggtgcaatgtcagcacactgcagccttgactcccaggctcaagagtgatactcccacctcagcctcccaagtagctgggactataggtgctcgccacccacctggttaacttttgtatttttttgtaaagaagaggtttcaccgtgtttcccaggctggtcttgaactcctgggctcaagcaattcgcctgccttggtctctcaaagtgctgggattacagacatgagccattatgcctgcctgtcagactgttttcataacaatactaagatgtcatttaacacttttcactgtgttaatatttgcactgatggtgcaaaagcaatgttagtgttattttaaaagaaataaaaaataaatatttgaaaaatatctgtcttaatttttttgtttgtttgtttttttgagacggagtctcactctcttgccaggctggagtgcagtggcgtgatctcggctcactgcaacttccacctcctgggttcaggcgattctcctgcctcagcctcccgagtagctgggactacaggtgctcgcccaccacgcccagttaatttttgtatttttagtgagtcacgggtttcaccatgttggccaggatggtctcgatctcttgaccttgtgatccacccgcctctgcctcccaaagtgctgggattacaggcttgagccactgcgccaggcctaatttttttttttttttgagatggagtctccctctgttgcccaggctggagtgcaatggcacgatcttggctcactgcaacctccacctcctgggttcaagcgattttcctacctcagcctcctgagtagctgggattacaggcatgcgccaccactcccagctaatttttaaatttttagtagagaaggggtttcaccgtgttggtcaggctggtctcgaactcctgaccttgtgatccacctgcttcagcctcccaaagtgctggaattacaggtgtgagccactgtgcctggccatctcagtcttaatttctaatgttgcaagtgtaggtggatactacataaacaagagctctttggggtcctcagtaatttttaagagtgtagatatttattctctgtagcacctaatatctaattaacactcacacatttcattgagagcatccaaagcttgtcttatgcgttttgctgtctttatgtatatattctattgcatgagcttttgcctttttgtgtatttgttttataacttatttcaaaaaacataaagcatatgacttaccattttcttactgtgactagttcagtagttaagtgcttacagtaggtctagcaaccacaacagggtcagttctacattttgtgtttatatttcataaacagtaataaatcaaaagccataatgactgtggttcattatgttaactttcagagaggattgcttgacatgatccaaagtccccataatggttaattttaatggaaatggatcagtattaatgactgaaatttcagactccagtgggagagttaaatgagtttttaatggtgctgtgttatttgaaactttgctgttaataagaaagtggaatagggcttctgtccctgtggataagccagtgagcttttttatggtcaccacttatgctttgaaggagctaactccactctcagcttcctgtttctgtttttgagagatttcacaccaaatagtcatttagagcagagactggcaaattacaggccaaattttagtctgtcactgttttctgtaaataaagttttattagaacacattagaaacaaacatgtctgtttgtttacatatcgtttgtggctgcttttgctttagaagggtagagttaagtagttctaaccaagactggatactctggaaattttaaggaaatttccttatctggcattttaaggaaaaaatttgccgattcctgaccaagagtctgttaacataagggccttattctttctctaggaagaatccttgcctttggtttttggtgatcatggaagacactaaagggggttgtgtggtccttgggtctaggctgctgcttggtcacagatgagattttgacatagtgcagatagccacagtcttactttgggtaagcagtattcttatcttaacaaaggaataaatctctcattattgctgggcaaaaagcaggtagatttttagaaaaaaaattaagatctgttaaattagtccatagaatataggctagttatttaggaagtcaattctaaacaataactttttatttataaatctgtctgtgattctgtctatgcaactatctatttttggtattttatgtatttttttattggtatatcacagtcgtacatatttttgagatacatgtgacattttgatacatgcctacaatgtgtaatgatcaaatcagggtaattgggatatccatcacctcaaacatttatcttttctttgtgttgggaacgttataattctcttctggctattttcagcaactaatctatttttggtttgttttgttttaccatctctccagggctcttcattcatttgtgtagatccaaatttctggttgccattttccatctgtcggaaggactttctttaacatttcttatagcacaggtttgctggtgtcaaattccttcaacttttgtatgtttgaaaaagtttttatattaccttcattttttaagaggtatttttgctgggtatagaattctatgtggacaggtgttttttttttttttttttttttttgcttgtttcttctgttttttatttcagcactttgaagatattgctttactgtgttctagcttttcatgcccactccttctccccatcttggtgagaaatctgtctttctcatttttgtttctcttaatgtaacatgtatttttctctggctgttttttttttttttaagattttctttttattattggacttaaacagtttcattatagtgtgctttaggttaattttcttcacatttcttatgcttggtacttacttgttgaatattttgcatctgtgggtttatggctttcatcaactttggaaaatttgtggccattatttcttgaaatattttttctgtctcctgtactccttctgggtctctaattgcatgtatgttaggctacttgaagttgtccacaactccctgatgctctgcattttttgaaaatgcctttttcttttctcattgtgtttcattttggtttctacttcttgtcttctacttctttgtttctacttgtcttcaagttcactaatcttttcttctaaagtatctaatctgccattataaactgacaatagtatttatggaaaaatagacatattagaaaaaacatcacagctctaaaatttttgactcagttatcttatagacttttttttttttttttttttgaggcggagtctcgccctgttgcccaggctggagtgtggtggcgtgatctcagctcactgcaagctctgccttccggttcacaccattctcctgcctcagcctccagagtagctgtgactacaggcacctgccaccacacccagctaattttttgtattttttagtagagaccatcctgttagccaggatggtcttaatctcctcacctcatgatctgcccgcctcggcttcccaaagtgctgggattacaggcatgagccactgcgcctggcctcctatagaccttcttatggagactttttttttttttataattaaatagaaggatcactcttacatctgccctaaactgggttctgggttcttatttgggttttcatacataagcagatgggaccatatccactttgtctatcaagtgaaaagtctgttagggcgtctttgactcctctttcctcttggccacacatctatcagtaagtccttttccttatgttttcaaaggagatctcagtttcatccactttctctgtttggtttgtttgtttgtttgtttttgccaccatccttctccaagccactatcatctctcgcttgaatgacagtaacagtaccttcattggtttccctgctacgttctacctttgttctattttgatcctcttctccctgtaacatctaccgtgatcttaaaacaacagtaaaatccgtcactttctttcttaaaattttccattggttttcaattaattgaattttgaatgaaacctaaattctttactggaccttcaagattcttggtctctgccttggtccctgtcatcatcttgggctacttttttttcttctttgctgtgctttttcaaaagttgaccacaacccacagaatacattttacttgcaatccaatagaagggagtatatatactgtatttcactgtttctaaggcatctgaaatcaaggtgcatattacagtcatatacagacataaacatgtcatagtttaacagcactttttctttcttaatgttacataaaattaggttttaccatggaaagtaccttaaatttgattagttatagtatctaaagcagaagtttcctataacagacctcatgtttactcctcaaggcacattctgatgttttcaattctatcttttttattctacttcactggatacaacaaaacaaaaaaccccacttgtcatgcttgctattgggtcacagcttgcagtttgaaaaactctgctctagccactcagtttttttggttgttgttgttcatcaaatgcaccagaccctttcctgcctcagggtctttgcaaatgctgctccctctgccgtctcctgtccattgcatggctggctcctcatcatcctataggtttcagcttacatgccacctcctcagagaagccctccttgaccatcccatctaagtaagtttctacctacctttcttattccttttttttttttaaactggtccctatttgttttctttataacatttgtcccaatctctaatcacgcacttattcatttccgatcttccgtcaccagaatgaaggcatgggtcatggatgcctatatccttccacagtgtcaagcatatagtatgcactaaaaaagtccttgtcaactgaaaaaatgctgctggtttaaggcagctttttcctggagaaagcctatatatatttatttcaaggccgatgtagagttttctgaatgtccgcagcttttaatgaaaaaacaacacacacacaaagtccctttgtcttggctattgtcctgtgtgtgcgtttctgtgtgtatgtgtgtgtgtgtgtgtgtgtgtgtgtgtcagggagtaggctggggaggagtcagttggagggaagagggaaaatactcatcttttcagaatgggaataggacaaatgaaggagagtaaaacttcatcctttattgctttttttcccttttctcctaatagcctgtaggtgttaatataaatgttaaaaatatttgtacagggtgtgcatgtatggtctaaagaattaattgttattaacacagcattgtgtattcctgtaacttatttctggtgttggggatgatttgattaattagttcttagaaaaacagatgctggtgccgcattctcggctttccaggcaaattgctattctctatatttgacccgtagcatgtagaattgtattctaccctatgaaaaatttataatcaacttcttaccttttaggcacatagagatgaaatccagcgcaaatttgatgctcttcgtaacagctgtactgtgagtattaattacccaaagacgattaaaataacatgaaactaaaacagaggaggaaaaggggacgtctctttaaaatattggtgactgagttttgatacgaacttgcagcttgaagaagataatgcaatcaaccttatttggagtttttgagccctagataacctgtttttgggggttcttccagttttcaaaaactgaaaccattcttcatgttttggggaagaggatagttggaagggtcaaaataattctattagtggaacaactaataggtttcagcagccgcaacaaaaatcccaaggcagttccacctcctgtcccaatgtagaaggttccatggctagcccaggtcagagactcccctgtcaccagggcagttgtatctgtgagacttgtccagattgctgcccctgcggaggaaagaccagtgagctctcctggagacctagaaattgtaactttctaccaggcaaaatttggcttcccaacatgcaaattcaaaatctaggactctttgggagatgttatttatattgagagaagtaaattctatgagtggataagcatcttccataggttatataatagagtagggtcagtgggaattcagtctatttttgatgagagtgaagaactgaaataggcccctttcagaagatggggatgttctccttattcatgtgccctctcttttctttggcctttttgtcactttattaccttcttagtcctcagtgatcttgtccttgtttgtattatttgcatttgtgaatttccagagacacctcccagcctccacacacatacatattttattttcttgttatgagccctttctttcctctttagctactgtaaatgaaatattaagtcctaatggtatttttttcttaatttagatataaaatgtatctagtaaagcacataataatgtagtaattttaagtatacagctcaataaaatttttacacagatagacaactgggtaaccccaatgtagatcaagatacagaactttcttagtccctgaaggctccctcatgtccccttcccatcatcatccttcacccaaagggtaaccactatgctgacctctgataaccatagtttagtcttacctgttcttgaatgtcatataaatggaatcacagaggatgtgctctctggggcttagctttttttttcgcttaaatgttttgtgaggttcctccatgttgctgtacctatcaataatttgttcttttttttttttatcactgtgtggtgtttctggtgtatgaatagaactatagtttgtttatccattctccttgttggtagacatttggattgtttccataatggatcaagctgttaggaaaccccgttacacaaggcctttggtggctgtgagcacttacgtctggtgaacatatccccaagaattactaggtcatgagatttgcctctgtttgactttagtagggaactgacagaccagttttttggtctgtatttcctgatgtggtggtggatcgggatgggcctgccttaaaatgtctgtggatttcctccatccctcctcccttccttgaggagttggggggtgacattctggtagttttctgccctaggattttagtttcttgttgtcttcgtttcttattttacacaagaattatttgcttatattacatacatgcgcgtgaatgatcactgaataaaatgtagatcattttatgactggaattttttatattactattttttccttatataagcttggattttaaaaaatgtgtgcattagtaatcctgttccattcatctggagttcttttttcctttttcagtcttttggcataagaactttctaaaaaacttttttttacagttttattgaggtataattggtgtactataatctgatgcgttttaaaatgtgtgtgtaactgtgaaacagcaaaacaatcaaaataatgaattttgttattattttggataataaggttatccaaattttatccttgagcgataaaaacaaaatatttattgtattcatgaccctcaaaagtttccttatacccctttgtaattcatcttgtcccccattttaaaaactggaagtttagttttagtggaatacactagtatgtagaatgcatttggttactttctcatgtaactctaatgctctccaaatttgcatttctggaacggtgacttctaatctttgcttcatttacctctgtgttctgtggcgaagcctatgggggccttcccaagtgtgtgtgtgtgaacctgagagagatgcccttcacccacatttcagccagaggagctgggtaacttagtagtctaagtcatgggctctggaatcagatagagttcagattataaattggcctcttagtaacctacgtgtattatcctactaagcctctgtttctttgtctgtaaaatggagataacattgtataccctcagttccaatcagtacgctcattgattgtaggatgcataatttatttaataactgctctttgggggctgggtgagggaagagagagagctgctggttccagtataccacgtatccacatttcagaaacaatacaacttatggaacactgagtcatgggatttggtagtagtacctccctcataaggttgctgcgagaattaaatgagatacgtgcaaactgcttgcacagggcctgatccatagaaagtactaaacaacattggttactactattattttattctcctgggcttataatataatcttttgtttggaaaatggctctgctgctactttaaaaagtttgaataccactactttagaacaacatttggccacaatagtaggtctcaattatacttttgcaagttcaagaccgctttaaagacacttcagaggagtgtgttggaggttcctttctttcttggcattgcccaagattgtctccgctaggaaatgtcatctttgtcatttaaaaatgagttattatgggagttcccacaactcccataataactcaattgataggagctctcttcagctttcaaaaagctcatgcacagtaagattttcaagctcagaccatttctatattttgaagacatttaaaaaggatttgattcaatctggcacctaaaaccctacctaagtctgttttagaggggagttggtgggcaaacatatgacacagttttaattatgaatcaatctgtcagctataagattaaaaataaataatatgcaaatagctgccttcagaagagaaccaggcattaaaataggatttcagtcctgtgtctgtttagcctgatgctcattatctgactggtttcttcacccctaacatgccattggacttttacctggtaattttcctctcctggtcttccagttaggtgtgagaggttcacatcttcttctcagaaccatgatagcactgaaaaacaacagataagcccaaacagagctgtttttttttctttttgacactgagagtagatcttttttttttttttttctggagattgagtttctctcttattgcccaggctggggtgcaatggcgtgatcttggctcaccacaacctccgcctcccaggttcaagtgattctcctgcctcagcctcctgggtagctgggattataggcatgtgccaccatgcccagctaattttgtatttttagtagagacgggatttctccatgttggtcaggctggtcttgaactctcaacatcaggtgatccacccgcctcagcctcccaaagtgctgggattacaggtgtgagccaccacgtccagcttagatctttttttttaatatcttctgtcttagaactgtaccaagacctctcatctgtaaaaacagcatataagaaagctctgctggcgcctgcgttgtgaagatattttgctcatctttttttgctgctaagatggaatcagcctttcagtttctcttttttactctctatctttggggttaaaaggttaacagactcatagtaaacaaatcatttgtccttggtgggtagagaatatacccaggaccagaaagtagacctaacaattttccttgcacattccctggatcaaaatcaagaggggttgtcctgaatggtcaatatatcttacctccatcatttcagttttcaaagatctgaataaaaaagtgaataaacacttctatccctattttagacaggcagtatggttcagggggcaagaatgtagattcttgagttttagtgttgggttcaaattctggctttgttatttactagcagtgaccttgggcaagttacctagcatctctgtttccccaatttccccatctataaaatagaaataaaataatacctacttcaaaggacagtagtgaacattgcctgttgttatgccttttttaaaaaatccacgaagaccattaatttactgcctatgtcataagtcagtttaatatctgtaaactcagtaacgtatgtgtgtgtgtgtgggtgtgtccaacgtttaatatcatgactccagcaacttgaaacaaggtcacaagctaaatgtgttatggcttgggtagatagaatatgtgtataaaaagtccaaatcaattaaaatgccttcaatctcggcatgggtactttacaaaaacatgtaacacttctcttgtcaaatgggcaaaatagagatgatgaccaaatatagaaccagcaatcacaaaccggaaatataattagaggcgtgagaacccttgaaaactggatgacaacagggaaatagaaagacccttcttattccaatgggcccatctcaattgagtgatacaaaattgccctttttcaagtgtttcttctttagcattttataatataactttgggagaaaacgaagaggtggcagaaatgggctaccatcacaaatgataaattgcatttttttcgtgaatcaaagaaagcaggtacccaaagtcttaagtacatccttgaatggcaagtaaattattttggcaatgatgtattttcatgtgagtagactttctatagtctagtctatttattccccaagaggcttttttttttttttttttttttttttttttttttttgagatggaatcttgctctgtcacccaggctggagtgcagtggcgcaattgtggctcactgcaagctccgcctcccgggttcatgccattctcctgcctcagcctcccgagtagctgggactacaggtgcccgccaccacgcctggttaattttttgtatttttagtagagacggggtttcaccgtgttagccgggatggtcttgatctcctgacctcatgtttacatgatgcattaaggtcaaataacatgcaagaaaattaaaataattaaaaaggtaaaagcagatgagtaaatatagtgttcactcccatgtcacagatgaagaaaccaacccagcaaaggtcagatggcttattgggggttccagaatccattttatatcttccaagccagcttgcctgtcttatttttctttgggaaagaggtagggggaggaattagtagttaaatggagacattatgaaaaacatcttaaggaatgggtttactacgtacaggaaggagaccagttgaactactgggcattgtttattcattgtttctggttttaggagatttaacatgccacagaaagggaaaggcagggaccctgcaagtcataagtgtctgttaggaatggcaaacgtacagattttccttatttgtcttccttgataaagaatgtatctgagctaagaacctgaccagataacttttattccccctcttgtagctgacagtgtacttcaaaatcgtacataggaattaatgtggcttttgacattaaaaagcaaattactagaccattagaccatacactaaaaggttatcagctcagttaacaaaatgaaaagttgtatctcctctgagtacatttgtggacaagtgtacttaattgatgttctttaatttcatgtgcctgggaagatttttttttaaattgataatcaaagagggttaaaatagggaattagtcatgaaagcaatggcaacatttcataaacgaaatcgactctaggtttgaaaattggaaacaattaataactgtaggcttaacggcatttccttttaatttccttctttttgttacgtaaaatttaatttactgcctgtgtgcctcagtccaactattattagaaaattgcccttaaacttccaaggtattatacataaaagctctctgcaagccataatactaaatctcagcaaagagaataggaaagctaaatgttctgaaattgaagtcattctgctactgagcaggagagtaatttagcaaaccccgattaaatctctctcaataaaataacaatttcatatacatggcttcccattgtctgatagccaactgtatagtaaaatccattaaagtcatgccatagtacagtgtattgtattttcagggtttttctgagtttccctgaagtttttttcctttgttgtatgaaattaaatttattgcttgtgatattatcgaaataactcctggcgtctttccctgtcagtcttccttgataagaacttcattttgctttctaagactatggccatctccaataataaggtcctagtgatagtgtcatgggcatttttagcttaattagtggatggtgataccagtctattcttaatttgcattttctttccacattatattatttccgtcaatttgatctcattcgaagtcatccgtttcatgcagtgattacttttgattgcttttgccatattttttagatgtgtcctgagttagagagaaactgagtctttttcttccactgctcgtgtttagagttaagtggctgggcataggagcttggacatggctctcacggtcaggtgggcaaactcatgagcggcacgttgattgccagtgtcacgtgggttcagaaatccatagccctagaagcaatttcttatttgaaatgaatgtgcttggcgtgtaactggattcctttcctcttttaggtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaagtaaggagggttaacaaggtcgtgagatccctggaggacttttagaaggattttaggagtgcttggtgcgttctcccaagggttccaacactgaacctcatacagtaattgggctctttttaaaatcatgtcttttttccaagcctttagggttttaaaaatgtattttaaaagtgtgtagttcttattaattttgattttaaaaaatagggccagtgtggcagctcttccctgtcatcccagtactttgggaggccgaggcagaaggatcacttgagcccaggagttcaggatcagtctgggcaatatagtgagaccccatctcttaaaaaaaataaaaataaaaaagataaaaattagctgggcttggtggtgcatgccagtagttccagcttttcaggatgctgaggcgggaggaacgcttgaacccaggaggtcgaggctgcagtgaactgtgatcatgccactgtactccagcctgggtgacagagctggaccctgtctcgaaaaaataaagatagataaaaacaaaatcaaatgctttgggggatcaatgtaaatggcttgattttaagcttggtcacttcccctggctttgctttggatcctgcctctaaggtggctgcagaactggcccttcatccattcttgcctggtccccttgggctgcagaagcaaaagacaaaccgcatttcaaactgtagttagaaacttgtgcttttctgaaactgacccgaccaaagtaatctccaggaaatccttgtttaaagacaaggcacaaatcagtgctactgatttgcagacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcaggtggggctttgtgtttgtggaaagctcatgacaggtgaccgcaggaggatcggcctgagagttgtggacagggtgatcagctattcccgccgagactgagaagtttcctgggtcacaagcctcctggtgctaaaaaccaggagactcttgggcaaaccaggatagggtggtcaccctagttgtaaacgtagatagtgtgagttggattctgtggctatgactggtatctgttttccccatgcagaggcctgggcatcagggcaaatacctctgttttctgtgcagaaaactctcatgaggtttcttgtcagagtgaccatagcaaggccatagcaaaaccattaccattttaatcctggtcttccctccaccccagggttcctcaaccttggcactattgacatgtcaggctgggtcattctttgttatgggggctgtcctgtgcattgtaggacgggacagcatccctagtctctactcactagatgccaccaacaacccccttcccacgttgtgacaacaaatatgtctctagacattgcccccaatatcccctgtgtctccattgtccccagttgagaaccactgctgtacaagaatagtttagtgggttttttttgttttttttttttttgtgacagagtctctgtcacccaggctggagtgcagtggcaccatcgcagttcactgcaacctccacctccagggtgggaggaattctccttcttcagcctcccaagtagctgggaatacaggtgtgcaccactatgcccggctaattttttttttgtatttttgtagagacggggtttcaccgtgttggccaggctggtctcaaactcctgacctcaagtgatccacctgccttggtctcccagagtgctgggattacaagcgtgagccaccacacctggctggtttttttttttttctcctttcttagtaggaaatgataataatcagttcaggcagtatcgttcctctgctttctcacttttgtttccacagttccccagtatagatttcccttcctgtggggccacagtggcacaattgcatactccatagttctaagggttgctggtcacattaaagatgtcatagactggaagagttgttatgacagttttacacagctcatggcagaaaagtgttttctttctgacaaaattggtacgttgtgacatttcacagatggaaagaaatggtctagaaggacgggtgccgctttccagtttgtacaaaggcatgatatgggctagtgtgtgccccgtgacttcctgtctgcacagctgaatcggatccatttttcatcaacttgctcatgtcaccttcctctgaaacttaccttcctgtgattctctgaactccttaagcaagattagctatccatagaaatatcgatcaatgaattagtctgtattacactcacttgggtatctatctctcacttttgcttggccatagtaggcttaactaaatatgtcagatggattacgcaaagttcagttgagctccaaaagtttggaggtaaaagatgaaaacccttacatttcaaaagaaatggtagaaatagttcctttttgtagatcctcccagcttccccactcagggtatttgttgatgtgagggactgctgtttaagtctcctattccagcttccttctgaatccttagactcccccatcctcattgtaagttctggttgttttcccacagaccccttccctcccaccctcaagtccagctcctatcctagctgtttttagggacctacagagatcatttttggggtaggatctggcttcagcatcaagaaatacacgaccatacatggaaggtataattatgaactgttctcaggaagactagcattagtctgctttcatttcatgtctgctttcagggcaattgtggaagatcgtgcctttcttttccttttttttcttttttctgttttggtattatatgggatactgagatgagtaaaatataattgttaatctttgtcctcaagagcctaagagtctactggaggagatatggattcagatatttaggagagatggggaggccgaagtgggtggatcacttgaggtcaggagtttgagaccagcctggccaacatggcgaaatcctgtctttacaaaaaatacaaaaattagccgggtttggtggcacgtgcctgtagtccaagctacttgggaggctgaggcaggagaatcgcttgaatcttggaggtggaggttgcagtgaactgagatcacgccactgaactccagcctgggcgacagagtgggactccatctcaaaaaaaaaaaagtatatatatatatatatatatatatatttaggagagaaatacagttatgcttttgttacagaacaaggtgaggttgctcctgagaagagaaagtgggaatagttttatggagatcatagcatttgaatttatccttgaaggctgagtaagatttgagtttgcagagtagcaaaggagggaatggccagtggaggagattgtataagccaaagtgtggaagtaggaagcatgatacctaaatggggaaagggaagtgatttttttttcctattttgcttctggtttttctattctttagcattatttatggagacactcatcagattcaagtttcacttttgttttttctttttttttttttttttgagaatggagtcttgctttgttgcccaggctggagtgcagtggtgccatctcggctcactgcaactctgcctcccgagttcaagcaattctcctgcctcagcctcctgagtagctaggattacaggcatgcgccactatgcctggctaattttttgtatcttttgtagagacggggtttcaccatgttggccaggctggtctcgaactcttgacctcaggtgatctgcccacctcagcctcccgaagtgttgggattacaggcgtgagccactgcacccagcctcaagtttcagtttcttgatgagtacccaaaaacatttaactttgtttttgtttttgttttgttttgagaccgagtcttgctctatcacccaggctggagtgcggtggtgtgatctcggctcactgcaacttccacctcctgggttcaagtgattctcctgcctcagcctcccgagtagctgggtttaggggcgcacgccaccacacccagctaattttgtatttttagtaaagatgggatttcaccacgttggccaggctggtcttgaactcctgacctcaggtaatccacccaccttggcctcccaaactgctgggattacaggcatgagccaccgtgcctggcctgttttgtttttccttacccaagcctaacatgggtcaaatctttgctttgtaagctgttggaaaggaagacagtttggaactaagagtcaaggttgggcatctttctggcctgcagcctgtttagttgctcgtcaggattagagacggaccagccttctttccgcaggtcagctgttggggggctaccaaaagctgacctgtgtctttctggcagggcgagagccgatcagcggatcaccgagtctcgccaggtggtggagctggcagtgaaggagcacaaggctgagattctcgctctgcagcaggctctcaaagagcagaagctgaaggccgagagcctctctgacaaggtcagcgcccaccccttctgctttttaggaaaacattttcgtttccttcttttaaaggcacgcttgataaaaattcaaatgcaatccatggcaaacatatttcataaacatatgttcatgcactccaaaaatgtcccatggttttgccttaccatgggacatttttggttggcagtagcgtgggtgggtgcggtgggtacccagtgatcacagtcggccagtgactttttaaaatctgtgtgtctaggcccttgaagttcgaattttgatctgggtgttctactctctggttgtctggcatcttatttccagaaggctttatggattgaatgctgtgcatctttgggaagttcttggtggcagtgactaatgctcatccaattgctgcagtaataggcagctcagcttctccgtgttccaagttcagggtcgtgatagggtctgatgacgcatgctggttctcagtatttcacatcggaaatacacgtgttccatccatgtgcctctccatattacatttatagtcataaacaatgttttggagattttagctaataatcttgagagagatacagaataggcgcttcagcgttacagatcaccaaagtgaagatcagaggacttttatgtatgaacacacagatgcatacatagacactctttttcatgcacatacacacacaaaataaaataacgatctgattttatattttctataactttgttatttcatgatagaaaaataattatttgggtcattgtggaaaatatagaaaccacagaaaagtaaaagaaataatggctggtcacccatcgctgttgttttattggtgtatttatttgcagtctctgtgcttatgtttatgcatacacacatatacatagacatacgtatgtatttttataaattagattttcattatatatacagctttacctgtttttattaaaaatcatttaacttcaggttttttctgagttgaatattttttgaatatgtgattctaaaaaaaataaattgcatggaagtacctacttgaatcattatacttgtattggaaatttgaacttccagtattttaccatataaataacaatatgataaacatgaatctttatggacatccatgattattttcttaccggatacttatattaatagaagcagaattattaggtttaaggccagagctctctagtcaggaatgctcctgagttccctgaaactgggttaccattttttttaagcatgaggaaactagatttattagagctatgtgaggccttttatgtttaatgtgaaaaatatttttttctagttgactgttcttaaaatgttaagcagcaaagtccttcatatcttttaaagctccagactttgcaataccttattgtcttgatcttctcctaattgggttgaatttctttcccaagcctttcttatcaaacttataagctgacagagcagtcattatttgcatacatgtctagttatgggcctttctgacttgacgtaagatccttgagagcttggttatcctttcatcctaaaagctataatgcaggtagtaagcattcagcgtatgattatttaattaaattcagccaaagcatgtcagataaataagtccttgagcagttatcctcctagaacttgtcacagccatatttaagagccatcccttagaaataatttccatcctcatataataacctatggaagactcaccagtgacagggacttctgtatttagaaaaaagcaacctttacgttctgacctttagaactcaatattctttctccgtgaaggttcgtggacattcataaacgttgtcagcatctaacattcctaagtgtggcattatgccaatctttccaaatgtctagctcaatgacctggagaagaagcatgctatgcttgaaatgaatgcccgaagcttacagcagaagctggagactgaacgagagctcaaacagaggcttctggaagaggtgagtgtgaaatacctgggagaagggccaagtggattttttttttcttttaataggcttcttttttttggagcagctttaggttcacagcaaaattgagcagaaagcacagagagttcccacatactccctgtctcctcctcccacagtgtccccagctatcaacaccctgtaccagagtgtccatttgttacaatcaatgggcctgcactgacacatcgtcatcaccccaaatgcatagtttaaattaggtttgctattggtgttgtatgttctatgggttttgacaaatgtgtaatgacagttatccacctttactgtatcatacaggatagtttcactgccctaaaaaccctctgtactctgcctgttcatccctccccaccctcaactcctggcagccactgatctttttgctgtctccatagttttcccttttccagaatgttgcatatctggaatcacacaggatgtagcctttcagatcagctgctttcacttagtcatatgcatccaggtttcctccatgtcttttcatagctggtagctcatttctctctggagtctttttttttttttggtcttgctctgttgcccaggctagaatgcagtggagcaatcactactcactgcagccttgacttcctgggttcaggtcatcctcccacctcagcctcctaagtagctgggactacaggtatatgcctccatgctcgactaatttttgtattgttttgtagagatggggtttccccatgttgctcaggctggctggtttcaaacccttgggctcaagtgatctacctgtcttggcctcccaaagtgttggggttacaggcatgagtccccgtgccctgcctggacttgtaaacaaatttctttaaaagatttttttatttcaatagctttaggggtacaagtgtttttttggtgacatgggtgaattgtgtggtggtgaagtctgggcttttcgtgtacctgtcacgcaaatagtgtatatcgtacccgataggtaatttttcatccctcactcccctcctcgccttcccccttctgaatccacagtgtctattataccacttgtatgccttcatactcatagcttagctcccacttgtaagtgagaatgtgcagtagttagctttccgttctaggtggaattttgaaattgacaatttgtcagatccaaattagatattttgaaattagaattttcaagtaagagtatgggggtcatgtaatacttgtcttaaggtatttaacacattaaaagactatgtcatgaaggccagagggtctctgtcatttttatccttctatgtgatgcttaatggagtgtcaagcacatagtaagtgtgtgccaaatagaagtttattaaatacatgggtgaatgaatattgagttaaattgttctttagagctaatatccaaagtatattaagtttcatgccgataggacatccatgcaaattagcttcctgcacagggcagaattttatcagattattctgagtaccaaatttcatgaaggtttttgaacattgggtaatttagttaaaaataatgtgtgccctgcttttgaagcataatagacaagctcagactgatcttctaaacccatcccttacgtgatggctggtaccttttcacagaactctgagaacggctatttaaattgatgactacctcccactccccaaccagagccctgtgtgttgaatcactgatgattccgctttgttctttaggattgacctgcaaggacaaatgcactttataatgaaaaattggactccaaagagtattctgtttaacccttagtgagcctgacagtttaattaaccagaatgccctgttctggctgatgaggttttgtcacgtgatacccatagctcctgaggcactttgctgatagaaataatattgttatgctgttaagtttgaaaagtatagtgacatttttgcgggtgagtataaaatattttattgaatgatactttaaaaaatatgggtggctgaggcgtgaggattgcttgaggccaagagtttgagaccagtataggcaacatagtgagaccccatctctacaaaaaaaaaaaaaaaaaaaaaaaaaaattagccaagtgtggtggtgtgcagttctagtcccagctactcaggaggctgaggtgggaggatcacttgagcgcaggtgtttgaggctgcattgagctctgatggtaccactgcactgtagcctgggtgacagagtgagagcctgtctcaaaataaaaattaaaaattaaaatgaaaaatatgggtgggagtttgagaaagttctagaaatggatggtggtggtggttacacaataacatgagtgtacttaatgccactgaactatacacttaaaaaatggttaaaatggtaaattttatgtcgtgtattttgcctctgtaaacaatttaaaaaataaaattaatactaaacacacacacacacacacacacacgtatatttggtgaacacacataggaattcaccccgtggccttaagaacaacactacagtggaaatgttaaatgtacctcgtggtcaaatagagaattagggtcttttatctgcagtgaatagacagtgttcccacttaggcacatcctgcaaacagaaagaacagaaataatcaatgctcttgcctgtcctattttccttctgagagggcgagttggccctgacagcccagtactttggtccaaggttatgtggtgagtcagtgacgactctaggaatagagtgccgggatcccaattcagttccctccttctcacttctaacctacatgagaacatttccagtttcccaggatgttcctcacagaaagatttttgagcacagacttctggctgacattgagccggaggcagatttcagtgacagttgaaaccattctggaacaaagaatgctctttattgtccacattgtgattgggcctcctggttggtgtgtgctgtataagcatatgtgcccaaggcttccacctaagtatcctcttcgtaggtgcggagacttttattttttatttttatttttattttttgagacagagtcttgctctctcgcccaggctggagtgcagtggcgtgatcttggctcactgcaacctccacctccgagggtcaagcaattctcctgcctcagcctcccgagtagctgagattacaggtatacaccagcactcccggctaaatttttttgtatttttagtagagacaaggtttcacgatgttggcccagcttgtctccaactcctggcctcaaatgatccgcccacctcagcctcccaatgtgctaggattatagcatgagctaccatgcctggcctataaggagacttttaaatggagccagaatcaaagtctcagaattgaaagaatttttatatcatccagtctgaatttccagcactattccctttatccttgctcctgacaaactttactaatggatctttcacatttttcctcctgggcccaaaatggcttcagaagctttctcaacatgacactttttttttttttttttttttttttttgagatggagtctcgctctgtcgcccagactggagtgcagtgatctcggctcactgcaagctctgcctcccgggttcacgccattctgcctcagcctcccgagtagctgggactacaggtgcctgctatcacgcccggctaattttttgtatttttagtagagacagggtttcaccacgttggccaggatggtctcgatctcttgacctcgtgatccacccaccttggcctcccaaagtgctgggattccaggcgtgagccactgcacctggccaacatgacactttatagccactatctgttcattggaagtaatatcagtgatcaaagtccatttgctagtcctggtcaaattcatctctcatccaaggtagaagatcccttccccaacgctcctcataggtaggccccgttgaaccttggcctaaatacttacaatgactttggacatcccaacccatttttcagcaactctcattcttagaacattcttattttgaactaaaaaccttccacttttacctattggttctattacattaaaacacatgaaattagaaagtagtctgatatctccaaccaaaatgggagattaatactgattaatagattacttgattaataattaaaataactaatgtttaattagcacttaccatgtgactgactctctgagtacatgaattaactcttacagtccttgcaatgttcctgggagataactagttttattatctctgtgacagtcaactagatatccaaatagctctcccactccaaattgccttctcttttattttttcaagtatttttgtagagacggcgtctccctatgttgccctcaaactcctgggctcaagcgatcctcctgccttggcctcccaaagtgctaggattataagagtgagccactgcacccggccaccttctcttttttaagtgaaacattttagatcccctcaagctttggatgttcttttctggtagatttgtctttccacagagagtttctacaagtccatgtggtctgaatagcactgaatacattgggatctttccgtctccatactgggctctaaacctctgccaattacctgtgctctttgggtagttttgatcacatcattgacaccactggtctgttaaatcactacctgcccttccacaagtttgctttttcttaaaaacatctttatgttctagatttattccattgacaatttaaaaaataccgccctactgaagtttttcttgttggtcttgatccattcttccagcccacgggggttgtttcatgctcttgttctatcatccaggccctttctttttcctcccagtttcctgtctttttccttacagtttcctcgtgaaattgttggacaggtctaaacacacagctaagatccccctttcagcctaacactggcccatgaatatacctctgtttgcttctttctgggaagcaggtaaatgcttctgaaaaacatttcatagagtacaaatgccccgcttacttttttttttttttttttttaatgtatagggaataaccagcctatttcttggaaagctaatggacagttgatgcgtttattctagaaaaatattttgggctcggctgtcaccaaacagattctcgtccccagcacttgtttctctggtttctgcctagtaattaatgttgtcctaaaatagtgggaagaaactaaagagggtaatttgcagaagaaatcactcatgctgcggaggagggtatcttagctgtttctttccttttttcctgtattttagggggctctgtggtttgattgagaaattccagattacgcacacgggccaaatgattttttttttaaattttcgtttttatttttttagagacagggtcttgctctgtcgcccaggctggaatgcagtggcataatcatagctcattgccacttcgaactcatgggctcaagcgatcctcccacctcagcctcccagagtcctgggatttcaggtgtgagccactgtgcctggccccaggtgatctttagttggtagctcttcctttgtggcagtactgttagggaaaggcagacgggaggatgagagggagcaccttaactgaatggagggaagaaagaaggacaaaggagatggagaggataaacattcaataagcacctactgtatactgggcactttgttcaatatgtcatccaatgaggcaagctagtatacccactttcagatgaagaaactgaggctctgagaggtgataaatacagattttaacaggtatcagtgatatgataagtgtaaaagtcaggatttaaaccagggtctgtaagaatccagcatccaggtctttctactgcaacacgatgccttagggaatcagctacatgttaagaggaagggcaggtgaggaatataaatggaaagaaaaacagaggtagagagaagcaaagagacagagagggccaggaaatgctgagattatcagtggctctgggcctgctgggatggaggagtttgggggctgccataggccttttggaatctccagtgatgatgtttattgctttgagtagctctctgtccctaagtctgcagaggacccaggctaccagggaagagattatttgggccacactaagtgtagttaagctataatccagggtttggataaaatcaagcactgtctcatcaggatgcctgctctctcctgcttttttagaaacggatgcattttaggaaaaagaaccacaaaaccagcgtctttatagcctgtcctattttctggttaacttccattataaaaattggagcgagatttgcagcacaaaactattttcaatatacttaattgaatttcttttctgggttttaccaacactctgtactataactgggatcttcttcttttcccccaacgttgtagaaatatgtctcatgattgtggttattcatgtacttgttggggtctcttaccctaatgggacctttattaagtaagggatgatatgatttctctttgtgtatcccacactgcctgcatggagtaatttctcatagcaacaattaagatcttgaaaacagaaaataaagacattggaacttagttgtcatggcactgagtcgaactgccttagatgtcaactcagatggctcatgccatccaaaatatcctcaccttaatgtaccaaaatatcctcaattggaactctgtctgggaaggccatccctgcagcctggacttcctgtgacggtagggatcctcggacttgttggccagcagaggtttctgtgcaaattcattttaactgtgcttgcatccttttggaatagatgacaattggtaattctgaattgagatgatttcaaaagctgtacttctggtgccatgcctgaaattagtttgaaataggaacagcaggggaacaaattgtattgtgtgcagtatcaagcatttccctggcccttctccccactagcaagccaaattacagcagcagatggacctgcagaaaaatcacattttccgtctgactcaaggactgcaagaagctctagatcgggctgatctactgaagacagaaagaagtgacttggagtatcagctggaaaacattcaggtgaggactggcagagggaatctgcttaaaaatggtctgcacggctgggcgcagtggctcatgcctgtaatcccagcacttcgggaggctgaggagggcagattacttgaggtcaggagttcgagaccagcctggccaacatggtgaaaccccatctctactaaaaatacaaaaattagcctggcgtggtggcgggtgcctgtagtcccagctactcgggagactgaggaaggagaatggcttgaacccgggaggtggaggttgcagtgggctgagatcacaccactgcactccagcccgggcaacagagcaagactttgtctcaagaaaataaataaataaataagtctgcagaggcaaagcatgattgtacagtcatctggtaaaatggtcagtatctttgtgctgcatattgtgtgtattttccccaagattttattttcaaagattgcaaacattcagagaagttggaagatttctatagtgaccatgacctacaaggaacctgttgctatttttactttttcacatatttatctataaatatatcttttttctcttttgcagtaaaactggactaaatacatactgactcagtactgtttgtgttggattttcatatattagtgtcctaacaacttcactttttagtttcttaaagtaccaactttaaaagtatacttctgtctggatttgaggttagtttgttttcttgaattttaggttctctattctcatgaaaaggtgaaaatggaaggcactatttctcaacaaaccaaactcattgattttctgcaagccaaaatggaccaacctgctaaaaagaaaaaggtgagtcaaagtgtttgaaaagtgggaattgtcagtttcactcatcattcatggctcagtggacaccactgtgatatatgatcataggaacatagaagaaaacaaagtatactttttttgttgttttattttgggttgaaaaatagattttgagataattataataggtcttactgaaagatatcagtgatcaagtctaacaaactactttttgtttatgaccattcaaatcatagtatctttgttaaagaagtaatccctccccagcccacacacatagcagttggggcagagggatgtatgcagagagaaagatttataccaagtcatgcatacatgactctagagggagttagcaagtcacaagtatggggcttcagcagttcaggtctctcgtaccacactccagaaaggactttaacagtgatctagtccagtccttttgatcggctcacaaagagactagaactcagggagctggggtgacctgcctgaagtgtctgactggacacttctcccctctgccaagtactgaacaacccttttagattgcaggagacaaattacaaactaggggcagggttatacatagtgcacatgagaagattgtttttcataagcctgatctatacatgctttcccaaaccactaaagccttcatactaggtttggccaggtgttctcagttccagaaaagtcttgaagaagcttgcagtttccttccaaatgcagaagcataccatagcagcagtggcagtggttttgcaggagaggccttgatgacttggaatacctaggaggaaggagtggagggctgaagttgacagttgtctcaatatttccggtgccatcttcgctgtaagggcatgagcacaacattcagaggccgcctcccactagacgttggctgcacgggaaggattttcttgcatgctgcgtgactgtatatggttgttatgcttatgatatttaatcttttttattttagcagtgaactgttacctggttatgtcacttgatttagttagggtgtttccatttgttattttttttagttaccttttttttaagttgcattattctgttttccttttttttccatgtatagtaaatattttcatttgcatttttttttgagtaagccccttgttttgacctcattttagcattccttttaaaattttgcttccttttacaaaacactcatctctgtgtcttgtaactgagcatcatgagacatattccaaggcaagagtgacctctgaaccatctctcctgactccatactccatactctcctgattccattttttgaatgggaaagactcaggacatgactctcctgtcttggcaatgctagaggaagaggtggtggccattcaagcatctttaatcctcttggtgaaaacttccgcacccctatttttttcagccggctggaacgggctgtggctcagcctacccttcccccccttcacatgccatttttactaaatacacttacagtgagtatgctcctggcttttgtggtttgctcctcccgagtcagatttcctttagctagtttcaagtgccagtttccaggagttaggagatatctctgtttccattgctagggtttatttagtcgacggaaagaggaccctgctttacccacacaggttcctctgcagtacaatgagctgaagctggccctggagaaggagaaagctcgctgtgcagagctagaggaagcccttcagaagacccgcatcgagctccggtccgcccgggaggaaggtaggggctcactctctccaaaatgctcaaggatgtggaaaaggcagaggattgatctcagtgagatcagccaagactaactagctcagtgtcttcgtttatggcccatacgctttcagaccagacatcccatgtctgaaaaacgtatggcccctgtgcattgccaagttgatgtgacgcatattcttttggtcttgggtccttgaaagatagcccagggacattcggcttagtttggtcctctaggcgacccagctaaccaaaaggcattgtcctggtctctctgcagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagagggtacgttggagttgtatggaaatttcttttagtcgactaagacatgtgggcatatggtaaaaattacaagtaatactaggggttaaagattaaaaagtcagtcttggccaggcacggtggctcacacctgtaaccccagcactttgggaggccgaggtgggcggatcacctgaagttgggagctcaagaccagcctgaccaacatggagaaaccccgtctctactaaaaatgcaaaattagctgggcatggtagtgtatgcctgtaatcctagctactcgggaggctgaggcaggagaattgcttgaatccgggaggcggaggttgcggtagccgagattgcgccattgcactccagcctgggcaacaagagggaaactccatctcaaaaaaaaaaaaaaaaaaaagaaagaagtcagtctcctggctccccatcctcagtgttggttcatatatgtgaccacatgtctataccattcatgtatcttacattgtgtgattatatttaaagaatatgagaaaataggctgggcatggtggctcacgccagtaatcccagcactttgggatgctgaggcaggcggatcacctgaggtcaggagtttgagaccagcctggccaacatggtgaaacctcgtttctactaaaaatacaaaaattagctgggtgtggtagcattctcctgaagtcccagctacttgggaggctaaggcagtagaatcatttgaacccaggaggtggaggttgcagtgagccgagatcaccccactgcactccagcctgggtgataaagtgagattccatctcaaaaaaaaaaaaaaaaaaagaaaagaaaagaaaaaagaatatgaaaaaataagcacatctctctctcaggccttttttcttttataaatattatagtggtggctcacgcctgtaatcccagcactttgggaggctgaggtgggcggatcacctgaggttgggagttcgagactagcctgaccaacatggagaaaccctgtctctactaaaaatacaaaattagccgggtgtggtggtgcatgcctgtaatcccagttacctgggaggctgaggcaggagaactgtttgaacctgggaggcagaggttgcagtgagccaagataaagccattgcattccagtctgggcaacaagactgaaactctgtctcaaaaacaaaaacaagaaaacgtaagcttatctttcaggccttttttctcttataaatatcatagcacactacagtatacactgcaagacaccttcgtttcattaaagtgctatcttagaggtttcacattagtacataaggacctaccccattctttcagagaaccacacagtattccgtggtgtgagcatgcaattcacctgttaagccaggctcctgttgatggccatttaggttgtttccaatcccctgttactgtaaacaccttgcagaggacatcctgtgcctctgtgggtgttgtgcctggagaaattcctgggaaatgaatcactgggttaaaggtcatgtacattttgagtgctggtagtttgtgccaatgtttatttctaccaacagtgtgaggagttttcttgctggtctcaaatgtactccatttacctagagattaaaaggacttaagaaaaggccaaggaagctgtttggaatgtcttaggaacactagggtagagctgtggtttagcaatcatggcattgcaatcaaacctgttttggttgtaaaccagatggtgttttcttgttgctgttgtttttctttagcctgaagtcattttcttcctcctgtgtttatataactccttgaatcaaagagctttacttttttttttttttttttttttttttttttttttttgagacagagtctcgctctgtcgcccaggcttggagagcagtggtgtgatcttggctcactgcaacctctgcctcccaggctcaagcgattctcatgcctcagcttcctgagtagctgggattataggcatgcgccaccatgcctggctaatatttttatttttagtagagatagggtttcaccatgttggccaggctggtcttgaactcctgacctcaagcgatccacttgccttggcctcccagagtgctggcattacaggtttgagccactgtgcccagcccaagagctttacttttaaactcattaaaatggtgatgacaagatagaggaaagcattgcttctggctgtggtgtccactgaaatgtccctgaatagtgatagtactacagtatattgctcctttgtgtatactgcaccacacagtttcaaagtgcattcctgttatttattccttgcacctttccaagaaaggaaggggggtgatgttgtaaggagagcctaccgtatagtcagtcaatctcctaccagtaacatgttcttaaagcctgattcctaatcactggataatggagattttaagttgagtcttataaatctagatgcatctgttagtgttaatactttcaaaatctgtaactaacctgttctaatggttttaacagtttcattcagatgtaatttgcataccgtacagttcgctcattaaaaatgtacaattcagtctttttcagtaagtttacagggttgtgtaaccctcatcacattctaatttttgaacaattttgacacccccccacccaaaaaatactccatacacattatcagtcccccgccattctccttccactaatgttcttcttagcaaccaccaatctactttctgtctctgtcgatctgctctcttagacatttcataaagatgaatcatactgcatgcggcctttgtgtctggcttctttcatggaatgtaatgttttcaaggttcacccatgttgtagcatgtatcagaacttcattcctttcatggctgaataatactccattgtgtagatggcacatctgattatccattaatccattttcattagtccattttcacactgctgataaagacatgcccaagactgggtaatttataaagaaaaagaggtgtaatagactcacagttccatgtggctggggaggcctcacaatcatggtggaaggcaaaaggcatgtctcatgtggcggtgacaaaagagaataagaaccaagcgagaggggtttccccttataaaactatcagatcttattcactaccacaagaacagtatgggggaaaccacccgcatgattcagttatctcccaccaagtccctcccaacacatgggaattatggcagctgcaattcaagatgagatttgggtggggacacagccaaaccatatcaccattggtggacatttgtgttgttttcactttgtagttgtcataaattatgctgctgtgaacatttatgtacagatttttgtgggtacatatgttttcagtccccttggatatatagccaggagcggaattgctgggttctggggtaactatgtttaaccttttacagaactaccagactgagttccaaagtggctgcaccatttttacattctcaccaggaatgtgtgagggttccagtttctccacatcctcatcaacacttatcttcctttttttagactgtagacatcctagtggttgtgaagtggtgtctgcttggggttttgattcacatctctctaacgactgataatgttgagcatcttttcatttgctcgttggccatttatcctcttcggggaggtgtctatttaaattcttggcccattttaaaattgggttgtccttttattattgagttgtaagagttctttatgtattctagatatgagtcccttatcagagatttgatttgcaagtattttttccctttctgtgggttgtcttttcactttcctgatgggatcatttgcagtactctaatgattttttaaaacattttcctccagaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcggtaagatcagtagttgtgcatctgtgctgggcacctgtgcatctccagcttaaaaagtctatcaggtggaggtgatttttttctaactcatcatatagtgcattcattttcgagcttcttacttcagtaggaggatgctatttttcccctgttgaagctgtgagtttatatatgtctgcagctcatgactccagcctgctgctcagagtgccttaggctttgctaatttccagcccctttttgtcaggctggtctctccctacctttccgctgactccaactgaaacatgcaaacgtgttctttacacacctgtttgtgggcggtctggattgaagcctggaaaactgggtcaagagcacttggcacttttgttttccctttctgcaggggcctggcaccaggggaagctcaggagactacctgcaagccagggccagactctctgggcccggctggggtagagaagcccaggcgttggctggcagaggaagggaagggtccagggtcagctgagcatgccctcaggttgctcactgttcttccctagaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggtaccatgtcagggtggcttgggctggagcaggtgctggcacaagccactctgtccctgatgttttctagggaagtgtcttttctaggaactctgccaccccctcatcctatcctccagccggatgtttcttctgagttcagacatttttcttttccatctttctttccccaggaataacaaacgaggacagcaaggctgggacaggaagtacattgtcctggagggatcaaaagtcctcatttatgacaatgaagccagagaaggtaaattaataattcagggggaaggtcattgcacgtggctaacccaggtctccccagtgctggcgcgaaggctttgttttttggactgccttgcaagccttctacgcttttccatttttgaaacttacaaaccaaatgacttctctaaaggttattggtgcgatactcacatctataggtctcccccctgaagaacccgcagggcgctgccctgaagattccacctgctaatacaccttccgagaacttctgcctcagtcaactaacccataaatccgcatcgtcatcagaaatttgactgtgctactcatctgacacactttatttttttttatcttccctctctgccttctctgcacacctctgtcccttccttgttctcgtgcgcctctctttacacacgtaccctgtctctctctcccttgctgtctctctcgctctctcttctccccttgttcttgttcctgttcttttgtttttctttctgcccttcctctttgcaccaagctggacagaggccggtggaagaatttgagctgtgccttcccgacggggatgtatctattcatggtgccgttggtgcttccgaactcgcaaatacagccaaagcaggtgaggaggagccggaggagccccgccctggaggtgggccgggcttggccaatcagcagggacagaaggggtggtacagggaagattggctctgcaaaggaggcccatcttcctccgctccccgccttggcggtaactgggatttgcgtggtttggtgggcatctttgatctctcaggcccgtccctcccagtgggaacgggggaaatccacacccaatcctgtgctctctgaaatctcctagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctgtgagtatgaaagcgggccctggaggttgtctttgtaaagggggctgacttggtaactggtgttaacgacgagaatcccattggccattttgattcccctcaggctctctctctgagggctgatggctctagactgtgtcatggccaggagtctggtggtgatgaaggcacaagcaccaaggtagcttgtgtggcatcatgatccatttagaatgtgggaatcagggatgcggtggctcatgcctgtggtcccagtgacccaggaggccaaggcaggaggatcacttgagcccaggagtttgaaaccagactgggcaagatagcaagatcccatctcttaaaaaaagagaaagaaagaaagttagccaggtgtggtgacatgcacctgtagttccagctagtagggaggctgaggccggcggattgcccaggagtttgaggctgcagtgagctacgattgtgccactgtactccagcctgggcaacagagcgaggcatggactgtaaaagcaaaggaaaaagaatgggggaatcggcatcagtagcctactctggtggcattgtagaccttggttgtggtgatgcagcagcaaatgtacttataaggaaatcctctctcctgtttactcaaatgagtttgtctggtttgaaggcttgagttagaagcactttggccacgaagcagcacaataggctgccggcagctgtgtcccctccaggaaggcttttcataagcatctcagttgtttttgcagtatttgctcttccgtaggcaggtttggagtcctacttatccttaagctgttagaaacgtaggtgtgctgtgattggcatcaccccacctaaaatgttccaggatacaaacagtgctcattgctcattgacgtttgctccagcgaagaccaaacagctcttttcagactcttcactcctaataaacactttatgtgttagcaattggcagattcttaaccacaagcctcctgaaaagggctttactcagtggttagacctgtttggatgacttgttggtcgtttcacacgtgagcttttactgaaatccttgttaatatgtgtacaataggcccgcgactgtgtttcttacgagcttctgcctgcctgggttcaggtaaagagatgcagaggcgtgctggctcgctgctaacacggcgcctttgcacttctgctgcagccttatgggggaaggagtctttcatgtgtcttattaaccctgcgcaggtgaaatctccttagcttcagcttatttcttattacagaatagctttccatgtctactaccctcccttatttctgcatcccagccaaattataactcagatgctaattaacagctgccccagagataccaatagcactcgcattttgcatttggagctcagatcaaaatacgggctgagctaagagcatatgtgcgtttctgagcatttccaggaataacttggccttaaccttctcttggtttctctggatggtttggtcataaacagatcagcctcacgatgtcttctgtttttcttttctttcacctatgaaaagaaactgcttggaaactccctgctgaaactggaaggtgatgaccgtctagacatgaactgcacgctgcccttcagtgaccaggtaatgcttgcatgggcacggccagctggtgtctggttacagccacaccccatcaagaaagaaagggctgtggaggccttgttgctcttactagagattgttctggtgacgtgaccgtgcttatgttctgccttcggacttctgcccttgcaggtggtgttggtgggcaccgaggaagggctctacgccctgaatgtcttgaaaaactccctaacccatgtcccaggaattggagcagtcttccaaatttatattatcaaggacctggagaagctactcatgatagcaggtgtgaggccaaggacatggtgttttttctttactttcaagggagccaatatgttgaagccacgtttcatgctcgtaaaacacaaaatagtagagaggagccgttgtagctcttatctctgtgtccccatagatgcccaagcctcagctaatggaccccctctgtccagattcagttcccttccagtatccagtttagcacagtctgacattcccaaagaacatcccactgttaggccaagtgaagagtgctaagcctcgaagactatctaaagccaaaccctttgtcctgattgcaacgaaaccaccgtgggccctgaccttctgagagcttgcttgctctgttaactctgtgatctctctcaagtcaccatttgctaatattttgtcataatttttttctctgtcttcttaacacacacacacacacacacacacacacacacacacacacacacacacactctctctctctctctctctctctctttcctgaaccatttgagagttagttgcaggtatgacgccaagttcttcagtatatcaacctaaggattgaagacattctgtcacataaccagggtacagtttatttctctctgtctgtgttagtgacattatttttaaaggggaaaagagtaatatatcgattcagtgttcaaaacaacaacagttaggtcttgtttcaggcatggctggatccggggactgacatactatggacaagaactggcctttcttaatctcagctctttttcctccgtctcttcctctcttccttattttattctttagagcagttttagattcacagcaaaattgaaaggtacagagagttcccatatacccccgttctcatatatgcatagcctcccccactaccaacatcccccaccagagtgatacgttcgttagagtcagtgaacctacattgacacattgacagtgacacatcattgtcaccccaagtctacagtttacattatagagttctttcttggtggtatacattctatgggttttgaaaaacatataatgacatgtatccacacatagagtatcatatagaatagtttcacatactataatttctgcatttaggaaatttacccttactataatacaagtatccgctatgctgcccataattggattttacctgtggcttctataatgtcccagaatttgcattgcatttaatcatgtctctctagtctcctttaatctgaacggttcctcagccttttgtctctcctgacatccacatatttggatagtccaagtctgttttttcatagaatgcctcctcattcctccctcacacattcgttctttactttgctggggagcatgtttgaaagtacagttcacattctccaattttatgtctgcagaattccaccctcctcagaatcttgactaaaaggccaaatgttattgtcttagatttaaatcatggacttgggccgggcgtggtggctcacgcctgtaatctcagcactttgggaggctgaggcgggcagatcacaaggtcaggagtttgagaccagcctgaccaacatggcgaaaccccatctctactaaaaatacaaaaaaaaattagccaggcgtggtagcatgcacctgtaatcccagctactcaggaggctgaggcaggagaattgcttgaacccaggaggcagaggttttagtgagccgagattgtaccattgcactccagtgtgggcaacagagcaagactctgtctcaaaaatttaaaaaaaaaaaataaataaatcatggacctaaaatgtgtttatatggatttgtggaaaactcagatcatctgtgtggcctcttgtgacttttacttgtgactagaactagaaccaccatcccgtacctttacttaacggcttcacactgacgagaggttgttccttttcctgttcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaaggtaagctcccctcagagtcctagctggtggaatgttctggaaattgacactacctctcttcccacagagctcgttgatttgaccttcaagatagtgtcaacttaaataacaaacagagaggggctctcttgaaagaaaagagattgatttgggaacagggctttgcaatgggaatacacgtgccattgtaaactatgtgggtatctagggagataaaggaagacagaggtttgtaagtgaggattccatagtctttttgaaataattatccttggcttcaaagattaataacaagactgacgcttgtctaaggttggacagatagtcactgggcggatgtccttgcagaagtattttttgtgtaagattgcaatggcctggccgggcgcggtggctcatgcctgtaatcccagcactttgggaggccgaggcaggtggatcacgaggtcaagagatcaagaccatcctggccaacatggtgaaaccctgtctctactaaaaatacaaaaattagctgggcacggtggcgggcgcctgtaatcccagctactcgggaggctgagggaggaaaatgacttgaacccaggaggcggaggttgcagtgagccgagattgcgccaccgcactccagcctggtgacagggaaaaaaaaaacagattgcaatggcctttgtggttttcgtcgagtctcttttttatcaggcacacaagtgtgagaatcctctcttcatggcctcctcctgctctaatgtcagcgttttgttaacattggcagctccattttgattctgacaactttcacaattgtacatcctcaaactaggttaaatttctgttgcctcctttaggcacgtgaaataatttgtgtagccatgaaatttgtacaggttttgaatctaaaataaatgtctgagagcaaaatgggaataaaattaacaaaactagaaggatgatccataatttaaaaataagtgtgtttgcatgtgcgtgtgtatgtctgctgtgtctgtgagagagagatgaaccttaaaaaaaatctaatgtggatctccatgtctgaactagatgaaagtatgtttcattactagaaatttaaaaattcgaatttatgacatttacataacaaagttcatgagaactcaagttaattcatttgtagcttctggcatattgaaaagtggcacataaaatacctttgtttgcttctttagtcaaaaagtcaaaaaataacagatgctggtgaggtcgtggagaaaaaggaacacttatacactgttggtgggagtataaattagttcaaccattgtggaagacagtgtggggatcctcaaagacctaaaaatggaaataccattcaacccagcaatcccattactgggtatatacccaaaggaatataaatcattctattataaagtcacatgcatgtgtatgttcattgcagcctactcataatagcaaagacatggaatccacctaaatgcccatcaatggtagactggataaagaaaatgtggtacatatacaccatggaatattatgcagctctaaaaaagaatgagatcatgtcctttgcaggaacatggatggagctgtaggccattatcctaagcaaactaatgcaggaacagaaaaacaaataccacatgttttcacttataagtgggagctgaatgatgagaacacatggacacatagaggggaacacacacactggggcccgtcagagggtggagggtgggaggagggaggggatcgggaaaaataactaatggatactaggcttaatacgcaggtgatgaaataacctgtacaacaaacccccatgacatgagtttattgatacaacaaacctgcacatgtgcctgtgaacttaaaagttaaagtagaaaataataaaaaagagtgtttgcgggtatatatacatgtacatgtataactttaattaagtctgaatcaggtgtttatagaccccctgaggctactggcgttctgctgttgaaaaccatcgcattttgaccctcagaagagagcacactgcacatttgttcattcagccgctcaatcaacattttttttttttttttttgacacagagtcttgctctgtcacccaggctggagcacagcggcacgatcttggctcactgtagcctctgcctcccggctttaagcgattctccctcttcagcctcccaagtagctgggactacaggcacgcaccatcacagcaggccaatttttgtatttttagtagagacagggtttgaccatgttggccaggctagtctcgaactcctggcctcaagtgatccacccaccttggcctcccaaagtgctgggattacaggcatgagccactgcacctggccaaaattttttttttttttttttttttttttttttttgagacagagtctcactctgtcacccaggctggaatgcagtggtgtgatcttggctcactgcagcctctgcctcccaggttcaagtgattcttctgcctcagcctcctgagtaactgggattacaggcatgcccaccatgcccagctaataaaaattagttttttaaattagaaattattttcattctaatatctgaactgttcaaaaaatgtatggaacatatatgtaaatcataaagcctaataatgtcgtaagcatccacacactcactacccagtccaagaaatagaacattgctaacaatttcccttttcttgtgtgttcctcccttatcccggcccatcttcattctcccactgtaccagctgctgaccttcgtgccaggactaatttgagcagtaagcctcatttggtgaatgataaacatctggttgtagcaggagacgttaaaagggtttcagctgttctagaaaaagagcgttttgatgtagaactctgcacgtgtatgagttcttagctaagaacttttccttttggattgaaattttctctaaatgtgggccgggtgtggtggttcacacttgtaatcccagcactttgggaggccgaggcaggcggatcacttgaggccaggagttcgagaccagcctggccaacatggcaaaaccccatctgtacttaaaatacaaaaattggccaggcatggtggtgcgcacctgtggtcccagctacttgggaggctgaggtgggagaatggcttgaagccgggaggtggaggctgcagtgagccgagatcatgccactgcactccagcctgggcgacagagtgagactccgtctcagaagaaaagaaattttctctaaattcgtttagcagtctctaccacctttcctctcccttccctcattctgtcttctccctcctcacaagggaagtttgtcaaaagattctgtctccagcagaaggcacatgtgtgggaaaggtgtgtggtgtcaggtgcctccctgaggccttctctggatcccaggtaaagccttggttctcgaccaggggtaattctgccttaccaggggacatttggtaatggctggagacatttttgattgtcacacattgaagtgctgcaggcatctagtgggtcaaggccagggatactgctcatatcctgcgatgcccaggacagccctccccccaccacacagaatgatctggtctgaatcatcaatggcgctgagcctgagagcttttcctagttttgccccacagccggtatcacactggtgacagtctttttcttttcttggttgcttttcagattgagaacgggctctgcatctgtgcagccatgcccagcaaagtcgtcattctccgctacaacgaaaacctcagcaaatactgcatccggaaagtaagtcctgggccttgccttggttgaacgtgggaaagccagtcctgctctctcagcgagccagtgtggaaagtgcactgtcctgggacacagcctgtactgggttccttctaccctgcgggcctttagcctggggtgacctctgtcgtcagcgagatccttcctttgtggaggattccccagggccactagtagctgcggtttccctcctgcttttcttctcacatttgcgaactgcctccccatccagcccagtgagttcagccttttgttagaacagaaagttgactgataggaaaaaccagtggaaaaaaaaaagggggggctctttctaagatcctagcagtcccaggtagcacttatcagaatctttctcaaattctagaggtgtctattaatataaccttctgcaataaccagtgctagcagtattttgatatgtaattagggagctccttcttttcggagcagagtgagctgtgatgatgactgcaatatggacgagatgtgtgttagatccttaaatctgcctggcttctggagaatgctgtctgatgtccctacctcggagtgtcccactcctcctaagcctgatatatttctggtgctttcatgattagtctcaaaaatgaaatgaggctgggcatgttggctcaggcctataatcccagcactttgggaggccgaggagggtggatcacttgaggtcaggagtttgagaccagcctggccaacatggtgaaaccctgtctctactaaaaatacaaaaattagccgggcatggtggcgggtgcttgttatctcagctacgtgggaggcagaggcaggagaattgcataaacgtgggaggtggaagttgcagtgaaccgagattgcactaccgcattccagcctgggcaacagagcaagactccatctcaaaaaaaaaaaaaaaaaaaaaagtgaaatgaagggtgaataatatataagggtcattacctgttagagaaactgttccattctgggcagggtggtgttagtttagttggtgtgttcattgggtgcccaccctgtaagggactgaactggctgttttacaagcacctttcaccacagttctgaaaagcagagacagttattcccaattttcaggtaagacaactgaggctggcagaaaatcctcagttacaaagttgaggccagaactgaagtttgattttttttcctagcatttcactatatcgtgcttcctcaaagttttcccatacttagtaggtgaccaagaaatattcagtgatgatgataatgctcactagaatttgaactgttagcttcaggaaaattctcagaaatcattgcttctttatgattcccggccacacattttgaataggtgtgcctggttttttgatgacattaggattggcctaaaaacaactaaaaataatcaggaagcaggtaattaagatgacaataatgatgatcatgatgatgactgcataggtaatataggttcaaactagaaacttagaagctagcaaaaagaaggaaaccaaaaccattgctgctgaccaccactgttaatagttgttgtatttttcctgtatttttttttcctgtgataagaatgttgtattgttcaagatctgtctcttcattggaatgctgtttctttcttttctttctttttttttttgagacagagttttgctcttgtcgcccaggctgtagtgcaatggcactatctcagcccactgcaacctctgcctcccgggtttgagcgattctcctgcctcagcctcctgagtaactgggatcacaggtgcacaccaccacacctggctaattttttgtatttttagtagagacggggtttcaccatgttggctacactggtctcgaactcctgacctcaggtgatccacctgcctcagcctcccaaagtgctgggattacagatgtaagctactgcgcccagcctggaatggtgtttctgaccccacctttttttggctgcagtttgaccttgttttcttagttttgggttgcatggaacaataggaagagaaaacaaatggatcactgttcatcctgagaggcatgaaaggtgaatggggcgtgtgcagtggctcaagcttgtaattctaatgctttgggaggctgaggtgggaggattgcttgagcccagcagtttgaggctgcagtgagctatgatcacaccactgcactctaacctaggtgacagagcgagatcttgtctccaaaaaaaaaaaaagatgaatggctctctatgacaacgtgaacaagcttggtgacaatgttctccagggcttggctagatgctgtaggcagaagcagaacagctgtggaccttggctgccctgtgttacctctcacatccttctcttctgctctcatgtctcaggagatagagacctcagagccctgcagctgtatccacttcaccaattacagtatcctcattggaaccaataaattctacgaaatcgacatgaagcagtacacgctcgagggtaggacccacctccactttcgcacccacccatggctcaggccgcgctgagactcagaactcactcctgaagccccgcttctcgcctgcctttacagaattcctggataagaatgaccattccttggcacctgctgtgtttgccgcctcttccaacagcttccctgtctcaatcgtgcaggtgaacagcgcagggcagcgagaggagtacttgctgtgtttccacggtgagtcgtggctgcgcccactgcccttttgggtcctcatggacactagggacccatgaggggttggaggagggtacatggagctctggggcaggataggtttgactaggggtacagagaatgtccttccagcaccaccaagtccccttggggatgctcctctccatcaccagatactagcgtggtctaactttatcacattctctccaaagagcaggcagttttttcctcatccatcccttgcctttctttctctccctttcctttctcttactctgtcctcatttcgtcctcccctcccttcccctccctttccatccttctatctgtccttttctttgttgcattctttcttttctttctttcttgggtcctcccctccccctccccatcccctccctcccctccccctccccatcccctccctcccctcccccttcccttctttcctgagtctttccgtctttccctgtctgtcctccttcctccggatcgcttcattcccctctctctctgtctctttctctttccctctcctcctcttattcctttccttcttttcacttgagttctctttctttaataaaatttaataaattaaaataaattaaatttaaaaagtccctcatttttaataaagctgagagctggctcagcagagggcctctggttttcacagtcagtcccatctggccaggggtccctgggctctgctcctcattcttccatcaccatgtgtgtcgctgatgcccctgctcttggctgtgctaatgcccacgtgctcttgacaccttgcagaatttggagtgttcgtggattcttacggaagacgtagccgcacagacgatctcaagtggagtcgcttacctttggcctttggtacgtgaggctcagtgtgggggcttctcttttgccagcagctggtgtcctggaaaagaattgcatccgggtgcggtggctcacgcctgtaatcccaacactttgggaggccgaggcgggtggatcatgaggtcaggagtttgagcccagcctgaccaacatggcgaaaccccatttctactaaaaatacaaaaattagccaggcatggtggcatgtgcctgtagtcccagctactcaggaagctgaggcaggagaattgcttgaacccaggaggcggaggttgcagtgagctgagatcacaccactgcactccagcctgggtgacaaagcgagactctgtctcaaaaaaacaacaaaaaaaaccgcaattgcaagtggaaatttttttcttttttggcctaagcactgtgcatgtgaattccattagataccaagtgccatgtgtaacagtcacccggagaactgttcatggaaagattctgaggctcgatgaagagctgcctacgccagattcaccagcccacagtcccagccctgggaaatatttgctaggctctcatgatagaaaggagcccaattcctgtagatttatttcagtcatttccaaaggctgcagagtgtcccatggcatagctgaacacctgttcacttaaccagttctaattaggcaaagcagtaaggccatgcccgttttgtttgtaagtgtaaacaacactacgatgaacatccttgtactaatctttttgcacttgttagatagcaccccctgattataagctcctaaaagtggaactgttggatcaaagactaaacacacatacacatacaagtatgtacatacgtatctgtgtgaatgttctgaaatgccgtcgtggcccagatacccttcgaggctattttgtttctctcttgctgcataacaagccatctgaaagcttagtgacttcaaacaacagcttattattggccccaactccgtggcttgactggacagttctgcttcatgtggtatcagcagggccactgggacaactagaaagcccaagacaggctcacaaacatggcacgcaatgagtgctggccataatgtgggcgcttagctgcggctggtggctggaggccttgttgctttccacgctggcttcttccaagaatatagaagcggaagctggcaagcgtgctcacttccaccacgctctactggttagagcagaccgcagagtcagcccagattcaaggccagggaactgcaccggggcacgcataccagagcccatgactttaaaagtctaataccaagtcttgccacaaggaataatagtgctttttccctttaaggcagaaaatatttccagtcctgtgtgctctagtttcagtgacactgtcatgcagagatagagtattaagaagaccagcaatgtctaaatagctgtgaacccagtcttttttttaaaatagaacccagtcttttttttttttttttttttgagtcggattttcactcttgttgcccaggctgtagggcaatggcacaatctcagctcactgcaacctctacctcccgggttcaagtgattctcctgcctcagcctcccaagtagctgggattacaggcgcctgtcaccatacccggctaattttttctatgtttagtagagacagggtttcaccatgttggccaggctggtcttgaactcctgatctcaggtgatccacccgcctcggcctcccaaagtgctgggattacaggcatgagccaccgcgcccagcccgaacctagtctttttaaaaattgaattctttgaagatgtttacaatcagttttaaaaggtatacaatgaaaagtctcacccagagagtccatctcccaaattctccatcgctattcctccaaagaaaaaaaagctcatatgagtttcttgtccttccagtactttatgcaaatactagcacataaaatatatatattcttttttccagctttttaaaaatcagtaaggcagaatacttcccacatgattctgaaccttgctttttgcactgagcagtgtaccttgggcattctttcatatctgtacaaagagagccttttcatgcatgtttacagctgcacagaattccatagatgtattataattttttttttttttttttgagacagagtctccctctgttgcccaggtcggagtgcagtggtgccatctcagctcactgcaacctctgcctcttgggttcaagtgattctcccgcctcagcctcctgagtagctgggattacaggtgtacaccaccatgcctggctaatttttgtatttttagtagagatggggtttcaccatgtaggccaggctggtctcgaactcctgacttcaggtgatccacctgccttggcctcccaaagtgctgggattacaggcgtgagccaccacgcccagccagatgtattataatgtatttagccaatccctacactgtacacttgagttgttttccatcttctgctgtaacaaaccacacggcagtgaatatcctcgaacatgcatgactgttctggcgcatagatatgtatttgttgggtgagttgctttacacaggattgctgggtcaaagaatgcattgcagtcagattttgattttccctcttttcaccattctttggcccacactgtgcctgcatggtgatcacacagcctacagagaaccctatctgtttgtgacccacttcaactcactcgaagtaattgagatccaggcacgctcctcagcagggtaagcattgtcctcccatgcgtggaaaacttcagctattggggtaggtgttggggccggccgcatgttccttcctaacttgcctagcaatggaggtagcctgcaatgaaggtaactggaactctgggactctgcaggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcaggtaaccagcttctcctcttcctcagtaccaggggcaacgtgcttttctgcaaggcagaaggaagtgatactaaaccagtagaatgtttcccaatcttcactttgttcttaagctcaaaccattcatttgtttgcgatctgcggcactgaaataacacagaccattatgagcatcaggagaattagaaaataccaccttgcaaaagtcagaggggagaggtctgatctttctctcctgggtattttcattggcttggtgagaaatggagcacaaattaggcatttattgctttagcaggtattctgcggtgctagttgttgggcttgtgggggagggagaatggtgaataaagcagatgtagcccctccctgatggcactcacagcccagtgggagagatgctggcaatcagagattaaggcatggaaggatgaggccctggtggggtggttgaaagcctggacgtggaggtgagggaggatttcccatcagatacgaggtgggggcagggagaccagtgaggggtgctcaggcaggagggaaggcaagccatgcctggaggtccagagatgtgaggtcgtgagagcaggtcagggactcctggccagcctcgtgccttccctggaatgcgagacctcctgaacaggattggactcaaacagccattgataaagaagcagttaaataaattaaagtacagccctgggaaggaatgttgtgcaggcatctggggaaaagaatgaagaactcacactgacatggagcaatcgccaagacacatcaaggtacaggagagtatgcagatatgctgccacttgtattaaaaaggaggggaggtggtgcggtggctcacacctgtaatcccagcactttgggaggtgagggctggcagatcacttgagcccaggagttcaagaccagcctgggcaatgtggtaaaaccctatctctacaaaaaatacaaaaattagccaggtgtggtggtgtgtgcctgtaatcccggctactctggaggctgaggtggcggggactgcttgagcccttgaggcggaggttgccgtgagctgagatcacaccactgtactccagcctgggcacagagtgagaccctatctcaaaatcaaaaaaggatgggaagggcacttccagaatttcagagtaaggacctctgataacctgtttctccataaaggcaacgggaccactggcaattatcaaaatcaacttttcagagctctggaaattaaccctagccctctgagtggtctctgtcaaggcagagtcaaaccaaaagagtcaggagcacatgggtatttggcacctctgcttttccagcaagttcctgggatcaaaaccacattgaacaagcatgttccaaaaaaaggcctcttcttaaaaggcattctttttaaattttacttctttttgaattgataatctaaccacagggcacagaattcaaaggataagaaaggtgtacagtacagagcctctcttctgggtctctcttgcctcctaactctcctcactccctctccccaggtccccacctgggaaggaaccaattttttgaagtttttgtgtttccgtttagggatcctttatgccaatacagccagccctctctgtctataggttatgcctctgtagattcaataaaccatggattgaaaatatttgaaaaaataattgtgtttgtactgcacatgttcaagcttttacaaattgtcattattccctaaacaatatagtataacagctatttacagagcatttacattgtattaggtgttataagtaatctagagatgatttaaagtgtacaacaggatgtgtgtaggttatatgcaaatacactccccctactttttttttgggacagggtctctgtcatctaagctggaatgcagtggtaccagctcactgcagcctcgacctctgggctcaggtgatcctcctacctcagcctgatgagcagctgggattacaggtgtgtgccaccacacccagctaatttttgtattttttgtagagatggagttttaccatgttgcccaggctggtctcaaactcctgggctcaagtgatctgcccgccttggcctcccaaagtgctaggtttataggcttgaagcactgtgtctggtcctacaccatttaatataagagatgtgaacatccatagattttggtacccacaggaagtcctggaagcagtcccccaggccaccaagggacaactgtacaaccaaatgtacagtcagatccactgccctgagaatgggtcttttccacggagcgtcgctaggcaggtcagatagcaacagttttctggggatggggctttttggggagcttcaatcctgatctgctccctctagtggctactagactgctggttttcacagctactgtggttccaaggacattggtttcaactcttccacagatctggggagaggggagtgggtatggggcaagttgaatgtcacaaaacattcggttcttgctgagattcctttgtttttcttgcataaacactctttgaattgttgcaggccttttttgcaacatgcttgttcagtgtggttttgatcccaggaacttgctggaaaagcagaggtgccaaatacccacgtgctcctgactcttttggtttgaccctgcctcgagagtggccgcgcaaagggctagggttaatttctagagctctgaaaagttgattttgacaactgccagtgatcttgttgcttttatggagaaacaggttgtgagaggtccttagtctggcattctggaagtgcccttcccctccttgtttatttattttttatttttatttatttattttttttcgaggtagggtctcactctgtgcccaggctggagcacagtggcgtgatctcggctcactgcaacctccgcctcctgggctcaagagagcccccgacttcagcctccccccgagtagctgggactacaggcgcccgccaccacacctggctaatttttgtattttttgtagagacagggttttaccacattgcccaggctggtcttgaactcctgggctcaagcaatttgcctgccctggccccccaaagtgctgggattacaggtgtgagccactacacgcaaccacccctcctttttaatacaagtggcagcatattctgcatactctcctgtaccttgatgtgtcttggcgattgctccgtgtcagtgtgagaagtagttattcattcatttctccccagatgcctgcacaaccttccttatcagggctgtaccttaattggtttaactgcttcttcattaatggctgttcgagttgtctccaatctgttgctgcaataaatgactttctccttacgtcattttacatgctgaggaatctatctgtaggataaattcctagaaaagtgtgggtgaatgggtgatggctgatgtggatttgtaaatctgatggacagtgtggagttttctgccctgaaggcttctcccatttgccatcccaccagctgcgtgtggaagtgggactggcctcgtcttgacacagtgctaggagctagatccagctcgaggtgtaggaagtttgaaaccttggcctgcaaagaaggtctgagattatttaaccccgggaataaatgacctaagataatcttctggattattataaggtgtgtctaccttctaaatagttatgtggactccataccatgtgcccgacataatgtctatggctggggatacagagatgtagaaagcatgttcttatattccaggagcccataatttggtggaagaaccacaactaatattacaaaataccaagatcttgggcaagactgtcctaatgaataatctctcttttgttgatgtataggagttaattaatctgaaatgtttggttagtgtggttttaacctgaggaacttgctgaaaaaccagaagtgccaataattaaatgctcctaactcttggcttggccctgcttcaagagtgactgctcagtgcaccacagtcctcccctgaaaatgtctagatcttttttaagtagttcccaagtcatgccagaaacacattgaaatattgtaattagatttttttcctccgttgcctcactggataggtggccaggcaccttgcttttgagattatatagtctctcaaaggagttgcttactgtgcgatcaaaacagttccagttcctgagaacgaggggcagaaaagtgtttgctttcctgtggcatgtctggaaaatcagtagttggttatctcttggcttatagaatgatcttttggtcgctgacttctttgggcagttgagaatgtagaaggttggctttctgggtctgattcactgcaggcttcgttgccctggtctgtttagcagagcaggaaacgtaactccttgccaaaaaaccataaaattgatgtggtagattatgggtcattaatggataaggagatggaagactgcccacttggcttggaatgacgggtgtgttccttcctcccgttaatctcagctgacgtcctgaatggccttcccttgagcaatccttcttcccctggccagtgagcaccctctcatttgttttatgatagtttcttgtggacacatcttatcatttcttttccattacaagtaggcttaatgtagttctcctactcggaatttatttttttgtttgtcttccagatttcaaagccatatggctagagatgaatataaaccttgatttcaagatgttgaaatctgagttatcttaaatcttactgctgcagagacaggggttctggccttctgagcattcgttgtctgaatctccaaacgttacagttgcatgggaaagcaagagcatggcatgaaactattcactatgaactgagcccttatgaaattatctctgcacaccaacttctctgttatattgtagaggaggaattggcaaactttttctgcacaggtttagatggtaaatattttcggctttgtgagccatatggtctctgtctcagctgctcaaccctgttgtggtcatgcggaagcagctgtaagacaatgcataaccagatgggcatggcttcattccaataaaactgtatttataaaaacaagcatcttccggatttggccctcaagcctgttctagagtctctccttccacaataaacactgtctttgctgtcgcttctcaattatggacgttgacagaagaggttctgatacagttagaccaataattgaagaaagaaatgaacaagttgataaaattatagcctcttccaatgagaaggatttaaatatcaaggattaagatagtcctttgggaaaacacttttcttgttttaatttttagttttagttttttagaagcggggtcttgccatattgcccgggctggtcttgaactcctgggctcaagcaattctccttccttagccttcctaatagctaggactacaggcatgcatcactgtgcccggctttttcaaatatttttgaagagccttctttaggatccactgcaaaagtccaatgtgtccaacgttggtgtcagagcatgttagcagcaattttgttgagacaattagcacaaaacaaatcattctgtgattcatgcttggttcatttttggaatcagcatgtaattgcattgtaatttaaatactaaaaatatctagcataaaataagtttatattccaagataaagcctcaatcaaacaaaatatgttttcaagtaatattcactgtaatttttttcctccattttaagtagggccttttccaagcacaaattatgctgagataatagggaccctagtacttttagagctgatcaagggtgggaaagaattgactcagaaggccacatttcagttctctctgtgtttgtaggtcttactacatcttcagagagggagtttggcccctgggtctgctgaaatcttcatttgaaatatccaggccaggagtgggtggaggattgggttgggttgtacaaaaaggccgcagtgttttcaactgcttggttactaattatcaacctttgaggcctgggacgttttctgagcccgctttactttgtctgccctgctcagtttcctgactctatcaggcctgatccctacacctctcggtcgtcttattgtcatgactgagaaccatccaccttctgagcatctgcatttgcatcaggtgtcagagactcttggaaagccacatgggggcagaggtgaccaaacacgaggcccaggagtgggacagacatggcagttaacagtgatcagtacagggtttctccaaactgcttccttgcactgagggcctttgtgggtccctgacttctgggtcttagtaggctgacctcctagttgatgacttccttctgtgccttctaggctctgggaaatagtaggtcagtaggatattatatggggcttatgacatcaaactggtcttttttttttttttttttttttgagacggagtcttgctctgtcacttaggctggagtgcagtggtccgatcttggctcactgcaacctccgcctccccagttcaagcaattctcctgcctcagcctcctgagtagctgggactacaggcacacgccaacacgcccggctaatttttgtatttttagtagagacggggtttcaccatgttggccaggctggcctcgatctcctgacctcgtgatctacctgcctcggcctcccaaagtgctgggattacaggtgtgcgccactgcgcctggcctatcaaactggtctttattggaatcccagctctaccactcattagctcaggcaagtcacctaactcctgtctgtccccattttcttgcctgtacagtgagggtcatgcttgttcatagctcaggagctgctgtgatgatttaatgagataatgagagatggcagatgaagaacttagcacaggcctggcacacagtaggtgctcagtaaatgaaagcctgcactgaggaaggtgggttgtcttttgttgccatctttgctctcttccctgtctttgctaccaaaatcaaatgcaggcaaagtccaaagaactccaggtctaatctcttgataatcagtggtgaggctgggtcaaggagggggttgctcaggtaagaaggaaaatgcccctctggggttgtggcctcgcagctccctacgttcctcttgtgtcgccagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtgaggcagcattccgaggcctgtgtgtctgttgcggaggccaggagtgacttggggaactgaggcccccacggggccactgttgtttaaaaaaggaactccatgactgtaattcagactttgcgagacacaggaatttaggaagaaaatgtaccttaagaaatagcttcctggccgggcgtggtggctcacgcctgcaatcccagcactttgggaggccgaggcgggtggatcacgaggtcaggaaatcgagaccatcctggctaatgtggtgaaaccccgtctctacgaaaaaaatacaaaaaattagccgggtgtggtggctggtgcctgtagtcccagctacttgggaggctgaggcgggagaatggcgtgaacccggagggcggagcttgcagtgagccgagatcgcgccactgcactccagcctgggtgacagagcgagactctgtcttaaaaaaaaaaaaaaaaaaaaaaaaaaaaagagcttcctaagcaaatggataacgtgtgtgtaattgaaaaggaaaatatgtatgcatgtaactcaaaatataatagctaccaaaaaatgttttcccttctccagaggcaagtggtagcagtttctagagatattctgtgcgtaccagcaaatatatatgtgtgctctccttttgaaacccaaatgatagcatcctatatgaaatgttgcatgcttttttcaaacatagatatagattcacacacatacacacatatgcttttctttttttttttttcttttgagagacagcgtcttgctctgttaccccaggctggagtgcagtggcgtgattatagctcacggcagcctcaaactcctgggctcaagtgatcctctcacttcagcctcctgagtagctgggaatatgggctgtagctaccatgtctggctaactttttcccccactttttgtttgtttgtttgtttgtttgttttgttttgttttagagacagggtcttactatgttgcccaggctggagtgcagtggtgtgatcatagctcaccacggccttgaacttctgggctcaagtgatcctccagcctcagcctcctgaatagctgcgactacaggctcaagccaccatctgtctgattcccacccccacccccggccctttttattttttttagagacataatgtcgctatgttgcccaggctggtcttgaactcctgggctcaagcaatcctcccaccttggcctcccaaaatgctgggattacaggcgtgagtcaccacgctcagcccacacatgtgtatatataaattgtttttctggaaggctacacagaaagtgttcacagtggttgccttccagaagaactttgaacttttggaaatgtttaaatcatgtgcatgaatgatctgtgtaattttaggtttgcgatcgaggagagggatgggtgtggaagaccaggggctcccccaggcagggcatggctcaagtgcttggtgcctccttagcaggctaagcaggtcaaggagccacctttctgccatttggggctgattttctgggtggcattctccttctgatgccacctgcagttcacctgctggtaaagaaagaaggaaacaccatccatatggcttcttatccctcccaattgaccgatgaaactgtgtatgtgcatgtgtgtgtatcacatgcttacagcatcgcaggtacacacacggctttgggattttccagtgagtttcactccctggcttccccaggctctggagcgggtgctgccctgccaagcactcactgctagctgctgaaggggatagcccaggggctgcagattcccatttgcatcatgcaaggtgagcacagcaacttctggcctcggatggctaacactcctccttatttcactcctaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaat

SEQ ID NO: 506 - DNA, 3616 bp, Homo sapiens
ctagtgcgttacttacctcgactcttagcttgtcggggacggtaaccgggacccggtgtctgctcctgtcgccttcgcctcctaatccctagccactatggtgagtaagccgtgcggctcccggctgctttcagggaagcagggaaaagcgagccggcggggcgctggggccctgtatacagccgggaagggctggcctcagagccgtccgtttggagggcggaaaacgaggcgagaggccagggcgggagtggtgagacctcggtgtgtgtaaatagcgggggcccggaaaggtcgaggggcgccaggatttcttctcggactctggaagggatggggggctcgggctgccctccgccgtatccggagctctcttttgtcgcgtaactgtgtcctgggtgcggtccctcgagtccccgcagtcctttccagcgcatgcccttactccgccttgggtggacgcgcgcgcggactcttccagccctcacttcctcttgagcgcgaaaagcgggggtgggaagcagctggagacaaaagcgcgcacgcgcgaccgttaccttcccgccgctcctgggcgggaaaccgccactgcgctttgcgcatgcgctctgggtcgcgacgcgactagggctacagggcgtgtctcctgttaacctgagtgttctttttttgatgaaagcaataagaggactgcggaagagctccctgtcaatgtaccgctctacaccagtgtattacgacagttcgtacacaacagtctgtagaggccacctgtctctccctgctgcgttaggaattcaggggagcaggtggtggcagtaagggattttgagggaacggaaatcggatcttgacccagatctgggccgccgataatctcctactgcgctcagactgctgtggaggtgttaggctgagcccgatgccggcaggcaagggaggatgggcggcttgggcagcgcctttgcagacgtggccatttcgtgcctctgcagcaccgccggggggcgcaagagcgcgcgcccggaattgctcattcatcctgtgccgcagagccccgccccttgtccctgcggacagacatttcttctgcgctggtctggccacgtgcttcctgtgctaggagctgcccggaaatgtgaccacctagtctaaagtgggcttctggggcctgagcgctggatggatgcccaccttcctgtcttggtcctccaaaggaggaagctgtgactgagctgtcttggtctggaaggaggccttcccggtttaggatgggaaggtaacattcattaaaagcaacgtagactatagtgtagctgttctcaaaagtagtacatcttagaaaaggatctttagaaaagatcgctttagaaaaggaaattcgttttcagattacgtgagtagcctaggtaacacagccagacctcatctccacaaaaaaaatgaaaaaattagccagcttggtggtctgtgcctgtggtcccagctgctccagaggctgaggtggggggatgactggagcctaggctgcagtgagcctagatggcatcactgcactcaagcctgggcgacagaccttatctctaaaaaaataaagattgcatgagtattttgttccacttgacagtcatcaatagattggtttaaattgtgatatcttttttccttcccgcagcgtgagtgcatctccatccacgttggccaggctggtgtccagattggcaatgcctgctgggagctctactgcctggaacacggcatccagcccgatggccagatgccaagtgacaagaccattgggggaggagatgactccttcaacaccttcttcagtgagacgggcgctggcaagcacgtgccccgggctgtgtttgtagacttggaacccacagtcattggtgagttgacctcagtaacctgagatcccaggatgctgggacaggaggtctgtccaggggcttctcttgtcactcactcactccctccgtccttctctccctcctccagatgaagttcgcactggcacctaccgccagctcttccaccctgagcagctcatcacaggcaaggaagatgctgccaataactatgcccgagggcactacaccattggcaaggagatcattgaccttgtgttggaccgaattcgcaagctggtaagcaccacatataaatatgcatttaatgtggtgtgatagttccagtgcaagttgggtggagtgactgacatcattcattctttggcacctaccaaaatgtggaataggctgcttgctatattaattggacttctaaatcagatagtccctaggttatggacagtttgtggatatgtctgttttgccaattccttgtgcttacatcagtgagatatggttcgtaatctaaaaagttgaaatagaaattctaagataatgtgtcctggcattaaaatattacatttttttattcccctacaggctgaccagtgcaccggtcttcagggcttcttggttttccacagctttggtgggggaactggttctgggttcacctccctgctcatggaacgtctctcagttgattatggcaagaagtccaagctggagttctccatttacccagcaccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatcaaaa

SEQ ID NO: 507 - DNA, 64009 bp, Homo sapiens
agttcccgcgaccccaacgtcccagaggcggggccggagtcggcggtggcgctccttggagccggctcccgctcctaccctgcaaacagacctcagctccgcggaagttgcggtaagtggagctttgtgctcctggtttccccttgagaggcggcagcggggccctgggaaggttggtgggtaacattcaaagccctgtagtgggttccgccctccaggagcctggagcagatgacgagaaggggagctagtgggagaaattaagcagtccatgaaatccttgggtatcatctgagctaaggtatgtgaaagaggtttgcagtcgataacgtgccatttaaagttgtttttacggtgggaatttcttgaggactgaaaccttgaatgctcgctcttgcattcctcacaatttctggctcacactctgctacgtagtaagggatcagttaatgtttgaagttcatggactactggaagtaaagtgtaaacagcaaagtgcgagaatgctatgcgtgtgagtacagacagtatagtaccatcgccacggtgtctgggagaaggtttcacagaggaagtgacattcgagttggattgtgagggatggcgggggtttactagggcattccaagttaagggaggcatcctgtgcagatattgaaaccggggcactgcaagtagttcagtttgactggaatgtaggatgagtggatgggggggttaaggttggaataatagagtggggctggattgtgaagatcctttattctgtatgtaaagaagagccatcggctttttaaaaaaaatttatttttatgtttatttttgagacgcagtttcactctttggcccaggctggagtgaagtggagtgatctcggctcactgcaacctccgtcccccgggttcaagcgattctcctgcctcagcctccctagtagctgggattacaggcaaacgccaccacgctcggctgatttttgtatttttagtagagacggggtttcaccatgttggtcgggctggtctggaaatcctgacttcaggtgatccacccgcctcggcctcccaaaatgctgggattacaagcgtgagccaccgcccctgacatgagccattgacttttaaagcaggagaataatttgatcagatttatatggaaacactcttctagcagcattatggggacttttccataagtctggtgagttgatgaagttagcaactaaggtggtgggtatggaaagataatttatatggaagaaggggtgaggatgatttgaacgtttctattgtacacgataatgactttacctgagaatatgttttgctaggtgtagatgttgtgtggttttagttttattacctttagtggcttgtacaacactgacagaatgaaagtaccttatgtatattgttttaaaataagaaatcaacattatccatcttttcacccaaatgaataaaggaataaaacacaaatagcgcattttaagacacttctgtttaatgaagaaaaaattggcactttttatactttgtagagttacagttatccatgtgaatactgttatccatgacaaccaagtactaaggaagggttttaggatttaaagcctgcattctgtggaagctgcattaaaccttttaagtccagatatttctaagaaggactgtttagtcacctttttttttttttgagacggagtctcgctctgttgcccaggctggagggcagtgacgaaatctccactcgctgcaagctccgcctcccgggttcactacaggtgcccgccaccacaccccactaattttttgtatttttagtagagacggggtttcatcgtgttagccaggatggtctcgatctcctgacctcgtgatccacccacctcggcctcccaaagtgctgggattacaggcgtgagctaccgtgtccggcctagtcaattttattagaagcacgtttttctctgtcttgaacaaggtataagagcattttcaataggattttcagcctctgactttatctaaaaagtctcttctaaataatctctgcatctggattaataatccttttctcctttatcttgcttcacacagagtgagacagaggctcattctcttgcccaggctggagtgcagtgggatgatatcagctcactgcaacctcccctcccaggttcaagtgattctcctgtcccagcctcctgactagctgggattacaggtgtgcaccaccatgcccagctaatttttgtatttttagtagagacggggtttcaccatgttgacccggctggtctcgaactcctcacctcaggtgatccacccacctcggcctcccaaagtggtgggattacaggaatgagctcccacacctggccttagacagtttctttttcctagaattgatacagaatgtgcaggacctaaggaactctaaggcttgaaagaatataggacatactgaactctaaagaaaggactacgaggtctgtgtttagcttcaataatacttagatggaactgtccagtgggcagttagaaatatggatttgaaacatctgggcatggtggctcatgcctgtaatcccagcactttttgaggcaaaggctgatggattgctttaatccaagagttcgagaccagcctgggcaacgtgatgaaaccccatctctacaaaaaatccaaaaaaattagccgggtgcagtggtgaatgcctgtggtcccagctattcaggaggctgaggtgggaggatcacctgagctcaggtggtggaggttgcagtgagctgagattgcaccactgtactacttcagcctgggctacagagtgagaccctgtttcaaaaaaaaaaaaaaaagaaaaaaagaaaagaaaatggatttgaaactcagaagagaggtggagctaaaggtttgctatagataagtaggtgtagaagcaatgggagtggaggatagtacccagagagagcatgtggagttaaaaaagaatactgggctgggcatggtggctcacacctgtaatcctagcactttgggaggccaaggtgggcggatcacgaggtcaagagattgagaccatcctggccaacatggtgaaaccccgtctctactaaaaatacaaaaattagctgggcatggtggtgcgcacctgcagtctcagctactcaggaggctgaggcaggagaatcgcttgaacccaggaggcggaggtgcagtgagctgagatcgcactgctgcactccagcctagcaacagaacaagactccatctcaaaaaaaaagaacactgatttttcactgacacaagtcagtttgtgggaatgcatgcagtactgttttttttccaatgaagattctttaatgacttcattataggccccaaataaatatctagcccaaatcatttttttctgctgcttcatggttttatgagggttgtaaggtttttggtcaaaatctcatacatttgatactacctgccttaccgagctcactaagttgatacaaaggttttggggcagaatccgagctttccttaagggatagatatattggtagattttgctgcctagaataaatattaacagtaatttattggcagaatgactctaacgtatgaaaatgattggcagaatctacaagcatttaatcttattaatctatagtcacacttcatataagtaatctaattttgcctgtaattttaatatgtggttaaatcatatttttcttctttgtttttatcattcattagtaatattctctttaattctttaggatactgaggatttggaattaaagaaatcattcaccagacatcatggagcctatatatccttttgcacggccccagatgaataccaggtatagaagtatatttacaaatatttgtcttacagcttttcacataacttgggaaggtaggttggaagagaaaaaagaatataatctttagaatcaggaaattctgggttcatatcctagctctaccacttgttaggtgggtgaccgtgatcaagttaattaactaagcctcagttcttcatctgtaaaatgaggatggtaatctctgtctcacagaagattattgtgtggggttgaataagattactaaactaaagggtctagtatgtaataggcactcagtaaatactagttccgtccctccttcaattattttcgtaatatagatctttattgatgggaaatagtacctgaacttaggaggctaaaaattatatcggtgtttgtttactttctagacaagtgggaaattggttgggttccttccctcttacaaatactgattccttgatgggaataatttcacattaggtataccaagtttcctcagatgttcctaagcctttgtcaagtgaagtaggagcttgccacctgtcttccatttttctcagtctgttactatggggactgggcaaatcagcttgtattatttggctctttggatcatttattgctcttttttcccctagggaacgacagttaatgctgacatgtgaatttttttttcttccaaaccagaattgcattcatgggtcgcctttattctctgtaatgtctttctttgtgccagatgttcttgatgaagatagtgggaaacatgacccaaggaggctatcgtattccttttgctttaattttggcccttgtgttctacccccctgccatctcttatttgaaaatttgtcggtgggcaaggtggcttatgcctgtaatcctagcactttgggaggctgaggtgggcagatcgcttgagctcaggagttcaaaatcagcctgggcaacatggggaaaccccatgttgacagaaaaattttgtcttctattcttagaagggtacagttgtgtaacaagttcagtgtattctgtttttaattaaaaaaatttaaatttttgtgggtacatggtgtatgtatttatggggtatatgacatatttttataaggcatgcaatgtgtaataatcacatatgggaaatagggtatccatccccttaagcatttatcttttgtgttagagacaatccaactgtacacttttaattattattatttttttttttttttggagacagagtctcactttgtcacttatgctggagggcagtggcgccatctcggctcactgcaatctttgcttcctgggttcaagtgattctcgtgtctcagccactcgagtagctgggattacaggcgtgcgccaccatgcccagctaacttgtatttttagtagagacggggtttcaccatgttggccaggctggtcttgaaatcctgacctcaagtgatctgcccacctcagcctcccaaagtgctaggattataggtgtgagccactgtgcccagcctaattatttttaaatgttattatttattacttttaagttgttattgactatagtcaccctgctgtgctatcaaataataggtcttaatcattctttctggttttttttttttaaacccattaactgtgtctacctctcacccaacccctactactcttcccagcctctggtaaccatccttctactctctgtgtccatgagttccattgttttgatttttagatcccacaaataagcgaaaacgtgaagtttgtatttctgctcctggcttatttcacttaacatggtgatctccagttctaaccatgttgttgcaaatgacaggaatttattcttttttttttccattttctttttcttttttctttttttttgttttttgagacagtatcgggggacctgccccgataatcacgtaggttcttttctgttttcctaagcgtccgctgccttgagaaataaaaggacagagtacaaaagagagaaattttaaagctgggcttccgggggagacatcacacgttggtaggattcgtgatgccccacaagccacaaaaaccagcaagtttttattagggagtttcaaaaggggagggagtgtgcgaataggtgtgggtgacagacatcaagtacttaacagggtaatagaatatcacaaggcaagtggaggcagggcgagatcacaggaccacaggactgaggcgaaattaaaattgctaatgaggttttgggcaccactgtcattgataacatcttatcaggagacagggttttcagatcaaccggtctgactacaatttattaggtgggaatttcctcttcctaataagcctgggagcgctatgggagactggagtttatttcacctctgcaatctcgaccataagagacaggtacgccccgggggggccagttcagagacctacccctaggtgcgcattttctttctcagggacattccatgctgagaaaaagaattcagtgatatttctcccatttgcttttgaaagaagagaaatatggctctgttctgcctggctcaccggcggtcagagtttaaggttatctctcttattccctgaacaattgctgttatcctgttcttttttcaggtgcccacatttcatattgctcaaacacacatgctgtacaatttgtgtagttaacgcaattattacagggtcctgagacgatatacatccttctcggctgacaggattaagagattaaagcaaagacaggcataggaaatcacaagggtattgattggggaagtgataagtgtccatgaaatctttacaatttatgtttagagattgcagtaaagacaggcataagaaattacaaaagtattaatttggggaactaataaatgtccataaaatcttcacaatccacgtccttcagtcatggcttcggccggtccctccatttggggtccctgacttcccgcaacaagacagagtctcactctgtcactcaggctggagtgcagtggtgcggtctcagctcactgcaacctcaactgattcaagcaattctcatgcctcagcctcctgagtaactgggattacaggcgtgtgccaccatgtccagctaattttttgttttttgttttttgagatggagttttgctcttgtcacccaagctgtagtggggtggcgtgatcttggctcactgaaacctcttccccctgggttcaagtgattctcgtgcctcagcctctgaactagctgggaccagaggcgcgtggcaccacacctggctaattttgtatttctagtggagatggggtttcaccatgttggccaggctggtctcgaactgcaggcctcaagtgatccacctgccttggcctcccaaagtgctgacataggtgtgagccaccaggcctggccccattagtggtctttttcttattgtggttttctcgtgttatacactcatgtaaaatgaaaagtttttgatggtaccctatatgatttaatatcacaaccttgctttacactgcccctggcatctttgttgaggaattatttataattatgtccttttgacgcttcaataattaaacttgtgctgtattttggtattccagaataccaaatttggaaacactggaaaataattaagaatttattaagtttttttgcttttcataactgttgggtattatctaacaattatctggaaatcagttcagaaagacagattttaggccaggagccatggctcatgcctataatcccagtgctttgggaggccaaggtgggaagattgcttaaaaccatgagttcaagaccagcctgggaaacatagcaggaccctgtgtctacaaaaattacaaaagtaaatctcacgtggtggtgcacatttgtggtcttagctgcttgagaggctcccttgagcccaggagtttaaggctgcagtgaggtatgattgagcccctgcattccagcttgggcaacagagcaaggccctgctctttaaaaaaaaaaaaaaaaaaggaaagaaaagaaagattttagtttaaatttaaatgtaaatgtatgatttatactcatttttctgttacttaaaagggattttgtaggattgtcttgttctttttttaaaagcttgtgtatacataaatttacatatgcatagataaaaaaggacaaataagccaaattttgagtgcctattctcctggtagtagagttacaagtgaattttcttttttaaaaaatattttttgggccgggcgcggtggcttacgcctgtaatcccagcactttgggaggctgaggcgggtagatcatgacgtcaggagtttgagaccagcttggccaacatggtgaaaccccgtctctactaaagatacaaaaaattacctgcgtgtggtggcaggcgcctgtaatcctagctactcgggaggctgaggtgggaggatcacttgaacccagaggcggaggttgcagtgagctgagatcacgccattgcactccagcctgggcaacagggtaagactccgtctgaaaaaaaaaaaaaaaaaaaaaaaaaggccaggcgtggtggctcacgcctgtaatcccagcactttgggaggctgaggcaggctgatcatgaggtcagcagatcaggaccatcctgattaacagtgaaaccctgtctctactaaaaatacaaaaaattagccaggcatggtggtatgtgcctgtagtcccagctacttgggaggctaaggctggagaatcgcttcaacctggaaggcggaggttgcagtaagctgagattgcaccacagtactccagcctgggcgacagagtgagaatccgtctcaaaaaataaaaaagtattttttggccaggcacagtggctaatgcctgtaatcctagcactttgggaggccgaggcaggtggatgacttgaggtcaggagttcgagaccagcttgcccacatggcgaaaccccgtctctactaaaaatacaaaaagtagccgggtgtggtggtgcactcctgtaatctcagctactcaggaagctcaggcaggggaattgcttgaacccaggaggcagaggttgcagtgagctgagatcacgccactgcactccagcctgggtgatggagtgagactttgtctcaaaaaaaatatatatatataaactctttgaaaattacaaaagtagtctgaaaataccatcaccttaaagatagttagttgtttcctaccaaatgtctaccaagtttgctattccttgtgctttaattttacattgttttttcaaaaggtttccttcaagcaggatggtacctttccactttcctccatcaaaatgtgcactttggaacccaacgccaactggagatttcatctacttacatctcagttactacaggtataacatgtttctttttttcaaatcaagccagtataaacaagagtaatacaaagatgtataaggcaaagttgattactatgaccaattattcatttttctttacttttcttttagaatctcccctcaggcaaaattttccttctgcttcttaacatctgttccttgtacttttgagagataatcttatcttcccagttttctgcaaattctgcatattgtaggaattcaaaagaggtgaaatatagtaaaaactgaaagtgttttttattatgtcagcatggtgtctttgtggaacgttgagaagcttgaaccaatttttgagtggatcagattagaaggaatataaaatcttgtagttacatctaggaccttgacagacaagaaagtttaggtgtaaagtaatagaaaatagatctattgaggttttgtacataagagttacttgttaaaagtagtattctaagaaggatagattatggcggggagagccttgagtcagcctagcttcaagatgcttttctgtaatcacacaggtgtatattgtaatggtttaaggtgctataactgggctgggtgcagtggctcacacctgtaaccccagcactttgggaggttgaggcaggaggattgcttgaagtcaggagtttgaaaccagcctgggcaacaaagtgagaccttgtctcaataaaaaattaaaataaaaagtaaaaaaaaaaacaaaataaggaaaaaaaaacggtgcaataattggagcagactgcctagggaatcaaatcctgattctagtacttatttatgcaacctcagtaaagtagccaaggatcagtttccttatttataaaatgactataataataccagtttcacagttctcttgtaggggttaaataagactctgtaaagcaattgtcacagtgcctggaatagaaagtatttcataaatggcatctattatacattataaggacttagagcaatgtagcagtattcagatcaagaggaaagaatgaaacaaggtgttttgaataaataatttgtagtatttgatgattgactgaatagaggaactgaaggaaagatacaagaaagaaagtattcgggttcaacactagttggcagagaagggtggtaccattgacaaaaatagggagagtcttatggaagttcaactaaataatggttagtcctgtttttattttttttattgttgtctttctgtacattttgagtagtttcctttgtttttcaagtctgcttattttctctttagctgtgcttagctgccatctaacctattcatttaagtttggttgttttttttgagaggagttttgctgttgttgtccaggctggagtgcagtggcgtgatgttggctcactgcaacctccgcctcccatgtacaagcgattctcctgtctcagcctcccaagtagctcgaattacagacatgtgccaccacgcctggctaatttttttgtatttggtagagatggggtttcaccatgttagtcaggctggtcacgaactcctgacctcaggtgatccacctgcctcatcctcccaaagtgctgggattacaggcatgtgccaccacgcctggccctcatttaggttttttaaaacgtggcggtgtaccatatatatgagaggatacttatagtatatatgcatagttaatagaataacaatacacatttgtgtacctatccccagttaattatataacttattgaatttttgcaaattatattttttatttctttaagttctgtatggcttttttattcaaatttgcctggtcttttttcgtagtatcttattcctggcttatattttggttttccttttacattttttaaagcatttaaatcatactatattttgtattcaatacagtagtttcccccctttatgcatggtttcactttccatggtttcagttacccacagtataatacaataaggtattttgagagacagaccatattcacacaacttttttacagtatactgttaaaattatgctactattaattattgttgttaatcatttactgtgcctaatttataaattaaactttatcatagatacgtatgtataggaagaaacatagtatatataggatttgttactatctgtggtttcagacatccactgggggtctggaacatgtctcccagagataagggggcactactgtaatgctgattatatctgaagcccatacacagtatgtaaagaaacagatgtgactgtttcaatcaaaatttacttacaaaaacaggagacctacctgctgaggttcataaagttaacaaaatgcctggagaacaactatagtttcagtgtctgtttattgccattctagtttccaagtggccctccgtatcccctgcctttgaccctgggatttcctgacaatgatctttctgtacatttttaaaaatgtgtgttataatttagacagcattttatggcaggaggtttttttaagatatgaggtctaccatattcataaaagacttgttgtttttcagaaatccaaagcttgtggtgactgagaagaccatccgacttgcttatcgtcatgctaagcagaataaaaaaaattcgtcatgctttttacttggttctctgacagcagacgaaggtaatacacttttaaaaatggaccagtgctcacgcctgtaatcccagcacgttgggaggctggagtgggaggatcacttgaacctaggagtttaagaccagcttgcataacatagtaagactccatcagtacaagaaaacatttttttaaattacttgtatgactgcaatagaatttattgattcggccaactattgtatttgctttgcgctaattttctttgctgtgtaccaaggatatgaagatgagtaaaactattaattacagagttcactgtctggtcagatggatcaatatatataagcaagtaagactttagtatacgcttataagagtttagtttactgtaagagtttagtttagtatttaagagtttagtgtactattggtatgaacaaagtgctttgctataatgtagtcttgcttggttgattttatgtttttaattagtatgctgtataatagctgttatttttgttctacagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggtgcgattcattgacaacttgatagttaattcaacacaagaatcaaactatgtttagtatgctgtattttagtaaaaccatatttgagaatgatttacaataatttggttgaattattgtgaacctaaaatccaactaaatgtgtttgtgagggcaaaaactctaggtaagcgatatgagtagcctttcagaagaagcagtgtaaccgagataagaaagttcaagatgtacttagggtagtgtttagagtatacatttttgctgaatttgtgggcagtcagactggagtattaatttggtcagattatagagaggcttggctgggcatggtggctcctgtctttaatcccaacacttcgggaagctgaggcaggtggattgcttgagcccgggaggttgagccgtgatcacaccactgcactccagccttggtgggagcaagaccctgtctcaagaaagaagagccttgtctgccagcctgatgaatttgaactttgtcatatgggccatgtagaaattgaaggttcttgaaaaaagaaaacactgtcaaatcagaaatagttaatctgatagggtaggctgaccgaagttagagtagccattgtagaagttgggcaggtgtgtattatagagggatgtattaacctatagtacaatggtagcagtgaaactaggaaggacacagtgggcatgggcaaatacagagggagaactaacttgacaatttgtggtaacaagaaaggaatcaaagaggaatggactttagattctctgaggctcaatcggaattattttatgaggccaggcacggtggcttacgcctgtaatcccagcactttgagaggctgaggtgggctgatcaggaggagttcaagaccagcctggccaacatggtgaaaccttgtctctactaaaaatataaaaaattagctgggtgtggtggcacacacctgtaatcccagctacttgggaggttgaggcaggagaatcgcttgaaccgggaggtggagtttgtggtgagctgagatcgcaccactgcactccagcctgggcaaaaagaacgagactccttctcaaaaaaaaaaaaattattttatgtccattttttcccatgtggtaaatatttattgggggtgactccccaataagactgaagtgctgctgggatatctacattgaaaatgtgtagtggagcttgggacagtaaatcttacttgctttgatataattattcacataatcttttggtcacatggaataaacgagaactgaaatgctgtaaatcagaactcatttaattttatttgtgcaagatattatatatgtatatgtatcagtataaaataaactttggcgatatgggcacatttcaaagttttaaaataattatttaatattgatttctcaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatgggtaagtaaaagatacattaatctaaatgttagttgcattagtatattttcagaatgtccatgtaatgtgaaagaattgtccagtcaatttatatgccagagatatggtggcttggttaataaccagggaaagtaaaaaatgaaatggtttattttcgttgaatatgaaattttctttaagttgtgccaccacctacaaaaaattggtggtagggcctggcgcagtggctcacacctgtaatcccagtactttgggaggcctaggcgggcagatcacctgaggtcaggagttgcagatcagtctggccaacatggtgaaaccccatctctactaaaaatataaaaattagctgagcgtggtggtgcatgcctgtagtcccagttactcgggaggttgaggcaggaggatcacttgaacctgggaggtggaggttgcaatgagctgagatcgcaccacagcactctagcctgggcaacagagactccgtttcaaaaaaaaaaaaaagacaaaactgagtggccataaagtataatgtctggataactcagttctttttttgagatggtgtcttgttctgtcacccagactggagtgcagtggtgggatcttggctcactgtaacctccacctccctggttcaagtgatcctcccacttcagcctcctgagtagctgtgattacaggtgcatgccactacaccggctaatttttgtatttttaatagagatgaggtttcaccatgttggccaggctggacttcaactccagacttcaggtgatcctcctgcctcagcctcccaaagtgctgagattacaggggtgagctaccatgcccagccccagagacctcagttctaaaaaaaaaaaaaaagtggtggtaaaaattatattaaaattggaggccgaggcgggtggatcacgaggtcaggagttcaagactagcctcaccaacatggtgaaactccatctctactaaaaataacaaacaaacaaaaaagctgggcatggtggcacgtgcctgtaatcccagctactcaggaggttgaggcaggagaatcgcttgaacctgggaggcagaggttgcagtgagctgagatcacaccattgcacttcagtgtgggcggcagagcgagactctgtctcaaaaaaaccaaaaaacaaaaaaaaacaaattggttgataatttattatttgaaaatgtaagaggaaattgtgttctatattgtatattctgtattattctttgtattttatttaggttttaggccttttttttttcttaactataacctaattatgaacccaagggaggctagagaattcatttatagtatgtggttttaactgtgaataatgagcattgcagatagagaaaggagataattaaataaaaagttacagtactcttgcttaccaaattgccaactacttgagggtggagtttcctcacagagctggagtagaatcctctccagcttcctatctccactcttaatttcttaggaaatgtaagccaaaatgcatgctttctaatcttcagcaaggctgcttccctgaatcttcatctattttctttatctattatttataaaactaggttagacaatataactactctactttaaagtttgaccagagactgctccaagtattacacttctggtttcctttcccagtgactccaccctagttcctgttaggccattcaatctaaaaatgtttgccaaagtacactcaattccaagtcttattctctaaaaatacctcttcagaaccagattctgaccagagctgtgctttctgattggagtggcccaaaggaaaaattggtatattccaaaatcatggagtggtcaaaagtgagcaaaaattgtttgaattaaatgaaacatttaatcctcttaattaataaagtacttctcaagtggagcatgggattttttgtttaaattaacaaaaaaattaatttgttttctttagtacccatccccatttacttgtatagcatgaatttacctttcttggaattatccatctgtgactgctgggcgggcatgctggtaataaccaggatgttcagtattctgtcaatcacctattctccttgccacttcctatctagaatcgtctattaaattggtgacatttgccatgccaggtacattgacacacacctgtaatcccagctgcttgggagagtgaggcaggagggtggcttgagcttaggatttcaaggctgcagtaagctacaatagtgcctgtgaatagccactgctctccagctaggacaatgtagtgagaccccatcattaaaaaaaaatttgacatttgccctttatataccctaatatttactagggcccattatggcataggcattatgttagacattggaaataaatagattaaaaactatacttactatctattgaatatgttgacatgtaaacatgatgtgttataatggaggtttatatacagtgctgggaaagtagggggagggatgtccaaaatgcctggggaaatcatggaaagcctgaactaattctttttttttttttgagatggagtcttgctctgttgccaggctggagtgcagtggcacgatctcagctcactgcagcaacctccacctcctgggttcaagtgattctcctgcctcagcctcccaagtagctgggattacaggcgcccgtcaccatgcctggctaatttttgtatttttagtagagatggggtttcaccatcttggccaggcttgtcttgaactcctgacctcatgatgcacccatctcagccttccaaagtgttggaattacaggcatgagccactgggcccagccagcctgaactaattcttttaaggagtagaaatttatcagatgggcaagacatgagggagaacttttaaagcagctgtgtcattgttgatttgtaaatcttacgccaactcaggcttaatattcttgtcacaagacctgacaaatgtattgtctttgtgttttagtgttattagagcaataaaatatatcatcagtggtactgccaaggctttatatcactaatggcattgtttttgttttctgtttttgagacggagtctcactctgttgcccaggctgaagtgcagtggtgcaatctcggctcactgcaacctctgcttcctgggttcaagtgattcattctcctgcctcagcctcccgagtagctgggattacaggcgtgtgccacaatgcctggctaatttttttttttgtatattcagtagagatggggttttgccatgttggccatgctggtctcgaactcctcacctcaagtgatttgcccacctcggcctcccaaagtgctgggattacagtaagcgtgagccaccatgcctgacccactaatggcattgtttttgaagaaagacataacaataaaattaacaattctactttggttttttgtattcttataacttgctgtcaataataaatataataaaatataaatatagtataatgtccttttaggaaagagtgagcttttgtgttttatgatggttccaaagtcctttgacagtggttggaggaatatggcacatggaaggttgatcatacttctcctaattcagtctccttcacttagaagtcacatctgttgcagtcttgtcaaatcacttggatgcatgaacattttctagtgatagggaattcagttcttccaaggaaacctatttggttctgaaactgcctaccttaatgttaacactcttgattaaagtaaattgtaagtaaagttatagagcaaaacttttaaaaaaggtgtataatcttcaatgtcttttaattgatagatggaagttttaaggtattaaatctctttaatctcttcctcttaccagagtctttttactgagtcagtaaaaagtttctgtttcttttgtgtgtgcaagacaacgttcatttgaattatctcccctttctaaagtatgcttcagcatttagattatgtcttttaggtaaaaagtacataatttcagttattttcacatgaatgtcttctgtttagatatcttaccatggatgaaacacgcaaattgttacttttgttggaatctgatcccaaggtttattctctaccattggtgggaatgtaagtattacattatttatgaaaaccttatcagccaaatgttcaaatgtatatgataagcatgtgactcagttgtactataaatatttagatcattttataaagccacaaagataagtggttgtcaggttttcttattttactagtagaatcagctaaaataagattttacccaatcttttttttgagatggagtcttgctctgtgcccagactggagtgcagtggagagatctcggctcactgcaatctccatcccccaggttcaagtgattctcgtgcttcagcctcctaagtagctgggattacaggcgtgcatcaccatgcctggctaatttttgcttttttagtagagacggggttttaccatgttggccaggctcgtctcgaacccgtggcctcaagtgatttacccgcctcagcctcccaaagtgcttggattacaggtgtgaaccatcatgctcagccagattttgtccaatattaggaagaactctaacatataaaacagataaaagcttaattctatggccaggcgcagtggctcacgcctgtaatcccagcacttttggaggctgaggtgggcggatcacctgaggtcaggagttcgaggtcaggagttcaaggccagcctggataacatggtgaaaccccatttctactaaaaatacaaaaaattagccaggcatggtggtgcgtgcctgtaatcccagctacttggcaggctgaggcaggagaatcacttgagcccaggaggtggaggttgcagtgagctgagattgcgccattgcactccagcttgggcaacaagagtgaaactccttctcaaaaaaaaataaaaaatataagttgaattctcctggttgaaggtgaaggcttagagccctgtttcttcagtattctctcactaccactcatccttaagtcaccctaaagaactcagggctcataataataccatttaaaatccactgtcagtcaatcttgcagaaatctcctttagtgttaatggccttctctttagagtagtaattaatgatatttatgtgtttacttttttttatatatgtatacatgttttgagacagggtctcactttgtcacacaggctggagtgcagtggcacaatcatggctcactgcagcctcaatctctggggttcaggtgatcctcccacctcagcctcctgaatagctaggactacaggcaccggccatcacgcctggctaggttttgtatattttgtagaggcgggctttcgccatgttgcccaggctggtctggaactcctgggctcaagccatctgagttaatgatatttagacagaatatttagaaatttatattcattcagtattgagtacttattatatacagtgttatgcttgataatgtgttgaggtttaaagcttcttaaagaatttaaaatcaaagtgaggtgataaaacattcaaatattcatacacagaaaaataaagtatatgatttactataaagtgaccagtatggaaagtgaacacttagtatttgtaagaaagatatgatagggagcattttcctagagaagacaaacttgagctagactttcaattgtttagatagtagaagggaagattgttggggaagggaacccatgtaagggaatggcacatgcaaagtgaatgagaatgcatgaatgttctctggaccatgaaatctacttatagtttgctacagtcctaatataggcaatggattgttgatgcttaagtaaatattaagagccttctctctttctgactacctgtatatattacagcatttaatcctcagcaactctgtgaagtagttttaggctgcaaattagtctgtactaccttagcccattctttccagtccaagctaattcattctagtatactgctttcatctctgttaaccattttctttcccacatctcaggtaaaagaggacagagatacgcgtgcttgctctctttctctctctctctctcgatatatatctatatgtctgtctatatatatcaatatagttatatatatacaaatgtctatatattcttccttttaattatcagcacgtttttagatttcttattactaaggctttttaatgtatggctgataaaagccatacgtctactttgttatcttaggaagaatgtaaattatgctatatatgtaagtgactatggtttttaatttctatctttttcttttagttggctgtctggaattacacatatctatagtcctcaggtatgggcttgctgtttgcgatacatattcaattcttctgttcaagaaaggcaagtgatattttattctgtagtactttatttcgatcctttcccccattcatagtttatggtcccatttaaaattcatgtaatgccgtaaccttttacaatacttataaataaacacgtacattaagaaaaaacaaaccttatattaaatgagaataaaaccagattaaaaaaagatgaggttgcagtatacctggaaataccaaggaattcacttgcctaaccacagaacacaaaccttttgggggtggaaaaaaactgtggagattgtctactgtagcatcctatttaataattaaggaggttaactttcagtgaaatgactgcaaatgagtttggatttgttaccttacagatgttttattaagttacacagtgttactactaatacacaaagaaatacttgagacaagatttttaatttcttcctgaaactgaagcctaaacattggaattaatagttagggaaactttacttttaacctcaactcatttaatagataaagaaggtgacatctttgtcagtatttgtctctcaccttctttatctattaaatgagaaggtctatttttatctaccttgggtggctgtaaaggacttaaactatattgaaaaggcagtacaagcacatagtaataaattgacatatgtaaatatctacaataaaagtagatctctcttcctccccatttccctagaccccattctcagaggcaatcactgtaaagtgatatcttgtgcttccttcctgaaatagtcaatatttcaatactcaacatagacaagtatcaccttttcctggcctgtaaaaattaaaccatagcatcctttcttttctttatgttgcttttttctgtataaattataccttggagatcattacctcttggcatatacagatttaatatacatattttacaactgaagagtttataatacatactgtattttaaaaactggcccttttgtcttgcagatagtggtagactgaacattttatgcatacatctttgtgtgcatatgctagtatatttgtaggataagtttctaaaagtgtttttttctaggccaaagagtatgtaatttaaaatttggtagatattgccaaattgcccttcaaaaagactgcaccaatttataatttttccagcagtacacgagagtgcctttttctctacctgcactaacactgtgaaagaaatatttatttatttatttattgagcacctattatatctattatgttcacagtactggggatcagagtaaacaaaataaaggtccccagaccaggcatggtgtcttatgtctgtaatcccagcactttgggactttgggaggctgaggcaggaggatcgcttgaggccaggagttccagaccagcctgggtaccatagcaagactctgtctctaacaaaaaaaaaaaacaaaaaacaagttagctgggtgtaatgacacatgcctgtagtcccagcaggagactgatatgggaagatcgcttgagcccaggagttcaggctgcagtaagccatgattgtgccactgtactccagcctgaacaatacagaccctgtcttaaaaaaataaaataggccaggcatggtggctcacatctgtaatcccaacactttgggaggccaaggcgggtggatcacttgaggccaggaattagagaccagcttggccaacatggtgaaaccccatctctactaaaaatgcaaaaattagcccggtgtggtagagcatgccggtaatcccagctgctcgggaggttgaggcaggagaatcacttgcacccaggaggcagaggttacagtgagctgagatcgcaccactacactccagcctgggcaacaaaaaataaataaataaataaaaaataaaatagtcctgcagagacaggcaataaacagaataaataaaataaatagtatgttaaaaggcgatgagtactgtggagaaaaataaagcctgagaggaggatgttgtgtgtctgaatgatagtggcaagtaaagagttgccgtttatttatttatttatttaatttttaatttttaaatttttatttatttattttattttacttattttttttgagatggagtcttgctctgtcgcccaggctggagtgcaatggctcaatctcagctcacagaaacctccacctcctgggttcaagcgtttctcctgcctcagcctcctgagtagctgggattacaggcatgtgccaccatgcccggctaattttgtattttttcagtagagacagggtttctccatgttggtcaggctgatctcgaactcctgacctcaggtgatctgcctgccttggcctcccaaagtgctgcgattacaggcgtgagccactgcacccggccaagagttgcaatttaaataggtggtcagggaggccgacttaaggtgaggaagtaagccttgtggctgtctggggcactgtcctaggcaaaggatgtgttaagtgtaagggctctgggtgaaacaacacgttacatcttcaaggagcagcaaagaggccactgtagctagagaggagtgaaggaaggggagagtagctggagatgagctcagagaggtgagtggagggctgttgttaaacttttgacctctgctaacctgatagatgaaaaataaacttttccaatgatttataacctcatcttccaggaactgcctagtcatgtctttagccatttttctcttagattgtgtatcttttctttttttttttttttgagacggagtcttgctctgttgcccgggctggagtgctgtggcgcgatctcggctcactgcaagctccacctcccgggttcacgccattctcctgcctcagcctcccgagtagctgggactacaggtgcccgccaccatgcctggctgatgttttgtatttttagtagacagggtttcactgtggtagccaggatggtctcgatctcctggcctcgtgatccgcctgcctcggcctcccgaagtgctgggattacaggcgtgagccactgcgcccggcctgtgcatcttttcatattgcttgtgctagcaagctctctctctatatatataatgtaaaatacatagagaaacacatattgatgatatatagtaacggttttccccccagattgtcatttaagtttaacaatatttttcccaaacagacttactgttttttagtcatatttattaatctttttcatatcgtgtttagaaaagattcacccactccaggtgtatttactgaagtaaaaaaatcacttgtattttcttcagatgcttttggagttctacttttaacattttgttttaacttttcaagataattagttatatttagatagcagaaattaaatgttagttttagatcctttgctatgatttagtacaattatgttttattatcaattactgatcatgctttaagttcatattgacagtaaatcctcagtaaaattaattttgaattgctctcttattccttttttttttttttttttttggagacggagtcttgctctgtcgcccaggctggagtgcagtggcgcgatcttggctcattacaagctccgcctcccgggttcacgccattctcctgcctcagcctcctgaataaaataaaattttgttttgtagagaggaagggtctcactatgttgacaaggctggtctcaaactcctggcctcaagcgatcctcccaccttttgccttcctaagtggtggaccccagtttttgaacaaaaattgcaccttttagtcattttgttaactagattgggagactcacatgaagttatttgagtgtcatcatgttatcctcattaaattttaattaaatgactttttttgtgcagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaagtaagtgatttcattgtctagtacattagtgactgtttagggttttgcactttggcagtttaaacccaacagcttttaccctttaaaatagtaatccaaactattatgctttgtttacttataaataatcttattaaatattaactttattcatttatggttaaatttttttagtaaatctgagatcatatcttcaaccaaattacaatagagaaccagaggttactcacagaataacttgcccatgtttttctaaaatctttgaagaatatatcagttgttcatatatcattttatacttgtgaaggttaactttgtgggatctcagtacttttctttgtcctgatgtttttttttttttttttttttttttgagatggaatctcactcagttgcccaggctggagtgcagtggcgtgatctcggctcactgcaacctctgcctcccaggttcaagtgattctcctgcctcaacctccagaatagctgggattacaggagcccaccatcacacctggctatttttttttttttttttttttgtattttcattagagagggagtttcaccatgttggccatgctggtctcgaactcctgaccttaggtgatccacctgcctaagcctcccaaagtgctgggattataggtgtgagccactgcacctgaccatgactgtattatttttaaaatgtgtgggaataagaaatggttttttatacttaaaggccattatttatattatgtatctaaggaatcagaatagattgttactatatcatctaataaaatacctagaaacacaactagatgatgatcatagaaaaagtagatctttaggccaggcgtggcggctcacacctcgaatcccagcactttgggaggccgaggtgggcggatcacctgaggtcaggagtttgagaccagcctggccaacatggtgaaactctgtctctactaaaaatacaaaaattagccaggcatagtgccaggtgcctgtaatcctagctacttgggagactgaggcaggagaatcacttgaacctgggaggtagaggttgcagtgaactgagatcgtgccgctgcactctagcctgggcaacaagaaggaaactctgtctcaaaaaaaaaaagaggaagtagatctttgaaactaggtgtcattatatgaaaatattcaaatgctacttttcaataaaattattggttattttaggtctcagactaataaaagtacattctttattagaaaaatattgaatacttttaaataaccacgtgtccactcagatcgtatttagtaccttctttgagatcatgtatatgttatacatctatatattttatataaatatatattttaatattataatatatacattatattacatatatgttatatataaaatacctttatattatatattatatacattttatattttataggttatgtaagctataaagtttttgtattttatacctatcattttaactgagatctaatatttctgttttagagacatatttgtcattttattctttagatggtattctcatttcatagttatattcactgaatctgtgattataacacaagtgattaactttttcacttatgtagcagggaactggacagtttacaaaagagggttacagaaatcagaagtctgccactccatcatctagtgtttcagagctacttttcatctaaatagaattctctggtgttcttatttaagtcagatctcaaaatatgacctacttcatttcagaatgttgaacctcctgacaaaaatccaatccgttgtgaactgagcgctgaaagccaaaatgcagaaacagagtttttcagtaaggcttccaagaatttttcaattaagaggtaaaagatctttttgttattatgtgtgtgtttttttaaaaattatatttattagtttttggtgagtaaaataactaaattatttctgatgaaatgattttttaaatcttatgtaccataaatgtctttgttttaaatgcattccttcatattcactaggaagttggatagtaattttaatgaagtggcaactctaatatggttttcatttgggttgatgtattatacaggaaaaatacaaaagtatttgtcaaaaaattatcttgcttagcaagaatctgctccctgttttgtttagtgctttctatttgttcttcccttccttataagtttcttattttaatatttaaattaaaggtggggtctcgctgtattggccaggttggtctcgagctcctagcctcaagtgatccttctgccttggcctcccaaagtgctgggatcacgtgtgtgaaccatcgtccccaacccttccttatagttttaaatctggacctatcagataaactactataaaattaactactagctggagtgtgatggctcacgcctataatcccagcactttgggagtccaaggcgagcagatcacttgaggtcaggagtttgagaccagcctggccaacatccttaaatctacatataatactggtcatttctcccattttataggtgagaaaagtgaagtgtagagaaatcacataggaaatgtacagtaaaagacattacacacactcaggtcctgaaattgatcacccagtgtttttaaaacattaatcactagaattctatagtgcattttaacatttgaaacagctaatattctttctttctcagaacttttcttttttttctttgagacagagcctcgctctgtcgcccaggctggagtgcagtggcgtatctcagctcactgcaagctccgcctcccgggtccacgccattctcctgcctcagcctcccgagtagctgggactacgccaggctaattttttgtattttttttagtagagacggagtttcactatgttagccaggatggtctcgatctcttgacctcgtgatccacccacctcagcctcccaaagtgctgggattacaggcgtgagccaccacacccggcctctttctcagaacttttagggatcatttggcaggtcttcagtgttattttttaaagttcctctcctcaagctgcatcttctccatttaaaaaaaaaagccattgaagttggaatattgaaatataaagctgtgggtgattaaatcaaacggtaactagtggtggggggcaggcagatatgtggagcagactatagttcagaaatagatgcaaacatatgatactttcattatacaataaaaaatgcatctcttgctgggtgcagtggctcacgcctgtaatcctagcactttgggaggctgaggcgggcggatcagttgaggtcaggagtttgagaccagcctggccaacatggtgaaaccccgtctcaactaaaaatacaaaaattagccggacgcactggagcgtgcctgtaatcccagctactcggtacgctgaagtgggagaatcgcttgaacccgggaggcagaggttgcagtgagctgagattgcgccactgcacttcagcctgggcaacagagtaagaccctgtctcaaaacaaactcctacctaaaaaaaaaaaattgttttaaaacttctaaaacacacttgaagaatattaattaaataaagtcttgtgacttcttgggtcagcatattctaccttttgtggtaaagaagatattctcggccaggcccggtggctcacgcctgtaatcccagcactttgggaggcagaagcaggcagatcacctgagtctcgggacttggagaccagcctggccaacgtggtgaaaccccgtctttactaaaaatacaagaattagccgggcctggtggtgcatgcctgtaatcccagctactcaggaggctgaagcaagagaatcacttgaacccaagaggcacaggttgtagtgagccgagatcatgccactacactccatcctgggtgatacagtgagactccatctcaaaaaaaataaaaaagatattatcttgtattagggttctccagattaacagaaacaacaagatgtgtgtatgtagagatatttgttttaaggaattggcttctgtgtttgtgaaggtttggcaaatccaaagtctacaggtagaggctgagcacagtggctcatccctttaattccagtactttggaaggctgaggcgggaggattgcttgagctcaggagttcgagaccagcctgggcaatgtggcgaaaccctgcctctacaaaaacagaaaagaagtacagaatttagctggttgtggtggcacatgcctatagtcccagctacttgcagggctgaggtgggaggatcacttgcccaggaggtcaaggcttcagtgagccatgttcgtggcactgcactgcagcctgggtgataaaatgagaccctgtctcaaagaaaaaaaaaaaaaaaaagacaaaaaatgtctacaggtaggctggtaggctggacacccagggaagaattgcaatttgagtccaaaggcagcctgctggcagaattccttttccctccaggaagtcagtctttatctttttttttttttgagatagggtctcactctgtcacccaggctggagtacagtggtgtgatctcagctcactgcaacctccacttcgcaggttcaaggaattctcctgcttcagcctcccaagtagctgggattacaggtgtgcatcaccacgcccggctaatttttgtatttttagtagagatggggtttcaccatgttggccaggctggcctcgaactcctgacctcaaatgatccacccaccttggcctcccaaagtgctgggattacaggcttgtgtcacctcacccagccaggaacatctttactgtcttaaattttaagaccttattcaacattttattgaatatttatggaagaaatagccaaactaaggagacaatagcaatttctttaagattgttattaaaagctactcagaaggctgaggtaggaggatcacttgggcccaagaagtcgagttggggagccatgatcatgctatgccaactgcactctagcctaagtaatagagtgaaacccggcttcaaaaaaagtgatgttaaaaaaccttgtttattttccattctggcctaagctttaatgaggaacagtcattttaaatgttatcaaaatgtttgtctctcctaaagtactgttgttataactatacaacctgaagtttttccttttttcccttgggtactaaaaaagctaagaaatgaggccaggcacagtggctcacacttgtaatcccagtgcttcgggaggcagaggtgggtggatcacctgaggtcaggagttcaagaccagcctgaccaacatggtgaaaccctgtgtctactaaaaatataaaaattagctgggcgtgctggcacatgcctgtagtctgagctcctcggacgctgaggctcaagaatcacttgaaccttggaggcggaggttgctgtgaactgaagtcatgctactgtactccagcctgggcgacagagggagactctatccaccccccacccccccgcaaaaaaaaaagctaagaaatgggttttattgctcagtgtcaacggttttgtgtgtatattcatcttaagtacaaaacagatattaattccatgccacaactcaggtatacaaaagaatgtaacttaaaaaagttagtaattgaacttaatatctattttaagcccctatttgttctactgaattatagacaccaaatttcacctaattcaaggtttctttattcccttttctctggggttatatgtaatgtagaggggactaatggtatgccagtactggtgatatggggtgacgtgattctcatccatctgtgctacaatctgctgaggtgttttcatttgcatctggtctttgtcagatttgtgcaagttcctgctgcaacttttgaccctgttcaggccactggctctcttgtttcctgtccatgctgcactgagcgctttggaatatcattatgtatctcaagctgccttgggtgttggagaagagctttgtgggactgaagacccatttctgcttaaacataatcatgcagacattctgattgcttcattgtaataccttgtacagaaagaactctgtgaaggtctacctcttcagacaatcagggtttagggcaaaaggtctcttctgctgtttgattttcaaacctgccttggagtttcttttgttcttcctgctagggaggattcaacttgcatgaaacagaatgcagggtgcttttttagggatcccattaatcctgagcgctgttagctttcattctggcttttcttttccctaatgcatcctattgagactttgtctagtgtaggatgtaaaaaagcctgatgcatatagtattccaaatctttagtcttaaacactaatttcagcttttaaaacttggtaccagcactcagaaattttctgttttgctgggcatgccatctgtgatacaatgagtattcctgactaaatgggagggtagtactttgatttttcaaagtattttcccatcatagatataagtacataggaaaatataattccttatttggttttcctttttaatacagagggtttgtaatatagtgtgtttaataacctttaatactagattataaattttttgacagcaagtactaagtcttacttgtttctatatttatcgaagtgatcaactagagggtgcccagtgacttgatttattgtgacattaacaatacaaggttaaacttgctatcatcaggtaaatagggtagtttattaaggctggctggtccagcttccctggtcaactaacactggcctgaaaaataaaataatttgtggttgtcagatactaaattaaatgatctgagtactactgcaacttattaaaggactttattcaatttctagaagaaagaaaacactggattaccaaaggcttttctggtctccccttctattctttaggtcttcccaaaagttatcttctgggaagatgccaatacatgatcacgactctggtgttgaagatgaagatttttctccaagaccaattcctagtcctcatccagtgagtcagaaggtatcactgattttaaaatgcattcacttttgtggttagagacctaagtctcttcatggttaaaacactaaataatactacctgaaacctaagtatcattcttagatatatctagctatttctatctctatggttatatctatatatagagatataagtatttcacagttatatataataattcatattatatgtaatgatatatacatatgtgtaatatctatgtaataagcatgtatggttattcctagagtaaactgagacatagattggttaagttacctacccaagacacacaactagtaagtagtaaagctgggattctatttcaggaggtttggttttagaatctggtacttttaataaccatatagactcaacattatatactatcactagagcttgacattggtttttatcactatattctgagaaaacattatacttgctttcagaggttaattgctaaaattcttgtcataatttttttattgctaccaacctgtgggtcattttagaattgtttaattcttattttagaagaaaaaggaatgggaaggattttttaaagctaatatcaaattataaccaaattcatcacagcgagtattttgtttactcttttttgctttccacctcttagttgatatcaatagaaggaataacagtgagtgacttcttagtggagaaatattttgaaacatttattggaagattttactatttaaggtacataaacatttgctactagatctgtgaaaacattctgcttgtgacaattttattttttgcagagaggatttaaaaagttatataaaacagtttctcatattgtgttctgtgatcttagcagtgttagtgttttaataaaaagagttccattattaaataagtttgggaagtgtttagttttattcttttagggcaaggaccttgtttatttagcttacaattgcattcctagtgcttagcacataaaacatgcccagaaaaaattaactgatggtctaaataaagaatgaacacttgttaatatgtaattagatataatttgggaaatactggtctgaggaaagtaaagtatacagtttctccaaaaaaatactttttttttctatttctttcttatttgtagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacaggtttgcttggtgctttcctagttctattaatttcttggtattaagatttcttaaaaactggcacctctcctcagtaatgatgttttatagaagtatagaatgtcagaattaggagggaccttggaaactgaattctaggccctcttgttttacaggtaagtaaaatgaggattagagagaataatttaacccaatgccacgttgctagttagtagtagaaccatcttatgcatatcctaacctacaatagaattgtatttttattttttgcctctaatgaaaagtctgttataattaactaagcctttatatacagctaaatataaagtctggacagtggcttatacttcatctctagtttgtcagccctatataatgcctatctatatagttagagcctttctgcatatctatactggacttattctacttcttgttttctgaaatgttcccttttttcagaacctctgttgcagagttcttagttttttgttgttttttttttttttttttgagacggagtctcttctgttgcgcaggctggagtgcaggggcatgatcttggctcactgcaacctccgcctcccaagttcaagtgatcttcctgcctcagccctgctaggagctgggattacaggcacgcgccaccatgcctggctagtttttgtatttttagtagagacggggtttcgccatgttggccagcatagtctcgacggagttctttgtcttaattatatccttgcgcagtgtttagtgtgtaagtgttgtcttttttcttctttcctcactgacgtccttcctccacatacctaccccaaaacagtgttcctctctttctccccagcaccaatgggaacaacctgaaatgtagttttaaatatttttcatgatcctataactatgcaaatatatgtgtaatgtgcatatatacgtatgattttttttttttttttttgagacggagtatttctctgtcgcccaggctggagtgcagtgccacgatctcggctcactgcaagctccgcctcccgggttcacgccattctcctgcctcagccgccggagtagctgggactatgcccggctaattttttgtatttttttagtagagacggagtttcactatgttagccaggatggtctcgatctcctgaccttgtgatcctcccacctcggcctcccaaagtgttgggattacaggcgtgagcctccgcgcccggccatacatatgattttttaaaaaatctttgttttataaaattggagttatagtgtttgcattttatcagaaaaaagacaatgacatttttcaaatcagtgaaaacgctttggataggaacacctgagaaaaatttagctctgctgtttttttaaacctaggtaaattctttgaaattgtaaagtatagttttttttaaaatttttacttttttttttagagaaaaggtcttcctatattgcccagactggtcttgaactcctcagctcaagtgatctttctgctttgacctcccagagtgctgggattataggtgtgagtcaccactcccacataatgtaaaatataaattggattttaacattataaacacttagcaaaaatttgaatatacctaaatatttttacattgaaaataattatttctcacttatttcctgtcttgttctaaagaagactaattagaggctaaaaggacccattatactatttagaaatcttagttacttggaatttgtatacttaaaatataatattatagatcacaggccgtggtctagactatctgaatcattatatttagaaaatatgaaatatacaaaaaaatgcttctgtgtgtaaatacatatagtattttccttatatatatatgaacttaaatttttaggtaccactttttaaaaagtatcttatacattttttatataagtatatatagaactcccttaccctgcatgggtttctatcataatgatagacaacaaattttctaattgttctcctattgattatttcaaccatttaaagcttctgctattgcaaacaatgcagcagtgaacattcctatatttgcatcttactacctatgtgcaagtatctctatactatagattcctagaagtaaaactgtgaagccaaatggaataaacattttaaatgttcaaagatacccaaatttgttcctgttctagtattgcaaatctcattttggtgtaagggttaagagagtgggctgtggtaccagactccttggattctgatctagtttgtgggtactgtaggttacaagatcatggacaagttaccttacctcattgacttcagttttctcacatacaaaatagggatatacataagttgtatggagttcttttgttttttgttttaatttttttttcagttgttcacatgtatggcaaagttgtatggagttctaaggatctgaatgagttactagataaaggtgtagaatattgctgacatatagttagtgctcagtatatgttaactattactattatttcactattattatcttagttaatggtatcacctctcatctcgtcactcaggcaaaattctcaggagtcacaaacccaggctctgctttgtagatatatactgaacttaactactctttactatctttcctgctaccaacctaattcaaaccactgatgacacccttacataccacttccatccagtactatcccctcatgtttcctatacttggaaacaccataccgtcgttgtttgtttgttttccccacaccatctttaaagcccaggtcagattgtagcactcttgcttaaaatcctccagtggatttccattgcaattagaataaaatccaaatgctttaccttggcccttaaagccctttatgacttggcttgtctttctctgcaaactcatctcttatcactgtcttctgtgttcactacacttcagctgtagtgcttttttctttaactttttgtactttaaaaatgccaaaacatgtttatactttaggttcttcagcttttggttccctttgcctgaaatattcctccttggacccttctaatggctatttccttctcatcattcaggcccttaatcacgtttttttgttctatttgtgatagaaagctccagggaaggagctcacattcatcactgttttcttagcaccttgaatagtacttgatgtgtaatcgttgcttaatacatagtttgttacttgaatgagtgaaaatggctgctggaaaggctatatctatttatttatttatttttctagatgagatgaatgatgccagattataccaatttagtatccccaaaccatttttccacatctacatgtccaacattaggcaaacttaaattattaccagtcttagaagatggtttttttttttttttttttttttttttaggcagagttttactctttcacccaggctagagtgaaatggcatgatctgggctcactgcaacctctatctgccccccggggttgaagcaattctcctgcctcagcttcccaagtagctgggattataggcacccaccaccacacctggttaatttttgtatttttagtagagacaggggtttcaccatgttggccaggctgatctcgaactcctgacctcaggtgatccacctgcctcggcctcccagagtgctaggattacaggtgtgagccaccatgcctggcctagaagttgttttaatttacattatattaacatatgtaattgattattatttataagagctcattgtatatgaaggaaattggtcctttatcattcatatatatatatatgtatatgtatatgcatatgcgtgtggtatttcttacagttagtcttaagtgttttgcattttaaccatttgttttgtacagaatattccagtttagatacagttaaataatgtagaccaggtgcggtggctcacacctgtagtcccagcactttgggagacctaggcggctggatcacctgaggtcaggagtttgagaccagcctggccaacatggtgaaatcccgtctctactaaaaatacaaaaattacctgggcgtggtagtgggcgcctgtaatcccgctacttaggaggctgaggcatgagaatcgcttgaacctcagaggcggaaattgcagtgagccaagatcacaccactgcactccagcctgggcgacagagctagactctgtctcaaaaagaaaaaaaaaaaagtatgagtcattctctttctgggttttatgtttagaaaagccttcttcctttcaagattataaaaaatttattcttggctgggcccactggctcatgcctgtaatcccagcattttgggaggccaaggtggttggatcacttgagcccaggaatatgagaccagccagggcaacatagtgagactccatctctacaaaaaataaaaaagaaataactggccatagtgttgcgcacctgtaatcccagctccttgggagactgaagcaggaggattgcttcagcctaggaagctgaggctgcagtgagccaagaccgtgccactgtactctggcctaggcgacagagtaagatcctgtcttaaaaaaaaaaaatcttatttatttatttatttattgagatggagtctcactgtgtcacccaggctggagtgcagtggcgcgatctcagctcactgcaagctctgcctcccgggttcacaccattctcctgcctcagcctcctgagtagctgggactacaggcgttggccaccaagccgggctaattttttgtatttttagtagagacggggttttaccatgttagccaggatggtcttgatctcctgaccttgtgatccgcccgcctcagcctcccaaagtgctgggattacaggagtgagccaccgcgcccagcaaaaaaaaaatctttttaaaaaattctccctctcccttcaggattatatttgttgcttcttttttatttaagtaagtttttttttttaaatcagatgactggactcacatatttatttaataaatacatatctttttacgaatgatttagagatgctttttgttgttgttgttgttgttgatgagacagagtcttgctctgtaacccaggctggagggcactggctcagctcactgcaacctctgccttccaggtgcaagtgattctcctgcctttatcacctgagtagctgggattgcagccgtgtgccaccatgcccggctaatttttgtggttttagtagagacagggttttaccatgttggctaggctggtcttgaactcctgacctcaggtgatccacctgcctcggcctcccaaagtgctgggatttcaggtgtgagccactgcacccagcaagagatgcattttttattgtataatgaaagtatcatatgtttgcatctatttctgaactatagtctgctccacatatctgcctgccccccaccactagttaccatttgatttaatcacccacagctttatatttcaatattccaactttaatggcttttttttttttaatggagaagatgcagcttgaggagaggaactttaaaaaataacactgaagtcctgccaaatgatccctaaaagttctgagaaagaggctgggtgtggtggctcacgcctgtaatcccagcactttgggaggctgaggtgggtggatcacgaggtcaagagatcgagaccatcctggctaacatagtgaaactccgtctctactaaaaaaaatacaaaaaattagcctggcgtagtcccagctactcgggaggctgaggcaggagaatggcgtggacccgggaggcggagcttgcagtgagctgagatacgccactgcactccagcctgggcgacagagcgaggctctgtctcaaagaaaaaaaagaaaagttctgagaaagaaagaatattagctgtttcaaatgttaaaatgcactatagaattctagtgattaatgttttaaaaacactgagtgatcaattttaggacctgagtgtgtgtaatgtcttttactgtacatttcctatgtgatttctctacacttcacttttctcacctataaaatgggagaaatgatcagtattatatgtagatttaaagattaaatgagtgtgtgtgtgtgtgtaaagtgcttacttagtatgggacctggctagaggaagtacgcaacaaattacaactgttttatttatctcttttaacaaccttagttttaggtgatattgaagctcatagtggttaagtaacttttccaaaaggtagcagggtaggatttaaacttatagccacatgataccaaagctgtactccaaaccactataaatacacatgccattttatactattagcgcagtttatatttctactgaccttaataattgattgatgatacttattttcctatattaataaggttaatccactaaaattatattgagcacagtagtaccatttgtagagaagcagaaaatcatagtgtttacaaagggaggctcttccactcctagttacatacccaagagaagtgaaaaaaatatgtccacacaaaaagctgtatgtaaatgtccaagtagcattattcctaatagcccaaagtgaaaacaacctaaatgtctgtcagctgatgagtggaaaagcacaatgtgatatatccatacaagggaatgttattcagcaatcagaagcaataaagtattagtaaatgctgcaacatggttgaaccttcaaaacattatgccaagtgaaagaagccagatacaaggccacagtatggtactgtttatatgaaatgtccagaataggcaaattcagagatagaaatcatgttagaccgtcaggggctccggagaagggcaatagggtgtggctgctaatgggtacagagttttgggggtttgatgaaaatgttctggaatcagatagtggtgattattgcacactttgtgagtataccaaaaaccactgaattgtacactttaaagcagctaatttcatggtacatgaattatatctcaatttaaaatggaagaggggaggcttttggtgtttgaacctcagctttcagatttgctacttgttagttatatgtcctatacaagtaacttaactttttccttgccgcaggttttcttacttgtaaaaaaaatgtttaattgtaatatagtcttcagaggattgctgtaaaaattatacataaaagcctatagtaatagggtcttgcaaacaacaggcgctcagtaactgttagccattgttattaatatatccaatttcaacatgggcaaacatgggcaattctgatttacctttataataatcttgtgtgatatgttcagtatttggtatatggagtcagagagtcagagtatacctccaatctaacttttgatttataagtgaaataggaatataatgttagtttgaagtattaaccattcacacttttttacatgagtatcaacttacgaatactaagctaaacacctttatgtattgcttttaaatgtatacttaaaggctgaggtgggcagattgcttgagcccaggagtttgagaacagcctgggcaacatggcaaaaccccatctctacaaaacatgtgaaaattaaccaggcatggtggtgcatggctgtcatcccagccaccccaggaggctgaggtgggaggatcgattgagcccaggaggttgaggctgcaataagccatgattgcaccacggctgggtgacagcctgggtgacagagcaagaccttgtctcaaaaaaaaaaaaaaatagtatacttaaagtgcttcttaataactagtgataatggctttctatattgaataagtttcatggtatggtctagttgaaatttgagaaaatagacttaaaagtcagtttcttataattagggcgctttgtaattcattattaaactgctgccagttttgttgattacttccctgtcagtttaaagtatgtttttaattgatacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtaatttcagtttttttttaatttgtaaggaaattgttaaaaatgcttttcatatctggtttttgaattttatgttcaaattggtgcatggtgcagtaggaccaaaaccaaggtgatgagagtatgacttaagtttttgtgtgattttagtctttgtgaaataaaactacacctgcaaactgcataacatgataaagtgtttgattttgctacttttctaggctggacccaattctggttttttttttgttttttgtttttttttttgaaatggagtctcgctgtgttgcccaagctagagtgcagtgtggtgcactctcagctcactgcaacctccaccatcctaggttcaagcaatcctcctgtctcagcctcccaaagtgttgggattacaggcgtgagccaccgcgtccagccagtcttgtttgtattaatttattttcataaaatcacccaagtatatcctcagagtagaaaccattttgactatgatttacttttttttttttttttttttgagacggagtctcactccgtcacacaggctggagtgcaatggcatagtctcggctcactgcaacctccgcctcctgggttcaagtgattttcctgagtagctgggactacaagcgcctgccaccacacctggctaatttttgtatttttagtagagatggggtttcactatgttggtcaggctggtctccaactcctgaccgcatgatccacccacctcagcctcccaaagggctgggattgtattacaggcatgagccactgtgcccaggctactttttggttttaaccatctgtttaaaccattatgtattagcaatattccccaaattatagaatgcctatggctcgtggtacaaaagatgatttagggtgttatacagattaatatttatattttgtaaatatatcttttccaatactcataggtataaatacaataagcatatcaaatctgtgattttagagaaataatgaggctcagtaaaaaaagagttaatttaaagaaagagtaagtaaacaatattacatgcaaatagctctgaagataggtgtaagtgcttcataaagattgagaaattggctgggcgcagtggctcatgcctataatgtttgcactttgggaggtcaaggcaggtggattgcctgatgctaggagttcgagaccagcctggtcaaaatgatgaagccccatctttaaaaaaaatacaaaaattagccacatatggtggcgcacacctgcagtcccagctactcgggaagctgaggtgggaggatcacctgagcccagggacgttgaggctgcagtgagctgtgattgtgtcactgcactccagcctgagcaacaaagtgacaccctgtcttaaaaaaaaaaaaaaaaaaaaaaaaagattgggaaacacttgattttttttaatacctgcctgatattacagatattacagatgtctgatgcatcaccaatgtagtcttttaaatattgcatttaagtgtcaaaaccagagaacctagggatttgtattttatatattatctcatattattcagagcagcagttttcaacatacacaccccatcccacggatcatattcagaatcttaatatgtaaagcaaatcatttcagagccacccttcttgaaaaagcagaacccagaatgtgcccttccacccgacccgtcccctagtgttttgtctttctgtcttccacctacctcttcctggcatttctgaggaaatataatctaaaaacttagttctaagtaattgtgtgtgtgtgtgtgtgtgtgtgtgtgtgtgtgtgtgtatatatatatatatttttttttttttttgagccagagttgcccaggctggaatgcagtagcacaatcacagctcattgcagcatcgacctcctgggctcaagtgatcttacacctctgcctcctgagtagatgggactacaggcacaccaccacacctggctaatttttttgtattttttttgtagagacaggatttctccatgttgcccaggctggtctcgaactcctgagctcaagtgatcctcccgcctctgcctctcaaagtgttgggattataggcgtgagccattgcacccagccaatatggctattcttaacaaaggtttggcagagtattatttttaaagttgaatgtttgtttcagtatcttaaattatttaacctccaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaagtaaggtctctttgatttagtctttcatcctactttcaaaaaaaattttttttgatagacaaataataattgtatatatttgtggggcacaatgtttagatgcatgtttacagtatggaatgattaaatcagaccaacaaatctatcacttcacatacttaactttttctgtggtaaaaacatttgaagtctactattagcaattttgaaatatacaatgtattattattcattacagttgctgttctgttcaggtttttttttgtttttaattctaatttctttaaagtcttctaactcagaaatgatatattttctaactggtattttcttttatgtctttacttgatatgatttctatgtaactgacaactctgagccttctagaaccatttccagatgtcagtctttggctatattaacagtctggatgaatcagaaatcggaagaaaacttcaaaaatacacaagctcaggcctcaccctagaggatctgataatattaggttccagatacagatggagaaatttttttttttttttttttgacggagtcccgctctgttgcccaggctggagtgcagtggtgcaatctcggctcactgcaatctccacctcccgggttcacgccattctcctgcctcccgtgtagctgggactacaggctcctgccaccatgcccggctaattccgtgtttgtatttttagtagagatggggtttcaccatgttagccaggatggcctcgatctcctgacctcgtgatctgcctgcctcggcctcccaaagtgctgggattacaggcgtgagccaccacacctggcggagaaatttcttttatttaatttatttatttatttatttatttatttatttatgagatggagtttctctcttgttgctcagtctagagtgcaatggtgcgatcttgactcactgcaatccctgcctcctgggttcaagtgattctcctgcctcagcctcctgagtagctgggattacagacacctgccaccatgctgggctaattttgtttgtattttttttagagatggggtttcgccgtgttggccaggctggtcgtgaactcctgacctcaggtgatccacccaccttgacctcctaaagtgctggaattacaggcatgagccactgtgcccagcctattttattttatgtatttattttttgagacaagagtctcgctttttcacccaggctggagtgcaatggcactgtcttggctcactgcaacctctgcctcccaggttcaaggcattcttgagcctcagcctcccaagcagctgggattacaggcgtgcgccaccacgcccagctaatttttgtatttttagtagagatggggcttcccatgttggccaggctgatctggaactcctcacctgaggtgatccgcctgcctcagccttccaaagtgctgggattataggcatgagccactgtgagatggcgagatttctaaagattctccgtattgccattatatataaaagagtctatttttgagtgatagaaccttaatatttatatatgaaatgttatctgagatttgcttcaaattaattctgtgggagaatgaaatggctaggagtataaatgaaataagattggctatttggtaatttttgaaactgattgtatatggtgatttgtaaaataattctctcatgtttgaaatttttcattatgaaattttccattaaataaggatcgtaggctaggctcagtgactcttacctgtaactgggcacggtggtgcacacatgtagtcccaggtacttgggaggctgaggcaggagaattgcctgaacctgggaggtggaggttgcagtgagccgagattgcgccactgcattccagcctgggtgacagagcaagactaagtctcaaaacaaaacaaaacaaaaaacggattctaaagtaaatttttttttttttttttttttttagatactcgctctgtcgccctggctggagtacggtggcgtgatcttggctcactgcaacctcagcctcccaagtagctgggactacaggcacgggccaccacacctggctaatttttgtgtttttagtagagacagggttttgccatgttagccagggtggtcttgaactcctgacctcaggttagccacctgcctcggcctttcaaattgttgggattactggtatgagccactgcacctggcctaaagtaatttatatcctcagcaaatttggaaacaaactcagcaaatatttgagtttctggtacgtgctaccacaaaactagacactaaatatcaaatactaggttaggcaaagctcctaactttatggaatttaaccacatgagcagcaaataacatagtttcagatagtgacaactgctctgaaaaagtaaactagagtgatcaagtggagtgtaactgggatggtaacctgggaacaaggtgttatattaagtagagtggtaaaggaaaccatctctgtgagggggtgacatttgagtagtgacctgaatgatgagaaggagccagtcatgataatatctggggatgagtattccaagtggaggaaaaagcaagtgtaatggcaagtgtgggtttaaaagttacagaaaaaagcatgaaagccagtgtggctggacatagtgattgagagggagagtataggaaatgaagtctgagatacaggcaggagccaagttatatggggctttgtaggatatagaaaagattttttaatttattgcatgctcattaaagctagtggaggattttagataatggagtgttatgatctgattttcattttttgaagaccattctaattgtttcgtggagaactgaaggatgttaagagtggaagttaagatactaactgattaataaactaaagaccaagtgagatgaagatgtcttggacttgtggaattcgtggaagggatcaggtgtaggataaattttgaaggtaaaagaaaaatgtaggtataaaacatcccaggataatagcacatgaaacagtttaaagaggttaatttgaaattcaagaccaggctaggcaaaatagtgagaccctgtctctataaaaaaatattttaacttagctgggtgtggtggtatgtgcctgtagtagttccacctactcaggaggctgaaacaggaggatcgcttgagaccagaagtttgaggttgcagtgatctatgataagtgccattgtactctggcttcaataacagagtgagactccatttctaaaaataaaaaaaggtgaactggtaaggtgacatggggcaggcagtggattactttttagaaattaataagccttgtgatatttgacattttaaatcattgtgattacaataatggttaagacaataaacatgtcccttcagaaaactacagagaaacatctccttttagtatagtatatgttttaatcatatgataaaattaagcactcattgtgtgtgccacagtatacagaaaagctcttttgtgtatgttagattgagttcctgcagggtaaggatcatagtaatttccatatttttagaatttgctgggcttggtggctcatgcctgtaatcttagcactttgggaggccaaagtgaaccgattgcttgtgctaaggtatttgagaccagcctgggtaacatggcgaaaccctgtctctaccaaaattacagaaattagcccttggtcccagctgttcgggaggctaaggtgggaggattgctggagcctgggaagttgagtctgcagtgagctgtgatcacgccactgcactccagcctgggtgacagagagagactgtttctttttttttttttttttttttttgagacagtcttgctctgtcatccaggttggagtgcagtggcgcaatctcagctcagctcactgcaccctccgcctcccgggtacaagcagttctcctgcctcagcctgccaagtagctaggattacaggcacttgccactatgcccggctaagttttgtatttttagtagagacggggtttctccatgttggccaggctggtctccaactcctgacctcagatgatctgcccgcctcagcctcccaaagtgctgggattacaggtgtgagtcaccatgcccggccaactctgtttcaaaaaaagtaattaaaaaaaactacagtttgacccagtgtctggttccccatggggtgagccccaaagtaggtctgcagtttatttagaataattatagaaactgaggacaaagaggagcaaaccatgggatctttatttattctccttaactctgtaaactgcagactactttctagaataatgggggttttcagattggaattttaaaaaatatccaatcttgtgtttttttttttttttttttttttgggagatggagtgttgctctgttgctcaggctggagtgcagtggtgtgatcttggttcactgcaacctccacctcctgggttccggagatccttctgcctcagcctctcaagtagctgggattacaagtgtacgccaccacacccagctaatttttgtatttttagtgaagacggtgtttcaccgtgttggccaggctggtctcgaactcctgacctcaagtgatctgcttgtctcggcctcccaaagtgctgggattaaagatgtgagccaccatgcccttgttttggctttttttttttttttttaactttagaaacagatctgagttaattgatagaatgaagttaattgctttttcagagcaattaattaactctgtcgatcccaacacataactagatgtaaatctaatctttgctcagcattgatttgggttgttgatttggattaaatactttctccagtgttgtctatgatggttttggtgcttctctgggatccttctcgcacttttggtctgattcgtgctctggttcccactgctgagtattcatagatgacacgcaactccagggcttccagtcccccttagatgtcttgttggaccagtgtttctgatgttgaagtagtctgtgaaagataaatttatttgccttgcagcttcattggttattgattactttttcccagcagtgagtagtggtatgtagtatttatagagactttcttttaaaatgatccatatttttctttagaagctgtgctttgggcatacctaataatacttggcatattagaagcattttaaaattttttatttaatcttaaatcttttgttgagatttgacatttttatttattcctttttcttccccctaaagagtgtagacatttatttatttattttggcttataaacaacagaaatttgtttctcattgttctgaggactggaaactccaagattgaggcgccagcagatgtaatgttttgtgaggacccatttcctggttcatagttgatgcctcttccttgtgtcctcacgtggtgaaaggagctatctagctcttggtgttattttattaaggacccttgtaatctttaatgatttgggtttgttctttttcagttttagtttttgcttcctaggttagacaccaagacagatatttttaaatccttgaggccaggtgcagtggctcacgcctgtaatcccagcacttggggaggctgaggcaggcagatcacctgaggtcaggagttcgagaccagcctggccaacatggtgaaaccccatctctactaaaaatacagaaactagctgagcatggtggtgcatgcctgtaatcccagctactcaggaggctgaggcaggagaatcgcttgaacccagaaggcagaggttacagtcagccgagatgacgccactacattccagcctgggtgacatggtgagactctgtctcaaaaaaaaaaaaaaaaaaaaaaaaaacttggaatgaacaaataacatacctaaaatatttaaatgctctaaaaatttccattgccatcaagttcaggagaaatcaacagcttgttttccaggcttcaaagaaagttgtcttaaatataagtaacacaagttaaaaggtaccatggtttagtttatatgcagcctgttaaaacgaggtgttttcgtttttgtttcttatagaaatagggtcttgctctgatgcctaggctgagtgcagtggtacaatcatagctcactgcagcctcgaattcctgggctaagtgatcctcttgctcagcctcctgagcagctaggattacaggtgcatggtgtcacacccagctaattaaaacaaattttttgtggagatggggtctcgatatattccccagtctgatcttgaacttcttacctcaaacttctcttgccttgctctcccaaaacacagattacaggcatgagccactgcacctggctaagatggggtgtttatgtagcatcatcactaagagctaaaaatacaaccaggtgctgcttgagtcttaacccttttttctaaagttactacatttcaattatatgttaaaggtacctcaatgactaacacattatatatccttcccagcagctcttctctagttgtgagaaaagaacctgatgtacctgtgttctttccaagtggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattggtaagaaaatgtagagcatttcatctttttgagaaggttatttagtataggatatactagttaagcttttcctaggtttaaactgattgagaccttaagataaaaagattttttgtctaattaacaatgtaatttttcttttagcttttcataaattataacttaaattcactaatttaccataaacatacttaagtacttagaaaaacacagctttatttttaaagtataaatattgatattatgcctaattcaaaccaaaattagtattagaaaataagcaagagtttctcggaaatttgaaaattggaaagtagtgggatatttatgataacatttactgattttagttcaggtaagccaatgtttattaaatacttagcttagtctaagacagtaggctaagtgaaatcgataatataaaggtgaatatgacactctgtgcccttgagagcctaggggaaacaacagcacatgcagactagtaacaattataagacaggctgttgaggagtagtagtgtaaagcaaagagaacacagaataaaggggtaattctggttggaggaactagtattataaaacttaaaatgtgatctgggacttaaaggatagagaaaccctgactgtcactttcatccaaattgtagaacatttgatttgtccatttgcgagaaggcaacatacttcacagggccctatgtattcatcaatgaacacatatttgttatttgcttgctaggtcctaggctggtgctagcagcttgtatgctcagggaatgaaatatgcagaaatagtatcacaggtcattcttactttgagaaagtgagaagaaaaggagcctaactctgtgaacatcataaaggcctaatttataactgaaacattatcactttgcaaacgaaagcattatttaaaacttgtttataaaaaatttagcataagtcctcgaaaatacttggagaattactcaaaagatttttttttttttttttgagacagagtctctgtcacccaggctagagtgcagtgacatgatctcagctcactgtaacctctgcctcccaggttcaagcgattcttgtgcctcagccttccaagtagctgggactacaggcacctgccaccatgcctggctaatttttttttttttttttgagacagagtctcactgtgtttctgttgcccaggctggaatgcagtgacatgatctcagcttactgcagcttctgcctcccaggttcaagtgattctcctgcatcagcctttcaagtagctgggaccacaggtgcacgccaccacacccggctaatttttgtatttttagcagagatggggtttcaccatgttagccaggctggtcttgaactcctggcctcaagtgatctgcccgccttggcctcccaaagtgctgggattacaggtttgagccacacgcctgtactcaaatgatttttaaatacgttggtttttatttttatttgtttattttctattttatttatttattttttttagacagagtctcactctgtcacccaggctggagtacagtggcgccatctcagctctctgcaacctgggccttctgggttcaagtgattctcatgcctcagcctcccaaatagccgggaccacaggtacgtgccaccacacccggctaatttttgtatttttattagagacagggtttcaccatgttggctaggctggtcttgaactcctgacctaaagtgatccgcccaccttggcctcccaaagtgctgggattacaggtgtgagccaccacgcccagcttatgttggtttttaagtgaatgaagtctgaacaagcattctgttttctctagggtctgatgaaattgttcattaggatgtgcttctataaaaacttcataatacctgcaaataataccataatacctgcctacttgatactttgtggaatttgacaagatactgattttccctggccttgttgtatcattaaggtcttactgtaaaattgttttttaacttttttttaattttaatttttttagagacagagtctcactttgtcacgcaggatatagtggcacaatcacggctaactgcagcctcagcctcgtggctcaagtggtcctcctacttcagcctcctaagtagctggaactacaggcgtgtgccaccgtgcccagctaatttttagttttttgtagagacaggatctcgctgtgttgcccagggtcttaaactcctgggctcaagcgatcttcctgccttggcttcccaaagtgctgggattataggtgtgaaccaccacacccagccctaacattgttaatagtgatttttcaaaaaaattttttttctttttgtcagggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccaggtaacttttaaaattttgttttaaagagtgaataaattttattttttaaaaatttttatttatttttgcccatcattggctagatgaataaattttagatgtattgtggcaatctcatcagaaaagttacgtttgtgcctcaattgagttgattcacgatttattcagggcctaccatatgcatgatgaataagagattcttcattttagtgggagagagggttacatacataagtaatttgagagatattgtgggatgactcctggctggataggccaacaaaatactttaggagtcttgaggaaagagaaaggagttttgcttggtagcatctgaaaagtctttctggaggtgataaggtctgttccagctactggatgtacagttacacagtcgtgccatctaaaaagcaaaaatatttcttttttctgggaatgtgcccaactggtcatgtccttctgttcagattcctttctaccaaagatgacctcagcacataacttattaaaaagaaaataaagtctggagattatattattaaggctggcatattttctgttaattattttttgttttctaatttaaaaagtaataaaaattcatggttttaaaaaacaatacagaagagagtgtaagataaaatgcaaaagccacaactccccacattcctgcctgactcttccaaagttacttctcttaggccgggcgcggtggctcacgcctgtaatcccagcactttgcagggctgaggcaggtgaatcatgaggtcaggagttcgagaccagcctggccaagatggtgaaaccccgtctctactaaaaatacaaaaattagatgggtgcggtggcgggcgcctgtaatctcagctacttgggaggctgaggcaagagaattgcctgaacccggggaggcagaggtcgcagtgagccgagatagcgccactgcactctatctagcctggacgacagagcaagactcagtcaaaaaaaaaaaaaaaaaaaaggccgggcgcggtacctcacacctgtaatcccagcactttgggaagccgaggtgggcggatcacgaggtcaggagatcaagaccattctggctaacacggtgaaaccccgtctctactaaaaatacaaaaaattagctgagcgtggtggtgggcgcctgtagtcccagctactcaggaggctgaggcacgagaatggcgtgaacccaggaggcagagcttgcagtgagccgagattgcgccactgcactccagcttggatagcaaagcaagactgtctcaaaaaaaaaaaaaagcaaagttacttctcttaaccatttcttttgtattctagaaatgttccatgcatgttcaagtatatgtgtatgtgataagctttgtgatttgattttttgttgttgttgctgttgttttaattttgagacagtctcgctctgtcacccaggctggagtgcagtggcatgatcacagctcactgcagcctcaacctcctggactcaagtgagcctcccatctcagccttttgagtagctggcactacaggcttgcaccagtacttagctaattttttattttttgcagagatggtgtcttgctatgttgcccagtctggtctcagacaaactcttagactcaagcaatcttcccaccttggcctcccaaagtgctaggattacagccgtgagccactgcacctggcctgtttttttgtttttgttttaaacatgatattataatatcttggatacttttccttatagggatatacagttctttctcttgtatttaaacagctgcataatattcttttgtacccttgtactagaatatattgaaccccagtgctctattaatggacctttaggccaaatctcttatttgttatttcaagcaatcctaagtgaacatcattctacaggtacaagtatctttgtaggataaattcctagataggcaggatcaaagagtatgtgcattcaaagtcttagtagatgctaccattgctcatcaaatagttgtaccagtttatattcctaccaatagtgtaaaagagtgaggctagcatttttgagttttttatccatgttgcaagatagaggctatgtatcctaacccttcccctcttgtcagaactgagaaccaacttgtcacgttagttgtggtttcttactattttaatgttgctgtgatgatcttttgcaaatattgcttttcagttttaggattatttccttagaatagaatctcggaaatggaaagactaaggtaaaatgatacaaaaattttaaagctgttgctaagttgctttctgaaagagtaagtattattaccagctacacatatacatgtgtgccagctaccatttcaccaatacattcacttcaacaaatacttactgagtttctatgagccagcctataagagatatcgtaatacacaagataacctgataaagaaagacatctttgttctcatagagtttacagttcagtggggaagacacagatagtcaatatcttttatgcctgctatgaaatggaaggatagggaatgccatggaatcacataggaaaggtagctaacttaatttataaaggaaaggaaaaaagaaaggtagctaactttaggagtatttcatactgtgttgtaattgatctacatcaaaatggccccttttaaagatctgtactaattaagaccaaaaatatcttaaagttttgaaagttatattttattattgatgcaatatctgtatatttaaaacttttttttagtttttaaaaataggatcttgctctgtcacccaggcctgtcacccaggctggagtatgatggtacaatcataatttatgtaacctcaaactcctgggctgaagccaatcctcctgcctcagctttttgagtagctgggaccacaggcgtgtgccatcatctctatgtcattttgattaaataggaaactgtactgcaatagtttctccaacataagagttaaatttagtttccctgttatcttaggctccgtctggaatatcctcccagcctatctgaggcctacctgattaattcgcattgtttcagtttgacttaaacttagttttttagtataatgtcctaccattctctaccaagttccagcctacttgccattggcatttgcaagattccttgatgttacttttatctgaggtgctctttttttttacctttctgcttgccaaaatccttatccttcaaagctgaactcaaatgtcacctctttggtcagtttcctggacctctcagagtgtattgatgttttgtactcttattgcccaggctggagtgcagtggcatgatctgggctcaccataaccttcacctcccggcttcaagtgatttctcctgcctcagccttcctgagtagctgggattacaggcatgcgccaccatgcccggctaattttgtacttttagtagagacagggtttctccatgttagtcaggctggtctcgaactcccaacctcagatgatccacctgcctcggcctcccaaagtgctgggattacaggcgtgagccaccgtgcctggccgatgttttgtactcttaaaatacctcgttctcagtaaattgtagcatgtacttatgacacattttcagcaagatttttttttttttttttttgagatggagtctcgctctgtcgcccaggctggagtgtagtggcatgatcttggctcactgcaacctccgccccccaggttcaagcaattcttctgcctccgcctcctgagtagctgggactacaggtgcgcaccaccacgcccagctaagttttgtgtttttagtagagacggggtttcactatattggccaggctagtctcaaactcctgaccttgtgatctgccagtctcggcctcccaaagtgctgggattgcaggcatgagccactgctccagcgaagattttatatagttctaaatcctcattgcctctaccactaacttagtgggccttcaatgagtcatttgctgaatgaacgacattcctcctactcaggtcatcaccgacgcttacagtgaaggttcatttttagtgtctttgtagtatttactgtcagtatttataatcttatattgttaactttttaacatgtgtaggtataatataactggtatactaaaagtttataaggccgttgtttagaatgtaagacacatttttctatagaaacagtgttacagattataggttgaatattctaggaaactaatccttataatccatgctgttcctctagctctgtaaatcagccgtcttttatcattgtgtctatgtgaaaactcatttcatgttccagttctggactccaggagcacatcattccgccagaagagtggctaaggcaggggaaggaagacctgctttctattttcctgttaatagaatgccgcagagattaagagagtctaaaggcaggaaggcagggaaaaagggtgccagacaaacctagaaattgtgcaggaaatggagattgtgggttcgaggtctggaagcaacctctacatattcccaattggagtgactttttgaattcaaaacctgtctcaagtagtctctctagttgcttctttaccttgcttcctggctatctgcttagtagttgaaaaactgtgtaggataagtagtagataactaatctggattcaaataggatcatgaatcaaagttgacttttttttttttttttttgagagacagggtctcgctctgttgcccaggctgcagtgcagtggcacaatcatggctcaactgcagcctcaatctcctgggctcaagtgatcctcccactttagcttcctgagtagctgggactacaggtgtgcagcagcacacccagcttatttttatttgtagagatgggggtcttgattgtcatctgagttggaataattttagagcttcccataaattgttgacatgtggctaactcaaatttattcatggactttcatcattccttgtggctgcacatctaatgagattttaacataggcatatatttgtgctcaggcttttaggatttgattagtggaatgggttcctttttgcttttcgtcttaattaccctagtgtttatatgctttggtttctgagtattattgattttttttttagtgatgtggtctctattttgcctagggtggccccttgaatgcctgggcttaagcaatcctcctgcctcaggctcctgagaagctaggactacaggtgtgcataccactgtgcctgtcttgatttgttttgctattaaagtaatgatatctcattgcccctagcccaccctccaaattgaaattggctagcttgtgttaggcattgaaacttgaatagccttctaaactgatattgactactttatggatcttttaaccattctataaaagaagccctagttaaaattaagaggctgggcatggtgtctcatgcctgttatcccagcactttgggaggccaagatgggaggatcactggagctcaggagttcaagaccagcctgaacaacatagtgagaccccatctttacaaaaagaaaaatttttgattagctgggcatggtggcatgcacctgtagtcccagctacttgggaggctgaggtaggagggtcacttgagtctgggaggtcgatgccatggtgagccatgattgcgccactgcactccagccttagtggcagagtgagaccttgtctcaaaaaaaacaaaaaaaaaacccaaattagacctgctttctttaaatatttaacattttgaattagtagtttttctttgcttttatcaaattatttacattaacattatctatagactgaggaaataggcaaagtagaaaaagacttccaaaagtattgtcactatgaataaaagaataatgtctggataaattagtagtatctctttcatcttattaaaatagtcttcaaagcattaaatgccaagaagattaagggagaatttcaaggttgtaaagaccagcattagtgagcacactgttccattgtttggtgatggcatcactggtttcagagaatttttttttttttttttttttttttttttttgagacagagtctcactctgtcacctaggctggaatgcagtgacgcaatctcggctcactgcaacctccgcctcctgtgtttaaccgattctcctgtctcagcctacagagtagctgggattacaggcacccgccaccacgcccagctaatttttttgtatttttagtagagacggggttttgccatgttggccaggttggtctcaaactcctgacctcaggtgatctgctcacctcggcctcccaaagtgctgggattacaggcgggagccaccatgcctggcctggtttcagggattattagtggttggaaatagttttttgcgaatttcaggtgcttataagaatgaaaatatataatggttgtttgatttttgtgggtctgtgaatgcaagcagtggctagcacatataaaacagctgaatttcttcatgggatgatgtagaaagccatagcatatttgactagaatataatgttcaccacaacaaatagtgcacaaaggactctgatagaaaaaatccaagttactgaatatagtacagtaaaagagtggttgcagagccccagagagtaaggcagtcatggattatctcagcttgctatgtactatttagcttggaaaaaatagctcaaatctctattcctcagttttctcaactgagagtaaatataacaatagtacctactacttttattcattcaacaagtacttactgagtgcctactatgtgtgtccaggcatcgaggatactgcagtgggggccaggagaacagacaaaactctgtccttattggctttcatgagggtgctagacaataaataagaatcgagcattgattgaatatgtagatgtgtgtattcaatgtatagaccgcggtaagtgctaaaaagaaaacaaaaaagtaggggaaagggaatgtaagatgttgaaatggagaataagatagaaatattccatagagaatacctccctgacaaaggttactgtaaggaatgtatatgaataatgcatgtaaagcattaatagagtacctggcatatataacgactcagtaattagcaggctgggtacagtggctcacgcctgtaatcccaacacttttgggaattcgaggagggaggctcgctttacctcaggagtttgagagcagcctgagtctgtaattgtgccaacattagcaaatgacatgcagttgccactgtactctagactgggcaacagagcaagaccctgtctccaaaaaaaaaaattagcagctatttattatatatgtgatattaaggaaaaggtaagtcagttgacttaacactaatcaaagtaagttgaagattataactaatgaaaaaagtattcgtgtgtgtgtgtgtgtgtgtgtgtgtgtgtgtgtgtgtgtgtgtgtataagcccatatccagagactggttgatgttttttattaattgcaaatggaatctcttcaactatgaacaatttaattttctgagctacttactaaagcttgtactgttatataatcaaatgtgttttgtgtttgattttatttttatgttttactttacattaaacattagctgatctcttgtgctgtttgggctaatagtcgtaaattaaatgactcatagctatgttgatgacttttacatttggggccttgtatttgttcttaaaaccatgactgatatacagatttaggaaaattaatttgtattccactttaaacctgtaaatcatggattaccttctaggctattatttgtatccctttttttattttttctttattttttcttttttaagagacagggtcttgttctgttgcccaggctggagtgcagtggcacgatcatggctcactgtaactttgaactcttgagctcaagcaatcctcctgcctcagcctcttgagtagttgggactataaatgtgcaccaccatgcctggccaatttttaaatttttttgtagagacaagatcttgctatattgcctaggctgatcttgaactcctggcttcaagcaatcctcccacctcagtgccccaatctgctgggattggaggcttgggccactatacccagcccatatgtatcctttgtgtatctggatcatcaagacttagatgtctgagtagttagataaaaggaccatgaacttaaagctgaagatcttttgttgcttgtatagaatggaacacattgagaactatgtattacttagaatatggtaaatgatggcttactactttgtgtctttcagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacctgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgcccgcctcggcctcctaaagtgctgggattacaggcgtgagccactgcgcccagctatactgtatattttaagaagttccagcatgttgcatctctgcatttatcctatatcattaaaagaacataagttatcatggtgttgggtaaattagcgaaatcaacccttcctaagtttaagggaaaagttatttttaaaaacaacttaataaaaacttacactcttttatacaagagtgtatttccccttaattaggatgcatgttgattaaactcgagatacagctttttgcagtatggtgggttggttttggtgtaacatcttcaacatgtcacactggctatcaaagaataagaaaattattgagtatgagtgtgttttataaactttctgagtttttcagatgtcttaatattttttaatagaacttaataaaatgtctagattgactattttc

SEQ ID NO: 508 - DNA, 14863 bp, Homo sapiens
atcccagcccagctctgcatctgtcaacattctcggcccggcccgaggcgctcgacccgtccccattggccccagcccggcccggcgcccgcccccggggcgcgaacgccgcctcccattggctctgcgggccgccgctctcccttatgtgtcaatttgagggcctgaggcggagggtggcggccgagcgccggagtccgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgaggtagcgctcgcaccccattgtgcgcccgcggcggtgggcgggcggcggggccgtgccgggcgggggccgctgaccgcgccgtgtgtccgcagaggccgagcacggctacgcctcggtgctgcccttcgacggcgacttcgccagggagaaaacaaaggcggccggcctggtgcgcaaggccccgaacaacaggtaccgccccccgctcccgaccccgcccggcccggtccgaacccccgcccccgcccggagcgtgctctccgggccccgattcccggcccgcggccctcagcgccgccgccgcgcgccccggcggccagcctggaggaggaggcgcgcaggccgcggccgcagccccgcccggccggccccgccctcgccgtcgccatcttcccgcggccgcgcctcccgggccgctcgcgtaaacagtgccacgcgtacagcgcccgccgccggggtccgctcccgcgcccgctccccgcccccgagttgttctggacttttccaggcggtagaaaagttgtcagcgggcgctggccggtgccccgtgggtctggggaaacaggctcagccagggtctgcgggggctgccggccctaaccccttctctccgcgggtgggtgggcggcctcctttcgactggctctgccagccgaactctgctgctcggccaccttcccccgcccccaggagcctagacagagaagcgagtggaggcgctgtcctgggccctcactcctcccagggtgcccaccgcttctgcccagcctcctgacacagcgaaactccagccaccagtatgggggtcctcttttttaagacagaggccttttaagggggcgggaggagggggcaggctgcagggcaggggccccatgaagtcgttactacgggtgccagctgcgccctccataccttgacctcgtgttcaggcagcagaagccctgaagctggggtgcgtacaggtcccccgcgtggggagtggggaccctgggccggggctccccggggatttccaccctcctggctgctgtgaggaccatagcacacctggtcctgtctgggcccaccttggcccagcccttttgtgtgagcaggctgggagctgcgtttgtagggggcttcagagccccagggcatggctcattcctgtggtccacctgttctagggaatccgaaaggctggtgtagggacccatttctgtggcatcctgagccaggcgaggaattggttgagtctccagctgccctggctgggacccgtccctgagtcccagcccctggtcccctactggggacagtttggggaaggacaggagtgtgacgagggaaccattgcctcaggcctcctcagtgagcaagcccggcccccgctgccgcttctctccaaaccaagtccctgacccgtggagaactctggggcgtgagctggggctcccccagcatggagaatccaaagctgacaaccagcgtcctggccaaggctgcccgaacactgcctctatgctgagcgtttcacacatgcagccagttcatcttcaccccaggctcagagaggtgatgtgatttttatctctatggccaaggaaactgaggcaaggagaggtttggttacttgcctgccactcacccatctctgatgacgcctgttcctgagatggggtcccagctgtccacattctgctgggacagagaccatgggggcactggtgagggagacagagggctccccaactctggtgcatctcccctggctcctctgggccgagccccgctcccccggggcctgaggcagcccagggctggcggcttggccccttcctcgggtgggcagcactgccctggaggtttcctcagccagcccagacaagtagctgggcggagcagggggccagaggatctctgagcccctgacttgtccccacctgtgaggcttccatgctctgccaaggtgagggaggggacatggcacagtgaggctggggcaagggtagggagtggggccggaggacagtgtcagggttgagggaggcggcagagcactggggccagcctgcaggggggtccattctgtgggaagtgtgcttgtctcctggggtcacgggaatgctgggaacgcacttggcctggcctcagcggggacaggtcccacctctcctgagggatagagtgctcctgggacccatgttgcaaacatccccctcgatggaccccaagggtctctgggcccaggaggagctgcaagaggggccctggctgctggaggagggccccctgcctccagggtggggtccagccccgtgccacccttcaaggggtaggcaggtaggcttttatgttgaagggcacctgctgaccccgacctccctcttgactacagacccacgtggccaggctgcagtttgggctgaggacagagagtacggctcattcctgcggcctgcctattctggggaagcagaaacgctggcgtaggggcctatctctgtgaggccagtgaggagcatatggctgtggcctctgctggccctggtcggccctggctggccctggcagtgattcggaggctccttgtccagcccatgtgaccaacaggccctcccggaccctgagacctgggtctggaggctctgctgaggctacacaaggaggcccagggcctgttggtgcagcgggtgggaggggcaggcccttggcctgagtggttgggacaggagacgccagatcccaagttcctgaagcaggcagtggtcagcaagaagcttcaggaaggagccaggtcctgagggcagggagaggcctcagggctgggtctggaggtgccccgaggcagtctgagctctctgcccacctgtgcagcggcatcctgggaggcccgggagccctggctggcctgtggggtcctgcctggacacggaaggtggcctggagctgggagcgaggtccccctgcctcgttatcctccaggcagatgctgtggcacaccctgtggtgctgggaattgtgtgcccgcgtctgaatgggcaagacaggtgagcagcaggtggggccactgtccccagagaagctgagcccgggcctccagggcagcccatcctgctagcacagcccctgagggaagtgggagggctggcctcagtgtccccctgtgcctactggcctgggaagcatccacatctcagaagccccctcatgggctgacctggctgacgctgctgtgtccctggtccccattggtaaggtgggctgtggtcacgcaggtgtgtgagcccgagagagtggtggtgtcaggacaggaccacctgtgtcctgagggcctggtctctgggctccatctccacctgctgtttgtcccgggtgctaggctgctttggctccaaggacacagctggcctcagggattggggagcagggaaggcaggtggctggtgggggtcagcgccaggacctgttgctgctccctgggcctcccccatccctctggaagggggcctaggtcctcctgtcagccagattcaccacgggccttgctaggtgggctggtggccctgggcgccctggacctgcctgcagctctgggcctccctgtaagcaaggctggcccctgctgctgcttctcaccaaaccaagtccctgacccatggagaactccagggcgtgagctgcggctcccccggcacggagtacccaaagctgacaaccagcgcccacccttagcatgtggttccccccaccctgggtgggcaactgctcacctgccccaggcctcactgctctgggccattccaggacccagacacagccagccactgtctgcaggtcctggccccctaggagagcactgctctctgtgccctggtgggcaggcagaagagtgagctctgtctttctgtctttctaaacaggtcttcacacaacgagctagaaaagcacaggtaagtgaccccccagttccccacatgagcccgacacctggcccacccttttactgagggtgtgtggtgcgttgagcctgcccctgtcccgggcacggccagccgtgctgccaggctgtgtccttgtcttgggaatggtcagacttggaggagaaggctgaggtctgtttcaggcactctgtgctagaggcaggagatggcaggaggcccaggccctgctttccagagctcatccaggtgggggtgagagatgtggagcagggccccttgtgctgtgtgacagtcagggcccttggctttcaggacagtggtctccaatcaggagggttcggctctctgccctgtgcatcctggggtctgccttccaagaagccgtgctagagtcttgtccgaggggcagatggagggcagccagtccctggccgcctgggaagctccagcctagggcaggattcaggcgagctcttgagtaaagctgcggggtgttcattcctcctggtgacagccggaggcagctagggctgcaggctcagctctgctggtggggatgaggtgcaggtgagctcaggggcctaggggctggcagcgggagccctgggtgagtgcagaggcagccctagaggcaggagcccccatgccaggaccaggaagagtcccctgagggatgctggtccttcgctctctcctgacttgtgatcctgtctgtgaaatgggtcagctctgtcctcccttcctagtggggcaggtctgcgtgctgcttgagccccccacagtcccctccagaaagatttggtgctcggccagttctccgcctccccaccatgtctacccccacagcagcaccaacttccgttctcccgggattcaggccgctggctggggcgggcagctgggcagggacagaacgcagtgttctctgaggaactgcacttcctggacaggtcatgtgtgtttcggggggttccctagaggccacagaggtgggggcaggtacagggcccaagagaaccaggcaggcctggaattgttccaggcctaagaagaccagcctagccttgaccaggacccaggagccggggcaggcacgtgggggtgttcagggaaggcttcctggaggcggtccctgggaggacagccccccaatggggacagattaaggggcagtgacattgggggagggtgggtggcaagggcgtggcagcccttggggaggacaggggacccctgcagctgccctttgacctggctttgccctctgtcctctcctcccagaggctgcatttagccagggcctcatggggccttcttgagacacagaggaggggtgtgtgggcagccagggtgtctctgtggactcccccaccccagtgcagggggtctctgtctctggctggccaagaggcggatgtggacagccccaagcacctacaggcctggagcttggggccctggatcacagcctacctgatgccagctgctcttggctgcaggaagggctgcgtgctgtcttgagaaaggaaggaagcccctggctgggccacccagccatccccgggaggcaggccctggacatcgctttgcccggagttgtccccttactggggactgggcagggcctgtgggacttcccctgtgggtgctctgagccaagcctgcccagccctgctcctcatccctttgtagagaggcagctccagcaggtctgaggccgttgccaaccccagggtcctggggaccgtggaggcctcgccttcttggctgctgacctcactggccccactccaggctctgatcttagtgtgttttgggggaaggtcccagccttctttcctggcccttgacagccgctgaatggcaggacccatcccaaaggccagtccagagtcttcagctgagtctctgccccacattcccccaggcacgtccaggaggtccccaggagccccctgcagcccagcctcatgtgctggtgcagcctcacacggctttcacatacctcgggaagttctgttggcaacatctagaaaacgcaggcagagggagtgggaggcacgcttgctcctgggccacccccagctccccggcagcggcagccaggctctctggttggctgggatgctggcgtggagccatgccctctcggtgccctgggtccccctctgggcatgggggtttttgggggagctgggaagtgctgcgtcagaggtggggctgctgtcgataccagcccagcgtgctagtcctgcaggcgggttctgcctcctgaatccacacagggttccttcaggaagtggaggttttaaaagccctttggatgcccagggacagccgtggggtgctggcagggggcccagggcactgcagcggcttcaggaggggagggctcagcaggagcccagtgcagccccgggctgaggggcttcatggctcagaggggtgggtggggatcttcctggggtcccgcaaccagccactgtagagttggctccaggccactgctgctctccagggcaggaatttctgtggcctccagccctggcgcccacactcttgggccaggtggacctgttactgggttttggacagtgcgtgtgtgtggtcagatggcttctgtttgtctctcgagaaaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaaggtgagtgggccttgctctccaccctgccctgtctggctgcctcagtgtccctgcacgccctgggggggtgctcacaggtgaccctgggcagcccttggatcagagggcctgaagatgggtggggagccatctggcgggtgtgtgtcgggggcctggtgggttttgccagggtggaggagcagcaacaggagctgccaaggggtcgaggctgttccgtggcttgtgtcgggtttgttgggtgctgatggcataagaagccgcatcgcagcatagactgggatggagaggaggaggtcgggggacagattgctctctggggtcctgggctgtgaagaggcagctgctggaaggagagagggggccagggtttcctgggtgccatcagaaggcagactaaaagtaggcagcctgatgggggtgccagggtggggttggggcagcgggagctggcagtgggtctgggctcagggagacattccctgggaccgccccccaaaggacttttgacagccctgttggtttgggggccttgtgacatttggaccaaccagggcaaatctctatctgctctgagggcctcttctgcctgcataggcatggtcaccttcaggctggggtgtcaggagctttgagaggggcacaaccagagccctgggggccctcacagagcaagcagtgtctcagtggggcccacaggaaggtttagagagggcagggcacaggtgttgcagggacaggcatggcataggccacagcccgatgggggcgggcagggctgggagtgtgtgaggagacccgctgtaagcaggactgtcctggagacggtgccagccaaagattgggtagcactgacccgctgccacacatggctcaacttggccaaggctgcctggtggctgcgggtattagagctgggccgtagacagaaaccacagggctgggaggtggcatctgactgtgaccgcctggctggggcagggagggacccacctcaggctgtggggctggcagagactgggcaccctgtggcctgtagccttggctaggtcttggcagggatggggaacctcccgggcccaggcctgggtgccccagtgcctggccagggggatggggggactcctcttcccgctgtgagctcacagcccccctcgaccccagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaaggtggggcgtggggcgcggggcagcctcacctgggcctccgggtgcgcagtggtgcagctccctgggtggagaggaggtgcctggtgctggggctggggagaaccctcccagctccctgctgcactggggtgtgtgtttgtcactaagcgcagaagggactggacagggagggtgggatgcagaggctgtgtggcccgctgaggactggtgcttctgaggccgggttctcagccagagccctcctggcgtctgctgccccagggcccagacagcgccctccgcacttctgcccctctgcctagagcttctgcttccagaaaagggagaaatgggctggcaccctcagagtggcctgaccccatccccactctattctccctagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctca

SEQ ID NO: 509 - DNA, 61980 bp, Homo sapiens
ccccgcccctggagccggcggcgcagggcgcagcttcccgccgccagagcgggccagcctgctgcgtgcgtgcgtgtgtacgactctgcgtgcgtgcgtgcgtgcgtgcgtgccgtcagctcgccgggcaccgcggcctcgccctcgccctccgcccctgcgcctgcaccgcgtagaccgacccccccccagcgcgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtaagccccagaggccgccaccttcctgcccgcggcctccgccccagtgctggaaggacggagcccggcgcggcgggtgacgtcggccctcgtccccaccccgacggcgctgtcgcggggggcggcgaggccgggccgggccttggcgctcgccgcgctccccagaactgcccggagtggccgggacccgagagggctggtgcgggagccggggcctgcgcctcctccccgacccccagcctcctgggacttgccttcgaggcacttgtcactttgtaacttaccagtttgtgatcctctctagtgtgagcctccgccgctgcctttgcctagaagtttcttcccctgctccgtgacagtgttgacctcagggcttagttgaggtgtcagctgctcagagaggcctgctgtgaccacccagccaccgtgcacacctgctgtcattccctattccgtcactgtttcgtggtcagcacggcacttttcatacccaaaatcactgtttcaatactagaagggaaactgcatgaggacaggctcttgtcagttcgctgctgtgtacccagcacacattatacgcctagtaaataaatacctgttgaaccaacagatgaacatgttgaaccaacaaatgaacctcctcaggacttctgatgggattgggcccattttcctttcactgcgtccctcatgctgtctcctggttgcggtgcaaggaggctgccacggtgctgggatcctttttctccgcagagctgtctggagcaacacctgcggcgatgggaagccatgaccctggtttctcccagatactattacctctgtaatttgtgcctttatgttttctatgttgttacttttgttttttttttttttttcctaccttcaccagggccacgaggtaaaagttcttgtctgacatgctcattctttctttttgcgtgtatccagtgatgtgggaggctctggggaggtgatggatgcacaagacagataaggcctctgctctcacagagcttaccttccgacgaggacagacaaaccaacacacaagatcattgcagatagtgctaagtgctgtgtaggaaatggaacagtctgactccatggaagcgtactttagattggaaggccgggtctccactatatcgctagcaccggactcacagtagatgctcagttggtatttatgaatgaatgaatggccagaggctctccagtttatatgtcctattgggaagtagtgtagggtaacttacccaaagttacccagttggcaaatggtacatttgaacccagacttcagagttcacgctcttaaccgttttgctgtctgatcgctgggaaatactccagaacggtggctgtcactttgccttccaagttaacaatgtgaaataactctgaatttacagagaaccaaaggctttccaattaaaatgaaaaaaccgaaaaaccccaccaaacctaccgtggattgtaattccaggatagtacttgagctttcatgatgttctcatggccttctggggatgccagattgggaaagaagtccaggtagctaaagtgaaaatagtgagccttagtttccacttgagttgtctgaagttctttctctatctgggaggcctggcttggcttctcctgataattggtgggttcattcggttagtccacaaacatttactgagtacctgatctgtgtgtcagatacccagagaagccaagttatatcagctgtactctcctattttccctcaacctcctcccagtactttagggaagggggcagatgagaataacagccaggacaggacaatgatgtagggtagtccagagtgctccaggagcattgaggaggtcaactcctgaaagaggtgtcatttgagctcagttataaaggtcgagtagaagaaggctcaaagaaggaaagggtggggaacatttcagacagaggaaattgcatgcacagaggcacaaacactgagatgactgggctcctttgggatgccactagtagtttttttttttttgagatagagttctcactctgtcacccaggctggagtgcagaggcgccatctcactgcagcctctgcctcccaggttcaagtgattctcctgcctcagcctcttgagtagctgggattacatacaggcatgtgccactacgcctggctaaattttgtatttttagtagagacggtgtttcactatgttggccaggctggtctcaaactccggacctcaagtgatccgccctccttggcctctcaaagtgctgggattacaggcgtgagcccggccaccactagtggttctgaatgacagcaacaaagaacatttgttgtggttgcctggcaagatgggagacaaggctggtgagtagacaagagtcagatctcagtccctttatgcatagatgcagccagtgtccaagttaaaattgtgttgcttctccttgagcagtccttccttgcattaactttctgaaaacccccaaatcccagtacaaactctgttgtctaatatgttatggaaagaggcactcatttgagaaaatttaagattttgttcaattgttttactgaaagatgtgtgaccttaggccacttcactcctcaaagcctggggtggttattcggtcaatggggatgatgctcgtgtccacgttgcctcttgtagaacgtgtttagaaggaatgacatggctgttagtggctttgtaagtgcatagtactatacagagattagacaaccacttaactacttaagtggtttcatcacttctgtacctgaaaggtgtggcagagaatagcgatcattctggccctggattggccaaagtaattatgccaaagtcactggatatttttgctagggaagtggtccaagagaagtggtaccaaattgttgaaggcctctggctcataactttagaagagacatctgtgtgtgttcttaaatgacgtcatgaggtgtgttgtttgtttgttttaaactgaatgctaagacagtacaattaatagagactgaataccctgacttagagataattcatttcaggatgagaaatggcacatttaactggtttcttccaggttactcagggtgacgactctgatttctggtcgttcacctagatgaacctctgagctaactttacttgagaaggtaataactaaaatgcccattcaaaggaaaaattatcttttaaatgcagcctaagttgatcgtatgggattgtatattgtcagactctttaatcttgggaattttgtgtggtatgttaaatttaaggatgttacagaagaaaaagaatgcaaatttatatgactttatgcagttttataggaagtactatgctgcatcataaatatcaaaaggagaaagcctggtggcttcctgaaagaagcatgacacaggaggatttgcctagacttaaggttgactttcatgagatatttttagtaagtgaacattaagctctttcagactaggggtatctttctgagagagtaaatgtttttgttttttggcagggtcttgctctgtcacccaggctggagggcagtggtgccatcatagctcactgtagcctcaaactcctgggctcaagagatcctcctgctttaggttccctggtagctaggactacagatgccaccattcctggctaatttttaaatttttttgtaaagatagagtcttgccatgttgcccaggctggtcttgaattcctggcctcaagcagtcctcccgcctcagccttccaaagtgctgggattacaggcatgagccactgcatgcagcctaagtgtgtgttttcttttatatttctttttgtctttttcactaagtcataggagttttttaaaattgtcactctttctgttgatctcagttcttccaagtcctaatcgtttccttgccatctcctcactctgagatcccacttgttgtccagctcaaagagagctttccgaatgagtcactttcaaggcattatatagcactcttctttcattcccttctccctccccttccatgagagtccatctgtggtaaatagtatgtcatatattttttggtcgttcaggactctagatcattccttacatcctagcccattcccccagcaatgatactgtcacatggaaatggtctgttgaacatccatcctcactaggttaaggtttgttttgttttgttttgttttgttttgttttttttgagatggagtttggctcttgttgctcaggctggagtgcaatggcgcgatcttggctcaccgcaacctccgcctcccgggttcaagcacttctcctgcctcagcctcccgagtagctgggattacaggcatgcgccaccatgcccggctaattttgtactttcaatagagacagggtttctccctgttggtcaggctggtctcgaactcccgacctcaggtgatccacccacctcggcctcccaaagtgctgggatgataggtgtgcgccactgcacccagccggttaaggtttaaacataactgtggatgcatttacttttgctttattgcttgactgaaccaatgaccttcaagaagtcttagatagtcctgccattagtagggatctcagatgggagggcaccaatgaatcagtgtagttgagtaccacttttgggagaaaatagaaacttggacactctaaatgatagtttaaggacgttgtttgttttgttttgttttttgtatgggaaaagttggcttagactctttagttcagcccttcaagttgatgtgtaatttaagattgtttaggaagttaaaaaatctaaagccctgtggatatagttcattcagtgcagtaattatctttcagatgccaagtacagcattaattctttagctttagcatggcactgattttcttaacacttcatgatcacgtggagcagactgtgctttacagcacaacagagcgtcagccatgtgctgaagattcttcgtggtagtggtttagatccaccctgaatagattatcttcatttatttaattattaagtagcttgcttatcaaaagcggcattaaacttactaaacttgagtcaaacgtaaatcttcatagatagtaccatttacttctgaaatcttgttcctgggagaaaaatgtggactggaagttaactttcttttatccacctattcactcctttttcttcacagttaactccttaggggaaaaaatgtatagttcttgaccatgtgcttatgtttgtaaagcaatgatgtttccttaacgtgagtggttgtgacatagatcactgttatcttcataattacctgggagcttttcatccaagtgtggatttactaaaataattagtctgaattgatgcttattaaagagctgaactcttaaacgttaacactatcttgtatttattaaaattgtatgcatgtttccttcaaatgctgaaggcagaatactgagaactttgaccctgtgttattatcgctaagtagttgaaaattaggggaggagtcaagggagtatattatattggttatcactcaaatactacccctaggcatgatttttagaaccgaaacttgaatttttacataaagaattatctccaaaagtgtcttttttttttttttttttgagatggagtcttgctctgttgccaggctggagtgcaatggcactatctcggctcactgcaacctccgcctcctgggttcaaacgattctcctgcctcagcctcccgagtagctgggactacaggcacatgccaccatgcctagctaatttttgtatttttaatagagacggggtttcaccatgttggccagatggtctcgatctcttgacctcgtgatccgcccacctcggcctcccaaagtgctgggattacagacatgagcctctgcgccaggccaagagtgtcttatatatccccacttttttgaaaaatttgctgtctaaaggatgatcatgatttgggacgaatgagcacagctttcaactagatgacaagaaagatgaatacaaagagtgctgagttccattagtcaagacaaggttgccatagaatgtctttaataaaataaaacaaaagccttttgcgttattttgcaccgaggattgtgttaaaaacaaagttgcattatggtttccagattggcatccttgtttttttctatcattttaggcccctttcaggctgttatcagcatagcatatccaggattgctttggccttgctcagtgggtatgtgcgttctttgaagttcttacctgacagatgtgggcagctggctttacacaaggaagagttgtttaaagagctttggtatggaaacaaagttactaaacttgacagtcacttgaggattatttaaaaaacaaacaaaataactgaatgtggtaaaatactatctctagaatatttttcaaactgttaaatgcatccttttaacagaagctgttgatgtctacaaacactgtctttgtagacaaagacaaaccccccttgcatgggggtttgggggttgggaagcagttgagaaaatggcatagtcccgtgagaaaaccttggaatactttcttttaataacatttttttattgcatagaactgtaaagctacagaaatgctttcttggagttttccttcatcctttcagaagggctaatattgacctttggttagcatgttagtattttcacctgtgtcaagtgatgtcttcacgcttttggggggtgtgtgtgtgcatgcccacctcgtgttgtgtagggcacattggccgatacctataatgtgtttcaattactacattgttggcatttcagtaggctccttcagcctttgcccatctgggaagtggagactagggcaataaatgttttaggggtagattgagactgcagtgtttttcatcttttagcttgtactttaagacaatgggatgtacccctagaccatttacctagatttaaattacttccttgtgatgtggtttagagctctaagttccctgagttgtcttgaaaggctgaagggtgctcagagaatggaggggaattgaaaatggaacctaaggatctgggagtggtcatatgtgtgagtggtgaaatgtgccccccaacaccccgttgggtcgggtctggagttaaaagcagtggctgacatacattttgcaatataagggtaaagaaaggtaaagaaggaacaaacatttctagaggataaatgctttaattccagaagataggccacacagtttaggaactgtggtaagaggtgctttgccatatttatgttactgtttaatctgtgtaacaatcgtatgagatgacttagtcagtggctaggtaactttctgctggatgaggctgcactagtaaatggtggcacaggcaaagccttgtactttccctcataccagtatcagctcattagagttaactcataaaggggtttgttcttgagagagggaggcagagaatttaaaaccattaatgaagtattaatagctgtcaggacaatttcttaagaacatcaattcattaagagttattctctgaattttttaggagggatttcttgccctacttttgaaaaagttcagacagatgactccaaagaatgtttgatttctcttgtgaatattcacttttatatcagattctgatggtttcttgattctatatatttagaaagcattcggccgggcatggtggctcatgcctgtaatcccagcacgttgggaggctgaggcaggcagatcaactgaggtcaggagttcgagaccagcctgaccaacatggagaaaccccatctctactaaaaatacaaaattagccgggcatggtagcgcatgcctgtaatcccagctacttgggaggctgaggcaggagaatcgcttgaacctggaagacggaggttgcggtgagccgagatcccgccatcgcactccagcctgggcaacaagagcaaaactctgtctcaaaaaaaaaaaaaaacaaaacacattaacttgtgggtaatttgtccttctgctatccagtctttggaaggcagggcaaagcttgtgtgtggtagagatttcataggcttgcaggtttgtagagtgggaattcaagaagttgtaaagggcacttattaagataggaatgtctaaaataaatgatctttagcagtgccaccttaaactttgtaagtgttgctacaaaacctttagttctgcatgctcctgaccagccattgccttggacagagaaacaaataagggtgagttaataaactagagacttgtctcaattgttcaaagaggtaaacttaaggtgattaaaaagtgctgttttattctgtatgagatacactttgggaagtcgtcattttccaagacgatgatacgccaggcatacgaattggatcagaaaggatttagagacatgcatggatataatgatctcttacagatgttcctcaccttacagcggagttacatcctcagaaacccattgtcagttgaaaatattataagttgaaaacatattagatacagcttaacctacccaacatcatagccttgtctaccttaaacatactcagaacccttaagttagcctccagttgcacaaagtcatctagcacaaagcctattgtatgataaagtattgaatatctcatgtactgcatattactagcctgggaagagatcaaaattcaaaatatgtcaaaattatgatggcttcacaccattgtaaaattgaaaaatcgcaagtcaaaccaatcggggattgtctgtacataagagatgattgtccaaattagagctgttttgggtttctgccctttgcagatcctttgaggttttctttatagacagatgactccttctgggggaattgagcgtgactctgattgagatttggttcagttaccacatactgaaagcttcctgtgggccaggcactaggttgcactggggacctgggaggaaggcctagcccttaaagtttccagcctctaggtattgggagacgagggaaaatggggacaagatatttatggcctgtccttattgagagcttagaaaaagctgtgttaattctgctttgggtgttcgatctcacagggaagatggcatttgagatatgtgacttggcgagcttacactgtgcgcttgccatttttctaagcgttcatttatttaattcttaatgcaagcctaggaagtgggtacagttatgatcctgaagttattaacccaagttatgaacctgactgagggttggagctgggatttgaatcaagatctgtctgattgcaaaggctatggctttttttttttttgtcgtcatgctggctgtgtttcttcccttaaaagataagtgggagtgtgcccttggctttcttatttattatgttaggaagatgagaggaggagtgagactagagaaagaggcttgaaagagaaatgggatagaaaaataaaggaaaaggctgggcacagtggctcacacctgtaatcccagcactttgggagtctgaggtgggtggatcacctgaggtcaggagttcgagaccagcgtgaccaacatagtgaaaccccatctctactaaaaatacaaaagttagccgggcgtggtggtgcatgcctgtaatccaggtactggggaggctgaggcaggagaaccgcttcagctggggaggtggaggttgcagtgagccgagatcgtgccattgtactccagcctgggcaacaagagcaaaactccgtctcaaaaaaaaaaaagagagaaaaagaaagaaaaagtgccttattataattgtagtcttgtaattgtctcgttggcacctcttacataaagtgcagttgctctgggacattagaatgactgtgactgacttttaatctttgccagccatggtggctcacgcctgtaattccagctttgggaggctggggtgggtggatcgcttgagctcaggagtttgacaccagcctggtcaacatggtgaaacccctctttactaaaaatacaaaagttaaccaggcttggtggtgtatgcctgtaatcccagctaatccggaggctgaggggcaggaatcgcttgaacccaggagggcagaggttgcagctagctgagattgtgcctctgcactccagcctgggctgagagtgagaccgtctcaaaaaaaaaaaaaaaaaaatccttctatgaattctgtgtttccccctaagaacttctgtcctaacttgatcacttcttattgtgagctatttgtttattagtgttgaaaattctgtgctaatactatcaactgtaccttcccttccaccaccccactctctgctccaagtctttcatgtcctcaatacctgtcgtgcaaactatgcatttctgggttaactgggtactattttagtcttttagttccatcactcagcatttacaatatagtagaaaaatggaagaaatggaaaggtacgtactcgagaaatcagtgttatggccatctccattttagagatgagaggcctttgcagaaggcctttgcgaagactttacagaatgtgaatttgtacccgggtcttacagcctcccaagcctgtgtgctttgcattacaaagcgaatctgtggttcctagcattgctgtcacctagaggcacttgggctaacctccttagctttggtttcctcctctgcgatgtaaggaggcttgaactcagtacctctaggtggtccttccagctctaagcttgagaacttaagtttattttagctgaagaagagagatagaaagccccttgaggacaggaaccagcttgtatttcccacagcacctactggtactttgttcctatgggctcctgaatatttaattaatgaaacctcttgttactgtttgaaagctcactacttgtattaacctttcctgagtattcttggactctgatccagttttttctatatcacctcttattgtacgaattgtatgtcactttcacgttttgttttattctttatgtgcttcatttacttatttattgcttggctttcactgctagaatgtaagctcctataggtttttgttttagtatttctgagtagactacatagactacattctcttcttcttcttgttttcttttccgagtaccccaaagaaggatacaaccctggatttggtcatcttttcagtgtttgctatgatcatttgaaacagaagcatacacaagaataaaaagagaaatttgctgaaaaaccagaggtttgtccttgtggaggcttatttgaattctcaatctgttggttgaattgatttgttggcatgtaaatatatcctgatggactcctctgaaaatctaaatttgtgcttctgacctttgtaaagtcaggcagtgctttactaattggatgaaggagagccatggcttactcttgagagaatgtgcagatgcacacaatcaaaacttttcatgtaatttgcgggcaggaggatcccatcttagtgcatagttcacctctaacctcgctcagagaaaaggtggaagaagcatgagcagtcatctagagaaatccagagaccacttggtcggctcatttgtatctttttatttattattatttttaaaatgaatgcttttgttgcctttctcttccaaagcaagattgtttctttttctttctttacatacctagcactcactgagaatagtgcttggccattagtcattttcattaaacatttgagtattgtcccttccacctttaaagaagaaaaactgtgttgtcagtcctttttaccctgtctagctactcctttcactttccttcttatcatggtaagcttctggaaaacatagtttcctgtcttttttctttctgttcttcacttctagtcactgcccgggagctcaatcattgcttcatcactacatctcccattgcatgttcagtcttcactaccatttgacccctgttgtcatcctgctcattgacactcttctcttgacctctctcattgctctctctgcttttcttccgcccatgtggccagttttgcccactcatcatgcagtccggttggtaatgctcagggttacaggttcaccttctccccctcttctcctttccctgtttctctcagatttgctctctctgtgtcttcccttctcccctttgcggaactcttttaccagtacccttcgcttctaacgtcacttatgtatgaacccaggcctgacccaagcccatataaaaggctgcaatacgttaaatgcagcatgacccaagctgaactctataccaccttttcattttttcctccaaacctccccttcttactgtctcattggatggtacctacattcatgcatttgaccaactcagagagtctatgactcagttctgtcccttcttccccattccctctatggctgccccattttctcccgcaactgtaatagcctcttaactggtcttcttgtccgagtcttctctttctttccaccctgatgtggttttcaaagatggtttgcaaagatgcaaatctgagcatatctcttgcttgcttacaatcattaaatgtcttcctgttgccaaaaataaagtttaaattctttaacaaaacctggaaaattatcgatacttgttgcactccccccacattgccctgcccatctttccagcatcgtctttcctcatgcttgtgtttcagccttttagttctccttggccatggggctttggcatactatgtatcatgacttaccctgtatgtagtcataaagtaacagtttttagctgtttccaccactaaaaattagttgattccttttcctcttgtttgtttcactgcgtccccctgcttacctttgaggctcagcacaggcttcacttcttcaaggtaactgtcctgacattcttcactcacattgtatctgttcctctggctcccacacatgtcacagcatgttgtcattggcaacgtgatacgtgactccctttcgctgttagtcagcaagcccccccaccctttttttttttttttttttagattgtgtctcttctccccacatcccagtgcctagcacagcacagtgcatggtgcatggcagtttctcagggagttcatggtctctgggtctaaggcataggcgaggaagggttggtgtttaggagaaagctgagaaagatgccaggcgcaatggctcacacctgtaatccaaggattttgggactccgaggcaagcgaatcagttgaggccaggaatttgagatgagcctgggcaatatggcgaaaccccatctctactaaaaatacagaaattaacctggtgtggtggtgcatgcccataatcccagctactcgggaggctgaggcatgagaatcacttgaactcaggaggtggaagctgcagtgagtcaaaattatgccactgcactccactctgggtgacagagcaagactgtatctcaaaaacaaaaacaaagctgagaaaggagagaggggggaagaaagaagactttcagtggtgaagagtaatgaagcctgtcggcagggcccgttatgtacagccgatcgatgtagacacagtgcattttgctcagaaaatatttgaagattttccactaaatgctggttgcttttctctcttgtggaaacttatgtttttacttctcctcctcttctatttcagagagtcaggactacctcttaggtgtgtgttcttttaccccattcctttcccatcacttaacagtattttgcatcgttagcctattactgctgtctcacttttctcttgtacttgattccttccttgtgcctacaaacatgcttaagttgccccttcctaaaaagaaatcttgttttctagatcttccccgcttaagcaaatgcccagtcttctatcacagctaattttggggaagcggtgaatctcagtttctggtatctttactcttctttcatcagacctcaccccttcactcaaacccttcttagttcccccaggtttctctctgtgatacttgtctttgacttttctgatgaactgtccacctctttatcatctcttttactggatgttgaggtttctcaggttctggcttcagtcttctcaatttaacaattctctgtatgttgtctcattaataatgccttcatcttccacttctgcacagaaaacttccaaatctctatctccaagcaaatcttttgatctgtcagcctgctggacatccctgtctatctggttgtcatgagaacacctcaaactcagcatgttccacactgtatttaccgtttaccttctcatccccactgactgtggcttctggatcttgggaatggcccttgcaccaagttggcaagctggaaatcctaaacttgtctttcactccccattttccgtaacctttcacatctactcagtccatttaaatcagcagcatctcctatgcccttttgcttcttagtattctatcgtatcctaagtataggtcctttcccttccagactattgtagtagcaccgtgactcaactttctgtctctattttttctgcctgcttctctcaccctttggactatactttatacagtttccagagatatttttctaaaaattgaaatttgatatcatttcttggtttaaaaacattcattggctctctagatcttacggataggttcgtggcccaaattcttaggccagcagcaaaactcttcagagtcaggccacaccgcatctttccagcctcagcttctttcacccctctcgtaccccttcctcttcagccatttgatgcccccagaagccccttatagcgttatcacactgtactttcacccaagttccctacagctcaaagtgtactttgcgttatctgcttttcagactccagggcttgcctcagtgatcagttccctgtgctcctcaccctccccttttgataggatgctttatagattacctttcatacagtgttcgatgcagttagaggtagtatactgcccaggagttaagagtgtgaaccctagatttgccatctgaaagtcatgtgtccttcagtgatgcatttaacctctctgtgcctcaaatttctccctctggggtatgttaggagtatacaaattaacacatgtaaagtgcttagaatagattggtactgttaaatatgagctaacgtcacatttgatatttttttaaaaagaaaaaatcattatggagtctcagtcctagagattctgattcattaattctggatgggccccaagattgttctgtgtattctgggtgggagctgcagtgccctgtttctctctctagcttgagagcctagcacagcacctgaaccattctcttcatgggttacttattgagtacctgtagtgtgccaagcattgctgagaggccgagatgagaaaacttttaccttgtggagctcatcttctagtggagaaggtgtacattaaataaaaacagaaaatatatatgatgtggtgtcaggcagtaggtgataaatgggaaaaaaacaactaaaaacaatgcaagataaagggatttgggaatggattcaattttaagtagggtaattagggaaggtcatttaagtagggtgattagggaaggtcatttacctgaggaggtgatatttgaactgagacctatataaaatgagtgtatgaactgtggagacatttgggaagagcattacagacagatggaagggcaggtgcaaggtgatgatgagcttggtgtgttcaaggagcagcaaggtatgcctgtgctagagtggtggaggggcctgcggggagatgagctcaaagaagagggcaggagccttgccggtaggcaggccacaggagggactttggattttgttgtgagatgggaagccacagaggaatctgagcaggagtttatttttatttttatttttatttttggagacagagtcttgctctgtcgcccaggctggagtgtagtggcgcgatctcggttcactgcaacctctgtctcccgggttcaagcaattctcttgcctcagcctcctgagtagctgggattatgcccagctaatttttttatttttagtagacagggtttcaccatgttgcccaggctggtcttgaactcctaaactcctgagctcaggcctcccaaaatgctaggattacaggtgtgagccatcacgcctggccaggagccttttttttttttttttttttttttttgagacggagactggctctgttgcccaggctggagtgcagtggtgcgatctcactcggctcactgtaacctccccctcccagttcaagcaattctcctgcctcagcttcccaagtagctgggactacaggcatgtgccaccacgcctaagtaatttttgtatctttagtggagacagggtttctagattaaatgtagaggaatatagaggaatgtagattaaatgtagaggaagagagactgcttttggcctaagcagttgggtgagtggtggtttctttactgagatgagaagcattgagtttgagggaggagagtgggactcaagagtgccgtttggacatgagaaacttgagatgctcagtacacttgcaacgagagatgttaaataggtagttgagtctggagctcaggggagagggccaggctgcagatataaatttggcagtcagcttattgttgtgacatagaacagtaaggagtaatttcttctgattaaagagatttggtaaacctttccaaaagagaagacgtttgagcaaaactttgaagaatgagcataatttccaaaggcagagtaagggaaaaatagaaaatatttttcatccaagtctcacagcctttcccctggcctcttcttgagtttaagaagctgctgacctggttgataatctcttatcactggtatagccacttaggttctttattgaaaaggaaccagaacagattacacactaactgataaaccacgttctactgtttctcatcgttcacagattgaaaattccagttggatcatcaaggtgcagaatgctaaacttgttcttctcccctgttctgtatctggtgtgaattggatgtgttgattttcgtatggaggctttttcacatgctgtcatctccactaaagatggaacactttggagaagttttacttctgttgttaatgactttttgcacttgaactgttaaaacaactacaaccatgagaaattgggaccccatgctattttatcactcatacccctaacttgagcatattatctgtcttgactcatcctgctttgtgtaaaatgtgaatcatgttttgtcactcttctatttagatagaattttatttgcagtagaatattgcttatctttttgtttatttttgtgattactgtaatcagaaattttggtctttcaagtagagaataattactagatgttcgttagtcaatgggataaagaatgcattgaaaaaattcagtttattaaatcgtctaagatccttttagaactgatgtaaaattcatctgtgaataatcttctactgcacgataatattagtgctggatatagatagaatgtatgaagcctcagctcttatatactccttttagccatttttctattacgaaaaaaaatctagtgtattaaaggaaagtagtgacagtatttatctttagatggtttctagtatttgaagttcatacagaagcttttgtcagaattgtacacatgggtctttgtcttgagttaatgagaccactgcaactttaaacatgttttgagtgataaccttgatttttataaattatacaagcatgactatcaaggctggtttatcagttttcaacaactttacaagtctgaacaagtagaaaattatttcaaaagaaccttgtttggatctcacataaactacaggtagctttctgtatatgaaaaaatttttaagtacagaaaaatacagataatataaataccccagtatggagtaactaaatgttaataatttgttagaagactcgttttaaatctttctttaataaaacaagtaaaacttcactaataatttatggcatgtctgtactccatatctgctgattcatacgccctccttttttttttgttttttttttaactccccggaggaatttaatgtgaactatttccgtttttttctagatcacttaatgtagtgtcatggtgtatggatgacttaacatgtttttgagacctatcaactgttgaaatacagatctagttcattcttttaaagagttgtatagtattccttcatgagattttagaatttttattgtaagtaagagaattctttatatattttcaattctggccattcatctgttatataaactgcaaatatcttagttttccaggctgttccttactaactttgtattttttttcaggtagctttcctgagtttgatcttaggaattcttaaaatacagtagcatgtcttccagtttagttttcccacccatggaggtggtggcaggctgagttttgtttctttctgctctgaaagacctaggaaactagtgaattgagtaagcaccctgcaagtctggtatagtctatttcaatcaagttggcttctggtgtgcctttgatggcatcatcagtgagagttcttggtgttgatttctcttgctgcaataacaggtgtgatgtttctcagtagctggctggctcccgaggataccaggagaatactttattaatttaaaacactgcattctaagagttcttcaggaaagttatgtgtctatgggtagggttgtttttatgtggttatttcaaaataagagctatacaatcaggctttctgctggaatattggaatataatgtctgccatttaaacacattggttgcaaagctttaaagctttatttttgtttctaaagcattgatttaatgtgtgagctaacaattcgatcaagaaaatagatttttaagaaaacttctccagtgtccttattcttgagttcatggttatttaacagctcactctcttcgaatatctgttagtatggtatctttcattttttagggagggggcaactttaaaaaaaaacaccatagaataattatgatgaaagcattattgacacagtgagcatttttaataccttcaacctgtatataagcagcacaaatttagagtgatttcagatccgggttttgaagtaggtgtctgtttacaggaaatgcagcagaatcagagtacaatgacctctgaggaagtctcgtattcatgcagcatacatttttactatgtttgtggcactgttctagtttggaggatctggtgatgaataggacagacaccccccccccccaccccgccccccactccatgtggaaacaggaaaggaacaaacaaaatatgtcctatgcagaagatgaaaagggtgtaatgctggaacaggagcagcagtagtctcagtatttattcacccagagcctggatgtgcttacagagggtgcatagaggaagaatacagccattgtgtgaagtagatggaagcatggcatggctatttgttcattcagcaaatatattattgagcatctgttctatgcctgcaagtgctctaggtgctgatgatcagtaatgaacaagagggacaaaaaagtctgtgttgatggagtttccattctagaaggggaagatttacataaacaagaaaagaaataatgtggggattggtgcactgcagatgggtatagaacgcagaaagcaataggatactttttaatgtaaatagactgtcaaagggtaaaatttaaaaatattaataagatatccaacagattttgctttagaatgtccgtgtccctccattttagtgtatttttcccacatagagagtctactgtattgaaacctcaagcacacttttattgtcttaacaaaatccatcaaaagtcataggcttctggagacagattattaccttcccagaaggtaatctttttagagttgaagtgaaatatggtaatttgttttttggagaggctgtgaaaaggagagatactgtacctaatttgtgtttgcaagagtataaaataatatagctttttttatgcagagtggaaaaaactgttgtgaagctaataactttaaacttgtatctggaaagctgagacctgatagattatatatcaaattggtatacaacttatttggtaacatatataggttgagtttcaaagtattgtagctacatcagaagataaataacaaaggaaggatatgtatttgtgaaaccagaatttcatgaactctagaaaaggaagaggagcaatcactttgcacaacaaagaatctttattcatatacacacacacacacacacacacacacacacaatacagatagatattttcaaaatctcaataatatttaatattagaaatgttaagggggatactaccgaaagtgaattaatataaaagaccaaatgctttttccccttcctttttttaaaaaaaatatagtttagaacagttttaggttcacacaaaaactgagcagaaagtatgcacagagttctcttgtaactcctaccccacacatgcatcataaccccctccactgccaacatcctacactgagaggtacattggttaccattggtgaacctacattgacatgtcattgttagccagagtccgtagtctgcgttagtattcatttctagtgttgtacattctgtgagtttttacaaatgtataatgacatgtatccaccattataatatcagagtagtttcagttttactgtcctaaaactgctctatgctccttgtgttctttcctcccttaaattttatcaacaccgtatttatttatttatttatttattttgataacagagtcttgctccatcacacaggctggagtgcagtggagcgatcttcgctcactgtaaccttcgcctcctgggttcaaactgttctcctgcctcagccccccgagttgctgggattacaggtgtgtgcccccacacctagccaatttttgtagttttattagagatgtggtttcaccatactggccaggctggtctcgaactcctgatgtcaagtgatccgcccccccgccccactcagcctcccaaagtgctggattataggcgtgagccaccatgcctggccaacaccttatctttttattgtctctgtagttttgccttttccagaatgtcatagagtaaaatcatacagtatgctaccttttcatactgactgctttcactcaggaatatgcatttaaggctcctccgtgtcttttcatggctttatagctcatttctttttagcactgagcactatttcagtgtctggatataccacagtttattttatccactcacaaaatgcttctgcattttggcagttatgaataaagctgctataaacatccatgtgcaggtgtttgtgtggatataagttttcaacttacttgggtaaataccaaggagggtgattgctggattgtatggtaagaatatgtttagttttgtaagaaactgctaaatggtctttcaaagtgtctgtgcaccgtttttcattcccaccagcagtgaatgagagttcctgttgttccacatcctcaccaacacttggtattggtagtattttagaatttggccattctaaaactcaacaataagaaaatgaacaaatgtgtaatagtatctcattggacatcttttctatttttgtttttctgagatggagtcttactctgtcgcccaggctgaagtgcagtggcacagtcttggctcactgcaacctctgcctcccgggttcaagtgatcctcctgcctcagcctccccagtagctgggactacaggcatgggccaccacacctggctactttttgtattttcagtagagacagggtttcaccatgttggccaagctggtctcgaattcctgacctcagctgatccacccgccttggcctcctgattacaggcgtgagccaccgcacccggccagacatcttttcgtatgtttatttgctttctgtacgtttttggtgaggtggctgttcagatcttttgcccattttaaaattaggttgttcattttattttattttatttttattattttttgagacggagtctctttcgctctgtcacccagactggagtgcagtggcacgatctcagcacattggaagctccgcctccctggttcaggccattcccctgcctcagcctccagagtagctgggactacaggtgcccaccaccacgcccggctaatttttttgtatttttagtagagacggggtttcaccgtgttagccaggatggtctcgatctcctgacgttgtgatccacccgccacagcctcccaaagtgctgggattacaggcatgagccactgtgcccagccttcattttcatattattgagttttaagagttctttgtatagtttggttgacagtattttattcaggtatgtttttagcaaatattttctcctggcttgtggcttgtcttctgcagaacagatgtttttatttttaatgaagtctagctaatcagttatttttttcatggattttgttttggtgttgtaagtagtcatctccaaatccaaggccatctagattttattctgtcatcctgtaggagttttatagtttggggtctaaatatactttagcctttatttttctggtagaattgctaagttaaaagtaaaattatggctgggcgtggaggctcacacctctaatcccagcactttgggatgccaaggtgggtggatcatttgaggtcaggagtttgagaccaccctagccaatgtagtaaaaccctgtctctattaaaaatacaaaaattagccaggtgtggcatatgcctgtggtcctagctacttgggaggttggggcatgagaatcgcttgaacctgggaggtggaggttgcagtgagccaagatcgtgccactgcactccagcctgggtgacagagtgagactctgtctcaaaaaaaaaaaaaaggtaaaattatatatttactccttaaaaacttctatcttgccatttagtagataggatgttatgctatgcttgaggtaatacagataggtaaggcctagattgagttttcagttcactggaaattttcattattactttttataatttgatgggacatgaacttttaaattattcttttgtaaagatagtatttacatttcctgaagggaagcgttttaatttttcttccatggctcttgaatgaataattacagaaaagcatttaaatcatatgtagatcaggagactgtttaaagatttaatggaatacttttcccataaaatgctcttaggtttcctgacaagtttattcagccatttttttatgacattttcaacacctggaacctgacctcttcatgttgtgctggattgtgacggtctttgaccttcaaaccagaactttatacatcttaaggcccaatttttgtaattaagagtaaaaagcaactatttcttctttcacttttaatggtatgcaagtttttgctggtattgtatttgccttcttttttttttttttttaatttattttttattgataattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggactggtgatgactcttaacgagcatgctgccttcaagcatctgtttaacaaagcacatcttgcaccgcccttaatccatttaaccctgagtggacacagcacatgtttcagagagcacagggttgggggtaaggtcaccgatcaacaggatcccaaggcagaagttttcttagtacagaacaaaatgaaaagtctcccatgtctacttctttctacacagacatggcaaccatccgatttctcaatcttttccccacctttcccgcctttctattccacaaagccgccattgtcatcctggcccgttctcaatgagctgttgggcacacctcccagacggggtggtggccaggcagaggggctcctcacttcccagtaggggcggccgggcagaggcgcccgtcacctcccgggtggggccgctggccgggcggggggctgacctccccacctccctcccggacggggcagctggccgggcggggggctgaccccgccacctccctcccagatagggcggctggcctggcagaggggctcctcacttcccagtaggggcggccgggcagaggcgcccctcacctcccggatggggcggctggccgggtggggggctgacctccccacctccctcccggacggggcagctggccgggcggggggctgaccccgccacctccctcccagatagggcggctggcctggcagaggggctcctcacttcccagtaggggcggccaggcagaggcgcccctcacctcccggacggggcggctggccgggcgggaggctgacgccccgacctccctcccggacggggcggctggccgggcggggggctgaccccccacctccctccctgacggggcggctggccgggcggggggctgaccccccaacctccctcctggacggggcggctggcggggcgtggggctgacccccccacctccctcccggatggggctgctggcctggcggggggctgaccccccccacctccctcccggacggggcggccgccgggcggagacgccccccacctcccagacggggtggccgccgggcggagaggctccccacccctcagacggggcagccgccgggcggagggtctccccactcctcagacggggcggttgccgggcagagggtctcctcacctctcagacggggcggtggggcagagatgctcctcacctcccagacggggtcgtggccgggcagaggcgctcctcacatcccagacggggcggcggggcagaggcgctccccacatctcagacgatgggcggccgggcagagacgctcctcacttcctagatgtgatggcggccggaaagaggcgctcctcacctcctagatgggatggcggccggtcggagacgctcctcacctcccagactgggcagccaggcagaggggctccccacatcccagacgatgggtggccaggcagagacgctccccacttcccagacggggtggcggccgggcagaggctgcaatctcagcactctgggaggccaaggcaggcggctgggaggtggaggttgtagcgagccgagatcacgccactgcactccagcctgggcaccaccgagcactgagtgaacgagactccgcctgcaatcccggcacgtcgggaggccgaggccggcggatcacttgcggttaggggctggagaccggcctggccaacacagcgaaaccccgtctccaccaaaaccagtcaggcgtggcggcgcgagcctgcaatcgcaggcactctgtatttgccttgtaaaacagatcaattctagcccctcttactgtcttactcttacctcttattgccttaaacacaatttaaaatgacaaaaatccaagcacagtgggtcctgggggaaggtagaggaaataaattatactgtgtttagctttatctaaataccttttacagcatgtcaaggaattcattttcagttcattagtgctgtttcataagcatcttcagcaaactcacacaaatgttcacagatgagtatatgcataatctaggacataaagggcattgtttacattattaaaaagagtaacagtttcaaagagtattgccagtttctcccaaattcatgttttttcacttttttaacctcccatttcacattttagatgcttagttcctggttttgttacagacattatctgaaataaggaatagaagattaaaaatgatttgaagtgtatgctgtggttctagagacacatcatttttttttatctctaaaaaggaaaaattctaagtttagaaggagatttcatttgtaaaattgactgtactttataagcagtgtttaaattcattggtggtaaatatgcatgttggtatagtaaaatcccattttttacataatgctttaatggaaatggcagttttatgaaatgaaagtgactagtaaaagtctgaatgatgctcataagcttttacatcatttttattgaaggttttgtgtatgctaatccattaatacaggggaaaaggagaacactaacatggtttattttctataattactcaaatagaatataatttattttcaataaaattcttggagcaaattgcccagagtagggagaggaaggttggcctgttcttacaaatatcttgatttttacccacgggactttgttattttaccagtgatgttgtttcattgcatatattttcagtatagttccctccagatttttacaaataaaagcctgtgaaaggccaagaaatcccaagcatgtaaagacccaggattgtggagggagaaatctgggatgtttattttatcctgtttattattacaaatattgcttgtcttttaatagtttagacttccttttatgtggtttatataagttgaagcaccattaagattgctgtgtaatagcaattaactgtgatgtaatagattaacctggggaaattttcaaaaacagttaagtgtttacatttaaatttggcttatttttgtagagtaccttgaagaagaggtcagtgtaaggaataaacaaatacttaaatttgggatcctcacaccacaacttcataagggggagagggtgaactgaggtatcccgtaggtggttgaggtgtgtgtgcttgtgagttttctgtatttctttgcagttgggttcagcgaggagcagttttctgtgttcaccagtgttgatagcagacaaaatcacacagaaacaaatacgaaaattgttttatgtccagaatgtccctctaatatgcacatgagtaacgttggatcaaatttatgttttcaaaataagtctcatagcagaactagctgtcgtttgattttgggattgagtcccatttccttccttccttatcaccattttgatttcttaatttgtattaaggtaagcccatatcagattgattttttttttttccatgcccggagcacctcaagagtagagacaccagcctgaggatcttaattttgctggagataatccacacacaggtagttttcttcttggtgaatatgtagattgagatctttattctatgccagccacagtgctggggctacagagatggataaggtataatccttgtctcaggagcttagagtctcattgaaaagtttttcaaaacacacatttgaatgattttgttgagtcaacattacgtatttgtttgtgaacacataagcgcacaccctttccccaccttcacttcctgtttccttgcaaatgcaaagacaagagtaaaggacttgcctagaggaaacacagaaatactgatttacaggtgaaaaatatgtaaatttgaaaaggtgttgaaaaagacctaagtttttgtagccacctgactaataaacacagagatcacatgtccaccatagatgggtaaatgaaaaaaagcaagtttcaggttaataggaatagtattatttcattatttgttagcccctatcccttgcacatgtgtgtatgtattgtttgtgtaaacatagatgatgtggaaagatctcccatattgttaatattagttatctcaggggacaaaggaaagcttattcctgtttatacatcttttattgtttggtttaagaagcatgttttacttttttaattaaaaaatctaataaagtaggaagtgaataaataatagtaataaaaagtatcttcaggccactgagcctgttgcagtcttcccagtagcgtgagtaattagtaccgtctgtaatgcttcaggtgtggactgcccagcaggactctgaacttcttgctacagcctaaggtgatactaagttttctgtagcaacactataatgttgagagttactgtgtttatagaccattaacacctcaaagtctttcttccatctgctcctcttggcacactgctctagataatcattttggaatgagtttagtcctttacgctctccctgttagatttcatattgttactgtggaaatcagtatttagcatgggtaagaactggccttagatgcaagccatctggttacagatcctcactaccactatcatgaaaacttggacaagtaacttgtctccccaagcctcagttttctcatctgcaaaacagcaataatcataaagttgtgaggtttcaatgagatgccatatgttagaacacttacactaggtacctggtgaaatagtgggaacatggtaaatattagacgttactgctagtgcattaacctcagctcatctctttcatccattggcatgttaatgagataatcgtggatctcaaatcttcccttaactatatttacagctctcttttccacaaaccttctaaactttcctcatgagacccccaatcagtctctgtctcattctacaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctggtaagtcctgagactggaggcctagagggtgggctcagaaggcccctggacagtaggttttcttaaagtttgtatttgcagtgtagcagaagaagatgatagaattctctccaccccacccccaccccaccccaccccaccccacaaccctccaccccgtgatcagaaagctgggtcccagtcgcctgtttttttcataattaatgcctccttgtttcaaagcttacagcccctttgcacctcaatagttagagcaaaactgaagtgataactttagactttacttcagaatgagttttgttttcactcccttgaaattaaatctgccctttggcaataaataaaaaagggctaaacaaacttaattttactttgtgggagaaagctaaatggagttattttcttatttaagctaaatgatttctgacattaagctcataccatttccagtgattggccactgcactttactgattgtgaaacgccaagagagatgagggctgagcaaattggaatatactcaagggtgtcagtttggtgcatgtctgatggttttctcttctgtctgggagtgcatgtattttccaaaatccaccttttgaaaaatactggtaaagtgcccaaattgagaattggatttcagaattaaggagatgtcagtgatgggttggagtttaaatgtattttagaaatggaataaacttttagctcattagaacttctccatccaagaaggagctgtgggggagtgtgtatttatcttgtaaatatcaagtgactcagtgtcacagaggcttctgcatcaatagaagctactgctcatttgaaatgagtatctctctggctttttccatgatagattttgattgtgatacacttggctattcatttgacacctaaaagaaaatgattcacctctttggaaagatataaggtgtttcattatctgatcgtttctgcaaactcttattccctgcatctcgtctctctcattatggtgcacccatgccagctctccccctgtgcttctcttgagtctgcaagacctgatcttcgaatcaagttattatcttgaagtcaggagggtcgaagccagcattgattgaggggcttctatgtgctggacctgcacatgtactatctcatgtcatttctcttacctgccctgtaagggatgcattgtcacctccattttactaagaagtagactggtggtcatagcatcgtgaaactagcaaataacagagccaagatgtggatcattctgactggctctgaagcccatgctctttgaactgcagcactctggagaaaggaaggaactgggattttggcatttctgtatcctctggatatgtatggtttaaatttttctgttgacatcaagggcagctgaaatcttttgttcccctcttctatctactttccccccctcgatttccatgcctgtatcaaatttgagcaagtttgtcagtagatgaaaattaccaatttttataggaagaatagggaatgcagcatggttttctgaataaaagaatctcagtaggtggttgtacaatgttagtgtgttttctgatataaaatataaatatgtatgggtgggtgtatgtgtatgtctctatctctctcttttttttttgagacagtctcactttgtcgcccaggctggagtgcagtggcgcgatctctgctcactgcaacctccacctcccagattcaagcaattctcttgcctcagcctcccgagtagctaggattacaggtgcgtgccaccacacctggtaatttttgtatttttagtagagacagggtttcaccatgttggctaggctggtctcaaactcctgacctcaagtgatccgcctgcctcggcctcccaaagtgctgggattacaggcgtgagccaccgcgccaggcatctccgtctctctttcaggaagatccattgtttccccatcataggaatttttaaaaagtaaaagcgaactctgcctttgttctgatttatgattgcttactcaaggaagaccaagactttgtggttgtggccttcctttggcagataaagtaaggcacagagtgtggcacagtcatcaagggtcacttggatggtcatggcagcactgctatttgaagctagtggcttggctcctgatccagtgctctttctgtcatactaaactgcctcagtagtgttagaggatgaccccacttatgaatgaatgtaaaaagtaccatcattctcaaagtttaatgtatttgggggaaaaagtagttgaataataaaatgtccatgtgtctgtagactttcttcctagatgagacaagatcatatctgcaccttagaaagagctcctttgttattatttggtatttagctcagtgcttggggggaaccaaggtgaaaccagatgtcattgcatttctaggacagccttgcaagtcagcaaaggaggccagccccatttgctgcagttgtatgtgctgagggaccactgcatcatttattagacatgcatagcttgggataaaaagcactgcctttttccaggagtcctcttggtattaatacagctacatgatgacatcttggtgagtcactagagtcctcaggaggaggaggataccagtcgacaggcagtgcagattatccaaaagccagcctccccttctccccagatatgcacatggccaagcttggttttacccactctcttcaaagattagtggatttgaggtcgggaaacctgaacaggaagaccagttgtgctgtttaaccagtcagctgaattttgaccaacctattaacctttctaggttcttgttttctcacttgtaaggtagggagaatagtgtctaccttacagaatatatacaaatactgcagaatcaacagcatggtacaagagtggtacatttgtacgttcgttgttcttccactagctttgacaaaaaccggctagtttttgaagaaggtggattgcataatacttgaattgactgtttagaaataaattacccctatattttatttatttatggacctttgctaattttgagaagaaatttgtgttttctcttccttgtgtaatattcatttgttttatagtgaaaagttgccagtacattttcaggtataatctttaaaaaggtggccaccacatcagcttaaaatactgctagcattgccctgcccaccacccaaagtgtcactacatacctgagaaggacatgaccagtgcatttttcccatttctgaaaacccttggaatgcactagctattcgggaaggctgtaaatcattattttaaagagaggagggagggagggggaaggaaagaaagagaggagggaagcaggaaggtgggaagagagggagggttgatggtaatgatgtctgcccatggagctggcacctgtgctggccagagggatcaaggttttgaaggcacacaggttcagattgtgacatggaaagccagatgtctttcagagaaaccctgtgaagctctttttaccttttcacattaccctgatattcaagggaccttacattgtgcttcaaaagttcaggctctgacctatcatgctattttcttcagaacacggcagatcacttattgggtccttaaaaaaactcccttttataaacttaggtggtaaagtaacagttggacacaggcataacctaaactttttgtgtcagtggattataatatgtgggctttcccaaagagttgctttaggccctggccccttggacctgtgatttgaatccttttctttgtcctttacatgggtgctcgtctcatctcatttttattgtagccccttctgaggtttgtgctttttggatgaggtcacatggtagatagggggtgcagggggctttctgtttgcattcactggcccagaatactgtggttttggcccgttgctccatgatacatactatcaactagagatggttttgaattatttaatctggacctcagcaaaataggtacacttaaatagagattgaagaaagggaggttggaattttttcctcctgagatttcaaatgtaaggaataaagaactttttgaattaacgaattgttttgaggcagtggggatcttcccatttgttctagctttacaaaattaaatctattttctgaactgtacggtgggaaaatatttttaaggtacataatttctgaaaatgtctttgtggtaagctgttagtggttgtggatttttttttttttttagtgcttcagttaataatgagggagttttccattaatattccaaaccatgtttgccagcggatacagcaggtgaagtggtaaaattatgggcccatcaaaaatacttatgcttcctgtaatatgatattaagtttaatatttttataaccttcactgaattctaatttcactaaagtagcaagcatgcgtccatttgcagttcagttatgcacattggttgcctgtgtcccaagcaaattagaaatgcaaaatatctgtgtgtggaggggggcattggaaagagtcattaaagataccgatatttagttacagatacactttactaagtgtaccttgggaattgaaaatggattaaagacaaacacaaaactcccagtgtctgaatctgtattttaaattagaattcaaaggattaaggagcagtattcattcctgacatacagcccttttcagcactcttttcaatcacatttaaagcataaagtttttccagtaaaatcctcaggacagccaggtgcagtggcttatgcctgtaatcccagcactttgggaggccgaggcaggcggatcacctgaggttgggaattcgagaccatcctgaccaacatggagaaaccccgtctctactaaacatacaaaattagccgggcatgctggcacatgcctgtaatcccagctactcatgaaggctgaggcaggagaatcacttgagcctgggaggcggaggttgcagtgagccaagatcgcgccattgcactccagcctgggcaacaagagagaaactccatctcacaaaaaaaaaaaaaaaaaaaaaaaaaaaaaaaaaaagaaaagaaaaatcctcagagcatgaacatcagcagctcttcttggatgaaaacattgatcagttaatttaaatggatagtattgtgattaataatccttttaagatttccctgactcagtttaatgtagctgtttggtggccctggagcagtcaaccaggagtgcacctttcaggtgcactagggtataaacgcacagagcccttagacaaagaagccaaacatttatccatcaagcactgatagtgggagctgcatttggggagtttgagcttcttaacagcaacattcttctttgtttgattgtttgctttggaagtctctgataagcgaaacttttttataagtggtttccatgaaccaggcttattactctcagataagaacaactcacattcatactttaaaagatgtctttaatctttttcagcagatgagagattctgcttaaacaaaaagtagaaaaaagaaaattaccaacaaaaattcagcttaattacgcttttaagggtttttacaagtttactgtaatacttaggtttttaaggaagaattgttactttttttgtgactatgacacagtttattctttacatttttaaatatcaagatcaagaggacttacacattttgtctacctcagttagctgaaggtaacttcaactctgtacagcataactgagaagcaaaaaataagcaaagttttaagaagccaaaagtgattttcttttcactcattatgggtccttgcatacttacacacttgagggctctccagtcttgaatcttgtcttgtttattcttaccttagacttactgttaaccctgtcctggttgccagctcatcacagatgagaataaagggaaaggggtacagaggtggccacgttgaaagcggcccatgtgacagtgcatagcagacagtggacgggctgggcaagaacaccaccgagagcaagtgcagggagcattcagaaataacagtggggagctggaattccttaagcctcggggaattgttctccatgttttaggtgatcagccccaagagacacagcttgcaggtttcattaagatggtatataatgggggttcatgtcacaacataagagtaatcagaaaaggggtatgttgtattccattataaatgttagaggagattgaaaagtatgttggatttttgaaaaagatttacattttaaaagatatttataaaaaagagtgaataagccttgttatttggccagtgcctgtatatagcagtcctcatcttccattgatactggagaaaggagacctcactgtcagcacatttgtactagtctcagcacaaacaaattaatcagactgtgaggagtttgttttctaagacagaatacacgaactggaaaatcctgtagagaacacaaagacacttcagtgttaactgatttataaataaatgcaattcattatttatttgctagactcagagttccatccatgggcccctgaataggcagaggtccaccaaggtggtcatgatctcaacgtgttctggaccctaaaggatataataaatttgctcacagtctaactaaaatgtccagcttctttgctttaggctagaattatatcaccttgtttaggtaatgctggttatctccagcttatcaggagctctgcttggcatttatgtatctgtgtctttgattagtctcaaaaaagtggatcagtgacttcattccgaccctgtaagcaccatatggtagaggacagtctttctctatgcaggctttgtgagaggacggggagtgcgagactgagggcactgccatgagaaactggaagccctgtcttgccctcttggaagggagggagtgactctgggaagtgggacagaagaaaagccagctggtgggggtaaagaagggtttcctctttgggcttctccaaggatatttctagggagagcatgattcaggaacgctttgaatgttggaagagaagaaggtgcaaacctgttagctaacgcaaaaaatgcaaattagcacccagaatgtgagctattaaaacattaagttctggtctcagtctcattggggagaaaaagcaaacatgtcagaaggagcttaggagtcttggagttgacagtctcccaataaagtaaggtgcccacagtaggaactgtggtatgaaatggtgtttcagcaggaactgcagtgttaggaggtatagtacagcacagattttccaggtgtgtaccctgggccagcagcagcagcagcccacttggggacctgttagaaattggagtgctcattctcactgcagccctgctaacacaaaaattccggaggtggggtccagcagtctgtgttgtagcaaacattcgtggtgactctgatactcactgaagtttgagaacttttccctccagaattcttatttaaattttattatatttatatatttatttatttttgacaaagtctctctctgtcacccaggctggagtgcagtggtgccattttagctcactgcaacctccacctcctgggttcaaatgattcttgtgcctcagcttccccagtagctgggattacaggtgtgtgccaccatgcccagctaaattttttgtatttttagttagggatgggatttcacaatgttggccaggctggcctcaaactcctggcctcaagtgatctgcctacctcggcctcccaaagtgctgggattacaggtgtgagccactgcacctggccttgtttgtttagttatttatggagttggggtcttgctgtgctgtctagcctggagtgcatgccgctctcatagctcactgtagcctcaaatttctgggctcaagcagtcttcttgcctcagcctcccaagtagctgggactacagacatgcaccaccatgcctggctattccttacagagttctgttagtggattcagtcctggaagatggggtatattgacatgtgagtagggtaagggagaatcaagagaaacgtgtcaggcagggccgacatgataagggagactttgatgatgataggagagcatcactgggtgtaaggacataggggcatgatgtgtggcctgagtgatgcgcacacctgttggagcagaagggaggcctgccaataagagaccaagaaatccaagaagggccagattgtgaaaagctgaactgattgccttttacttaggaaatagttactcttataggaggtttttgatctgaggaattaccatgatacaagtagggtattaaggtacgattaaatttgtggagtttgtaggggctaggcagggtgatttggatgggaaagaaactagaagaaacttggaaaaatctagaaggatctgtgggcctcagctgagattgtgggcacgtaaaatgtggagagagagatttcgaagataagattgtgagattaaaaaaaagtgaagcatgtgctgtagtacttgttagactttatttgctctgttaccgttataatgcagacgaaagtgatctgtgatctgttaccattatgatgcaggcgaaagtgatctgtgatcttttaccattatgatgcaggcgaaagtgacctgtgatctgttaccattatgatgcagacgaaagtgatccgtgatctgttaccgttatgatgcaggcgaaagtgatctgtgatctgttaccattatgatgcaggtccatgatctgttaccattatgatgcagacgaaagtgatctgtgatctgttaccattatgatgcaggcgaaagtgatccgtgatctgttacaattatgatgcaggcgaaagtgatccgtgatctgttaccattatgatgcaggcgaaagtgatctgtgatctgtgatctgttaccattatgatgcaggcgaaagtgatccgtgatctgttaccattatgatgcaggtgaaggtggtccgtgatctgttaccattatgatgcaggtccatgatctgttaccattatgatgcagacgaaagtgattcgtgatctgttaccattatgatgcaggtgaaagtgatccgtgatctgttaccattatgatgcaggcaaaagtgatttgtgatctcgtagcattatgatgcaggcaaaagtgatctgtgatctgttaccattatgatgcaggcaaaagtgatctgtgatctgttaccattatgatgcaggtgaaagtgatctgtgatctgttaccattatgatgcaggcagaagtgatctgtgatctgttaccattatgctgcagatgaaagtgatctgttaccattatgatgcaggcagaagtgatctgtgatctgttaccattatgatgcagatgaaagtgatctgtgatctgttaccattatgatgcaggcgaaagtgatctgtgatctgttaccattatgatgctggtgaaagtgatctgtgatctgttaccattatgatgcaggcgaaagtgatctgtgatctgttaccattatgatgcaggggaaagtgatctgtgatctgttaccattatgatgcaggcgaaagtgatctgtgatctgttaccattatgatgcaggcgaaagtgatctgtgatctgttaccattatgatgcaggcgaaagtgatctgtgatttgcttgggttctcagaagcagcatttaactgcatttaatcaagtcatcattactccaaggggtgtgtgtgtatgttttaagtagcgtatcttctgtgtttcttctctgttcaggcaactctgatcttaatgatccaatgttttatgaccccaaaggccctttcttaacaggatcccagtttgcaatctgtaatacaacaggcattgtatcacaaagcattaatgtagatgagtagtgacctggcttccaggctgtcttctggtaacaggcttctgtttagtgtagtatcagcagatacattttaaaagtaggatagatggttcatttaagagggctttatcatcagtattcacttgaataccagagatactggtgaataccatttggtgtagcgtaacagtgcttaaactttttggtctcaggacccctttaaattcttaaaaatgaagatgcagctgggcacagtggcaggcacctatagtcctagctactcaggaggctaaggcgggaggatcacttgagcccaggagttggaggccagtctggacaacatagcaagaccccatctcttgaaaaaaagtgaaagtgaaataaatttaagttaatggcaaactcttttatagtctgccatggtaaaaagtacataatttctgtcacaatttgcacatatggagctgaaagaactaatgattagcaacattctgtcatgtttttataaagttcccactaacaggatagagcaaattgaatttgacatgagatgatagtagctgagaaatacaaactctttgatgtgagttaggggccatgttatgcaggatgtggatactgagatactccagaagtttatgaagtttcacagaatctgggtgtcccaagtcctcactgtggctggctgatgtaggagcccacaagccaaggagagctggtgatgaaaaacacccccatttgctgttccaggctggtagaaatctagaagtgagtctttggggcctgagctgagattgtaggcgtgtaaatgcgaagagatttcaaagatgagattctgagatttaaaaaatgaagcatatgccatggtgcttgttagacttttttttttttttccaaagcagaaaacttttctcagatcaaaaacctcccataactacccaccttatacccagaacttcctgaaagttgacatgccggtagggcacagtttttattcccaattgaaaagtttccattcaccaatgcatgtaggcatctgtgtatatatctcctcagtcctccgcttttgcagaagggctgttggacctgctacctcaggctgtcgccggtgctctgttaaagtgattgcttacacccactgccttgtgtgcttgcatgcctgtttatgtcttctcctctgcccatgaaatggtccttccatgtctacactgtggtgacttggtaggtaggatgttctaggcctggagctgtgctggtgacatctgtaaggtctgcagtaagggggcagtatatctcagacagtgcccttttgtggaggtagagcaagcagttgcaaaggcctttgattagaggagcatagggaacgcccattccttccgtaagggatgtgtgtgcatgcatatgtgcctctattttcacctgagggccaggtacgtcccgaaaactcaagacctggtttgtgtaaatctcctttctctttttaaactgcagattctcccaagaggggtactacacagagccaccagtgtgttattacttggccgcattgacttatttaactatatttttacctcctggagggcctgtgagaccatttggtgtagcataacagtgctcaaactttttggtctcaggacccctttacattcttaaaaatgaagacgcagctgggcacagtgacaggcacctatagtcctagctactcaggaggcaaggcaggaggatcacttgagcccaggagttgtaggccagcctggacaacatagcaagacctcatctcttaaaaaaaaaaaaagtaagacccaaaaagcttttggtttgtggggtatatcaatatttattatattaaaaattaaactgaaaattcatataattatttaagaataacataattacatgttaacagagtaacatttttaatgaaaagtaacttttcaaaaaaattaggagactgatacttgacattttttcattttttgccaatttttctttttttttttgaggtggagtctctgtcgctcaggctgtaatgcagtggcacaatcttgccactgcactccagcatgagggacagagtgagactccatcctcccaggttcaagtgattctcatgcctcagcctcccgaatagctgggattacaggtgcccaccaccgtgcctggctaatttttgtattttcagtagagacaggttttgcctcttggccaggctggtcacagactcctggcctcaggtgatccacccaccttggcctcccaaagttctgggattacagccatgagctgctgtgcctggcctgcaaatttcatttttctttttttttttgttttgagacagagtctcactcttgtcgcccaggctggagtgcagtggcgccgtcttggctcactgcaatctccacctcgcaggtttaagcgattctcctgcctcagcctcctgagtagctgggattacaggcatgcaccaccacacccagataatttttgtatttttagtaaagaaagggtttcaccatgttggcgaggctggtctggaactcttgacctcaggtgatccacccgcctcggcctcccaaagtgctgggattacaggcgtgagccactgcgccctgctgcacatttctttagtgtctgtttcaatagaagacaggctggatgctcatatctgcttctgcatttagtctgttaggatgtgttcttttggtgaatgcatatgaagaaaaactgctgtcaccacagatatgtagttggaaaaggggagagtatgtttaattgctttttcagataaatctgaacattcttcgatactacaccaaaacttgacaagtgttactttcttcaaggttattagtatgatgtggaatctgaagccatgtctgtgactttttgaacattgtttcactaaaacacatcagtctctgttgtactttgaatggattttgtgatatcatgcatggattgtttggaaaccatttgctgagtgttgcagagcttccaaatgttggcatattgcattgtacactcacaaaaaaatcacattcatttcttttcctgatgatctcattggaaaagtctgtaagtatttgcagaaccatgaagctctggttggcagatgaaagtattccacaattataatttttacctaaaagcctgtattttatcattgacagtaactactgtaaattgtttttctctagagtcaaagccaggtttgagccctggcactcttgtttaatacgctggccatgggacccaggtgagcccacttagcgcctttctgagcccttatcttgtttgtttttttttttgttttttctttttttttaagagactgggtcttgctctgtcacccaggctggagttcagtggtgctatcatagctctctgcagcctccatctcccaggcctaagcagtccttccacctcaatctcagcctctcaagtagctgggactataggctaccatgcccagctaatttttttgtggtagagatggggtcttgctttgtcgcccaggttggtcttgaactcaagtgatcctcccgccttggcctcccaaagtgctggtgttacagttgtgagccaccatgcctggcagcccttatctttttatcttgaaaaaggagacgtgctgcttggatggattgttgtgagtagtaaatgggagcactaaggagaatttgccttctatggtacctattacacaggaggcatgagtaaagattcttttcctttctttccttcttgggccatcatgaaagtattggggatgaagaagctgagggatgatggagaaatggaaaggaaggacctgttttcccttggggcattcttagaacccaggcagagctctggacacagtgctcttggctgtacttttttactcccactgcctctaggaaggtgatgaatgggaaggggcaggcagagcttcctggggctgttttttgggggtgtgttctgttctctggacccattggtttttgtatttcatctaaatagcttctctaaaaattagcattttccttggattgctgtcatgtgagcatcagggatctttacaaataaaccttgttcctcctcagagctctccagagtggtagacttgggagtggtgcaatagctgttcacagctgggagaacagagtctcaagggtaagacggtgtttactactagatctgtgccctgccaaaaatctaagagtagttcaggtcaaagttctcttctttcctaaactgaaaaataccagagcatgattttgtcacagccaaggaagacctgaaattcttaaaactgaattcactttaattttagaaagggaacattaatctaacagtgaatcccagctccaaagaaggttgacagtccctgtccaggaaggttcacagagcatgtaaagacattggctctttactttaaaatgtgtgttttcgttattgcaatcttaggggcaggaaaaaaacacattgggaatttggctttcagaaaaagcattgacctgccagtctggtcatttgtccctgaggttaagtgtcaagcccaggtcggtaaatgttccaggtctgtctgtaggaaaggtcagctcttgccagctcagtgatgccagagaaagagttatgttgataaaaggtttactctctgacagttattgaattttgtcctgaagaagtctcccagcaaggcttccttgtagctcagggccttcaggtgggtcttgtgggcagtgaagctgtctgggtgactagggacaccagtgcatttaagtccaatgcatggttaggtctcagtggactttctctgttcccatggtgaagagtgctactgcatccctaagatggatgggggaggttggtatttctatcctgttttgtgaatggttccattagctttgtcgtggggcctgggtgccagatataaatctagctcatattggagtgactagtgtggtgaaaggggtgctagactgcacttgtagtcaagtcttggctctttgtcccagtgttgccacttcttaacattgtgactttgagggagccacttcactttgtggaatcccagattcttcatttgtagaccacggctatcctgctttctatctgctgctggctgtggttgattgtgtggctctagaggaagcacctgggaagtcctaagttggggtttcaaggcaagagaatgctgatgagggcccagcagaaaggtggtagaagccctgctggtgagaagcataagacttgtactgtcagaggacaaggcaccagtcctttgtggtggctgtgaacttaggtccccacaccaactgcctgggtttgagtctgcactccaccaaggtgtaaccttgggcaaattcacctctctgtgttcattcttttcatgtgaaaagtagacaccagaatagcccctctcccccaacaatagtacctactttttaaggattaaatgagatgatggtaaacctaagggacagagcccagtttctggcacatggagatactcagtccatgcccactgttgtggtcaaggccacagtaggctttccctgcatgtgaagttgtctcagggaacttaactagatgtgtgggttagccaaagccttgtagcaaagtaacatattttaaagcagccatcatttgataggagtaggcccagctgtactctaggaagtaggctgaagggagccacttggggtaggaaggcacctccctccatgcagtgggtgtgactcatccacaggatcctctgtgtgagatttctctaggttcttagggaaaaaaaagggggagtataagctgataccgttttccctgctgtgtgagtgtcctgattgtaaaaattttctagctttatgttggcaaaattgtatttcaaggattaccttgattagctatatgagaaatgggttggagagaagctacaacagttccttaaatgttcttaaacatcttagattattctatttaattcctgaagagatcatttggatatgttttcttgagcaaaacaggcagatggtgttgctacccagtttcccaattctgtaaggcctgtagcagacatttacggtaggcttgcagtagtgaaagatccatggactaggaatcagaagactgggtcctcggccttattcccagctctgtcatgcgtgattttgtggctcttaggttggtgacctgcaaaatggagatgttggtcatccttgcttacttcaccaggggcgtccatcctaagacataagagaatgccggtaaattgctttacaaccaaagtacaagtattagcataataaatggcactgacaaccaagctctgaccctcctaatgaaatattttctttctcagtgatgttacagcctttcgattatgatcccaatgagaaaagtaaacacaagtttatggttcagtctatgtttgctccaactgacacttcagatatggaagcagtagtaagtactgaatgcttcttatttttttcagtaacaataatttaaaaaaccaattagatatggaattgtgggtgcatgcatttcaaaatatgtcaaaattatttaaaagggaatagttttttttcaaggaggtttgtactttatctacctttatggtttttctaaaactttgaggaataattttaacattttttgtgactttctagaaggctgttcttttctgactttcctgagctcagtgtgcttcagcagctccttgcactggtggatggtgtcttgcatggttagggattgccttctttcgcctctcctttctgccccgacagaaaaggatacttttcattgtcccgcctttttcttacttgtcttctcatcccccacaaactcaagagccatgtgagagtgtcagtgctgaatgtcctcacccatttagacatacatgtttgtggctttgttctagtaaatatgcttatttattttcccccctgcttaaatctatgtttaacttttctctaattttgataaaattaagatgacttcatttttataaaagaaataagtgatgttagtgatggttttggaaaaaaaaaaaagagtataatggacattccctccaaaacgagctttttatacatttgaataagtccattggcattctggggctgggagttgaattgaaatctacaatacaacccacagccccagcagggacagatgcgcttgtccttacagttcaggaaagcaggacagggttgcctcataccacttgcattgctctccagttttggcccgcccaaaggggagccccgagtcatccacggcaggtctgcccacctgagtccgctgttcatcacaccatactgcagttctcctctgtctgagtttcataccaagggcaactcaggccaagaccaccccatgccctatgtcaccacatagccttttgtttaagttctggagaagcatctccgctgatgtttcacttgtaggcagaaaatgaaggaggaggccagatatttttgacttttagagagatcagtgataataggctgtcttcttttcataagaacaattcttatgaaaactttctctgattttctgcaacatgatgtgttacttcatgttaatttgtgtgatcaaagaaacatggcagatagaaaataatggaagatccaagggtgtgttctgtttggcttctgctgcatggcatagtgaaaagagcatgggcttgggtgttttcgagctgagttcttccttttactgacgttgtggctgggagcaggttttattaactctgttgaggttttgatcatttgtaaaatagggataaaaatgcagctcacacagtggtgagtatgaagtgtgcctgtgtaagtgcctggtgggtccagtgtctgacacttgcttatcagagtgtgtaataggccagtcactgcatatctagtaaagggtcattttagttccttgtatgatgatataagtttaaattttttttatataaaatgtacattgtgggaaattttggaaatacacaaatgaaaaaaatttaaagtgacccatagttcttttctactaggcctaaccatcattaatgagaaatgagagctttgtgtttttcttcctttttttttttttttttttttttggagacatgattttactgtgtcacctaggctggaatgcagtggagtgatctcagctcgctgcagcctccacctcctgggctcaagtgatcctcccacctcagcctcccaagtagctgggaccacaggagcgcaccaccatgcctggctaatttttttgtagagacaggttttctccatgttgcccaagctggtctcaaactcctggactcaagcgatctgcccacctcagcctcccaaagtggtaggattacaggcatgagccactgccccagcctgctttttctttattttaaaatgtttttctttttattgtgatatacagaaagttgaaaaaatagcatggtgaccactcatataacttttacctagatttacatttgttaacatgttgtgacatttgcttcctttctgtcacaaactttcttatttgcttgagatgcaaatttatgacacttcacccctaaatgcttcagagcaaggacagtctcttatatagtcatgatactattaatcatagctgaaaaaagtaacttcaattcagtattattatgtgataaattcatattcattatttcctagttgttccaaaagtgacctttagtagaggacacccaaacctttttgtttttcaaactttgaactttttttttttttttttttttttttgagacaaagtcttgctttgtcaccaaggctgaagtgcagtggtgcagtcatggcttgacctccacctcagctgttcgagtaactaaaactacaggcatgccaccatgccggctatttttttatttttttatagagttggggtctcactatgttgcccaggctggtcttgaacttctgggctcaagtgatcctcctgcctctgcctctcgaagtgctgggattacaggtgtgagccactgcaccctgcccaaactttgaacttctttttttttttaagagtccaggccagttgacttacagaatgtcctgtattctggatttatttgattatttcctcatgattaaattcaagttaaatgtgttttggcaagaatattccatagttggtatttcataccaggttgttccgctgttggtgatgctgtttgatcacttggttaagatggtgactgccagctctctccactgtcatagcacaaagcacatttgcccctgtggttaataggtaatctgtgatactctgagtcatctgatactttgagaccatgtgaatatcctgctcgccagcagtctttcacctggtgcttttagcattcagtgatgatccttgcttgatattttttttgacttatgtggtaggcacacgtgtacaggtgtgtgtgtgcagaggagcagacttcagtattctttgcgattttttcacttaacattctggacattttctccatctaactgagtgctcttcagcatcatttgagtggcagcatgctgttccgtttagtggatctgccataatttttgtggcagtcccctagggtcagatgtatagattgcttcccacttttggttcttggtacctgtgttacagtagctgcctcttgcatggttttgggaagggttgagggcatggagggtgggggtgccttctttttctatatcataaccttgctgctatcctggtctgtaatcctagaataccctggaattcccatcttctgctgccaaaaggagaagtaatcaggagcgtatcctcttaggacatgggatttagctaggaaggtgctctcactacagcctggagggatggagatgggtcttggggtagacacagcccacacactgccacagtgacagaggagggatttggtaatgaatgtgttccgttggtagttggcagagtggttctgaaactagtcccagatagtatgcgcttatactttctagatatgcctttaaaataagtttcattttctcattttaatttaatttattatttttgagacagagtctctcagtgtcccccagcctggagtacagtggcatgatcatggctcactgcagcctccacctcctgggcccaagtgatcctccctcctcagcctcctgagtagctgggaccacaggcatgtgcctccatgcttagctaattttttaatttttttgtagagatgacgtctccttacgttgtgcagactggtctcaaactgctgggctcaaccagtccctccacctcagcctcccaaagtgctgggattacaggcataagccaccatgcccagctgaaaacaagttttattttcataaggagagccaaggttacctggtcatccagacattgtttagaggattcctttttgttcagtggtgggcctgtcccacagagtagcaacatggggagcattggttgactttgaggagtcaggcagcaagacttcagggtttatgaagtgtaatattttgagaaagtgagtgtatttaatcttgtcatgttacaaatattgaaatctcagcagacttcagttctttatttgatatacatcagggctttctcattaagagtatttttctgaaattgtcagttataggaagaaagttattcttccagcaggtttataatatcttgattattaaatttaaattgttttagtggaaggaggcaaaaccggaagaccttatggattcaaaacttagatgtgtgtttgaattgccagcagagaatgataaaccagtaagtatatttatagttaacaataattgaatgttgtaagctgatacttatttgcataccatttcctgcaaaaccaagatttaagttggcaaattattttcctttatctgatgtctgaagaaaaaaaataagctgaagtcagcaaataagtgggcctttatgaaatcagcctttgaaaaactcacggaaagacaactgattgacagtgtttccccttgaaaagtgcagcccgatggccattgagatgtcataaatcctgaagagcttctgtggcctggcaaaggtataggttgctgttaaacagtgggtgagagtgaaagagggaacaatttgccctttatcatggtggttgatggacgtgtgggaagctttcaagttctcttgttttacaaagtgccctgtcagcctccctaccccttttaccctatctacctcttcaatcaaaggctgcttttagatgaggatttctcagcctcaacactgttgatatttggggcaaatccttggtggtggtggaggttgccctgtgtactgtagggtgttttattaatagcagcatccctggcttctgccctcttgatactggtagtacttcccagttgtgacaactaaaaatgtctccagatattgccacatgtgtcctggagggcaatatcaacccccattgagagtgatcccattccggtgttgcctgtggggagaaggaaggagccccatcctctaggctgtccactgtgagcgctttacctttcatgatcctcacttgtgaccagttgaagaaaggagactgtatctgaaatgctaatttggacttcccttcaacctagtcgaaaacattttaatttttataaaaacaccaaaactgtgaaagcatgcagcatgtgaaactatcctagccattaatagctggagttgggaaacagaagtaccctgaaatgttgtgttaacagtatctatgttggtctgcgcgagtgctgttgatttgtgtcaaaactacctgagattttatttctgctgaatcatttaccactatcattaccctgtttctttaagtggatagtggtcattttttccctcttcccagtgtacatcctgtcacaggaaggtcagtttggaagctgtgaaagcagtattctggcctcagctctgtgataggttgacttggtagcctggggccttgcttcacagggcctactcttctcatctggaaaatgatgggtagagctagattccaggccaatgatcgtcagttactctttccctgacaagctgcgtgcttccatgccctccctccactgactggctctcatcccctgtaaatctcaagaggggatcatagctgaatcttggcaggggaaataaggggagtatgtaacttcccaagattgaaacattgcagacactgagtttgtttcaccttcatcccagcttccaaatgctaagttggtaaagtaattcgccctctgtctaatgctctcccaagcctcctaaccccactaaggcaatcctagggatgttcacatctttgtggtgacagtaatttgtggctaataattcctgagcttgcacaattacagtatgctgatttttccgtggcaggaatttgatagtgcaatatacacagccctttttctctttctttgaagtattagtctcagccgaacttcattatttgcccttatccataatttctagggccctgttgctttagattattaagatatcagataaagtaatccatttttaaaataaatgtgacattttacagtgtggatgaaatgctaccacgtttggtgtttgctgagaactactttactttgcataaaaaagtccattattacatggtcggtgacacttaggctttcatttgtttttgaacagcatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggtaatagtttattttctggtaatctacagaaaacaagggcgttttcactagcttcttgggtggggaagttgatgagccagtgaatatatagatttctttttgcttttggtatttggctatttttttctccccagggagaaatttccatggctttcatgagagtctcaaaagggtccttggatctgcctaaattaagaaccactgtcccttgatcagaaatttctcaactgttgaagctcttgtccccttaaaaaaaaaaacaaaaacaaaaaacttggccgggtgcggtggctcacgcctgtaatcccagcactttgggaggccaaggcgggccgatcacaaggtcaagcgttcaagaccagcctggccaacaaagtgaaaccccgtctctaataaaaaatacaaaaaattagttgggtgtggtggcaggtgcctgtaattccagccactcgggaggctgaggcaggagaatcgcttgaacccaggaggcggaggttgcagtgagctgagatcgtgccactgccctccagcctgggtgacagagctagacttcgtctcaaaaacaaaataaacaaaaccccaaacaactcaaactctccattattgtaaattgaaaataaatgttgagaccaaaatagtttttattttgaatatgcatttttaaaccacttgggtgagaatcttttttcagagagtgaatactgacctatactctgttttaatgcaagtatagttctgattttagaagactctaaataggtctgggcagttgtggctcatcaaactattgatgtggtgatgagcttggaggtggggtgcctcacagtgggtaggaggtggagattatggaaggaaaatctgagcttctagcttctggatgaggcagttggcattggcaatggaaggttgtattgtactgagtgatgaagtggggaggcagggggtgcttcttttggcttgtggtggtgtggaagttgctcccatccaatatgaaacagctctgaatctgtgctggtcacagcatctcttaggcctctgtttgctaaacacctctaaggccccttccagctttaaaagtatgagttttcttctcttttactctgacagtgaggtagatataggagaactgacagcatttgggaaatggcatcatcttcttcctttgcagtgattttgatttgcctcagtcagtaatttctttagtgtgtagtaaattgtgaagctgacactactttttggctaaaaatctaagctatgcctgaagcttctcgagtgtatttctcttctgaaacagagttctgtgctatttaaagtggtaaataggtagaaatagcttctatataacctaataaaataaatggtttagtttgccgggtttttttttaagccagtcggacaccaccagttgtttatcactgtgcagtgatacgggccatgccccatgagcagaatatccttaaaatatgatcagaccaatctcaacattagaagattctttatcctgccaaacactgccttcttgttttgtgttggtttattctgtcatctggccaacaaatttactgagggtctaatatgtgcccggcactgtggattcaaacacgaacagcccctgcccttgaggagctctctgttgttgggatagcagggagagacatagacagaagtgattacaagccagtgtgatcaatgtcccacagagatagcaacaaattgcagggagagtcagctccatgggactcatctgcctgtggtccccaggacctactaggtactcgggcggatgggagcgaatggaaggaaacgaagaaaagaaagtacagctggtgtgtggggtttaaggatgaggagatgaggtaattagcaagagatctatcagcaaagatgagtctgtgccagaatagaatggcttgatgcatgtccctcttcagggatgtgggcttggctttgagagcatggaaatggcatcatagatctacatagtaacttgcagattcttaggaaagtgcaaggcagttgtggcagtggaggtgaaggaagaaaaaatttttcatttcttacatttccatgtagtttggggacaaggggagggtggggaatatggtcaaatatctttatatgtatgaaaaagaatgttgcttcttcaatgagaaatctatgcattaagtagaaaatatttgagatgagtgtatgaaggccagtcacattttaatattccaaatatcatttgatccagcagtctggatgtaactcattaagtaccagctatctacagagctctgcatttgaaagcttccagatgtcccacttttaggtttttttttttttttttttttaatatggagtctcactctgtcaccccaggctaatttttgtaattttagtagagacgaggttttaccatgttgaccaaggggtagtcttgaactcctgagctcaggtgatccacccgcctcagcctcccaaagtacagggattacaagcatgagccaccgtgcccagttgactttgtagattcttttatttatatatttatgtcttgggaaatgcctgtgattttaaaaatcgatgatttgatcaaggaaggctattcattagaggcaggaaggacagagaggttggggttgaagagaagcatccggaagacatggccatagaggtgggtggggccgagggtgcaaagggcccagttgacccttttaagtgcttttttctgtaaatcacgggaaaccaaggagcaccctgtttagatgtctgttgtaactagcagcagcaagtggaatggatgaaagaaaagaggggactgttttctcagtggcttcaggctagccctttcccctctgtagcctgcagtttctccgtttgcaaaatgcggttggaccatatcatgtcatccaacactgggcataaacagcccatcccgttaagctgtacagttgactcccctttctggtgccttggcttgtctttgaaatgtgcgtttgctcccgtaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaattcttttgtcattttgtcacatttgctctatggggggaattattattttatcatttttattattttgccattggaaggttaactttaaaatgagccctatcactgagaaatacgtgtttcatgatttaactctgtgtgtgtgtgtgtgtgtgtgtgtgtgtgtgtgtgtattttttttttggttgtcttcagctgacagtatgaaaaatgaaactgctgaaaaagctgagcacctggtcacccttggccttccattgctttggccttcagtaaaaagcagcctcccttctaggtcagggaaccatgccattgagactagtaacgggcgttctgggcacagtcccactgtgcacaggtttgagaggacaagttcatcagaaggaaggcagtccttagaagtcacatacgttgagccacgttgctcctaagcctggctctgtcaagctgggtcaggggccttgaaactggagaagtggaagtctatggttggtctgagtaagtaacttcctgtcttcatgaaaaaagttgactttgaatcccaggtactcacagaaatggtgaacagacttagttgttacccaggcacccatggattgtgttgagtgtgcagacagggaggccaccccaataggaattcgtctccaggatttttcccatgtgtcccccagtacttataaaagggagtgaaaagaccgagctgtaaggcatgtgccttctgccacctgactttccgtgaggggactaaaatttactaattgtagttgctgcagccagttaagtcctgtagcttccaggccctcatgtctttgataggagagtgcttaggtggtccccaacagtgcctaggggtacagtacagtcccattacactagagcagggctctatttatttttaaaggatatggccgtgtgttttgataaaactttattcacaaaaacagccgggtcatgggatttggcttgtgagtctgtaacagttcttaaaaagaatatctgagaaactactctgttttagacctttgaaggtgatttagagttttgtgtacatctaggagaaggtgttcagcttctcagaggatgtggacattttggttgcagctaaaaatcagtctctgaagtctctctcccttctagaggttaggacttggtgaacatgtttgtgggccttttgactgagtggcagaaggaaactgctcaggaagagaaacaggtgactgatgggaaggttgattattttctcagtcatcctggcagccaaaaatgtgccaggaaaagaaagaatgtggagcacgcgtggctcctggaggacttggagatgcatgcacatttagggtgttttccctagaattacataatgaaaaaaagaataaggcaaagaggaggtgaatatggggcctgtcacaacggcctgccctgccccaagagggttaagagtcagataatcgggacgaaactggcatggaaagagcgagcctagggaggatgccgctgggcagtgtgcatgggggagctgctgccaggctgccctccagtctgctcctgtggttactggctccacagcacctcagagagggcggccctggcttcagaaatgccagccatagtgctcacaaatgcagaagagatggaagcggtgacagaatcctgaaagtttttattgattgaagttttaaattggtaacttaagcttccttggcacgatacaaaatacctcttaaagacagcaggcttttttatttgtaggtgtgaggaactggctttaacttttttctcctcctagtttgcatgttttccttctctcgtcttctgaactgctggcaccagcagtaatacatactgataaaatcaaaattgatttttaccagtggccagtttatggctagagagacgacttatacctccataacacagaagggggaaaaatgaagaacctccagtgatccgtgaaaacctaaacgctttcaaacaaatcccaggaacagaattgctatcgaaagatatcattgcccagtttgcaggctatgttgagtcagatagaactgaatgtagtgagagctcagagctacagagcctttcagatgaatttgaaaacagactctgtgtgtgtgtgcatgtgtgcatgtgtgcatgtgtggcatatgtgccgtatgtcagtagcttgacagttttcaaatcgtgcctatatttttttgcatacacaaatttttgtgtttgcaaactcagaatccatgccaaaatacaatgttatatgtcattttcagctccttctctaaaggaatggcccatttctcattgtagtttgagaaatacatgtatgaagagataggggtcttgggcttcccagtgtcactttgaacacctgaataacatttaactcctgagaccttctcggtgtagaggccactgcttccccctgctggagatggcatttcattgaagggcctctcgtggctttccctgcccccggctgtctggcctgaagaaggagaaagaaccaaactgaactatgaaaagttaccactctgaggagacctctcttaattaacacttggggccatgtttgctgttgttgagaaggagtgttctcaaagatgagctggaatggaattgtatttagaaaggcccctgcaaagtatatagatggatgactctagttcatgacatacaaatcccataaggccaacgaccactcttctggaacaccaagagcagctctgagatcatgctggccctacgcgaattgagtttctgtggcctaattggatttggagaacgccttccctggccccttttcctcagacagatctgctctgataggaaccttttcaagaaagttactgttgtttcaatgccactccttacctgtatagaacatttccaatacattcgctcattgaacttaatccttgcaactgtgactggggggtagatggctctgtttgcatacgaagaaataaaggctccaggaggttaaatcgggcaactttttagaactaaatcagtctctgtaaggcctacattgctaagataccatttcagctctgaaaatctgcttcagggaagtgagtggatgaggccttcctgcctcagctactctgcccgtctgtacatcttttgtgtctgcctccgtaccttattcagttattttcacactaaagtaagtagaattaagactgtagttcagatgctttttctttttctgttggaaactgaacacactacagacagtgaaaaaaggtacatattccattttctcattgcctgaagatctctgctgatgctcctggagaatgactttgggggctttagaaagaatattgccagtccgtctcggcaaggagatgatgggagcgctttatatggaggctttacatgacttgtaaattaaatgtgaatgagggcagttgattaaaattggtattacagaagggccctgctgaggtttgaaaacagctgagctgctgatgtctcaggcctttccctgaattagcactgcggttctccaggatatcagcaaagagggcaagtaatagaagcccctgataaggagcgtcagccgacaggcaagcttgggaggctgtgggaatgggtctgcccccagcttcacagacctcttcctccagcctctgaatcccattagccacagcctagaacattagctgagctgcacaagctcacccacccctgtgccagggggccctgacctccctccatgccatgtttttggctgtatctacggcacttaacaataggggctttttattttcattacagagatattttgaaaaatttaaaagacatgaactcacataaacagttatggatgatagttaaaagagaaacgggtggaggtggatgagaggttgtcttcatgaatataattacttgagatttttttttcttaatggaattagtttattagaaaatgtctgtgttaaatccgtagaaaaggaagaaaagtgtagcaacaaaaatgtagccattatctaacttgccataaatatttgcagttatgataccttggaatgttgccacgatatggattgctttgattaaaagatgtcagttgaataaaacagtactgtgggagaatcgctttctgctgctagataaatgctgatgtttatttttaaaccaggaaacattgatcctgtaacaatgcccgattacaattgctttattacaccccagggctgatggagatgtaatcacttggctaatggatgtgggtgcaggacagatgctcgcttgctggcctgctttcctgcttgcattctgatgagctgcaggagtgcgcctggccttctgcaggtggagctgctgtcagagcttcgtttcactgatacccaaagccatgtctgactgaaataaaacaggttccctttttttttccctttggaaaatgccaactaagggagactaatcagatatcttaacacaatttcatccaggcttagtgctaacaagattgcggggctttttagggtttaagaagatgagaaatgagtgtgcacgtttcacacgttgacttgccggtttttccatgtcatacaaaaaagtcctggctgtttctccgaactggctgcctgcattcccgtctttcttttgtttttaagaaatagactgaattcagctgttaatcctctagtacagtatccatgttaaaatgtttttccattgcatcttttatgtgaattcaaaggtcagaatttattgtctgtgatattgagaccatgtgtacaagaactactttttgcttttcatcattcactccttagcaaacgtttcgtaagtaccctctgtctgtttgctactatatgaggtgctgcgaaattagtgggcgtggctttttatatttttcattcgtgtgtagcctaagtaaggtgactcaagatgatacaccgagagaaaaatgcaaaatatatttggttctcatttctgttgctgtcgtttcctttttaaagacgatttatcaactgctgccatttggaacttcctataagaaactaaaaatgatctatttcagtgttcctttcgcctttcctctgctttctgaataaatggtttcagtaacccatgctgttctctccctattctacgtctttctccctatgttgaaaaaagattcccacagtttctgatgtgtgtgtttatagtcttcaatgtatgttaacatgttaggaactgagtatcttaagagatgtcttagaatgctttagttttcataatttgtcctttatgtatttttcattgtatttgctgttttgacatggaagtaatttaaaaagttggtgcaggaaaggactctttactgttgcacattttggttttctgatatgtaataaattcatggcttggcagctgacatgatgtttcccagagagaaggagatgtatttctgcagggtccagaccaaaagagccatttacagcatgttctcccatgttccattatcagcctgatgaaacctgccctgccaaggcataaacttttgtactagctgtctccatattatgttcaataaattctgtgctctgaatatatttaaa

SEQ ID NO: 510 - DNA, 44345 bp, Homo sapiens
ctggcaagtggtagtggcgcttctcgggtgctgtgcttcacgttttggtactaaaggccgagactgttgtggcgacggcgacctctacggcaacggcttaagctctcggaggagtggcagagtacgatctgaaggaggggcttctggttagcccaggtgggctcgggtgcccgggctgctggggaaaggactcgagggaaacgccgttctcccggctctgggggcgccctgcgcctccctttctgccgccgtcggggctgtgaagggcggcacgcgcctgcccgagctcctgtagggagggaaagcgcgcggggtcccacgtcgcggccatcggcgaaaaggggcgtccgctggggtcagcccctgcccctcgggagcaatagggggttttcgtccctttcccccccgcacaggtgctctgtttccccccgactcccacccaagttcctgactcccctcagcgtcctcctaacactcgaaccgaattcttggcctgagtcccatttctacccaggtgcaacaatgctaggcaaattgacccgcgcggcatcccccgcccctctccccgggctggagcgggagggattgcgcgtcgtgcccttcccctattcgcggcccctgcgcgtcctctgcctttttatacttgctccatctcccccttgactccagccctcattcttcatgcctcatttgcctgggagacgttcgccacttctcttgtgccttgcggtccgtgagtgagcccatcaccccctaccaacccctaaattccattctcatctctccagaaaactaacattttccacttgcctcttccaggcagctggaaggtgaactgagagaggcagaatacgcagaacagggagtttggcaaggttgggaactttaatgttttgttcctggtagactgtttttgccttcaaatggcatttgaccattatacccgctctagaatctttgtcctaatgcagttcttttggtggtaattgctgaaaatgcagttgaaaagggctaactagaagcaagggatttaaattttgttactattattttcagtaaattgaattggattatactttaaacagcttaactggggtttctgggagtttgtagtgtaagggcctggctaccctactttgtcataaaatatagaacatacttagttgtacagcacagtgtgattcgatcacacccaacctatgaagggataataacagcattgaatctgtccaaaaacaacattccctgttcccttttcaccttcatagtatattcgtttggtttctagtaatgtcggttctagccatatgttttttgataacagtacaaactatgctgtgcctaagtaaaattatgccaacaattttatggggaaaagctaatgcactgctcttagctttgattaagattttagacgtttgaaaatataaattcagatattggacagtgagggttttattttgaaggttggaggagattgaagtgttggggtaagactgataggctcctctggctacttgtatatcggggtggggagaatatacaggtttacaaaatcttgtaaattctcacagtgcttagtttcctgacttttcaaaaattggaattgtttttcctagctttcagtggagaaatgtaagctatgagtttaacatcatgttcactgtgttttggccaggattttgcaagcttttgtggaaaaaattatattgctttctttatcctgtttgtaatgtatgtatcagtatgcttccttgtattttactgtggtaaaattgtatcttgtatataaagaaaaaagtctattatagtgaattaaaagaaatctttactctgaggtggcagccttgtctaatggaccatatgtttaagccttgttaataaatcacactagagcctagcacagtggtgtgtgcctgtaatcccagccacttaggaggctgaggcaggaggattgcttgaacctaggagtttaagacaagcctgggcaacatagtgagaccccatctcagtcaatcaaccaatcaatcaattacactaaaaagagtaagatcttaaaactgttccaacaaatgtctgggtgtctaaaacaaggaaaagagtttatgacagagttacagcagtcatcagagaaaaatcctggacaaattgcaaatctgtaacagttgtgaattgctgtgactgcagctgaaaaccaaagttatttttgtgcagtcttttttgggagtatttgtgtttaataataacttgtttgcaaatttagaggactctagctatgatttcttcttagagaccttgaggagctcacagtttaatggaagagagaactagaaaccaataattaaatgcagagagtgaggttctgcagtagaaggtatatacagggtgcagagaagcacgatggcactgtgttctgatctcatctcctactgctctagacttcctgaagtgccatttcctgaacctacctgtttttttccaccatctggacctctctctgtatgcaccattctctctccttgcaagccttttccacaccttatgtgcttggtgaaattctgtttcttcaaaatcttgaagcctgcctctgcctcatccaaatgttttgcctacttctctgttatttctttataaataattatagtcaattctcattatttgcagtagttatattctataaagttgccaagaacactgaattatcaaatattcaacccttgttcccagggaaaatatatacatatatacatatctcacacagattacaaaattaattcctaaaaacaactcatcctggtagattgaattttccttacttacaaaaaataaaggaagtacagaagtgttaagcgatttgcctgaggcctctctactaacaggtgccagagttaagattcagactcgtccagatggccccagagccagagcttcttgcactacgctgcactgccctctgctgtctctgtcctctggtcatctttgtatgagggctgagacaaggctgagggtcaccttgggacttgggcaaggagtgacatatttttcactactatgtgtatatccataagtcaccttgaaagctccacaagtatttggggattacaaagacattttagcaagtaagcaaatttgcaaatatgggatccacaaataatgaagatgaactgtatttgtaagtgactgctagggtctgtttcatggtaacccctttccccaacaatgtggactatttctttagcttatttgatagtttgtacatttattcataaatttattcagttatcatatattcattcattcagtttgttcatttatcatatattaagcacttaccataagtcagactcggctgagcgtggtggttcatgcctgtaatcccagcactttgggaggctgaggcaggtggatcacgaggtcaggagttcaataccaacctgtccaggatggtggaaccctgtctctactaaaaatacaaaaaaattagccaggcatggtggcaggagcctgtagtcccagctattcaggaggctgaggcagagaatttattgaacccaagaggtggaggttgcagtgagccgaatcgtgccactgcactccagcctgggtgacagagtgagactccatttcaaaaaaaaaaaaaaagtctgtgtttttgtttgtttgtttgtttttgagatggagtttcgctcttgtcacccaggctggagtgcaatggcacgatttcagctcactgcaacctctgcatcctgggtcaagcaatcctcctgcctcagactccaagtagctgggattataggctcacaccaccacacccaacgaatttttgtatttttagtagaaacagggtttcaccatgttggccaggctggtctcgatattctgacctcagggaatccacccatcttggcctccccgagtgctgggattacaggcgtgagcctctgcatccagcctcaaactctgctttaatctgtggtgaacaagctggagattaaggtcctgccctgtggattttatatttgcctaagaaagacagataagagctaagtcaggagctctggggaaaggcccaggttggaattatagattcacttgaccaaggtaaacctggtgtgcctgctcctacttcacatccccagacatacttccagaacatttccttttgtatttttgtgtacaaacttccttttgagcctctctccattgtcacatgtcaacctctacttgtcttttgttgattttgaggccacttgcccatgtaagtggcaggatattatagaagaatcatgctgacctgggtctttgaattctggttctgctacctaccaactgagttcctttggtcaagctcttggacttctgagcctgtttcctaattccaaaagtggtatatgatgtgttagtccctggtgggttgcaagaaagaggcacacacatatcagctttggtgatgagggctgaatgtaaacttggatggaaagtcatctaagcagccatattgtctcttggccctagtactttcaaaacttcacagaacattaatttagcagtatttagtatttgagctctgaagacctgccctcttttgctttgttcactcaacatttgtattttccaagagagaatatctgattggattagtctgtcaccttctaaaaacagaaggcccctactagagagaattttgagctgtgccatcatgtccttggtgattgatctccctgaagttcagcctatatgccgtcctcagctgaagcactgagccctggtccagtcacttgtggccacagaagtaaggttggttttatgcattaccagtcacacagatatgctacagatatgcttttttgtgtatgccacagtcacacaatagttgtattgtgtctggagttggttcctgcctgtgggttcacggtctcactgacttcaagaatggagccccagaccttcgtggtgagtgttacagctcttaaagatggtacggacccaaagagtgagcggtagcaaggtatattgtgaagagtgaaagaacaaagcttccacagcctggaaggggaccccagcaggttgctgctgtgggctcaggtggccagcttttattcccttatttgtcccctcccatgttccgtttctgggctatcaagagtgcccttttttcaatcctccctgcgattggctacttttagggtcctgctgattggtgcattttacagagcgctgattggcgcattttgcagagcgctgactggtgcattttacaatcctcttgtaagaggaaagttccccaagtccccactcgacccaggaaatccagctgtcctcacctctcagtatgactatagcatattttaaaagaaccctttggagagtttctttagaagacgattgagagtataacagttctagagtttcatggccttttgtccaattcaaatacttacctaatataatcatagataattattaataaagaatctaacaaggtaattgacacatgtcaaatattcaatacatctcccttttggtattgcatttagtattatagtgtggttatttgttcatatggctgtttttcatactagaccgtgagctctgtgagggcagggtctacagtttcaactgtagaaattctgaactcttcctgagagaatgggaggatagaaaggcttcccagagaaggtattatttaagctgatatctttaagggtgagtaggaatgctttccaggtgaataaaaccttcagacatcattccaaaccgagactagcaggtgcaaaggcacagagatatagagatggtgaagtttacttatgtgctgtttgtattaaaaatacaaagaacaaataaaaacaaaaattaaaaatcatctagaggaaaaactatgaatgggcttggccagagggcatgtcacaattgagttagctatgaccatagatactcagtaatggatggaagttttagggaaagagtataacattctcaggttgttggcagagtgtctagaacaatttagaaatacaggtaattgaattctgggaatgattacactgtagtgaaatcatttacttcttctctgcctgtgaagcatacatgtgttgcacactgttcaaggtcctgaaaatgagacttcttctcaaggagctcatgagcaatcaagggagacagatgggtgagcagctgattatcatgtgacaagtgaggtaatagaggtataacaaaaatgctatctaaacaagaagaaaggaataattagtaatatatggagtgctggggaaagatttctcaaatgaagctggccgggtgtgatgatggctcacgcctgtaataccagcactttgggaggcagaggtgggagaatccaggagttcaagaccagcctggtcaacagagcaagaccctgtctctatatttgaaaaaataaacaaatattttttaaaaacgaagtgatatttgagcactctggagcactatacaaatataggacagactgaaggaatttatccaccttaatttgagttaacatttttaaacattttatattgcagaaatagtacatattcactgttgtgaaattagaaataattgattggcaaggagcaggggactacaaagcactccacagatccaccatactgagacagtggttagtgctttgatgggtttattgtatactttctatgcatatacatgtattgtatacatacatatgcatggttaaatagaaatggttcatcctagctgttctgtttatccctttatttttatgaaataaatccccaaagagtacatttgctttgtccaagggaatcttttgttacgtgctgctgtacataatgaaaactgaaaaaggggctaatatttcagcctagtgaccatgtgggcttgcagtaatttaaatagaggcctcatgagaggcaccttcggaaatgaatttggtgtgtgtaggtggttatgcttggcatcattgtttgtgctagtatgatagggatgacttcagtgcctgccatcagggaactggttaagtaaactatggtacatccaaatgatggaatactgtgtagttgtaaagaagaatgagaaagacctatgtactcatgtggaagaactagatattgtgtgtgtttttaaaaaaggaacaaggaatggtatatggatggcatagtgtatatggtatgctactttttgtgttgagagagaagagtagagtaagaatatacgtgtgtttgcagagataacttctgaaatgataataagaaaccaattaaaagtgtttggctgtggagggagaataggactatgaatgggattttgccacatacatttatagatagttatattttaaatatttttgaactatgtatttgcgcacattacccttttaaaaataagtgaatgaaggaatgaagtgggattatgagaacgagataagaaaaaaggttctatggggctgcccatctttttagtacccagagaatattaatacatagcaatagcagcaaaaattggaagagtagccccaggaaggtggggaatcagcctttcctttgtcttttcctcaatttcatatattttaaaaaatgagaagagtaaaacaatttaaaacaaaaatgtttccagaacttgtaaaataaaaggaatatggggcagctttgtgtagtgcacatcccgaaaatgggctgattcacctcaagaggcaaggagtcaagctctctagcctacatggggtacatacatgagaaaaataagaaaaagaaaagaaatgtaaaaataaatgaaaataacacttatccctgattataaaggaaatcacattctttttacaataatttaacaaaatataaagaaaaacccttaggctgggcgcggtggctcacgcctgtaatcccagcactttgggaggccaaggtgggtggatcacaaggtcaggagattgagaccatcctggctaacaccgtgaaaccccgtctctactaaaaatacaaaaaaaaaaaaaaaaaaaaattagctaggcgtggtggcgggcacctgtagtcccagctactcgggaggctgaggcaggagaatggtgtgaacccaggaggcggagcttgcagtgagccaagatcgcgccattgcactccagcctaggtgacagagtgagactccatctcaaaaaaaaaaaaaagaaaaaaaaagaaaaacctttaattctgccactcaaaacattctggtttgctgctttttatacttttttatgcatataaacatttttaaaagtagaatcataaaatatagtcttttgtcacattatattttgggcatgtttctgtggcagtaaatatatcctggcatcatcatttttaatagctggctatatattaagtgaatcattgccactccagaggtgaatttccttatatatacattttaatggacttgagcaagcatttttggacggaattcatagaagtagaatttctggaggaaaataacaaaaaaacagttttagggtttttaatagaaattttcaaattatcctgcaggaaaatgggttcagtgtatactcccaccaacagtgacagagttccagtttcgcccttccatttgtcatctttgctcgtctttaagcagaaaatctcattgttttaattacattttctttaatttctagtgcttttgagtctttttaatatgcttattggccatttttattcttgtgggaagtgccttatttctccattatttgtttttttctgagtaattttataaaattataaaataattttatcttttttatcatttttctttttctgagtaattttaaagatttctttataggctagggatacaaaccttttatctgtcattgaggttaccaaaactgtctcccagtaagtaatttgtcattttgctttattttttctttctttttttgctagccaagctccaaagtcacatttcactttatttttattgggctgaatgaaagcattttaacttagtgattttagtgtaaacaggagtagggcagaatgtaattatctaggtcttggtctgtcacccaggctggagtgcagtggcatgatcatagctcctgcagcctcaaactcgtgggctcaagtgattttcccgcctcagcctcccaggtagctaggactacaggtatataccaccacgcccagcagatttgaaaaattttttgtagagataagaattcgctatgctgcccaggctggtcctgaattcccgacttcaagtaatctccccccttggcttgccaaagtgctgggattgtaggcatgagcttctgctcccagccgagagcttacttttgtttgctagtggtgttcttggtatcttttcatatttgaggctttattgctagtactgaggtattaccctcaccatctgaggtttgaggacttttgtttttaatattgaacagatggaactgtttagttctgcatctttgcaggtaacacaatgtgcctaccaggactctgcctcatgtccattgaaagcaagaagcaatacagtaaaactttgcctgggtagaggctttgaaagaatggagtattctggtttaattctattaacttggaagtatgaaggtgaaaaaattcaaaagtttaatttcctgtagaatgcaatccaaaaatataggctgggcttggtggctcacacctgtaaccccagcactgtgggaggcccaggtgggtggatcacctgaggtcaggagtttgagaccagcctgaccaacatggtgaaatggtgaaaccttgtctctactaaaaatagaaaaattagctgggccgtggtggtggactcctgtaatcccagctactcgggaggctgaggcaggagaatcacttgaacctgggaggcggaggttgcagtgagccaagatcatgccactgcactccagcctagacgacagtgagactccgtctcaaaaaaattaaaatatatatatatagccaataattccacttttcttctcttagtaagtttggacattcagagctacttggtattttattatagaactcctagtgtgcctgagacttacattgtgaagatccttttctaaaactttagatgtaagaggatgtaaatggttttgtatcagagcagtctggatgagaactgacacctgtaaatatactttttagactaagtctctgattgccatttgttcttatttaactcataaaaataaaatacattggatggagggtgagagtagaaaggagatatatgtcttttaattggatgtcattatttcatatcaagatagaacatacagtatccctggctttgggcctacagaaagaaacacatttttctaagtgctatatgccagaggttcttgaacacctggagggcttattgcaacacagattgctgggccctattccagagtttctgattcatcaggtctagggtggggcctgagaattcgcatttataacaagttctcaggtgattctgatgctgctggtccagagactacatttttgagaaccattcttgtatactaaaaattgtagaactctagaagaaagctctttggtctgggatgagaaacatacaggttatggagcaaatcatgacagattcaacccttgatcccagcctagtgtggagttcaggttacaagcaatacacagtgacataacacaattcttggttttttatgattggaagtcatagccaagtatctagtgagaaactccatttcatttgcaaggcttagagaggccaggagattctaggcaaataggatttagtgattaaccccatgaaagtaagagttatttatgtccttcttctctcccccatcacttagcatttagcctttagaagggccttgtattttttaaaactggtaaagagctttgagtgcttattaaatcgaaacctttgtgtgtttttaaagatattagacatgtatcttgagattattttaaacagtaatgtaggagaataagagaaactttttccaaaaaagaaaaatcactatgattattttatcttattggaatgttggataatatagtctccttcattaatcatcaagcatgctatgggttttccatttttataggatttgtacctcaactgaggtaatactggtaattcttgtactccatttgaagatgaaaaatcaaggccaaaatcaaagacctggcatagaagctggataatgaagacagcttcaaaggaacacatagatacacacacacatagatacacagatatataaagtacacacaaatatattttttaaagttttatttattgttattattgtcagcacagacaaagatatctgtgctgaacttaggcatcatatgtagaatctttgcgttgaagagaaaagaaactgtggaagccacaccttttcatagaggagttttgctttaacaagtttttcttgcttgtcaactctaatttctatcgttccacggctaatagtctcagttgaccagctggttcagcctagactgtttgaaggaataactagtattacaaacagtgggttaggcagattccttacttggaaacattcctgtttttctccccttacccctcagagaagagtttgagtgaagaagggtagaactagaacccacagattaaactggtggctctgaagcctggctgcacatcaaaaacaacccagactgttttctagaaaacgacacagattttgcgcctcacctttagaccatctgaattgtgatctcctaggatggacctttttgggaggctggggggagtctgcattttttctttttttttttgagacgaagtctcgctctgtcacctaggctggagtacggtggcacgatcttggttgtgtctgcattttttaataactttcccaggtaattttatataggctcctggactgtatgcctcagatcagatcagtgccagtcccaggtgaattttcaccagcttattgtgaaataagaagtataaggaccacatagtattttttgtaacattaaattcattcagtttaaagaattgtcttttgcattgaattaagaccttcttttgtttttttggtgctaaaatatccttttatagaatgatgttgataaggatgtttttaccatctttgtatgttttttaatttggaatcctatattgtcctcaatattttttaaaatctcctggtttatgaaatcctaaatactgagtgtctctgatctaatcatccttggaaactgttttttaaattatttggaatacaggttcatagagggtccaaagcccttggaactagacaactctcagaattcagaatttttcaggtttaggaagatgctttctctgttacgaatgcctcagtgtgtctgatgcagcatccttagtcacccgatacattaatatttctgagcaaaacaggagtattcacactaagtgggtagataaaggctgtatatagcttcatatcagttcaggccaaattttactgtcctgcaagttttgacataaaacatatgaaaaattcttggtttttagagctgtttggatattagaattgtacataatggattgtagacctatttggaggtttggtttctcatcctaaaagtattagcaagcttcaaattaaatggagcttcatatgttcatggtagggaatgtaatttattttgatttaaataaaccaccatgtgctgtgattggtttgtgttttccttccaaagacctcagtacttttgttgaatagcatttttcttcagcatggttctccgaaccccatttttaatatttgagatcaaatcagagttttctattatagcctttctggacctaaagtgggaagtgtgagtatggggtagtcactacatggaagtggttaagagcatgggctttgggaccagaaagacctaagcttaagcactaattctagtactactaggttatactttaggcaaggtgttgaataaatctctgatggctcatacctgtaatcctagccacttgagaggatgaggtgggaggatcacttgagcctagaagttcaagtccagtctggacatcatagtgagacctgtctctaaaaaaattttttttaataaataaatgaaaggtggagtatttgtatgaaaacaactgggagactaacagtccctgccttgtgggattgttatgaagattaaaagagagactgttaccgaagtacttagaagagctattattttgttgctgtcctttcccccttgtatttggatagattacgatagttgttttttctatgtaacttaattgtccagtggggttctcattcctttaaaggcctggagaaacttgtcttaaatgctttcccaattcataaattgggacataattcccaattcatacttaagtctcaccgttgcaatttagacataaaatctgcctcttgagtggtttccacaccaaaaaatccacagactcctgaattttatatgggcctaatagtcttactgaaaattggaagtcttaagttgtagtccattttacacagtgtgaggcctttcatactctgaatgtacgactcgactttttcttcttcactctgtctagcactgtgccctcattagccagattaatgttcccctttctcccaagaaatgttctgaccttaccctcgtccctcaaggaccctctttctcccccagattaactttcaaagagcttttccaacccaaaatggcacccttcctgaaaagatttctagtggatactgttttctctacctcattacagatgtattatgctgcttggctcccctctccccactttgttgtggcaaacctttatttccagaaatatgtcaaagaaaatgaacatgtgatccctttttgtgatttttgttgggattcactgtatgaatttcttctagtttagataattccactgtggcaagcttttattcttattatacagctcgtaaagagaatgttatagtcatttggtgttattaatgctaaaatagtaaacaagaacacaaaattttctagattagaagtgtttttccccactgctccccaggccaggcacagtggctcacatctgtaatctggcactttgggaggcggaggcaggaggattgcttgaagccaggagtttgagaccagcctgggcaacaagcaagaccccttctctaaaaaaaaaaaaaatttagccatgcctggtggtgtacacctgtagtcttagctacctgggaggctgaggcaggaggattgcctcagcccgggagttcagtgctgcagtaagctatgattgcaccactgagctccagcctggtctacagagtgagaccctgtctctataaaaattaaaaaataggctgggcatagtggctcatgcctgttatctcagcactttgggaggctgaggcaggagaatcacttgagtccaggagttcaagaccagtctgggcaacatggatcccatctctaaaaaaaatataagtaagtgttttttaatccctcttgagtaacttgatttgtcaaaaacagattccagagtagtgctgtcactgactgtggggaataactgttcatactcaacgaagagtgctcacttacagatcctaacccctaagggcatgggcttcctgctgaggaaatgagatttagaatacagcgttctaaaaatggcagttaacagattatttattaaggacctggtgggtgcacagaggcatgctagaagctgtaaaggacttgattcttgccctcaagaaacttccaaggttatagactagtcccaaaacaagtaatgagtgatgctctctcaaatatacatacaatcaaatgtgagatggaggtgaagatggggaagaccttaggctcggagattgtattcaggcttttatagtggcatttatttgatataattatgcatttaaaaaacaaattgtcatcacatcagtctgaaatgtatggagacacttgttggtgagaaaggttttttatatataataatttacccataggaatgtttttgattaacgttgtctgttaaagacttcacaatatttcccccattaatagtctatatctttttggagctgatctggagaagtcaaggaccatatgctaattgctatttgatgttattctgggaggacaattgattggctttggggcaaggagttggaacttgaggactcaaaggtgggtctgagtctagagatcttgccactgacttttggcaagtcttttgattctacctttgaaactgcctttaaatgccttgtggagtacattttatgactgttctgtacgtttccagtagaatgatagtaatatcacagaacatccttggggcattgtttctaaaagtttgggattgttaatagttactaggttaaaaatgtaatatatgtaataaaggtaacaaattaatacataaatttgggaaatgcttggtaaattaaacaggacttctcaggacaatgaatttacacatggccatttttttttttttttttcaaagagcattcacaagactgtagtttgtagaacactagtttgggaactgttggtgtaggaattagggtaattaggatttggactattccaggtagaggttgtcactatattcgaggaattgttcttaagtctttagtctttctatatatcggaattacctatggcaaattaacaagcagaaatacaaaaattgggccttggctcaggcctaacaaatcagaatatctgcaaagtatggatgtggaaaaacttccaggtgattctatatactcctaagactgaaaaccgctcaattagaatagaccttcttgccacttgctaaatgcagtctttttttttttttgagacaagtcttgcttttgtcccctaggctggagtgtgatggtgcaatctcggctcactgcaacctctgcctcccgggttcaagcgattatcctgcctcgcttcaccccctacctccccgaatagctgggattacaggcgcctgccaccacgcccagctaatttttgtatttttagtagagacggggtttcaccatgttggccaggctggtctagaactcctgacctcaggtgattcacccacctcggcctcccaaagtgctgggactataggcatgagccactgcgcctggccagctaaatgcattcttaatcctatttcagtatgcttctgttttgttttcttgggtctggtccagggactagactgttgctgtaattaagttcagttttattattcttcccagagtatctgtatcccagttttcagattccatttcctcagtggggcaaacttataggtcagtataggacaagttttaaacattaataaaaaagaggttgtattgtatttatattgtctttctcatttggcagccttgagtttaatttagaaaatgcctctatttgtaatttacctttgttttgatatattttacaaatatagggaccacataagtgattttcctctttttcctgacttccttgtcaactaatatgtttttgaaagcttcttgttaacttataattgcaggtaagttccattttctgtttgcttaagctcactgacgttatatttgcaagcactgttcttgcatcaaatggaagatagccaatggaacatttgtgcattgaggtcaatataggaaaacttagcagaatgactacttatttgttttctgttaatgtccatgcagctgctctggaaataaatgaaatggaagtacatgggacaaaatcattctaatttgaaatttacctggaaccttttaaaaaattttcatatacatgtcgtacgtctcctcaccccacctaaagctgaactactccccctttctctttttttcctttgatccttcaccaaataatggagaaaatctgatgggtttatttacttagtaaaagaaaatcttgtaaaacaaggagagaaattattttagtgcaaagtatgacatggtatataaaaatatgttctggctgggagtggtggctcatgcctgtaattcccagcactttgggaggctgaggcgggcagatcacgaggtcaggagattgagaccatcctggctaacacagtgaaaccctgtctctactaaaaatacaaaaaattagctgggcatagtggcacgtacctgtagtcccagctactcaggaggctgaggcaggagaatcgcttgaacccaggaggtggaggttgcagtgagctgagatcgcgccactgtactccagcctggggcgacagagtgagactccatcttaaaaaaaaaaaaagttctatgtgattttaaaaggctttataaaattatttattgtattgcttatgtagctttaaaatgtttatttgtgtttgtgtatgtgtgtgaccctgtgaaaaactgaaagaataaacaaaaagttagaaagttagaaagttggagtttgatgcattaatccaggagctgtctgggcaggccaacttacacttggggggtataagcattcctgctaccagggaagtgaaatttcctaccatggagtaaggatgtttcatgtggctttgtaatggataaaatctttctcctgatgcttttcctactgctctgatttcgtgttcaccatgcaaccatcttttactaattaagcatcccaggcatttggattttgaatggtgggaatgtattagctattcgaaaataaatattcccttctgccttcccaggacctacactatcaactatactttctccctcctgtatgtataacctgtccctctccactagaccctttctatgaacatttaaatgtgaattagagtttctaatctttaaagatgtcatttccgtggacttcatacccctccagtttctgtctgttcctgcctcttcccttggcagctggactctgagttatctcatacttggtatcacctacgattcagcctacctccatttggctttcattctcattttttccgtggaaaccgctctcattaaggtcatcagagactccatggtcctgaattctgtggacacttctcagtcttcttcctacttgacctttcagcagccttctgtattcctactttactggaattggattcattccctgtggctgctgtgacaaattaccacaaactggtatcttaaaacaacatttattgtctcatagttctggaggccagaagtccaaagtcaaggcatcaggagggccactttccttctggaggctctaggggagaatttgttctttgcctcttccaaattctgatggctgcaggcattccttgatttgtggccacaccactccaatctctgcctccatggtcacattgcctcctcctcttctgtgtgtgtgttaaatctccctctgcttttctcttatatacctatcattgaattgagggcccatctgaataattcaggatgatctccttatcttaaggtccttaattatatatacaaacacccttttttccaaataaggtagccttcacagattccatggattaggacatggacatatttttgggggggctaccatttaatccaaatcaagaaaatacagaacactgggttcggtattttcttgatttctgtgatgtcacactcttctgattgtcttctcaactctctgggttcttctcagtttccttttcatgttgccttcctcctctacttgacttttttttttgggggggtgaaatggagtctcgctccatcacccagtctggagtgcgatggcgcgatctcagctcactacaacctccatctcccaggtccaagtgattttcctgcctcagcctccgagtagctgggattactggcatgtaccaccacattcagctaatttttgtatttttagtagggatggggtttcaccatgttggccaggctggtctcgaactcctgacctcaagtgatccacctccctcggcctcccaaagtgttgggattacaggtgtgagccacagtgcccggcttctacctgacttttcaaaatattcacacacatcagtgctgggtcatgggccctcttctcatctcactttgcattttctccataggcagtatcttctattcctatgacttcagttaccatttatataaacgactactccaacttcctatatttaggcagacttctcctattcttggtgcatacagccaacctacttaacatcaccatttcagtgtttcagaagcattgcaaatttaacatgtccaaaatagaactcatcaccttttttacccccacgcccctatcaccacccaagaaaagtttgcccttcccacagagttccttagctcagtgaatgacattaccaatccacccagttgcttgtgccaaaattatccttgatatttccctcactctgactccccacatctagttcatcaccaaaaacctcctaaaatagttttagagtctacctcctttcttcttactgccatcatcttagttcaagcagctacccttttttcatctggattggagcaatagctgccttaccagtctctcattattaactctcagtctctgcaatccattttccacatggcagcctgagtgatctcaaaatatgtcgaatcatgctacggtgcattataaggagtttcagaactccttataatggcttctattatttaggatgaaatccaaaatccttcatgtggtctcttaaggtcctgaatgatctgatctggccccacctgcctctccaacctcatctctcttccttgtcattctctggctatatacgtacctaccttcttgtagttcccgaaaattccctcctgcctttgattcattgtacgtcattttctctctcctccctattgctagtaagcttacattctttaggtatcaatgaaaatgtttcttgctcagggaaacctttctgaaccatccccctctctcctggactagattgggccccctgttgttttctaatagtcccttttatagcatggatcattatttttaactattttcttgtctctctcctgagagaatgtaaatatcaccagggcaagggctgtgtaccctatcaaagcaagagtcaagcccagtgcctcagcacagagggtcagtaggcactcagatattaatgagtgaatagatttaatgatcttagttgttaagatgtagctgagagaaagcaaaacccgaatcatgtggcagaatatttgaaataaaatttaaagctgtcatccaccatatttactttttaaaatggtattaaccagactgaaggaagtaatgaaactgtaggaaacaaaataggagggagtagtttttatttcagttgttcagtagactttttccaggtaattcagtcaaaagtcctaagtaatcttagcaaactgttatcataggcacattgcaggtatgtaacttctgaaaaatattatttaagttcaaagaatagctagtttttggcataagcatgttggatctgaaagttgtgggtgtttaaagtgttaaactgatgaagcatgtatccttgaaatatcctagatacattaaaagtcctggagttctttctaacttggaacataagtccctatttcaagccacatattttagacacaaatatgtcttgacccttgaccatgatagtgccaactcaaatgcttggcaggccttagcacccctgtattgactattaacagggttgtgagctttcccattttcagccaaagtgacaactgttatttcttattttcagcatgtttgacatgtgtataagagggaaagtggggtgaaggggaaataagtttcaaattgttcttaggtttcaagatgcaatatagtcacagaccagacacaaactcctttatctactgttgaggtctaattcttaaagaactgcttctcaagcagtgacctatttcaaattgcacatttgtcttcttgatagataaaaagatgttgtgacatagtggtttgtgtggcagagttaattgccagtgtttattgaatacctgtataagctattgttaggtgacaactttccccaaagattagcaggttaaaacaactaatatttattatttcataatttctgtgcatcaggaatctgggagtagcttagcagggtgcctgtgcttgagactcttacaaagttgcagtcaatctgtcatctggggctgctatctcatctgaaggcttgactgggaggaaaatgcacttctaagctcacttacatgatggttcatttcctctcccatgagcctctctgtaatgtaactcacaacatggcagccattcagcctcttaacccgatttatgtaaccaagcattcctcccatctctggaagctttgggcatattttctttgtcctcactacactagactttcatccttggtgtggatgaggatcaagtgaaataatgaatgtgaaatggtgaaatggaatgactagagaaacacagtgatcaagcatggaccgtgagctggggaagagctggaaacagagaatgttacatgaaactgggagcaggaacttcagggaagttaagggtgatgatcctgtcttcccttgtgtcttccccaagttggaaacatccaaatgccttccctaggagttaccagtctccaacaaaaatctccctattgccacctagctagtaaagccagggcacattaagcaccagttcactcacacccagtaggcccacaaaacaatgttgttcttgaactatgtgccttaaagtgtgggtatgaaagtgctttattaatttttaaacagtataaaaattaagttgttggaatgctgctgtttggaaacaccaaactttctaattgtgtggaaaacacaggttgaatagtacaaaatacaaatcaacactgtataatattgtaagagaatcacttgcctagtattgacaataccatatcagtgtttttaacttctgtgaagtatttgcgttaagttcattaacagtttttgtagattttatggtaattccccactccctttctcatgaataagcacatcctggaatttgctatctgtgttccaccttgctcttgaattagaagggttttttttttctttctttcttcctttgccttccctttctcttttgccttacaatcatgtacactcaggacttactttttgggcacaggaagattttttttaaaaaaactgaactctgatttctgattctctatagtgattttccatattggtggtgagaaatcagtgtgctagttgcaaacaactgccaaatctttggaaataatagtacagtatatcttgctacccagcaaggttcaggacctttaagagtctctgtgctcttacttacagggcaaatacagttgccctggcatttagaacagacttgcttctatcactgttatgctacagatggaagtggtaaaaataaagaactggtttctttccctctatagcttatgaaattattattatggatctgtatttggaatagacattgatttcttttgtttctatttaaaatatgttaagcagatatatttcatattagtagccttatttaaacctacagtgatttaaatgggttctattttaaatgaattcttttagaactatgtactactgagttgtttttccatctattctttgctcttcacaattttaccttgtctttttagaatattacatttctaatatccataacaggttaggaaattgcaaaacaaaacaaacaaaaaataaaaacaaaaaacctttaaagagaactaagaaagaatattttactgtatccagaaacagaaaataacttattcacaagtgttgccaagatggaaacaacccctgggaaataatttgttatagaaacttaaagaagccccaaggaaggtgggagtcggggtagagatggagtcaaggttgaagagagatgagttagagagggaaagttgcctaaatacaattaagcctcaggtatttatggaactcataatattgtggtgagttacaaaatctataaaactcaatcttgcttgtcaggaattgagaatctaattggaaggagaaaaattatgcatatcaaacaacaattaagtagtgttaatgctgtactaagtacagaagggaagcagtgaataaatagcgaaggaaagtagtgaatgaagactggaatgatttttgaggaattgttaagatttagatgaataacagaaaaagatgtattctaaatgatagcaaaaaacatcaaaatgggtttagaagccaaaataaacaattttatgtacatacaattttacgaagctgtagacagaaacatatatatgagctagaaaaatttaaggccggcaaaaattgccataaaaaattaaatataatgaataacatatttattttagttataaactttcatttaaattattttataaaaaataaaaattataacaaatataataaatgtttttacaaaagataaggaaaagatatataccccaatagaaaaatgggcaaagtactttagcagtaaaattacagaataagaaatataaatggccagtaaacatatcttaagataatcagcctcagtaaaaattaaggaaatgtaaaaaaatgcaagttttatgagattggcaatggtttagaaaatgatagtactcatgaatgttgggaaacgggcacttccacaccactggtgggaatttaaattcttatagtagtgtggcaatgccaagagccttagaaaagagaacatactctccaatgtaacagctctatttctaggagataaaaagaaataattagaaaagaagacctttataaaggagaacctttataaacagaaacattggaaacacccccaaaagatggtatggctatgttattaaacaacataggaatgagaaaaagcaaatgatggggcatcttgtatcacatgatcctattactattgagaatggatacttgggaaatgtgtgtgtatgtttgtgtatacacaaacatatgggaattcaggaaggttatatgcgcaacattgttaattgttcttaactctggatggctggacaacaggtggcttttgttttttcctttttgcttatcaatatgataaacatgtattttttaaaatacattttaaagaaaaacagcttgagaattagaataaggagtaggtgcttacaatgttcattaagaatgcattttcactgtttcaatgttaaggaagctgtaatgatcttgactaggttccaggacctacagaaatttggcatgggaagattcctacccctcccacccctgtcccacctgcctagaaagactaagtgagcctaagtgttaatagacatcttttcttttaactcttaaataattgtacatctgtctagttgataactgcaggatgtggatggttttataagagttacagactaagtttctgtttatctatagttaaaatctttgacttagaatttcagaagcttctgacagaatctgcatgttttaggtctctacatttcctttatccttatattcattttatcttttcttttgcttctctttaggttccatcataatgaatggatccaatatggcaaatacatcaccgagtgtaaaatccaaagaggaccaggggttaagtgggcacgatgaaaaggaaaacccatttgcagagtacatgtggatggagaatgaagaggatttcaacagacaggtaaagaaagaactggaaaagtggaagattgatgatacatgtaactcaacagctataatattttactgccagtttattacaaaagaaatggatacagttagctttagaataacttaaaaattcattggtggggggcctcatctggaatgaccaagaaacatcttcatctggtaacagaccagagtgatagtaccttggaggaagatatttatatttttcttaccatgttgattaaaagaggaaacaaatatcagactaattagttgatatctgaacatcctcacgtgagagcccatgtttaaccaaatagatttgcatatactccacactctgatatgccttctaagtgtagttcacattacacagtaactactgcagagggtccctgccctcagccttgttctggctagatttgtttatgacatttctctcagcaactgtagaccattctagaatattcccagaatttaaatcaaacaagactcttatcaatcttagaggattgacataaaacccttgtaccaaaccatggtagctgaggtcctttatcctgccctgattctgcctttaatcctaggaagcccagtggttctataactctctgtagtgatcaatgtgaaattaattgcttgaacagtggagcactaaaaaacagaatggtagtgaggttgtttttctatactttgtagtttgttgctttcacttgcttataggaaatgtgatactctgcatttcattttgaaaataaatgaagacataaaagaagtttaaggccaggcattgtggctcatgcctgtaatcccagcactttgggaggccaaggtgggcagatcacttgaagtcaggagttcaagacctgcctggccaacatggtaaaacctcatctctactaaaaatacaaaaattagctgggcatggtggcaccctcctataatcccagctacttgggaggctgaggcacaagaattgcttaaaccaataggtggaggttgcagtgagccaatcgcaccactgcactccagcctgggctacagagcaagactctgtctcaaaaaaaaaaaaaaagattaagaactctcactgaaggtaaatatgttttccatgggattttagaacagtcgtgtttggcatttttgttgacctaatggtttcactcttcctttatccagcctctgaatgaaatatatgttgttgaaaacataaaacaattttcactagctttgttaacactcactgacatgctcttaaccccagtgatcaggattgcaccagggctattagaagccagatgtctgagctgtgggtcagctgtgcactcctacattcaagagtttagcaaactcagagacaaggtacatggaaaagtgctggaaagctaggggcttgcagaaacacacatacacattcacacacacacacacacacacacacacacacacacacccacacacacaaagagattgaggaaagacagttgagaagctttaaaaattgtaactttttttctggagatctaggtaagcaatgacagatatatgcatggcagcttccaatattgcagtaaataccaggccttaagaagggctgagcagataaacaattgtttgctcaaattcccccaaccctaatgttttacaggtaatactagcttggcaacataattttgggtttttttgttgttttttgtttgtttgtttgtggaggtggagtctcactctgtaacccaggcgggagtgcagtggctcaatctcggctcactgcaacctccacagtccaggctcaaaccattgtcttgccttagcctcctgagtagctgggactacaggcatgtgtcaccatccctggcaaatttttgcatttttagtagagatggggtttcgccatgttggctaggctggtcttaaactcctggcctcaagtgatctgcctgtctcagcctcccaaagtgctgggattacaggcgtgagccaccgtgcctggcctggcaacataattttgaaactgttatatgatttcaggtcataggagtaagtatttcggagaagccttctttatccttcatttgggagcaggagggtttaggaatctgggatatgattgatgtcagttctttctgaacacctgtatattactctgttacactatggtgtgctgtacagtttttaccactgccaacccccattccattactagcatagttttcatggtaattcagaagtggttttgcataccatgtaccttgagttggatcttaaggagtagaaactggtttctagctagcaaccctgatacaatgtcttctgactttctaataaaatatctaacaaaacatagaataagatgaaaacagcttacaaccccccaaactcggagtgacattcattggtcttttgaaaagattttcattgactgtgaggctgatagaagcagattgaaatgtagttttgggggaaaaaggattaagtctcaagaaaagtagtgggacttttattttaaagtaactcaggaaagaagaagtaagacctaacatactagttataattgtgaatggcttatatcctccaacacccacacacatacaaaactttttaagaaatggggtcttgctatgttgcccaggctggacttgaacccctaggcacaagtggtcctctcactacagcctcttgattagctgtgactacaggcatgtgtcacagtgcctggctagaatttttaagagagaagataggtggtgggcgcctttagtcccagctacttgggaggctgaggcaggagaatggcgtgaacccaggaggcggagcttgcggtgagctgagatcgcgccactgcactccagcctgggcgacagagtaagactccgtctcaaaaaaaaaaaaaggacgcagttgggttaagggggaaaaaaagggagaagtgtaattatatgcaacttggaacatacactctcactggctattcaggccacagaaaaagatggaaaatgcttagtgaattgtaaaatcttatgggtcatttctaactagattttttttttttttttactctaagcttctgtcattttcccgttgggtgtctattaagtaaaaatcagggtagatatattctgaaatgtcaacaatattcattatgtgtgagtgttgagattaagggggctttttttcccttccaatttggttttcttagttctgatttcccaactcatatgcaaagaaaatggattacttccacaataagggaaacaggttcacatgtaaagaacctaaaagagaaacatctgaattaaaatgcttcagaaaaggaaaacaaaataatgaagatagaaaatatcaggaaatttcaaacacaaagcaatataagtactggataaagtggaaattgaagggaaaaaacagttctctcaaaccctgctactgctttatcaactaagttgattatgtaatattctaaatccttcgttgtcatttccacagtgttcagaatatgaataggaacaaagatcatcaagattcaggaggatggcaaaacccagtccaaggaaaataaaaatcatagtaaagtgatacaggagctgaaagacaaaataggcagtataaaaaaagaacctaacaggtttgacagagctgaataacacaagaatttcacaatgcaatcacaagtattaacagcagaataaaccaagctgaggaaagaatctcagaacttgaagactggttctctaaaataagacaggccaggcatggtggctcacacctgtaatcccaggactttgggaggctgaggcggggatcacctaaggtcaggagtcagagaccagcctggccaacatgatgaaaccccatctctactaaaaatacaaaaattagcggctgggcgcggtggctcacgcctgtaatcccagcactttgggaggccgaggtgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggtgtgaacccaggaggcggagcttgcagtgagccgagatcgcgccactgcactccagcctgggcgacagagcgagactctgtctcaaaaaaaaaaaaaaaaaattagctgggcctggtggcaggcacctgtatcccagctactcgggaggctgaggcaggagaatctcttgaatctgggaagtggaggttgcagtgagctgagatcacatcactgcactctaacctgggcaacaagtgtgaaactgcatctcaaaaaaattaaataagacagtcaaaaataaagcaagaagaatagaaaggaatgaacaaaaacctccaagaagtatgggattatgtaaagaggacaaatctatgtatcactggcatccctgaaagggaggggaacaaagtaaataacttgaaagatatatttcaggattgatatggtttggctctgtgtcaccacccaaatctcatcttgtagctcccataattcccatgtgttgtgggagggacctggtgggagatgactgaattatgagggtgagtctttccttgctgttctcatgatagtgaattggtctcacgagatttgatggttttaaaaacgggagttttcctgcacaagctctctctctttgcttgccgccatccatgtaagatgtgacttgctcctccttaccttttaccttctgccataattgtgaggcctccccagccacatgaaactataagttcagtaaacctccttcttttttaaattgcccagtcttggatatgtctttatcagcagtgtgaaaacagactaatacaaggataccatccatgaaaacttccccaaccatgttagagagtccaacagtcaaattcagaaaatacagagaactcctgcaagattccacacaagaagatcattcccaagacacataatcatcagactttccaaggtcaaaatgaaagaatattaaagacagctagagagaaagggtaggtcacctacaaagagatccctatcaggctaacagcagacctcttggctgaaaccctataagccagaagagactgggggactatatttaacattcttagagtaaaaaaatcttcaaccaagaatttatatccagccaaactaagtttcttaaatgaaggaaaaataagatccttttcagataagcaaatgttgagggacttcattactactaaacttgccttacaggagaccttgaaaagagcactaaatatagaaaggaaagaccactaccagctaatacaaaaacccacttaaccacacagaccagtgtcactgtaaaacaaccacacaaacaggccaacataataaccagcaaacagcacaatgacaggatcaaatccacacatatcaataccaacattgaatgtaaatgagctaaatgcctcacttaaaaggcacagagtggcaagctgggtaaaaaagcaagacccaatagcatgctgtcttcaagaaacccatctcacacataatgacactcataggctcaaaataaagggatggagagaaatctaccaagcaaatggaaaacagaaaaaagcaggggttgcaatcctaatttcagacaaaacagattttaaaccaacaaagataaaaaaagacaagggaaggacattacataatggtaaagggttcaattcagcaagaagacctaactttcctaaatacatatgcacacaacataggagcacccagattcataaagcaagttctttatgaatctgggtgcaaaaagacatagacagccacataatattaataatgtgagacttctatactccactgacaatattagatcattgaagcagaaaattaactaagatatacaggacctaaattcaccattggaacaaatgggtctgctagacctttacagaagtctccacccaaaaacaacagagtgtacattaatctcattgccacatggtacacactttaaaattgaccacataattggacataaaacaatcctcaacaagtgtaaaagaaccgaaatcataccaaacacactcttggaccacagcacaataaaaatagaagtcaacacaatgaaaataaaaccatacaattacatggaaattagacaacatactcctgaatgactttcaggtaaataatgaaattgaggcagaaatcaagttatttgaaaataaggagaacaaagatacaacataccagaatctctggaacatagctaaggcagtgttaagagggaaattcatagcactaaatgcccacctcacaaagtgataaaagatctcaaattaacaacctaacatcacaactgaaagaattagacaagcaagagcaaatcaaccccaaagctagcagaagacgagaaataacaaaaatcagagatgaactgaagaaaactgagacatgaaaaaccatttaagagatcagcgaatccaggagttggttttttgaaaaaagttaatgaaataggccaggcgtggtggctcatgcctatagtcccagcacttagggaggctgaggtgggcagatcacttgaggtcaggagtttgagaccagcctggccaacatggtgaaacccatctctactaaaaatgcaaaaattagccaggcatggtggcatgtgcctgtaatcccagctgcatgggaggctgaggcaggagaatgcatgaacccaggaggcagatgttgcagggagctgagattgcaccactgcactccagcctgggtgacagagcgagacttcatctcaagaaaaaaactaatgaaataggctagtagctgcagtaattaagaagaaaatagagaagatccaaataaacacaattagaaatgacaaagggaatgttactactgaccccacagaaataaaacaaccatcaaaaactactacaagcactacacacatgaactagaaaacctaggagaaatggataaattcctggacacataaaccctcccaagactgagctaggaagaaattgattccctgaactgactaataatgagctctgaaattgtatcagtaataaatagcttaccaaccaaaaaagcccaggacatgatggactcacagccaaattctaccagacatacaaagaagagctggtaccattcctacagaaactattctaaaaaattgaggaggagggatttctccccaactcattctacaaggccagcatcatcctgataccaaaacctagtagagacacaacaaaacaagaaaacttcagggaaatatccttgatgaacattgaatcctcaacaaaatacttgcaaaccaaatccagcagcacatcaaaaagctaatccacaatgattaagtaggcttcatccccgggatgccaggttggttcaacatgcaaacatcaataaatgtgattcatcatgtaaacagaattaaagataaaagccacatgattatctcaatagaagcagaaaagtcttttgataaaattcaacattgcttcatgtttaaaactctcaataaactaggtattgaaggaatatacctcaaaataataagagtcatctatgacaaacccacagccaacgttatactgaatgagccaaagctggaagcattccccttgaaaaccggtacaagacaaggatgccctctctcaccacttacattcaacatagtattggaagtcctagctggagcaatcaggcaagataaagggcatccaaataggaagagaggaagtcatactatatctgtttgcagacaacatgattctatatctagaaaactccgtagtctcagcccaaaagctcctttagctgataaataacttcagcaaagttgcagaatacaaaatcaatgtacaaaaatcactagcattcctatacaccaacaaccaccaaactgagagccaaatcagaaaggcaatcccattcacagttgccacacacacacacacacacacacacacacacacaacctaggaatacagctaaccagggaggtaaaagatctctacaatgagaatttcaaaacactgctcaaacaaatcagagaagatgcaaacaaatggaaaaacatcccatgctcatggataggaagaatcaatatcattaaaatggctatactgcccaaagcagtttacagattcaatgctattcctatcaaactaccaatgacattcttcacaaaactagaaaaaaatatttcaaaatttatatggaacctaaaaagtgcacgaatagccaaggcaatcataagtaaaaagaacaaagctgagggcatcacgttacctgacttcaaactatactgcaagtctacagtgaccaaaatagcatggtactggtacaaaagcaggcacataaaccagtggaacagaacagagaccccagaaatgagaccacacatctacatctgatctttgacaaagctgacaaaaacaagcactagggaaaagactccctgtttaataaatggtgctgggataaccggctagccatatgcagaagtttgaagctggaccccttccttacaccatatacaaaaataaactcaagatggattaaagacaaatgtaaaacccaaaactttttttttttttgggacagagtcttgctctgtagcccaggctggagtactcactgcaagctccgcctcccggattctcgccattctcctgcctcagcctccagagtagctgggactacaggtgcctgccaccacacccggctaattttttgtattatttagcagagaaggggtttcaccgtgttagccaggatggtctcagtctactaacctcatgatctgcctgcctcagcctcctaaagtgctgggattacaggcggagccactgcacctggctaaaacccaaaactataaaaaccctggaagacaacctaggcaataccatcctggacataggaatggtcaaagatttaatggcgaagacaccaaaagcaattgcaacaaaagccaaaattgacaaatgagatctaaataacttaagaacttctgtacagcaaaagaaactatcaacagagtaaacagacaacctacagaaagggaggaaatatttgcatactatgcatatgacaaaggtctgatatcaagcatctataaggaacttaaatttacaagagaaaaacaaccccattaaaaagtgggcaaaggacatgaacagacacctctcaaaaggaagacatacatacggccaacaagcatatgaaaaaaagctcaatatcactgatcattagagaaatgcgagtcaaaaccaccatgagatacaatttcacaccagtcagaatggctatgactaaaaagtaaaaaaaaagaaaaaacacgtgctggtgaggttgtggagaaaagggaaggcttatacaatgttggtaggagtgtaaattacttcagccattgtggaaagcagtatggcgattcctcaaagagctaaaactacaattcaacccagcaatcccattactggttgtagacccagaggaatgtaaagcattctaccataaagacacatgtacacaaatgttcattgcagcactgttcacaatagcaaagacatggaatcaactaaatgcccatttatcagtgacagactggataaagaaaatgtggtacatatacaccatggaatattacgcagccataaaaaataatgagattatgtcctttgcaggaacatggatggagttgcaggctatcatccttagcaaactaacacaggaacaggaaaccaaacactacatgttctcacttataagtaggagctaaatgataagaatttatgaacacaaggaacaacagacactggggtctacttgacgggggtgggtgggaggagagagaggagcagaataggtaactattgggtactgagcttaatacctggtgatatgataatatgtacaacaaacccctgtgacatgtgtttatgtaaccttcacgtgtacttcaaacctaaaattaaaaaaaaagtaacatcaaagattactgattacagagcactataacagatataataataatgaaaaagtttgaaaaattgagagaattaccaaaatgtgacacagacattgagcacatgctgttgataaaaaggcgccaataggcttgcttgatgcaaggttgccacaaaccttcaatttgtaaaaaaaaaaaaaaaaatgcagtatctatgaagcaaaatacagcaaaatgcaataaaacgtgtgcccatatataatatttttcattaatcatatgtggttaagtccagttcctaaaaatctagtttctgctctccttttgcagtgttttcatggaaaatttgtgttaatgggaaaaggtgaggaaatttattttatgaaaggaagttgttttggtctaatgccctgtgttattgggtgtagatttgtgggaaacagcagctatatgcagacaggtcagcatggcatgcctcaaatgggaactcgggattggcaggatgtgagtctgaaatagagaagtacatgaggtgagggttggctagactacttcagcaaagattcagcagtaacgcattgttttatatctgtgaggttaacagtccaaggtaagcattctggatagacaagtgatctggtgcccacttggtcccttccacggtattgctctgccacccccagggcatatatcagctgcgtggctgagggaaaactgggaagtccagcagctgggaaagggagagcaccaaaggccatggcaaggggtcttcttttaaccaagggatgccaaagtgtccatgtcccttgtgggaacattttgtgatgaatagtcacttggccatatacagcatgtaaggtgacaaatgtgattttaactgaacagcctggtgctctgggaagaaggaaacaagtttaaaggggacagacagcaatttccacctaatgtggctctgtcgggatctgtgtgaattgcacgtagcatgtttctgttacacctctgtgcccagcaaccattttcattggttgtgccagtgaacaggggtaaatttaataagagctagcatgctgttatgctctcatagagtcagggcagctctcaaatggtcatgttacatcttgtggcatgagaatattttattaagcacttcataactgtctagttttcacgtgtggctaattgtagtgttcaaatactattcttaagtctcactaccagtaacttttcctctgaattaattaggtaactgtatattccaatttgggaaattattttttgcttgacctcatttctggtggtggtgctagtgagctgtgaatctgtcaccaggcagcctgcaggaaagggatgccaaacatgaagcaagaggcctatcaaagacactgaaatctgcagagtgaaccacactctatactaagagttaacaatgtctgcaaagcagtgtaaaatatcctagatatatattgctttagtttagggcaatgtttaagaaatgcagaattgtttgaatattcatatatttcatcttttgaaagaatactacattgattatgtaattttctattggtatgccaaaaagtgttctttatgtcttcctaatgttctgaaagtatttttctcccttgagggtttccttacccaaaaaatggccagaagctgagagcattggctttgattttatctccactagccaggtcatgaactagttatatacttgcagtatctttttcatatttcttataaaatgggaaatttaagaagggttactttgtaacaagactgagaaaagaattttaggctctaaaatgattttccatgatatctgtatcacctattagagatcgtagaacatctgcggagaccttgaatttctgttactgtgaataactattttcttagtcttattagtgatagaatttggttgagaaaaaataaaaattatgctatctctagctagtcattaggcgcattgaatccttagatcccttggacctcatgtaagatcataaaatcttttttttaaatatatttttattttttaaagaatcggggtctcattctgtcgcccagactgaagtgcagtggcgcagtcttggctcaatgaagccttgacctcctgcattcaagttgtcctccagcctcagtctcccaagtagctgagactacaggcacacaccactatggcctggctaattttaaaattttttttgtagaggcagggtcatgctatgttgctcaggctggtctcaaacctcctggcctcaagcaatcctcctgcctcagtctcccaaactgctgggattacagttgtgagccaccacacccagctcaagatcattcttaattgcagagtaataccttctgaaggaaagaggtggaggaaaaactggaaggggtaagtcttgctgtgacagtaagtctgagctgctcccctttgcttgctaggtggaggaggaactgcaggagcaagacttcttggaccgctgcttccaagagatgctggatgaagaagaccaagactggtttattccctcacgagacctgcctcaggccatgggacagttgcaacagcagttaaatggactgtcagtcagtgaaggtcatgattctgaagatattttggtaagagccatatgtagttccccaggttatgtagtgaaaagaatataggatttggaatgacagactttctttccagccctacaaccctcaacaagtctggagccctgtgagctgttgtttctttgctcgttttatgggcattattaataaggggtgcattaaagatgcattgctcctcataaagcactataaaacattactgttgccagcatcacgggctttttacttgccaagattggacgccaccaacctttactttctaatgggctcttcaaagtagaattgggattaaggataacaatttgaacactgaagaagtttcttctcaaatatcatttgttgctattcttctcttttactgtccctcaaatctgtatttaatatacttctaaatgattctgttataaaaattagctgttcattttggaagaaatgtactcctgagaggtcattttctccacttagaattagaaaaccagataaattaatttcctgcctttcatatttatgtaacatcagaagtctgtgagcaggctgggcacggtggctcacgcctgtaatcccagcactttgggaggctgaggcgggtggatcacctgaggtctggagttcaagaccagcctggccaacatggaaaccccatatctactaaaaaaatacaaaaattagccaggcatggtggtgcgcgcctgtagtcccagcttggaaggctaaagcaggagaattgcttgaacctgggaggcagagggaggcggagtttgcagtgagccaagattgcaccactgcactccagcctgggcaacagagcaagactgtctcaaaaaaaaaaaaaaaaaaaaagtctgtgagcaatatagttttcatacaactcatattctgaacaatcttgccctgtggtttgctaaggttttggatattcacaagagagtagagaaccaaagagagtacagaaagatgaagaaaaatagagattgtggtatccagcctggtctgatggagtaccctggttttcaccaagttaaggtactcagtgaattgaaaaattattcttggagttgaacttacaggcctctgatgagattttggaaagcatcaggaaggaaacaagagtccaaagaaggaaggagaagatgagcttgctcagggctatgtcaggtgcagttgagataacctagcaataacagcctgagttacaaggaattttctttctctccctaaagctaaggggaaggtactgataatgatggactgggtaagttttaaaatgcagcttgccttaggatttactatctcttggttcttatttcagagcaaaagtaacctgaacccagatgccaaggagtttattccaggagagaagtactgagccgagaaagctttgaggaagacttgtctgtccccacatctggggatagtaatgcacaaaatggtggagctgaagagggggatggggcgggcgaggggtgcacagcgggaaggggagtggtggtctcacaatactgtgactctgagtaactaatatgctcagtcttattctaagcctctgagtatttctattttgttctgctgacttttgtttggggagtttcctgttttgtttttttaaatagctctttcgagttaaggaaattgcattttccccccttcatcagaagtgttccgcggtgtgtatttaaacaaaataagctgactaagaaaaactggatatttaggaaatgcccctctcaccctgctgtatacttatcagggacagtgagcacctggagagctttttgtggaatctattgagttggatgggaaaagggacaagcagaaagagcaggtggtgcaaactggaatttgaggctcagctgccccacccccggggtctcctgcaatgaactcggataaccaatgtgctgtcaagcccttgcctgtttgtcctgaaccccattcaagaaaacacagacttaaagtacttagtttacagtaacttttgatgattgttgaaagttgtaaatcagaaggtagggctgtgatggtggttgtcacttgagtcatttagttactgttgtcctgttcataagcctgtgttcaccaccaccatcagactcaccatttataagtagaagagcactagggttgatctgccacctcatctttcatgaagtctattccccagcctcctttttaagaaaagatactgctaccaaaggcataggggaggcctgctgtgctggcaattagcatgagcctgcagaagtcatccttgaatctgttgtgtcttaattttatttggacagtttttttttccagcctcatcaacacttggtcttcctggtgtcttaattccctcagacaagtttatgcacttttttaaggaaatatttttcaggacactagtaagaagctcagttcacagtttggatatttcttcccacattacagaattatggaaaggaactcaaaatcagcctaggaaagtgagtcctgcttgacccatgtgactgtgtacctgaccttctgggatcttttcagctattaaaacattttactgttcccacatacccagctttgcaagttttgtagattgacctcttagggtgtgtttctttgtctttcctgcctttaacttgctggggtcttttgttgctacccctaaggaactaaactgggtgccaggagctaccttcgtgtatagagatgtagatggcagtgtggggtacaggagagccatccaggccattctcccagggatgaggaattggagagccctgaagataatagtggcttctttctgattgctactgtgctgtgtgataggcctaatagggaaaagatatgtaacttgaaacaaagttggtataaattcagtatgtggctgtgggacagaggttggaaggaaaggactagggtatggaaagctgaagaaattctccttatgagctctcgttgactttttgaacagtgataagctaatgccagatttaaaatacacattttttcctatttgagtctttaggattatatcatttgaaaaaattgccttccttgttaggtcacatgtcataggagagtagcttagagaacttgcattaccagacagacacattaattcccaaagcctctatgttgagagaatgaaactgttaactctttttcagagaggactatgaataaagaaacttctttattcaagcttcagctttcagctgggttgtttcctctaaaagggaaagggcattgcaagtgcatagaggaaatctctcccttctgggactgcttttcctccttcatcctcgtgagcctgtccaagctcagaattccgaaggctgttagaaatgcgttgggattgcagagagaaaggagcttgtctttccttctgctgtgctggtctgttttggatgtcagtcttcaggactatgaaaacttcctgccagtttagcatggacactgagggctggcatttctagtcttcttcagacactgaacatactgactccaggtataggaagcagctagcaaattgattcttttttaaatgcataggactctgcttccggcggttcctcttgtagtccaactctttttgccatctatttatgttgggaggtaggggcacaattgtcactcacaacacaggctagttagagtttgctaccttcttagcagaaaatgcatgtgtgtcttgttggaccttcactggggaaaggctgggagcctctggctgtcagtgacttttctcacagaagaagaaccagcaagccagactggacacctttaccctttaatggtaagacttgtatttataaggggtaattttgatgttgaatttaagccactactttgtttaaacttttttaaattggcaactagaagtttgagaatttgtatagaaatggaacatgtatttctaacagttgccaatctggctggtcccaatgttagtttattagtgattgatctgtaattattgggattatttattcaactctaaaattccaagatgaaaataatttatctctttcttttcaagggaaaaaacccaaatgaatgcattttcagtttctccaggcctttgaactgcagcagaaaattcaaggatacagcctaggcctgggcaaatgcagccctgggtctttgggccagtttctgacaataatagttgagttttgggaatcacataagggtgaaaccagaaacgatcctaaggaaaggcttgacctttgttaacacctttagtttccaaagtcacagcagctggggtccctcttttttttttttttttctttttttttgagacatagtctcactctgtcacccaggctggagtgcagtggtatgaccatagctcactgcagcatcaaattcctaggctcaagcaatcctcccatcttagcctcccgagtagctgggacaacaggtacgcaccaccacggccagctaattatttttattatttttattttttgtagagactggatcttgctctatttcccaagctactcttgaattgttgtgctcaagtgattctcccatctcagcctcccaaagtgctgggattataggctgggtgtggtgagccaccccagcctggggtctctttaattaaggttataatgctaaccatggcttaaaatactaagcaacattttccaaattgtttattactattgctttgattttggagaagctgggaagtaaggaggtgaggtgaatactctgataattaacacgtgttagagaggaaagttgtgtgaagaggctgccaaagtaaacagcacgaatgaatcttcttgtactagggctgctgcaaaccccaggtagacaaatgacagcccaggctcctgaaccatcaggaacccaggaatctacccaactgtgaggagggggcaggccttcgtcaataagggtcccaccatcacgggctaataatctttctcagtttaggtgatattgaggtattgaaactgttagaaatctgacagatttgaccaagatttggagacgtccacataattgggaaggactgagtgtccctagccactctcctctgggataacgcggacgtcattagtttgcgaagtgggtggggagaacaggaggattgactctaatttggtgtgtagtgggggccttgatgtccttctgcctctgtccacatttccccatgtgactcattgcaccctgcattgctcacagggatcattagttctcccggtagacagagcacctctgcagcctctgctctgctgccttgtgaatttcctacacagacttggttagttacaatttggaaacagtttttttgggtttttttcctttgttttaatcttctcacaatgaagctgctattggtgacagggacaggggagcaggaagccaacccagggaaacatgcgagtttcctgcacaccacttagtcacctgccctcactggccaaccccctactgctgttcccagtcagtctggtttttagaggcatcgtggcaatagaatagctggatacactaatctctacaaggtgtcaggcaggagattcaccttccccagtcccaggggacaggagagaaatctgtaaagggacagatgcaccatctttatttcaaaagaaaaagctccctcagattgtgttactaggagtctcttttgtgacatttactgagctttctccccaatcttaccttcctattggctactttttaaataaaaataaacattttaggctaatatgacaaaaatgagataaaatcttaaaaacattgtactagtgtacagttactaaaatgtgcttactacaaaacagtaaaatatttcactctgtaaatcatcactaagtagttattctgtcctgttgattatgagcctccaaaaatgtttaatgcttgaaggatggtttgggaggcagggaatccttttcttaaaacaactttaatgaggcatatgttacatatcataaaacacccatttcaagtgtacatttcagtgattttagtaacttccctcagtggtgtagctgtaactattactcagttttagaacatttttatccctcccaataagatccttcatgctcttttacagttaatcctgttcttacccccggcaaccactaatctactttctctataaatttgccctttctggacagttcaaatcaatggaatcatacaatatgtggtcccttgggtctggcttttttacttagctaatgtttttgaggtttgtccatgacagataacgtcttggtagtttgttccttttattgctgagtagaattctgttgatggatgtaccacattttgtcagcagagagccttttaaacttggattccaacttcctgttgtctaaacggaaccctccgaacgtaggacttataggggaagctgctgtgcatgtcaaaaaaactactaatcagaatgagctttgtcatccagagccagaactgctgcagaaatttttataattttgcaacttctttttttacaaggaacttttgtgctactacacatcaggacttttgaagcatccaataaatccatttaataagtatgagcatgtgtctgagtggacaagaaagtgaaaccatccatgctacattggataatttttcctcccccagactggacagggaatctcagctttcaaaacagagtaacctggctccacttacaaagctgcacaggcattaaagatcgtgctgcctttgttaggcagatttggaggggaggcccaacagcaaagatggagaggaaaaagggagtggagcttgtggaacaggaagccccccagggtctgtgcagggctgctcagctcttgaggatgttgtggatggtgaagtggtgatggtgtcccggagcagcccagcacctccactgggcccagaaggtcttgacttcggacacttacccctgtttcacaagtgtttataaagctgtttttgctttttttcccctaatcattacttggtagttattaatccttctttgggggagggacagggctttaaaactgaagaaaataattttcataaaaatatcaaaaatggaaaaaagttactttgtaaaaaatttgctatacaaaccaaatggcagctgttgagaatctcaataaaatgttaaatgc

SEQ ID NO: 511 - DNA, 20571 bp, Homo sapiens
cctttaagaaggcggagacgccccagtggcggcgtcttcgaatgcggcctaaggcgcctgccgccagtctcctggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctatggtaatgccgcgcccagcttgggggctggcgggccgcagggccccctggcctccggaactgctcatggggttccagcccctcgcccgcgcaagttgcaggaccggggtctgggtgggggttcggcggagtcgggagacctgggctgtcgtcagggcttgtcatggacgcgccggagaccctgagaaagcattctcctcccccgggcctcagtttccctcctgttgccttcctaccctcctgggaaacccccctttccagtgcgctcagacgtcactaccgcttgggtccatccctttcccctccccgccccacactttctactttttttttttttttttttggacgaagtctcgttctgtcgcccaggctggagtgcagtggcgtgatctctgctcactgcaaccgtcgtctcccgcccacccctttcactctgacccttagagtcttgggaactgtatcgccagctgtagctcctgcggctctggcatctggggttaggcaccacctctgatctgggtttgacactcatcaggaactggctacagcagccctgctggctagaaagaaggaaccgtggactggggcatcctactctcctgggaccctagtttttgggccttggattaggtagggaaactactggcttcatttgcagaaacaatgccactgtgcagacatgtttggatttatggtagtttctcttatgtttgacataagattggtcaggcgaaacctttgggatattgcaaaatccttaggcccaagccaggggccgtggctgacacctgtttttgtttgtttgtttttttgagacagagtctcactctgtggcccaggctgaagtgcagtggtgcgatctccgctcactgcaacctccacttcccaggttcaagcaattctcctgccttagactcccaacaagctgggattacaggcgggcaccaccaccccagctaacttatttctatttttagtagagacgaggtttcactttgttggccaggctgttcttgaactcctggcctcaggtggtccacccgccttggcgtcacaaagtgctgggattacaggagtgagccaccatgcccagcctgtggctgacacctataatcccagcactttggaggccacagtgggaggatcacttgagcccaggagttcaagactggcctgggcaatgtagtgaggccccgtatctataaaaatttaaaaattagcctgggcgcagtggctcacgcctgtaatcccagcactttgggaggctgaggtgggcagatcacaaggtcaggagttcaagaccagcctggctaacatggtgaaaccctgtctcaactaaaaatacaaaaaaaaatagccaggcattgtggcttggcctgtaatcccagctacttgggaggctaaggcaggagaattgcttgaacctggaaggtggaggttgcagtgagccaaaatcgtgccgctggacttcagcctgggcaacagagcaagactccgtctcaggaagaaaaaaaaaaaaagaaaattagctgagcacggtggtgcacacctgtagtcccagttactcaggaggttgaggtgggagggtcacttgagcctaggagattgaggctgcagtgagctatgatcttgccactgcactccagtctgggcaatagggcaagaccctgtctcaaaacaaaagacaaaaacaaaatgtttacgcccatgtgcacagtcctggagaactgcccttgctcccctaggcagccttccctttgccccctttcttcccttccaggattagtgcagatggttctgagtggattatgttacaagaaagttttttaatctttctttccttttttttttttaagacagagtcttgctctgtcgcccaggctggagttcagtggtgcaatcttggctcactgcaacctctacctcccgggttcaagcaattctcctgccttagccttccaagtagctgagatcacaggcatgctccactaggcccggctaatttttttttttttaaagacagagtcttgccctgtcgcccaggctggtgtgcagtggtgcgatctcggctcactgcaacctctgcctcccagttcaagcgattctcctgcctcagcctcctgagtagctgggattacagatgcccaccaccacgcccagctaattttttgtatttttagtagagacagggtttcaatatgttggccaggctggtctcgaacgcctgaccttgtgatccgcccccacctcaacctcccaaagttctgagattataggtgtgagccaccacgcccgaccaaattttgtattttaagtagagatggggtttcactgtgttggtcaggctggtcttgaactcctgacctcaggtgattcaccagctttggcctcccaaagtgttgggattataggcatgagccaccgtgcctggcagaaagtgttttaatctttttctaagaggcgggtctcactatgttgcccagcctagcctcaaactcctgggctctagggatccacccacctcagcctcccaagtagctgggactgcaggaatgagccactgcacacagctaagtaagttttttagaatacttgggtcttttttttttttttttttgatacagactcactctgtcgcccaggctggagtgcaacctctgcctcctgggttcaagcgattctcctgcctcagcctcccgagtagctgggattacaggcatgagccaccatgcccagctaacttttgtatttttagtagagacaaggtttctccatgttggccaggttggtctcgaactcctgacctcaggagatccacctgcctcggcctcccaaagtgctgggattacaggcatgagtcaccacgcccggccctagattgtttaagtctttaacgaaatcccatttcttctcattccttagtcctttcccagccgtagcaaaaacaaacaaaaaacaatatacctgatggtattgttagtgctgggaagaagcagagtgaggacagaatgtgcttgcaaatggtatttctcaaccccagttggttttttttcttttcaggcgtgcagtttgcagaagctgtttgctgtggaagaggagtttgaagatgaggtagggaagtgttgatgatcagaggtggcagacgaggtcttaaaatgtaaacactcaggttcagaacattttggattagcctgtaccagcctccttttagttgacatgtgtatgtttttgcctgtgaggtgctgagaagtgatgagaagtgtaaacaacctacttaactgtcttagaaacaaaaaaccagagcaatgaattgcctaattgtcatacctttaaattataagggctctttcctggaagctgtgtcatctagctgatttaattcacctctatgataacatacttgcagtgggaagggctgtgtatgtagagccagaaccatgtaagagatagcatagttactggatggcaggaggccaggggtcagcaattggctatgtgaatcagggcaagttactttattctctggtcttctgttttctcttctacaatatgagggatgctcttctgcctcagatgttcttcccttccctctgtctaatcacaagatgaggggtgagactagatccaaagctcgcacgttagaattacccttgtctaggctctaccacacaccaattaaatcagaatttctgggaatggcccagccagggatatttcttttttttccttttcttcaacatttattttaagttcaggggtacacgtgcaggtttgttacataggtaaacatgtgccatggtggtttgctgcacagatcatcccatcacctaggtaataagcccagcatgcattagctattcttcctgatgctctccacctccctgcccccggcagcccccactgtgtgaacttctttctttttttggagacaggatctctttctgtcacccaggctggagtgcaatggcacaatcacggctcactgcaacctcaacctcccaggcataagtgatcctcccacctcagcctcctcagtagctgggcctacaggtgtgtgccaccatgcccagctaatttttcgtttttttgtagagacagggtcttactaagttgcccaggctggtctcaaattcctgggctcaaatgatccttctgcctcggcctcccaaagtgctgggattacaggtgtgagccagtgggcccgtcctgatttttgcttttacaaataattcacaactgccagttttgtcaaggagatgtgtccttgtctttgtctttcagctttggagatatgtgattacaggctgaaaaagtgactgttaaaatgaccctcttgggtcttacaaggtgatgatgggactgctaagtgagtaatggaattagagtaaaggaatctgacagctgaagtttctgttccttgaaaatggcagatcagtcccttcccccttcctaaagcagatgatgtcatgtctgagagtgagctctttgggagaaaaaagaccatcaacctccagagtcatcaggattttattactgctatagttctggttattattattattgttgagtcctgtggttgtcctgcctgagtatgggactcacttaataatacacaaagcaggaaaaagcctttctgtagcccagacaatccagtgcagtagcagagggtgggggtggtggggaccctcctgtcagttaaatcagcagttctgactcaaaaccaccctcagaacaggtctgttgctcttgaaggtgtcaatctcaccttgcttcccaactggaatccatactttatttagcttgcctgaaaagctatatttaacttctgccttttttgctggctccaagtcctctctggcttactgaagggtagctatctctgtgtagtgtgtgtgtgtgtgtgtgtgagagagagagagagaaagagagcacacgagtgtgtattggggatgaggagtgagctaaggacaggcagcatgaccagctggatagatccctgtttagataacaggccagacaccagaaagtggtctccttgagatggttgttgtgtgacctagggtgatttgtctgacttcttggttccctggaacgtttgcttctcctgctgttctcctctaactgcccctctccccacccatgaagactgaagaaagaggttacctgaagacttagccttagattggagtgtttttgatagagccttgtgtagggccatgggtgaggtcagaggtggtaagagacaccactattggctttcatgctttggtttctttttctttttcttttctttcttttttttttttttttttgagacagagtctcactttgtcacccaggctggagtacagtggcaccatctcagctcactgccaacctctgcctctcaggttgaagtgattctcctgcctcagcctcccgagtagctggaactacaggtgtgcacccccatgcccagctaatttttttatttttagtagagacggtttcgccacgttggccaggctggtctcgaactcctgacctcaagtgatcctcctaccttggcctcccaaagtgctgggattacaggcatgagccaccatgcccgaccctcatgctttggtttctttcaagtatctacacacaaacatacacgccatgtgcctgaacagtaaaagcagaggggttcttgatttccagatgccaagacctaccatctctgcttccttgtaggatttcttgtctgctgtggaggatgcagagaaccggtttactggctcactgcctgtgaatgctgggcgcctgagacctgtctcttctaggccacaggagactgtgcaggcacagtcctccaggctgctgctgttacaccccactgctccctcagaggctttgggcctgccagacttggacctctgcctccctgcctccagcacgcccagtgctgacagccgtccatcatgcataggagcagctcccctaaggcctgtctctacttccagcagctggattggcaatcagagaagagtgacagtgacagaagtgctcagagagacagcaagacctcagtcctcagccttacaccccctactcacctttgagagccaacagcagcaagttggtggctttgaggggcctgaacaagacgaatttgataaagtcctggcaagcatggagttggaggagcctggcatggagctggaatgtggagtcagcagtgaggccataccaatcctgcctgcccagcagcgggagggttcagtattggctaaaaaagcccgggtagttgatctgagtggatcttgccagaaggggcctgtgcctgccatccacaaagcgggtatcatgtccgcccaggatgagtctctagatcctgtcatccaatgtaggactccacgaccccccttgagacctggtgctgtgggtcaccttcctgttccaactgccttaacagttcccactcagcaactccactgggaagtctgtccgcaacgctcccctgttcaagcacttcagcctctccaagctgctagagggaccattcagagcagccctcaaaatcgtttcccttgtcagccattccagtctccaagttcctggttaagtggcaaagctcatttacccagacctcgaactcccaactcaagctgttctactccctcaaggactagctctggattatttcctcggatacccttacaaccgcaagctccagtgtcttccattgggtctcctgttggtaccccaaaaggtccccagggagctctgcagacacccatagtcaccaaccacctggtgcagctagtcactgctgccagccggacaccccagcagcccacccatccctccacccgagccaaaactcgccgtttccctggcccagctgggatcctgcctcaccaggtgagtgagctggctttctaggatttggtgggcaagggagagaagcagggttccagcactgtccagccctagcatatcttccctcttgcagagaaggaaggaaggaagtgcagagaggcttttcaaagctgcaggagaaataaaagggaagaactgaatgctagaaaatccactgtgaagaagtgcttaaggctctgaggacatcataattttcttttttcttctccttttttttttttgagatggagtcttgctgcaacatccaggctggagtgcagtggcgcaatctcagctcactgaaacctctgcctcctgggtttaagcgattctcctgcctcagcctcttgagtagctgggactacaggcccccgccaccatgcctggctaatttttgtgtttttggtagagacagagtttcaccatattggccaggctggtctcgaactcctgacctcaagtgatctgcccgcctcggcctcccaaagtgctgggattataggcgtgagccaccacgcctgaccctcttttcctttttttaagaagaccctcttttcctttttttaagaattagagattggctatgttgctcaggctggtcatgaactaggctcaagccattctcccgccttagcctcccatatagctgggactacaggtgtgcactagggcaggaagtcattcttgtgcatttgttaaggtcttatgtgttggacaatttgcttggaactgagaatacagagattaaaagaaacagttcctgtcctaaagaacttacagtgaaatggaagaaacagatgtaaacaaacaaacatgcacaaagcacacagtgtgaacaggggtcattccctgggtgctgggaagacactggctctgccttaggcttgctgagtgggctttggatggatgagtaggaggttaacaggtgtgtggcggagcgggcgctgtgctctgtggatgttctggcagtgggaaagcagggaagagcatgtgtaagggcacagaggcagaagagcaaggtgctctcagatccacagaacagttcattgtggcaggtgtggggaagctggggctgaaaaggagacagccctggtgagacttggattaaactagtcttggatcagatcccagataattggactctgaggatctggactggttgtgataggtgtgccctcttcctcccattttaagggtgtttgaaacaatttctgcctgttacttgctcttccctagcatgttagcagatatccaaagaggccgtctatgttcctcctgggctggatctccctggaggaaagggttaggacttggggaaagctgcccctttgctcatcacaggcctctcaatttttctttctttctttctttttttttttttttaagacagagtcttgctctctcgtccaggcaggagtgcagtggcacaatctcggctcactgcaacctccacctcccagcttcaagtgattctcctgcctcagccttccaagtagctggcattacaggcatgggccaccacgcctggctaatttttgtatttttggtagagatgggggtttctccatgttggccaggctggtctcgaactcctgacctcaggtgatccacccgcctcagcctcccaaagtgctgggattacaggtgtgagccgccacgcccagccaggcctctctatttgggtcactgcccccttcaggcagccctggtttttgcacctgggcgagctccggcttcctcacgttttcaaaccaatccccaaagtatcttttttgagctgccaaagaggctcctgagactttgttaggagagatgtaatatgtgttaatagtccctgatcatttcctgaactcattatgtaaaccagacaataagctgtacttgtaaataacagctgctaagcttgctctcatcttctccttccctcccctcttagcagagtgggagaagtctggaggacatcatggtttccgcgccccaaactccaacccatggtgctctggctaaattccagacagaggtaacttatgcaaatgttaactttctgggtgtgatttgagagtgaggggcgtccctgtgtgtttcaggagttaagaatcaagagctgatgctgctaggcctgtttgctggtgtcacacactaaaaggcatttgaggcaggtagttgggggaggcagcaattttactggcattaagtgaggcctgtcctggtgccaggtaggtattatctgatgccatgggtccagccttctttcccatctaagaaataaaggcccagctagctccagcttcccctgggggaggagactgtgataagtattatgagattgtgtctcaggagcccttcctctcaggtttctgagaactgagctgggaaggatctgccttctcttgcctttgctgggttccctttggtgggtgagaccctgcttcccttctccttggggttctggttgacctgctctgccctcaaacccagttttgcttttaattctccccagtattttttctctgctgtagctccgcagatctgccagtccatttcagatccaaagcagcagatactctctggattcaaagcatgtattaatgtaagaaggttaattgttaaagctagaagcatgccaaatagaatatgactggtttcaaaatggctaagccactctggaagcctataaatatatgtggtggatccctacccctaagactttttgagtctgttacaaaaaataagcgtagatagccttctgcttcaatgcagttaaagtcaggagctgattttattttattttattttattatgttattttatgttattttattttattttattttatttttgagacggattctcgctctgttgcccaggctggagtgcagtgtcgtgatctcggctcactgcaacctccgcctcctgggttcaggctattctcctgcctcagcctcctgagtagctgggactgcaggcgtgtgccaccatgcctggctaatttttgtatttttagtagagacggggtttcaccatgttagccaggatggtctccatcttctgacctcatgatctgcccgccttggcctcccaaagtgctggggtaacaggtgtgagccactgcgcccagtcaatttttgtatttttagtagagacgaggtttcaccatgttggccaggctggtctcgaactcttgtcttcaggtgatccacccgcctcggccttccaaagtgctgggataacaggtgtgagccaccgcgtctggcccaggagctgattttattaaaaatttgtttttcatacctagtcctgcagacaggacctgattttaaaaagaaaaaaaaagagtatctgctgaatgaaacctgtgatacgcgacaagattttcacgtgcttcaaatgccaaagcaatcagaaaaaaaaaaaagaaaaagagaaaaaaaagatgtcacataccattttctggccttggagataaatgagaggagagactgtggccattgtactacagtttttccgaggggatttgcctttcctctctcacccttccaccctgtttcaatcaagagtctgtagcaaggtagacctattcatacaggctccccctctgctctgtggtaccagattgttgctagttcccaggcatctgtggaggaggattttgggcgagggccctggctgaccatgaaatccacgctaggcctggatgagagagaccctagctgcttcctctgtacctacagcattgtcatggtgctgcgcaaggtaaggattctgggtgctgagacccaaaggaaagaccatttttctccctctctctgacctactgccctactccaccttaggaaggggctgtttgctccctcgtaccctatacaagtagcagcacgaagcccctttggttgtatcttccacttacctaccttttcactgtcatccataggattgggcccaggtggaaggagagagtgggttatggtatgcctctgcacttccaggccctgggtggggtggggtgagcacactgccaccctcaaatctccctagtggttaagggttgtgtgcagagacatgccagtacatgtgccaacatatccctgcctgtgactgttatgatggaacattgtgtaaacacatataaacaaaagaaagtgctggacacagtggctcacacctgtaatcccagcattttaggaggctgaggtggaaggatcacaaaggtcaggagttcgagaccagcctgggcaacaaagcgagaccctgtctctacaaaaaaatacaaaaaaaaaaaatcagctggatgtggtggcacatgtcttatagtcccagctactagggaggctgaggccagaggatcacttgatcttaggaggttgaggctacagtgaactatgatcgtgccactgccctccagccggggcaatagagcgagagcttgtctcctttaaaaaaaacccaaggccgggcgtggtggctcacacctataatcttgagaggtcaaggcgggcggatcacctgaggtcgcgagttcaagaccagcctgaccaacctggagaaaccctgtctctactaaaaatacaaaattagccggacgtgttggcacatgcctgtaattctagctactcaggaggctgaggcaggagaattgcttgaacctggaaggcagaagttgcggtgagccaagatgtgccattgcactctagcctgggcaataagagtgaaactccgactcaagaaaaaaacaaaaaccaaacaggtcaggcggggtgggtcacgcctgtaatcccagcactttgggaggctgaggcgggcagatcacttgaggtcaggagttcgagaccagcctggccaacatggtgaaaccccctctattgaaaatacaaaaattagccaggcttggtggcacacgcctgtaagtccagctactcaggaagctgaggctggagcatcgcttgaacccagaggcggaggttgcaatgagccaaggtcgtgccatggtactccagcctgggcgacagagcgagactccatctcaaaaataaaaaaataggccgggtgcggtggctcatgcctgtaatcccagcactttgggaggccgaggtgggtggatcacgaggtcaggagttcaagacaagcctggccaacatggtgaaaccctgtctctactaaaaatacaaaaattagccgggcgtggtggtgggcgcctgtaatcccagctacttgggagcctgaggcaggagaatcgcttgaaaccagaaggtggaggttgcagtgagccaagattgtgccattgcacccagcctgggagcgaaactccctctcaaaaaataaaaaagaacggaggcaggggagagaaatgaaggacctcccagctctaggtctgtcagagagagatggggtacctccttgtcctccacaaagaagatcatcactataactatactctgacccctcctaaccccggttgccctggcacacttggagacctgggaagtcacaagtgggccgtggaaggctcagcatatgcctctccttgtaagcaggcagccctgaagcagcttcctaggaacaaggtccccaacatggcggtgatgatcaagtccctgactcggagcacaatggacgccagtgtggttttcaaggaccccacgggtaaggaattaggtcctaggttgtctggtgagtgggctccattgaggccaggaaatgaggtggaatcaccctctccctttgcagacaggaaaactgaggcagtgagcagcccacttcccagccagggcccataccagtcgctgtgctgcccttgaccccgagactgatgggccatgtggtatttgcaggagagatgcaggggacggtgcacaggttgctgctggagacgtgccagaatgagctgaagcctggctcagtgctgctgctgaagcaggtatggggagcagctctccacaccactgccccccggatagagccctcagtgtctgtctccttacctgtttggctgccttcctctacaacaccaggcacggagtggctgaaccattgctaggccctggcttgagctcagggaaggcctgtggcccttgagctggcccccattcttcagggtggatagggatggagggttgtgttaaggggagattgtggcaaatggttctcttctggcaccaaggctaggcagaggacaccaagtgaaaggcaggtgggagccaggtgtccatctggcagctcccagtgctccatcaggacactgaccttccctttccttgactccagattggagtgttttctccttcacttcgaaatcactacctcaacgtgacacccaacaacctggtccatatttacagcccggattctggggatgggagcttcctcaagccatctcagcccttccccaaggtaagaggagcaggaagaaacgggagactggtaaggccctccttctgcctggatcttctgatttcttcctctcttccaccctggggagcagaggtctgaagggggcaggtgctctgaggtgaaaaggtatctttggggacaggaccatctcctatccctcatccagccgcctggcagatggctcagtaacagtacctagaggagcagctggcttcttggtgatccctgagcatctgatggcaggcttgaacatctgagaggataggagtcacttgagaactaaccaagtggagggcccaccagggggtggtggcagtaaatgaccgagggtcagatctgctacaggtggcagtgtggagaacagtgagctacaaatggcctgtcaggtgagccagcacctgctctgtgtcttccctcttggcatctgcctctgctaaattagggggaagctgcacagagcactggtggggacatcctctttaggaaccgagacgagcatttggcatttatgggaggtaagcatgggcttccaggcagatccactccaggttgagagtgtagagcctgggcttgacttgccctgcccccaccaccttcctaggatcttgtgtactgaaaacgtgtactgtgaccttgggcaagtcctgttgcctcccttgcaacagcttcatctatagtacgtttgacttgatgacctctagtcatcttagacagaggttttcatctaagctccaactttccacttccattttcctcatctttccccttagcccctccacattctctcaaaatcaccccacttctaaaccctttctttttctttcttttcttttcttttttttttgagacagttttgctctgtcacccaggccagagtgcagtggcgtgaccttggctcaatgcaacctctgccttccagattcaagcgattctcccacctcagcctcccgaacagctgggaccatgcccaactaaatctttttgtattttttagtagagacagagttttgccatattggccaggctggtcccgaactcctgacctcaggtgattggcctgccttggcctcccaaagtgctgggattataggcatgagccaccgtgctcggcctatttttcttttaaatttcaaattatctatacttattgaaataaatcaaaatagcacagaataagcaaaaaatgggtcctacccttccccactcctatttcctaggactaaccatggttaaccatttaattaccggtatttatttattttttttttttgaaatggagtctcactctgtcacccaggctgtagtgcagtggcatgttctcagctcactgcaacttcacctcccgggttcaagtgattctcctgcctcagcctcctgagtagctgggattacaggtgtgtgccaccacactcggctactttttgtatttttagtagagacgggatttcaccatgttggtcaggctggtctcgaactcctgaccttgtgatccacctgcctcagcctcccaaagtattgggattacaggcatgaactaggcgtgccaggcccagtttttgtgtttttagtagagatggggtttcaccatattggccaggctagtctcaaactcccgacctcaagtgatcctcctgccttggcctcccaaagtgctgggattacaggtatcagccaccgtgcctggccttaattaccagttttaattacctgcccatatattagctatatattcctttggggattgttaacaactaattttaaatctcaggctaactcttcaatgtatttctgaatggcctcttcactctctgctctagttatagagaatctctaaaatattagataccaacagaactaggaaagcaaatcagccaaaagaggtttgttttttgttttgtttattatctgctgctttgggtgtttggtgtttcagctgcctcccttcagcatgggcctgggtggctggcctctgccatactcttccatcatgtttctttttttttttttttttttttttttggagcaagggtctcactctgtcccccaggctggagtgcagtggcacgatattggctcactgcaacctctgcctcctgggttcaagcgattctcatgcctcagcctcccgagtagctaggattacaggcgtgtgccaccatgcccggctctgtttttgtatttttagtagagatgtggtttcaccgtgttggccaggctggtctcgaactcctgacctcaaatgattcacccgcctcggcctcccaaagggctgggattacaggtgtgagccaccacacctggccccatcatgtttctttcctgagccccacactgttcgtttgaggttgtctgggtagaggtggtgccatctgaagggatttcagggacacaggcattggtaaccagatcctctgtccccaggattcagggagcttccagcatgatgtggctgcaaagcccgaggaaggcttcagaacagcacagaacctagaggcagaggcgtcccctgaggaagaactcccagaagcaggtaaagcagtcagcccatctgggagcaagagaggttctatttcctgttgaatagctgaaccagaatcttcctggctatatcttgttcctctttccatgaatctttggatcttatataatcttacagaaatcagatacagtgtcttgtttggcaaggctgcaggccacaaactcgttaacagtgtgatggggccatgtaaaacaaagtgtcatccacaggtttcccccattttcaggttatgtgccatcagccacaaggaggaaacatcaccatcccctgtccagatggacaggcgctatctttgtgccacactctgagtcctctgtgggctgatgaccagaccacagaggcagatttcccatcctgagtaagcttagaggagtgctgaggagtcaagacgtccactggtttttgggaaaaccaggctacaaaccagagaggcccaaatgcagaccccttgtggttgggccagctgcttcctcagaaggcagcatcacccaggtgaaactaacaccattcaggatctagttttagctttttttactttaatttttatttttgcgacagggtctcattctgttgcccaggctggagtgcagtgttatgaacacgcctcactgcatcctcggcctctaggctcaagcagtcctcccacctcagcctcccgagtagctgggactataggtatgtgccactatgcccagcaatttttttttttttttgagacggagtctcgctctgtcacccagggtgaagtgcagtggtgcgatctcagctcactgcaagctccgcctcccgggttcatgccattctcctgcctcagcctcctgattagctgggactacaggcgcccgccaccatgcccagctaattttttgtgtatttttagtagagacggggtttcactgtgttagccaggatggtctcgatctcctgacctcgcgatctgcccgcctcagcctcccaaagtgctgggattacaggcgtgagccaccgcgcccggccatgcccagcaatttttaaattttttgtagagacagttttgccatgttgcccaggctggcctcgaactcttggggctcaagcgatccttctgtctctgcctcccaaagtactgggattagaggcatgacctaccgtgcccagcctggtctttagcttttcaattccaaaaattcaatcctgtctggccccaaagttcacaggattatatgtgggcagaaacctacccaggtgccgaggcaagagactgaaggcacaaactgttccagtataatacagaaaatagttagaataagaaaagttatactagaaataggatatagagatgattatatatggatattaccaatcattagtttttagtactaatttctgtattattattataactgagaaaaaaaccagccaatatagagtcaagagctgaagggacattgtgagaagtgaccagaagacaagagttgggtgccagatgtagggtccagccctactgggccttgtgggttttctcttcgtatgcagagacgagagattatagaaaaataagacacaagactaagagaaagtaggaaagacagctgggcccaaggggccactaccaccaatgcgtggagtccggtagtggccccaaatgcctggatgcgctgctatttattgtatacaaggcaagggggcagggtaaggagtgtgagtcatctcaaaagattgataaagtcaagcaagtcacgtgtccacgtgatgggggcctttccctttgtggtagctgaagcagagagggaggacagcatatgtcagcgttttttctgtgcacttatcagagaaatcaaagactttaatactttcactaattcactactgctatcttccaagaacttaaaagaagaaccaggtatacaggcggaacatgaaagtggacaaggagcgtgaccactgaagcacagcatcacagggagacgttgaagcctccagatgattgtgggcaggcctggctaatgtcaggcctcccacaagagctggtggagcagtgttctcgaactcccccaaggagagttccctttcccagtctgctaagtaacagttgccttcccaggcactggcgctaccgcaagactgaggtctgctaagtaacgggtgccttaccaggcactggcgctactgctagaccaaggtgtcatcaggcagcccttatcagggcgtgacagaggactttcactcttgtcttctgctcacttctcacaatgtgccttcagctcctgactctgtactggctgttttttttctcggttataatgataatacagagattagtattaaaaactaatgattggtaatattcatatatagctgggcacggtggctcactcctgtaatcccagcactttgggaggccaaggtgggcggatcacgaggtcaggagatcgagaccatcctgactaacatggtgaaaccccgtctctactaaaaatacacaaaaaattagccaggcgtggtggcgggcgcctgtagtccagctactcgggaggctgaggcagaagaatggcatgaacctgggaggcggagcttccagtgagccgagatcgtgccactgcactccagcctgggcgacagagtaagactccatctcaaaaataaaaaaaatccatatataatcatctctatatcctatttctagtataacttttcttattctgttttctttattatactggaacagtttgtgccttcagtctcttgccctggcacctgggtaggtttccacccacaattatggataggtgttctcacactacctaattcacagtataccaatggataaaccacaaaggccattatatcttgtgaaaaagcatatgtctcttatcctggaatcttgcattgcctggaagcctgcactctttctttgtgagacaagccaaggcatcaccagaaggttgctggtagtgacagagagttgattatagaatattagggctggtgggccgggcatggtggctcatgcctctaatcccagcactttgggaggccaaggcaggtggatcacgaggtcaagagatcaagaccatcttggctaacacggtgaaaccccatctctactaaaaatataaaaaattagccaggcgtggtggtgggcgcctgtaagtcccagctactcaggaggctgaggcaggagaatggtgtgaacccaggaggcggagcttgcagtgagccgagatcacgccactgcactccagcctgggcgacagagtgagactctgtctcaaaaaaaaaaaaaaagtttgtttcaggtaaagtggggttgataacaggagctaactggagatgccctacctatgaatgtttattgaggcacagagcaagcactcagtcagtattagctgctgctagtaaataatattgctagggattatcgaggtcagctgtgtccaagttctcggacataagtaccacatctgagaactgtagtcttacacaggcactttgaggaagggggtgatattttccactgtcagatgagaagccaattaaggaactgtgtaactctgaacacatctgatggcttttcccagccctctttctccttcagccaatgagagttgcactaggtgacctctgaagccttcttgtttggcactatgactggatggaaggagaggaatcagtgaggctcaggggaatcctcttcctcgtcagaatggcccagggattacgcccccgccttttgtcatgtacgggtacaaggggagcagagggaagatggaagtcaggccagcctcaggcccattggcatgggtaccactgcctggaggagccgcctgcccagctatacagccaggtccaggccctcctgaagggcagaaactttggacctgagtcacatggaatgctgatgttgtcactaaggctacccatcattcccctctctgtagatgacctggatggactcctgagtgagcttcctgaagacttcttctgtgggaccagtagttgagactgccccaacgcaggacaacccaccatgagcaggcagctctgggcatgtgtctggtcacatccaagggggagaagaaggccagcatgattggagagtggacacagccggggggcttctgtggttgctcccaccctgggtgttttccctgagagccccctcatctctgcgctgccctcactttgggccttcctttgccgttggcaccagaatccggccggagactggctctccagccaacaagaaaggcctgtcaccctcgccttgggtgtccctctcctgcctcagcttaattttagaggatattgggcctggttttcttgtcccttcataccctagtccctggacagctgaggagatgaaaggagccacaccacaacaatggcggcctgcccctccacacaggggagaagcacgctcaggcttcctctgctttgtctcttcagacctgtggttgctctgctcatccatgcccaaggttcccaggtgcaggacagaggtgtggcctattgtaccttgttctgaaataaagcatctcctgctt

SEQ ID NO: 512 - DNA, 22210 bp, Homo sapiens
ggagacgccggcccttccgctcggagaggtactccctgcctctaactggtggcgcgttggcggaggccgacgaaagcctcgggtggggcgtgagcgccgcggggcattctggacctgctttgccttaggctgtgcctaattcgaaaccaaagcgcgggacggatgaaagtacgggtcgcgagaggttgttcgcgccttgagagttaagcgaagtgtggtggcttccaaggtaccgacacttgccgtaggctgggcttttatttaagtcgtcttttctctaatccagactcctgccacaggggccaccgccgtcctggccccgccaggggtccgcacccacggcggagcgggaggcgactttttgcggtcacagtaatgggacctcagcgccgccaccagctctgaccggcgagcgacgggaccctccaacccgatttccacgtctgtgcaacgggttcattctagacccacggtagagggtgtgaggaccaaatgagaagtatccacacagaatacttagcagagagcctggtgtctaggaattagtcgtcgtctgtcacctaggactgtgtggccgccatgggacgggctccatctttgtgtttttccgtgtctcgcacacgcctcccttcctgggcgtcacattcctgcagattagaaactgggacgtcttgcctcaagctgtctactaattcgcatttagtatgtgtcggtccttcgggtattgagtcttgatttatttataaattttttttggaggcagggtctcgctctgtcgactttcttaagaaagggctctgtccaaacatgtcgaaaaagttcacaattttgatgtgcaatatcattctgatgcagctttcgctttgatggttgttttctctccaataggaatacaaacataaaggccttcgaccgttgcaaatagactaaagtgaaaacaaatctgaatgaagatgaagttatttcagaccatttgcaggcagctcaggagttcaaagttttctgtggaatcagctgcccttgtggctttctctacttcctcttactcatgtggccggaagaaaaaagtgaacccatatgaagaagtggaccaagaaaaatactctaatttagttcagtctgtcttgtcatccagaggcgtcgcccagaccccgggatcggtggaggaagatgctttgctctgtggacccgtgagcaagcataagctgccaaaccaaggtgaggacagacgagtgccacaaaactggtttcctatcttcaatccagagagaagtgataaaccaaatgcaagtgatccttcagttcctttgaaaatccccttgcaaaggaatgtgataccaagtgtgacccgagtccttcagcagaccatgacaaaacaacaggttttcttgttggagaggtggaaacagcggatgattctggaactgggagaagatggctttaaagaatacacttcaagtaattatctcaattctgattctatatgtttgctatgttttctataatagagagcaacggtgtcaaaagaatgaggtttggttttgtttttttaacttactagcaaggaactcccttcagatagtaattaacattaaatagcactttatgtgtattaactcacttgatcctcatggtagtcctgtggagtatagatactgttatccacattttacagatgaaactaaaatagatcaaatatttgactaaataatacataaaattcacttgttttataagctaccaacaatattagaattgcttgttttccttgattattgaaaaaagtcacctggtaacagaattctagttgtttgctagataattctgtttagaatccagtaaatacccactgtcctacttattagcgtaaactgactcgtaaatttaaagaccttgaagcagaccagaacacatgacctatatttagaccttggtaaacataatcagaggttcttcataaggatctgaggataaatacactttaaccttcaacttctaatttactaacttggacaagtgaggagaatagcttccttaaatttaatattccattcaaaaacaaagaccattggcactggtgaattagctagtcccataaattatataggggtcttttgttaaaggaaagtttcacatcaatcattcctttacccaagcttcccaaagtgcagtacatgtactcttagtagtacacaaactctttcatttttgttttaagaatagtgtactgacccttgccatagcctgggcttctatttaagtcgtcttttccctaatccagactcctaaaactatgcgtgtaacacattaaacatgtcacatgttctaaagaaaaatactaagtatatataggtggtattggatatgtaccaaatggtcaaggcctttgctccttataatattcctcagctgtgtggggcaaggattatatatgcaagagctaactgccttcctaagatagttaattagtagcaaccaccaaactattgtctgctttccaagcaagcaacataaaaatcttctaatggcatcttacagttttgtatttgtaccactaaaatttagaattgatagttttctcatgagaagttattttccttaaaccaggaatgtacagctgaaattactaataagaaatgtattattaaaaggcagaaacctgctggaacacatgggaccccagggcctgtagctcttggcacaaagtaaggaagtgcaccagagaggaatttctgtttggaatgtgaatgagccccaatagcccaggcagagagaagactggttgttttttttttcatagagtcagctttgttgatctagattagcactcagctgtgtttctcagttaactcagtagcaaccttaagaaatgagcagaatcgcttaccccagcaccccgcccagacttgaccgccgggacccaagtgattctcccatctcagcctgctgagtagctgggaccacaggcgtgcaccaccatgcctggctaatttttttattttttgtagcgacaagggtctccctatgttgcccaggctagtctccaactcctgtcttcaagtggtgctcccacctcggcctcccagaatactgagactacaggtgtgacccactgtgcccaggcagaatcactctttttagaaaataagtattagtaagcagtgggttctgaaataaataaagggacaattagtgtcatggtgaataaaagaaaaagggctcactaaattgattaacgggtctggaggatactggatcccaaacccaagaaggtggcacccaagaagaattacattttaaaaattaagaagatttttttaatgaaaaatattggatcagtaatttctacccagtcttctcaaaggtgagagcatagaaatgtgtctggcattcttccaaatacttgagcagtttcccaagcatcagttcatcttttgaagactggtgggaatgagaaagtctgacttattctgatttatattttgtgtataaatacacacaaagggatggggtttaggttttaatttttttttttttttttttgctacgctgatttaatcctgaagtattagccatcctgccagttccatcatgagaatactggagatgcatgaaggttttttttagtgcacttcatatacgaggacttgaaaacatttcactttcattactttgagtgaataagcagacttgatgctacatgcagtgaatattcttggatcattttttatttttataaattgaatcatgttgaatgttctgagccttagtgtctaaaggatcctgtaatctaggttttcatgtttgtgatcatgtgtatatgaagaacctagccaggggtaagtttgcagcgagaaatgtatggtctattggcatggcatttgctaagtttttttcttcctgtttttaacatgtttgtcttctgcttcattaacctagtgtgtagatgaatgctatacacttctttttcctaggctttaattccatcagtcataaatttcttgtaggtctttcacgtgttaataattccaattgagtcaagtaaatttggagtagaataacttagttcctaagttgaatttcatttaactctccaaataatttttcagaagggattccattttttgctaatgatagaattgacatttccagctgggcatagtggctcatgcctgtaatcctagcactttgggaggccgaagcaggcggatcacttgaggtcaggagttcaaaaccagcctggccaaaatggcgaaaccccatctctactaaaaatacaaaaaaattagccgggcgcagcgatcacttgtaatcccagctactacggaggctgaggcaggagaatcgcttgaacctgggaggtggagattgcagtgagccgagatcataccactgcactccagcctggaaaaaaaaagaattgacatttccatctttgtaaaaaatagttgaaggccgagtgcagtggctcatgcctgtaatcccagcactctgggagaccaaggtgggacgattgcttgaggccaggtgtttaagaccagcctaggcaacgtagagagattgcatctctacaaaaaaaaaatttttttgaattagccaggcgtggtggcacatgcctgtagaggaagctgagacaggaggattgcttaaggccaggtgttcaaggttacagtgagcaatgatcgagccagtacactccatcctgggtgacaagtaagaccctgtctcaaaaaaaaaaaaacttgacaaatgtaaagttgttttccgccttttctgtgggtctctctgcaagcatgttccaagcacgtgtatttcctgctctgtttctctgagtatctaattggtgatttccaagattgcttcctttgctctactgtgtggtagattggaaacagattctggtgccaggctgcctgtccagctttttgctttggggcaaattaacagcactgcctggtgggatagggcctcattcattaaaatgggggtaacttacaatccctattttgctgggttgttgggtttgaaaattaaataatgttttgaaagctccaaggccattgcttagcataacagtcccccctctttctctcctcttactaagaaacaagtgaatatatttcttgtgtttgttgagtctctttgtgtgtttttttttttttttttttttttgagattgtcttgctctgtcacccaggctggagtgcagtggcatgatcttggctcactgcaacctctgcctcctgggttcaagcaattctcctgcctcagcctccagagtagctggaattacaggcatgcgccaccacacctggctaatttttgtattttgagtagagactgggttttaccatgttggccaggctggtcttgaactcctgacctcaggtaatccgcctgccttggctgcccaaagtgctgggattataggcataagccaccatgcccggccatgttcccttttttaaaatgtgtatgaggagggggcttactatgcaagcgcttggaggccaacgagcactgaaaatgaggagagagttcaaaaatcaagttagatcctgggatacgccaacaaatccagacactacagttctttcggagaaacctggggacgaaaagtaaggctttgacctcagaaaatgaacatacaggaaaaataatgtgtcctaatgtgtcctaatgaaatttctctagtattcacatgttataaaatgttaggaagaaagaagatgtgtcctcctacaagccataaatcagaattctaataatctaaagctaattagaaaaatattacatgttaaatattaaatattagaatagaaaaatgtatgagggaaaaaaattgagacacagctgaatttttcaggctgttccagcactaaaaaaaaaatacaggagaagaatgtcacatattttcctcttcctccccctccagattccataatatcaaattcataacttttcatttgcgcatgccttattttccattccttgtttgtcactaatcctgttagtaaaaggattcccccacctatgttcataattaagttttggtctaaaaagaactacaaacagaagcacagttccctagatttctaatttttttttattttatcacagccagttaacttattacattggatacttaaacacatagtaccataaactggatgtggtcttgtagccgccagatcttcagttttgactttggcccaattctcctagaagtacttaattttaattcattttattacctaacgtcctattaataatcccgttggtttcaaagtatattcttaggtttcacaagaggctgaaatttggtcttaggggttgtcacttaaaaataactaatgtaatttttggccgggcacggtggctcatgcctgtagtctcagcactttgggaggccaaggctggcagatcacgaggtcaggagttcgagaccagcctcaccaatatggtgaaaccccatctctactaaaagtagaaaaattagccaggcacggtggcgggcgcctgtaatcccagctactcaggaggctgaggcaggagaatcacttgaccccaggaggcagaggttgcagtgagccaatatcgcccactacactccagcctgggcgacagagggagactccatccaaaaaaaaaaaaaagaaaaaaaaatgtcatttttaattgtattgtttcagggcgttttagagtatttgtttttcagtgttagctttgtttgtgtttcccccctccccttttccctgattttcttttcagacgtctttttacaagggaaacggttccacgaagccttggaaagcatactttcaccccaggaaaccttaaaagagagagatgaaaatctcctcaagtctggttacattgaaagtgtccagcatattctgaaagatgtcagtggagtgcgagctcttgaaagtgctgttcaacatgaaaccttaaactatataggtctgctggactgtgtggctgagtatcagtaagtatgagattggaggtgaattaatacagcgtaggacagatggtgcctgtcaaaggtgtgcctgtaggtactgtagcctctgtctgtttaatgtccagacctttgtgctaggtaaaagaattgggtggggcggggttgagaacaggtacaaggagaagagccacgtaacctttgtcatccagtactccaaaatcaaattgtttgctggagaaaggtatattctttgtttgtttgttttgttttgagacggagtgtcacccaagctggagtgcagtggtgcaatcttggctcactgcaacctccgtctcccaggttcaagcggttctcctgcctcagcctcctgagtagctgggactacaggcatgcaccaccgcacctggctaatttttgtatttttagtagagacagggtttcaccatgttggccaggctggtctcaaactcccgacctcaagtgatccatccaccttggtttcccaaagtgctgggattacaggcgtgagccactgcacctggccgagatttttcaatctccctaacatggcctgtttgccagcctgtccttcccctcccccaaagcaaggtacctgccataagatccaatttcattcctgcgttttctttcctgtttttctaaagatagcaccatgatctgttggttctgaaaatcaactcttcctggcttccaggcagtgcttgacatggatcagagatctgaacttactaaagcttcccatggttgttttgttttgttttgtttcgttttgttttttgagacggagttttgctcttgttgcccaggctggagtgcagtggtgcgatttcagctcactgcaacctccatctcctaggttcaagctattatcttgcctcagcctcccaagtagctgggattacaggcatgcgccaccatgtgtggctgattttgtatttttagtagagatggggtttctccatgttggtcaggctggtctcgaacttcggacctcaggtgatccgcctgcctcagcctcccaaagtgctaggattgtaggcatgagccaccacgcccggtccccatggtttttatatcgtagctgtcttactgttttactcaggtacttcagagtccaagtgttacaggaaaggggtcctgatccagaccccgagagggttcttcgatctcgggcaagaaagaatttaggttgaaggcaggcacagtggctcacgcctgtaatcccagcactttgggaggccgaggtgggcagatcacctgaggtcaggagttcaagaccagcctagccaacatggcaaaactccgtctctactaaaaatacaaaaattagccaggcgcagtggtgtgtgcctatagtcccagctactcgggagtctgaggcaggagaatcactttaacccgggaggcagaagttgcagtgaaccgagatggtgccactgcactccagcctgagcaacaggtgagactctgtctcaaaaaaaaaaaaataaaagaaagaaaagaaaaagcattcaggatgagtctgcagtgcaaagtaaaagcaggtttattaataaagtaaagtagtggaagtatagctactccatagacagagcagggcgttcctgaaagtaagaggaggaacacttccaccctaagtacagtgctcatatatataagataaaaaaagagatcttggggagatgtgctctactgcaagggtttgtgataaaggattaattttcttaattattatattttgcaagaatcgatactatctttaaagcaaaattaggaatgccttcgttctccagatatcagggtatctggacactcccaagtctgggtctgtttagtaaacattattaatttgttcccttaaccttaaacatctagaggctatgaatgcctgactttctgggaatgcagcccagcaaggcccagcctcactttcctagccctcactcaagatggagttgctctcgttcgaacgcctctgatacaaaggtggctacaacctgcaggtacccctaatccaaataaggcaagcgatcactaagaacaagatagaaaaatccgttcatgtaaaccttgaagctctagttaaaatttaagtttaaaagcttgtctattccacagcccaatacaaattcgtaaactttcttaaaacattatgagatttttttttggttatttatttatttatttttagttcatcagctattgtgtggcccaagacaattcttccaatgtgggccaggaagccgaaagagtgggcacccttgatagtctgaaaactgtttagaccacctaatggttttattttttatttatttatttttgagacggagtttcactcttgttgcccaggttggagtgcaatggcgtgatcttggctcactgtaacctctgcctcctgggttcaagcgattctcctgcctcagcctcccaagtagctgggattagaggtgcacgccaccacacccggctaatttttgtgttattagtagagatggggtttcgccatgttggccaggctggtctcgaactcctgacctcaggtgatccacccacctcagcctcccaaagtgctgagattacagacgtgagccaccgcgcctggcctagaccacctaatggttttatagcacaactgcgtcatatctgagaagagccctgtataccaagagatttaatagactttggttgccttttagataaaccaaggaagccatacagtcacctccacccaaggcctacaagaagttcctgacacccaatgcttgtcatagagatgataaaatatgtccatagcactgttgtttgttttttgctttttaagtcaacatcaaccttggtaatatgaacatttttgaaactacggtttttttttgttgtttttgtttttgtttttgagacagagtcttgctctgtcacccagactggagtgtggtggcccaatctcagttcactgcaacctctgcctcctgggttcaagcaattctcctgtgtcagcctccccaagtggctaggactacaggcacccaccaccacgcctggctaattttttgtgtttttagtagagatggggtttggacatgttgcccaggctggtctcgagctccgggccttgagtgatctgcccgcctcagcctcccaaagtgctgggattgtaagtgtgagccactgcacccagcctagaattttttttttttaagacacagttttgttcagttgcccaagctggagtgcggtggcatgatctcggctcactgcaacgtccacctcgcaggcccaagcgattctcccacctcagcctcctgagtagttgggaccacagatgcgaacaaccacgcccagctaatttttttgtatgttttgtagagatggggttttgccatgttgctcaggctgatctagaattcctgaactcaagcaagctgcctgtctccgtctcccaaagtgctgggatttacaggtgtgaggcaccgcgcccagctaagaattttttatttttgttatttttttaattttatttatttatttttttgagatggagtcttgctctgtcacccaggctggagtgcagtggcgcgatctcggctcactgcacgctccgcctcgggttcacgccattctcctacctcagcctccccagcagctgggactacaggcgcatgccaccacgcccggctaatttttttttttttgtatttttagtagagacagggtttcaccgtgttagccacaatggtctcgatctcctgacctcgtgatctgcccgcctcggcctcccaaagtgctgggattacaggtgtgagccaccgcaccgggcctaataattttttattttattttagtttatttttttgaggcagtctttcactgtcacccatgctggagtgcagtgatgcattcagggctcactgcagtctctaactccccaggctcaggctgtccttccacctcagcttcccaaatagctggaactacagggatgcaccaccacacccaactaatttttctattttttgtagatgtggggtctcaccattttgctcaggctggtcttgaactcctgggctcaagtgatccaccacctcagcctctcaaagtgttggaattacaaacgtgagcccctatgcctggccgattttgtttttgagaaggagttttgctgttgtcgcccaggctggagtacaatggcgagatcttggctcactacaacctctgcttcccgggttcaagtgattctcctgcctcagcctctctagtagctgggattacaggcgcctgctaccatacccagctcatttttgtatttttcatagagacggggtttcaccatgttggccaggctggtctcaagctcctgacctcaggagatctgcctgcctcggcctcccaaagtgctgggattacaggtgtgagccactgtgcccgaccccactgaatttttaatgggtaatatgctattaagagtaactccccacacccactctgtattgaacctctgtttaaaaagctcctgtgttcctgagatattgtatgaccatatgtacaatcatttgtccccacactcattttttaacacaagatgatataccctgcttttttccacttaaaaaaattatttaaaaaaaaatcaggctgggcgcagtggctcacacctgtaatcccagtactttgggaggccaaggcaggcagatcacgaggtcagaagattgagaccatcctggctaacacggtgaaaccccatctctactaaaaatacaaaaagttagccaggcatggtggcaggcgcctgtagtcccagctacttgggaggctgaggcaggagaatggcgtgaacccgggaggcggagctggcagtgagctgagatcacgccactgcactctagcatgggtgacagagtgagactccatctcaaaaaaaaaaaaaaaatcttttattagtttatatagatctgtaacattcttttctcatgtaataattttccaccacccacaattaacacttaacactggtgcatttgcttaaaactttttttttccttatccctgtgattacatggagatcttttttttaaagaaatataatattacagattaaccccaaattctgttgaaccacccgtggccaaaggcgattgctgttttaagtttggcactacctccttctagtctgccttctacgctcttttttgttcttttctttttttaatgaccaatgatctgtgacacagcatcaggagaacctaagaatatgtgccctctatactcttagcacacacataatgctatgtataatacacatgcataggcagcacttatgtatgatttcatgcagaactgtgacagtcataatatacagacatctctagatacacagcatcacaaagctagtaagatattgggctcaggagccagctgcttgagtttggattctggcttggcttttcatcttaaccttagattaattacttagtcgctctctgtctcaatttattcatctttaagataagacaaatggtagtacctaccttgttataaaatgagatattccctgaagagtgcttaatgcatactatgtattcagtagatgttacattattattttgatctacttctttttttacttttttatagaaataattcttgctgtgttgcccagactaatctagaactgggaaggaagtatgatcctcacctcagcctcccaaagtgctgggattacaggcgtgagccaccttgcccaatctactactcgtgtgtgtgtgtgtgtgtgtgtgtgtgtgtgtgtgtgtcagagtctcgctctattgcccaggctggagtgcagtggcacaatctggactcactataacctccgcctcccaggttccagcaattctgcctcgccctcctgagtagctgggattacaggtgcctggctaattttttttgtatttttaatagagacagggttttgccatgttggccaggcttgtttcgaactcctgacctaaggtgatccacccatctcagcctcccaaagtgctgggattacagacttgagccactgcacctggccctacttctctcttaactcgttttttgtattcttttgtatgaatgagccttacccatttccctattgggaacactcagattatttctagttttccacaattacaaacagtgctgcagcaaatgtgcctctttgtatattacagagctgttctaggcagatgcacagattcatttgtttatttattttttttcttgagacggagtttcacccttgttgcccaggctggagtgaaatggtgcggcaccgcaacttccacctcctgggttcaagcgattctcctgtcttgtactcccaagtggctgagattacaggcatgtgccaccatgctcagctaattttttgtttttagtggagacagggtttcaccatgttggccaggttggtctcgaactcctgacctcaggtgatccacccacctcagcctcccaaagtgctgggattacagacatgagccaccatgcctggcctgtttgttttagacgtgtgatatatgcagttacaatccatttagttggtctgaagtagacccggacatgactgcttcttaaatctcccaggcacttgtcacttcacttgtactcaggatatcaagccattgctatcctatactttaggaaggttgctgggtcaagggtatgcattttaaattaccaagaatatgagtgaatacatttaacaatacagtgttagtaattttgataacattgtatttttaatttgcatgtcacataagtgagactgagcatcttttcatttaagagctatttgtgaactgttactgtacttttaatttgggtttacgctactatgatgttaaaaaatgtttttgactgacaataattatatatatttataggctacagtatgatattttgatatatgtatacctaatggaaagattaaataagctaattatcatatccatcacttcacctatttatcattttttggtggtgagaatctttaaaatctactcttttagcaacttttaaatatacaatgcattattaaatatggtcaccatgctgtgcaacagatcactaaaatttattcttctgacctaactgaaacctcttaccctgggatcagcatctcccctttcctcttccccactctccatccctatcctcttgtaatcaccattctactctctctctttctgagttcgacttttttagattccacatataaatgaaatcatgcagtatttgtctttttgtgcccagcttatttcactcagcaaaatgttcaccatgttcacccatgtcacaaatgacagaatttccttctttttaaaggctatgtagtgttctattgtgtgtgtgtgtgtgtgtgtgtgtgtgtgtgtgtatccacattttctttatccatttatccatagatggacacttaggttgtttccgcatcttggcctttgtaaataatgcttcagtgaacctgggattgcaggtgtctcttcaacatactgattttaattcgtttggctatatatccaaaagtaggattcctggatcgtatagtagttctggtttcagtttttagatgttttagttttctgaggaacctccatgatgttttctcaaatggctatactaatttacatgcccaccaacagtttatcagggttctcttttctgcagtcctcaccaacacttaccttttgtctttttgataatagccattctaacaggcatgaggtaataatagcccagtgtgattttgatttgtctttcactaatgattagagatattgagcatattttcatctatctgttggtcattcatgtcttcttttaagaaatattcattgagctcctttgcccattttttaatcaagttatttgttttgttactatttagttgtttgagttccttatatactttggatattatccccttatcagataggtggtttgcaaatattttctcccattctgtggattgtgtcttcactgttgtttcctttgttatgcagaagctttttatttggatgtatatgtctgtttttgcttttgttacctgtgcttttgggcttctgagaaatcatggctcagatcagtgttggggagcttttctcctgttttttttctagtagttttacagtttcaggtcttaaattttaagttgatttttgtatgtggtatgagatagggtacaatttcattcttatgcaagtcgatacccagttttcctaacacaattgacaaaacattccccattgttcgttcttggtacctttattgaaaatcaattgactgtaaattcatggttttgtttctgggctatctgtcctgttccattggtttaaggtgtctgcttttatgctattatcatgctgtttgattataacagctttactttatacagccatgttccacataacaatatctcagtcaacgacagactacatgtaaacagtggtcccataagattataatggagctgaaaaactcctatcatctagtgatgttatgttatagtgcaacatactactcgtgttcgtggttatgctggtataaactaacctcctattcagtcatataaaaacagcacataccattatgtacactacagtatataattgataatggtaataaacaactattactggcataagctggtatataaccagcttataaacaactattactggcatattactggtatttactatgattctgaccctgtgtaggcctaggctaatgtgtatgtttgtgtcttagtttttaacaaaggtttaaggggtaaaaaataattttaataatagaaaaagcatgtagaataaagatatcaaaaaagaggccggggcatggtggctcacacctgtaatcccagcactttgggaaaccgagacaggtggaccacttgaggtcaggagttcgagaccagcctaggcaacacgatgaaactccgtctttgctacaaatgcaaaaaattacccgggtgtggtggcacatgcctgtaatcccagctagtctggaggctgaggtaggaagattgcttgaacccgggaggtgggggttgcagtgaaccaaggttgcaccactgcactccagcctgggtgacagagcaagactttgtctcaaaaaaaaaaaaaaaaaaaaagaaaaggaaaatatttctgtatagttgtacgatgtgtttgttttaagataagtattattacaagagtcaataaattaaagaagtggccgggcatggtggctcatgcctgtaatcccagcactttgggaggccaaggtgggtggatcacctgaggtcaggggtttgaaaccagcctggccaaaatggcaaaaccccatctctgctaaaaatacaaaattagccaagcgtggtggtgcatgcctgtaatcccagctatttgggaggctgaggcaggagaatcgcttgaacctgggaggtggaggttgcagtgagccaaaattgtgccattgcactccagcctgggcaacaagagtgaaacaccatctcaaaataattaaagaagtttatacagtaaaaaagttacagtaagctaaagttaatgtattattgaagaaagaaaaacgttttttataaatttagtgtagcgtaagtgtacagtgtttataaagtctatagtagtatacagtaatgtcccaggccctcacattcactcaccgctcactcactcaatcacccagagcaacttctagtcctgcaagctgcattcgtggtaggtgccctatacaagtatactgttttttatcttttataccacatttttactgtaccttttctgtgtttagatgcactaatgcttaccattgtgttatagttgccagcagtattcagtacagtaacatgctgtacaggtttgtagcctaggagcaaaggtctgggtgtgtagtaggctatcctacctaggtttgtgtaatatactctatgtttgcacaatgacaaaattgcctaaccatgcatttctcaggacatatccctgtcattaagctacacatgactgtactttgaaatcaggcagtgtgatgcctccgacttcattcttttcactcaagattgctttggctattcggagtcttttgtggttccgtgttaattttaggatttttttttttctatttctgtgaaaaatgatgttggaatttttttttctttttgagacagagtttcacccttgtcgcccaggctgcagtgcaatggcacagtctcagctcactgcaacttctgcctcccaggttcaagtaattctcctgcctcagcctcccgagtagctgggattacaggggcacatcaccacgcctggctaatttttgtatttttagtagagacgaggtttcaccatgttggccaggctggtctggagctcctgacctcaggtgatctgcccaccttggcctcccaaagtgctgggattacaggtgtaagccaccgtgcccggcagaattttttttttttcttttttcctgagacagggtctggctttgttacccacgctgttgtgcagtggtgcaatctcggctcactgcaaactccacctcctgggctcagcctcctgagtagctgggacaacaggctccagccacaacacctggctgattttttggtattttttatagagacagggtttcaccatgttgcccaggctggtctcgggctcctgagctcaagcagtccacctgccttggcctcccaaagtgctggagattacaggtgtgagccatcacacctggcctgccattggaattatgataaagattgcgtggaacctatagattgctttggatagtatggacattttaacaatattcttccagtccataaacagaggatatcttaccatttatttgtatcattttcagtttctttcatcaatattttatagttttcagaatgctattaaggtttttttttttacatttattaagttctacaattacagtacattgctgcaaacagtgttctgtggcagaaatataacatggtggctcacacctgtaatcccagcagtttgggaggccaaggcgggtggatcacttgaggttaggagttgaaaccagcctggccaatagggcgaaaccccatctctactaaaaatacaaaaattagctgggcgaggtggcgcacacatgtaatgccagctactcagggggctgaggcagaagaatagcttgaacccaggaggcggaggttgtggtaagccgagattacaccactgcactccagcctgagtgagactccatctaaaaaaaaaaaaaaaaaaagaagaaccaggaatggcatcctagagttactggggcccttttctcaactacacagattgtcaaacttggcaatattacaaaacaattctgaagacaataaaattatctctaaacctaaactgtccagtagagtagccactaacccctatagctattgagcatttgaatgtggtcaggccaaactaaggtgtgctatagcaatatacaaactacatttcaatgactttgtacaaaaaagaatgtaaaatatccctataataaaaaaaagacgtaaaatatcccattaatcatttgttagttgattacatgttgaaatgatattttggatatgttgggttaagtaaaatgttaaaatttcagctgtattttttttttcttttccgatgtggctactagaaaatttaaaatgacacatggctcacattttacttcttttagccagtgctgctctagactgagtttgcatgaggtgtaactgtctagagctatagtgacatgtaagtaatatacatgctttgtacaaaatctccctataaactgctgattttgaaattgaagtcatgaaagacagattgaaccgatagagtcctttgagagtcaccagttactggtccactctctgtatccttttgatatttgcatttggcaagtataaacccgaccaggataggggatggggggaggaatccactggttatttgatgcaaaaaaagagggagaaaaagtgggggggtgcacttatagtcccagctacttgggaggctgaggtgggaggatcacttgagcccaggagtatgcgtttagcctgggcaacatatgaaaccccatctcttttttaaaaaaggaaaaaaatggtgaataagagcaatggtcattggctgacaagtaacaaactatacataagagaactgttaacctagtagagattttcattgtgatctattacctacaaagtcttcctgtggtttctctttaggggcaagctctgtgtgattgattggaagacatcagagaaaccaaagccttttattcaaagtacatttgacaacccactgcaagttgtggcatacatgggtgccatgaaccatgataccaactacagctttcaggtcaggacactgagcctttacttaaagctttgctcaatgcttacttaaaactataactccgggccgggcgcagtggctcatgcctgtaatcctagcactttgggaggccaaggccggtggatcacttgaggtcaggagttcaagaccagcctggccaatatggtgaaaccctgtctttaccaaaaatacaaaaactagctgggcatggtggctcatgcctgtaatcccagctattctagtagctgaggcaggagaattgcttgaacccgcgaggtggaggttgtagtgagccaagattgcgccactacactccagcctgggcaagagagtgagactccatctcgaatctgtctcaaaaaaaaaaaaaaaaacttctcagtgggggggtaggaggagaaaaattgtaaaaaaaaaaaaagttaaaaaatagaactccttgaggtttttccttttttaatctctatttttatcccattgcttaacgtcttccttgttcctttcccacttaaaaaagcactttttggctgggcacagtggctcacgcactttgggaggccgaggcaggcagattgcttgtgctcaggagtttgagtccagcctgggcaacatagtgaaaccccgtatctacaaaaaaaatacaaaaattagctggacatggtggcgcacacttgtgccagctacttgggaggctgaggtgggaggattgcttgagcccaggaagtggaggttccagtgagccgagattgtaccactgcactctagcctggccgacagagcaaaaccctgtctcaaaaataaataaataggccaggtgtggtggcccaagcctataattccagcactttgggaggccgagttgggcagatcacctgatgtcaggagttcaagaccagcttggctgacatggcgaaaccctgtctctactaaaaatacaaaaattagctgggcgtggtggtgtgtgcctctagtcccacctacttgggaggctgaggcaggagaatcgcttgaacccaggaggcggaggttgcggtgagccaaggttgttccactgcactccagcctgggcaacagagcaagactgtctctctccaaataaataaataaataaataaataaataaatagcactttttggccaggggtggtggctcatgcctgtaatcccagcactttgaaggaggccgaggtgggcagattgcttgagcccaggagttcaagaccagcctgggcaacgtgacaaaactccatcattactaaaaatagaaaaatcagccggaagtggtgcccgcctcagcttcgagggtgcaacgagccgagattgtgccactgcactccagcctggacgatgggagtgggatcctgtctcaaaaaagaaaaaaaaagcacttttccaccctcttcttgggccttttttttttttcaatggctctgtaaggatcacagcccagtcttcaatgttttatctgtcatctttgtgttcttgtgtcctggtgcagtctttgatcaacctaccttagaaactgagttaggagatatcctgtagattattttatactgagtttgccctggagtaagaaggaaacgaacctaaactctggacctactgtagtgaaacgagaattgccctgtgtttcttcctaggttcaatgtggcttaattgtggtggcctacaaagatggatcacctgcccacccacatttcatggatgcagagctctgttcccagtactggaccaagtggcttcttcgactagaagaatatacggaaaagaaaaagaaccagaatattcagaaaccagaatattcagaatagggagcaagttgctatttgggaacattcagcaccttctcacagtttgggaacatatattgctgtttactccagtgtaaaaatgaggtgccactggatctgagtgctacacgaacacaagtagaagtattaatttgttgaaatgtgttgttaccaaaaagactgaaaagccccaaagtctagatataaagacctagacttcggcacgcgaaatcccagctatgctacctcttatttacctgaaaggaggacacgcaggatgggcagtcatgctggtgactcttgtactcccttgagggacattgggggggggggggcgtggtcccaggcaggatgcccagtctttgagctgagattggaaggcagtgaggctgagggtgccaagatttccccagggttcacccagaggggaaggggctacatgcccccagctgtgtgcagggaggacacatcagcccactaccgctgccaacaccaatgcctaaaacttgtttcatacattggggttttctatatatttcagctgggaaaagcttacatttaaccttttgaaaaaataaatacgtgattagcctcaactaaacattgctgactataaagacagtatattcaccatgtcgctggcaatatgtcattgcgtaacaccaaataaccccccagaagtagccagaggccagtttgaacatcacaattctaagtgttttagtaactatttctggcgtgagtcaacagatcatgtagatagagtcaattattgtttgtggagtttttcagctataggggaggggaactattaaaatccatttgtttctattcaataggtaataaaaattagttgtccctgggtttgggaaacttaaatgcccattacagccctggggaagggttttctgtcttatggagtgagtcttagcatttaagttatacagttgctgccttaaaatagtagcctgctacaatgacttctttgggtagccattttcataagaaataaaatacaagatatgagtaatgaa

SEQ ID NO: 513 - DNA, 56820 bp, Homo sapiens
cgcagggccttagcagcggctgccgcagctcaatcgcggagcaactagccgggcgtctgcgggagccgagcgtggtgaggtggggcctcaggggcaggtgggaggtgctcgggttaaccgtccgaggcccggagacccgcccgtctagggcgcctgagggaatcccgttcgggcagcggcctcttgttacccgggaggaacccgaggcccagagaggggctgggacgcgtcgttagggcccggggcccgcttgcctcagcttcttgctgccgccagcacgctaagctccagtcggcgccgaaggagagcttcccgaccctcgtgtccagtagccgcaatcccaggctgggagggtgaggcgccgcgctctgccgcccccccgcccctcgctccctgtgtcctggcggatttgcacgtaatctatccgaaagcccagtcccacccgccacccgactctggagctcccattcttcaggaccctgctgaagtatcgcttctcagccgccttctccaggcgcagctgcattcgcttctcggtttttgcactcgctgtgcaccgagttactttcccggcccctcgttgacaccgtaagctcgttcgttagatgttatgccttgcctttttcatctctagatcccagggcctagcacgtgatgataatagtcatggcttactgtacggaatgatcacaaattgtcaggtgctactgaatgcattacacataagggcccatttatttatttatttagagacggagtttcgcgcttgttgcccaggctggagtgcaatggcgcgatctcggctcacctcaacctccgcctcccgggttcaagcgattctcctgcctcagcctcccaagtagctgggattgcaggcatgcgccaccacacccggctaattttatgtttttagtagagacggggtttctccatgttggtcaggctgatctcgaactcccgatctcaggtgatccgcccgcttcggcctcccaaagtgctgggattacaggcgtgagccaccgcgctcagccaaaggcctatttaatcttcccaacaatcctatggggtgagttctttctatagcttcacgttttacccatgaagaaactgaggtattcatagaaaaagtaatttgccaggagtcccacaactaataagtggatggagctgggaaactgtccccagggcatttgatgacttgactagattgcctttgggtttaatcaacgtctgttgaattgatctttactttggccctgggagttattggaggctaggcttgtgatcagtattttaccgcgaaggcttagaaaggagaactggtcccagatttatagaggtcacaacaaaaccaaggctactggtacgccctctgttcctttagttcttctatctttctttgctccttttcgatcagaaagctgcagacataggtgtcattatcgctcactatttaagaagtgcccctcacagagctgtgagttcgtagtccatgctttaactaatgtaatgttcatgctttaacagctaatgtaatggagagagtgtagaatttggaatcagattggggttcagtcattgctctgccactgaccaagctataagttatatgcctccccccacttttttttttttttttgagacctggtctcagtcacccaggctggagtgcagtggtgcgatctgggttcactggaacatcctgtctcccaggttcaggcgattctcccgcctcagcctcctgagtagctgggattacaggcgcccgccaccgtgcctggctaatttttgtatttctaggagagatggggttttgccatgttggccaagctggtctcgaactcctggcctcaaatgatctgcccaactcagcctcccaaagtgctgggattacagttgtgagccaccacacccagcctgtttttttgctttttatataggtaatagagctgttagcattttgcaagaccattggtgataatatggatcatgttacctaatgtcctataatagtcagtaataatgggcacttgttataaaccaggctgtgttttaggtaggagctgggaatacagcattcgataaaacaatgcttttgcacttgtggaatttgcattttggtaagtatattacataataattagatagggacagaaaaagcatggtaaggtaaataaaagtactagtgttatgtggagaggtgatagtattttatttatttatttatttgagcatcttgtcccaggctggagtgcagtggcgtgatcacagctcactgcagcctcgaactccttggctcaagcagccctcccaccttaacttcccaagtagctgggactacaggtgaatgccacacagccagcaatttttttttttttaatagagatgggaatctccctgtgttgccgaggctggtcttgaactcctggcctcaagagatcctcccaccttggtgaaactctgtctctactaaaaatacaaaaaaattagctggtcgtggtggcacatgcttgtaatcccagctactcaggaggctgagacatgagaattgcctgaaccggggaggcagaggttgcagtgagctgagatcatgccagtgcactacagcctgggtaacagagccagatcctgtctcaaaaacaaaacaaaacactggatgagattaccttggaaattaatggagatggagaagaggtctgaagccttgaggtttccaaactttagatactggggagatgagaaaaggcagcaaaggagactgagtgggagaggccagaggttggaagagagcaacagagaggccccacatgagatttaaataaggagctgcatgctaatttgtttttttcaggagtaagaaacaaattatgtctgtacacaaatgtctatactgtagtttctttctcagtaaataaaatgtttgtgtcctcaagtatttttctgtttttgctttaagtgacaaattctatttaataccattctgcatcttagtccttgtagcatttatgcctctattccaagtttaggtggtagtgttgcttctcttttaaactttatttaaatactccttttgtagtattttggatgagagaggatcaaatacataatttatctcactcttctgtcactttccactccaggttcacaggtggctgttggtctttagtaagggtgctgtcttccctgtctgatccttagcaaaagtaggaaggtaggtcttgttcatttctgtaccactgtggcagactcctgatactgagttgaaattcatgagtgtttatgggataaattaatgtacaaaagaaatgaatctttccctttttcctgcagtaatgataacattggctcagtggtttacagcttagaagtacactgacactcattatcttatttagatgtaatccaatttgttacagtttgccagctactgctcttttccctttctcaggcacattgaaatttactttccctttgggggctctgctagtttattcctagcagatctgatctggcagtgtgtttgtaaaaggatgctgaactgtgtcttgaggaagctcagaatgaaatctgaatttcagaaagattcctgagataatttttctctgtctcttctcttttattcttgttttaataaattttagttttatgaggattgttttggttttaaaaaactttaaatcattttttaaaactattttttacaacaattttagggttacagaaaaattgcatagtacagagagttcctgtataccttgcacccagtctccccttttagtatggtatatttgctataatgcaaatctttttttttttttttttttttttttgagatggagccttgctcttgtcgcccaggctggacagtgttggccaggctggtctcgaactcctgacctcaagtgatccgcctgcctcagcctcccaaagtgctgggattacaggtgtgagccactgtgcctggccatgcaaatcattttttgagataagtggggcatataaaaatataaacaaaatgaagttgctttatctctacaagcctcagtttccttatctgcaagatgaggggggtggactaaatttctaaatagctttaaaattttttaattatctgctaaagtaaaataattatataattgtaatataattttctttatttgcttaagtattactaataccaccttgccaaatcatgtttgcaagttactgacagccatatcctaaaagaaaacttaatgagaattcatggaactatgtgtggcaggactgcttattagagatattaggttgaatgatgtgaaattgccatttttgtagataaaaagtaatgagtgaggctgggcttggtggctcacacctataatgccattgctttgggaggcttggaccagggggtggctgtctgaaaccaggagttcgagacaagcttaggcaacatggcaaaaccttgtctctaccaaagaaaaaaaaaaaaagcctcggtggcacacatcttcagctcctctgaagggtgaggctggaggatcccttcagcccaggaatttgaggctgcggtgagctatgattgcaccactgtactccagcctgggtgacagagctagatcctttctctaaaaataataataataataggataatattagcaatttcatatggttcaacctaatgttttgggatagggattcaacaaagtgtgagggggcctttgagacctcataaactcccactgcatgcaaaagcccggctcagccctcaccatactaggagagaaaaggctcctcagttcccttggagtaacttggatctacattattgtaggtagagttgttggcagaaatcctgggataagagaatagtttcctggaagatctgtgcctccaaccagcagagagggattgagcttcattgaactcaacagagccaacatttcatagcaccatggtgagttggtcacacagccttggcaaaaaggctgaaaaggagggtgtaatagtatggggaaaggttgtattcccctggttcgtaggctaggaagaggcctggagtactggtgccaccaaacctttattggtgccattctattctccctactttatgcactttccttactgcctagtacaggctctgcaaactcaagtatcttcggttgttcaggaggtaatgtaaattagtaagccgagttttcctctttaatgctactataacagaaacaatagcacagttgcaatgataaatgacaactgaaatatgctatcattgtgagggagagaatcggtgtgtgcataggggaggccatgatgaactggagagcacatgccctgtctaaagggggcaggcactatacaactgtgcagagcacacgccctgtctaaaggagacaggcgctgttcaactgcacggagcgcgtgccctgtctaaacgggcaggcactattcaactgtgcagctggttgttgccttattgaaatatgggtcaagcatcactgggtattctgattttccaaaggagccagaaatatggattttatgtacattctcccaatgataaatgttggcacctaatttgaattcttaaaaactattatgtgggccacacaatggctgaaaagagctagcagggcactgatttgtcatctctggcttatggcttagctctgccaggagtgaggctcacatgcatttcttcactggacattgttgacaagttacaattaaaatgaattagacagctcctgcctttgaggtactcatggattagcagagaaaatagacaagtaatgatgataagatgtagagtagacatcagaacatatgtattctctctgtgtatatagctataaaagtgactaactcttcctgggttcatctgggaggacatgataggacgtggcatttgagccaggatgtgggaaatcaatagtttggtgcattaaagggatttggggcccttgaaatttctactgtatgtgcaaatgttaggtttgcattcgctgtatataccattttgttgataggtagttgaaaatacggatattccttagccctgctggtgagagtcttagggttaataaaatgagagaactcttcctctggcccaggttatgggataattgtgtgttttagaggcctaagtaactcagaggtcatgataccctcatttctggatgagggaagtagcacatctgaggtcacagagcccattggaggcagagcttggactaacacccagaactctttaccaccatgccttcccctgtcctgggtatctctgatgaaggtcaccgttaggctggccgcctctgcctgtggtggcccattgccctgttttggcccagctcctggtgggtgagggggtttggccatcctgctgccactggttccttctctcttttggatcctttgcctgaaatgcctgctaccccttttctttgtcagatagactacttgtgttcaaatctctctcaaccatatgccagctgtgtggcctggcacaagttttttaacctttctaagccccagtttcctcatctatatataaagagttataatagtacgtttggtgaagtgtaatgagaaggcattggaaggtttcaagatttttgtaaaaacaaaatgacgtaatgcatgtaaagcacttaaagcaacagccctccagaagcactcagcaagtgttaacaatgatgatgatgattcacacagttcacaggctcccaggctgggttaagttctcttcctttgttttctcatattatcttattatttcacatgctacattgtatgtattgtaatagtttgtgtctatttcccctgctagactaagaacaccttcagcgattcattcaacaaatgtttctgaaccactgtgccaggaactaaggatgcagtgataaaccaggagctcttggtttagtgcagagttccaaaagtcatgccaggagacactagtcctgtgagcttgtctcatggtcagttaaatttggggaatgatgctcatcatagcgcccttcagagatgagggtcccttttagtattttaaaggttctgaggagtcttgtgtgtagtaaaagaacagtcctttccatttgactatgtgctttggtccccagttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgcagctggtactggaagagcaggtgctggcactacagcagcagatggcagagaatcaggcagcctcctggcggaagctgaagaactcccaggaggcccagcagagacaagcaacccttgtgaggaagctgcaggccaaggtgaggcagctgcccttttggggaggggaaagagaacaacccccagagctaggtgctgaggtgagataagggttgcaggaggcagagtcttgtggtgggagtggcctacatctagcatggtgagataagacccagaccttctagctttcatgtacagcttctcttttgatgctcacaactgctccatgaggtacgtattatatccttttaatttaattttatttttgagatagggttttgctctgttgcccaggctagagtgcagtggtatgatcacagatcgctgcagcctcaacctcctgggctcaggcagtcctcctgcctcagcctctggagtatctgggaccacaggtgtacaccaccacttttggctaatatatctctttaaagatgaaattcacaagggttaagttaattatccaggtttcttcagctagtctagagccaaagcccatgatcttgcctctgtgatataaaaggcatatagaaagtatttatttatttatttatatatttttgagacagagtctcgctcatatagaaagtattatttaaatgcccaaataaggccaggcacggtggcccatgcctgtaatcccagaattttgggaggccgaggcaggtgtatcacctgaggtcaggagtttgagaccagcctggccaacatggcaaaaccctgtctctactaaaaatacaaaaattagctgagtgtggtggcgcatgcctgtaatcccagctactcgggaggctgagttagaagaatcacttcaatctgggaagcggaggttgcagtgagccaagattgtgccactgcactccagcctgggacacagagcgagactccatctcaaaaaagaaaaaaatgcccaaatagaaactataagatgttatggccttaccttactgtcaccacccatttcccctgttcatagcaagtttgcctaagatcctcaggggcctttgctttgggctgtttgtgccagctgtgttcattgcccagggcctgttctttttgctgcaggtgctgcagtaccgaagctggtgccaagagctggagaagcggctagaagccactggagtgagtgaggctgagctctctgcaccccctgggtcctcagtgaatatacttgttaggtttcatttgttgactgagggaggttggagtgtacaagtgaggtgtttggtggaaggctctctttctcagcctctgagaggtttatcacactgatatcttcattggacctagctggcctgtcagattccaacccttggttttcaaaggacgaaatgtaaattagattggaaggagtgtgggattagcaggaagaagtgcatgtttcctccagcaggtgtcagtgtttcttttagaaagatgcaggcctttgcgagcctacagcatgtctgcagcaaagggatgtctgtgctattagaactggctttgaaaaacccatttatttgcctttgttccagctgcctctcagtacctcctcacattttcctcagaaaagttctctcagaggaaggaaagaaccaaaacttattgagcaccctcaatgcagtccaggcagcatgaggcactgtcatatacagatggtcctccccaacttaggatggttgcaagttttcaactttatgatgatgtgaaagctatatgcattcagtatgttccttgggttatgatggggttacagctggataaacccattgtttggggttgttttgcttgcttgtttggttggtttttgtttgtttggttggttggttgttttgagacagggtcctacttactctgtcgcccaggctggagtggactggtgcagtcatgagtcactgcagcctcagcctcctgggcttaagcgatcatcccacctcagcctcccaaaaagtagctggggctacagatacatgcctcaacatctggctaattttctttattttctgtagacacagggtctctctatgttgcccaggctggtctcaaattcttagactcaagcaatcctcccactgctgggattacaagtgtgagccactgcatctggcccgaactcactgttaagttgaaaatatcataagttgaaaatgtcagccaggcgcagtggctcatgcctgtaatcccagcactttgggaggtcatggtgggtgggtcacaaggtcaggggttcaagaccaacctggccagcatggtgaaaccccatctctactaaaaatacaaaaaattagccaggcatgatggtgcgtgcctgtaatcccagctactcgggaggctgaggcaggagaatcacttgaacccaggacgcagaggttgcagtgagccgagatcatgccactgcactccagcctgggcaacagaactagactgtctcaaaaagaaaagaaaaaaagaaaacgtcgtaagttgaaaacacacctttaacttatgttcaacttatgatggatttatgggatgaaattccagcataagtcaaggagcatctataattgtgtctcttaacctgcacagcaactttctgaagggaacgatataccgctttcattttgtagctggagacactgtagctccaagaagttaagtgacttcacaggctgggtgtggtggctcatgcctgtaaccccagcactttgggaggctgaggtgggtggatcacttgaggccaggaattcaagaacagcctggccaacatggcgaaaccccatctctactaaaactacaaaaattatccaggtgtggtggcaggtgcctataatcccaactacttgggaggctaaggcaggagaatcacttgaacctgggaggcggtggttgcagtgagctgagattgtgccattgcactccagcctgggcgacagagcgagactctgtctccaaaaaaaaaaaaaaaaaaaatgaaagaagttaagtcacttcccaaggtcaaaccgttagtgtagtggaagttaaggccattagtgaaagatacatcacttcttaagttgaagattctatttactactgaaggccgtctttcaggagaggtcatcagtttacttttggagtgagggatgcagtgattgagaatagaagcatattgctaacaaaggggagaaagaataaaaagaaagtggactgccatggaagggagccttagggaactggtctgagtgatgttctctttggaggtaagtaaggcttgtctctgtctggcgcagggaccaatcccccagaggtgggaaaatgtggaggagccaaacctggatgagctgctggtccgattggaggaggagcaacagaggtgatggaccccaaactttctgacctgggtgattggccagttggtggagaaggctgatgggaaacttctgccctgagggctaatgtggacttcagccatagccctctaattcctgcaatggaaaatttcagtggttgccatcttactcccaggaggtccaagggttggactagacctttattttgcacccacttttacccctccccagtgcaggtgtgagagtctagcagaggtgaacacccagcttcgactgcacatggaaaaagctgacgtggtgaataaagcccttagggaagatgtggaaaaactgacagtggactggagccgggcccgggatgagctaatgaggaaggagagccagtggcagatggagcaggaggtaggaagaacggggactggaactgtgagaggaagcctgtgtattctggatgctgccctggtcagtactggaaggagttaacttcaggacttggatgaaaactgagctgttgctgttaaagtccctgaccatccttacctgcgcatgctggcagcctcagccttcttgggccttcagcttagacctgccactacccgcctagtctaggttctgctgggaggtagcatgacactcagagcaactctgttcctgcagcagtgacgagcttaggtttttgatggatctgaaagcttactgattcctggtctggaggtcttgcatatctagatgctaaggaggtagatatgaaactgaatgggaaagaaagagctgttatgggccctggggaattttcaggtcccagctgaaggaaacaaatgtttcctgcatttttgctttgtgctcagtggtttatgtatatcattgactcctccttagaaaagtctgtggtaatagatcccatttgttaagcagctaccgtgtatccttttctaatctggcccagaggaaggcgatataccatcctaggccctctgacctgtcgaatcccactgccaactttattaagcccttcaccataacctggatagatacccattcataaactatctcctgtaagtccctccttccttccctcagtagtcaggaggaatccaagactcttgtgttggcaaaagatagccctctgcctttgggtatgacctgggtttctgaacacacagttcttcaagggctacctgaaaggggagcacggtcgccttctcagtctatggcgggaggttgtgacattccgacgccacttcctggaaatgaagtcagctactgacaggtcagtgtggggagaagaagggaggaggtttgcccctaccaattctggactaataacagtgggctgctatagaagcgggatcagctgtgggggtggggtgggtgggggagttggtagtattggaagcagatgatttttcccagccctgctcctcaggcttcactgggcctgatcaccacactccttccctggttcctagtggagtctgctgttttccttgcttgtactcagagatctgatggagctaaaagctgagcatgtgaggctttcagggtctctgttgacctgttgtctgcgcttgactgtgggagcacagtctcgggaacccaacggatctggaagaatggatgggcgggagccggcccagctgctgctgctactagccaagacccaggagctggagaaggaagcccatgaaaggagccaggagttaatacagctgaagagtcaaggggatctggagaaggctgaacttcaggaccggtgagatggcctggggtcccaggaagggttcgctgagagagagctgactcctttagagggttagggacaggcagggggaggtgccaggaacattcctaccatggagggggagaagatgtgcccaaggaaatctactttgaaacctgatgccacagttggggcttgtactgacctctgccctcagcctgtcttttagcccagtttctttcctgttgatttatggagctagctatgactccatcctccatcaacaccaaagtgcttgccattcccagaacagccaagctcttccccctccctgtctttgtacctgctgaatttagtctggaatgcctccctcccttctctctctgccttatcctctaagacatagttcaaatattacctcttttttttttttttttttttgagacggagtctcattctatcgcccaggctggagagcagtggcatgatcttgcctactgcaacctctgcctcctgggttcaagtgactcccctgcctcagcctcccaagtacctgggactgtttacaggcacatgccaccatacccagctaatgtttgtatttttagtagagacagggtttcaccatgttggtcaggctggtctcaaactcctgacctcaagtgatccacctgcctcagcctcccaaagtgttgggattacaagcgtgagccactgcaactcgccgaaatgtcacctcttctatgaagccttctctgacctcagtagcctgctaagttactgtgcccttgtagtcttttgacctcttattacagcattgatctcactgatgatttagtttcccctaccttctttttttggtgaggctgttttactttttggattataatgaagtaggtttttaaaaaataatgacatagaagggcagggaaatgagcagagagccccattgaatctcaggacaaagttcatatatgcccatgacgagggttgtatcttcacctgttggaggtacatacataaaatgcagggctattttgttttgtttttgcttttggaggcactgagaagtacaaaagcaggccatgtcttcgtaagtttttatttctagtactttgtacttcacctgccgtatactagacactcaatacattttgtttctttgttttttgagacagagtctagctctgttgcccaggctggagtgcagtagtgtaaacacagctcaccgcagccttaacctcctgggctgaagcaattctcttgcctcagcctccaaagtagctgggattacaggcacgcaccactatgcctggctaactttttaatttttttgtagagacggggtctcactatgtttcccaggccggtctggaactcctgagctcaagcagtctttccaccttggcctcccaaagttctaggattacaggttgagccaccgtggctggccagtgaatgtttgttgagtgatgcaatacttaaacaaatgaccatacagtgtgttaaggttcttagagatggtatagaataaaattattaagacttttgctgagtgaggaggatcacttgagcccaggagtttgagaccagcctggacaacatagtgagaccttgtctctactaaaagtaaaaataaaaaaagaatagccatgtggtggcatgcacctataattctagctacttgggaagctgaggcaggaggattgcttgagagtgagctatgattgcaccactgtattccagcctgggcaacagagcaagaccctgtctcaaaaaaaaaattggaaaaaaatttaaacttttagatagcattcattcaagaaatatttatttagccactcacataatagcaagcagtaagctctaagatatagtgttaagtgtttggtgattttgctggactttgagattaatatcaagaaggttgaacataatcttccccaaattgcccttcctttttccctatcagagtcagaacctcgggctggagggaccttgggactatcccaagtgcaattctgatgttcttattggcttcagggtgcttgacttcaagatcaagcgaggcctggaagggcctgggccagggctttccttcagctcttgggcccccaaacacgtgttccagccttgagatgtggtaaatccctgcatgtgtctgagtggttttttgcttccccacttcaaggctatagcatcatgtggtattcagggagtgcagacgggctgggggtgcctaagggatttgggggaggctgcagttgggagtggttggggttggggctggggctggggtgtgctgcatcgtagctctgtccacatccatgggctgttctggtgacagtgctatgctcttctctttagggtgaccgagctctctgctctgttgacccagtctcagaagcaaaatgaagattatgaaaagatgataaaggctctgagagagacagtggagatcctggtacatgatcctttgctctggaaaggagttgggcgtgggcttgtaggttccttgtgctttatggacagatagtgcaggataccagttacatattccatgatgaaatcctctaaagctaaaaaataaattttggctgaatctgaaaattaattaactcattcatttattcattgaataaatactattgactgtctactatccctactgtattcctggggaaattgcaatggcatatgtatgcagtgtgtccttaccagagaattggcacatacattcagagacacattggcaaattagtgagttaccaggaagcggatatgtggagagatttaaaatctagtcacatgggaaacaactgaggagtatggcaatgtttagccgggagaagaaagagcttgaggccctgtgaaggcccttgaagacatgatagctgccttcacatatctgaaggactgacgctgggaaaagagagtttatgaagggccgggcgcggtggctcacgcctgtaatcccagcactatgggaagctgaggcaggcagatcacctgaggtcgggagtttgagaccggcctgaccaacatgcagaaaccccgtctctactaaaaaaataaaaaaaattagccggtcgtggtggcacatgcctataaacccagctgctcgggaggctgaggcaggagaatcacttgaacctgggaggtggaggttgtggtgagccgaggttatgccattgcactacagcctgggcaacaagagtgaaactccgtctcaaaaaagagaaaagagagtttacatatttaatgttttccagggcaaaaccaatgtcaatagctagaagttaataggggaatagattctggctcacagctagagctgttcagtagttgaacagcctgtcttgtgaaggagtaaggttttggtcattggcttaacatctgccagggatgttatcagagggcttctctaaggttggatgttagaaccctctggcttaataccatgtttcatctctataagttttcagatctctgattttaggtagctcctgaacccctattcatatgcacacccctagtcttctcatccaagctgagatcaacaggaattgtagctttctgattccctctttttttttcaggaacttgccaattcagaatatccatggggctcagataatgtaaataaatgaaatgggttcagttgtaagaattctggttttccagtgctgtttgttgtatttagttttcagtactgcaggggacacttgagctcagtattaaggaagccatgaggagcaatagggattgtgggaccctcaataataaatgtctcatctagatgaggcatctaccattcaacttcagtaaatcgtttccatgtaggaatgggggctgggtgtggcccatttgttaactttttgggagaagccagaaatttatatttttatgtaaaatctttccatttataaatgttgattcaaattttgtataagccaaataaaacatagttgcaagtctgtgtctttaggtcttcactaacacaaataggaaggaagagaggaactcttgagtcttcaagattatgtctagctttggggctagaggattctctggtttagtattaggtctcaagcatccatttactgttcagagacagcacccatcccctatctaataatagtttacatttattgaacatttgctttgttccagacactatattgaataatttacatgcatttttcatttaagcctcaaaacaactagttgctgtaattatttctattttaaagaaaaagaagtaagtgatagaagctagtaagtgatagagcaggaattctaatctgtgaagtccaatttggaactcataatcacttaatctaaacttgtaatcaccacatcacattgtcttcagactcttcagacaacattagcattgacatatggtcagggaaaaagtggggctgatagaatagacagaatgagactttggttgtttggggtcctggaataataaattcacttttgagagtttggctctgaggctctgttctattccctgttcaggagacaaatcacacagaattaatggaacatgaagcatctcttagtaggaatgcgcaagaggagaagttgtctttacagcaggtgatcaaggatataacccaggtactgggaagcctcctgttcatggtaaccaggttatgcctccactccccaggtctccatgtcctttcagtcctgcctagatttccagtctctgaggttcgggtgcttaaagtcttgtggggatgagttttgtgtgtttgaagaccagaaccctaagagatagctaagcattcacgtttagcactacctgatgggacaggccctctttcctgtttctagctgcagttctcaggctggaggctagattctggtattcaatatctcaatcgtttcttctttcatttcctcatttattgttacctcagacagtgttctagccttgttgttagtcctagacttgggtgaccaaaggtggagagttgaaggaaccagacttttatgctcagatactcccctccttcccccaggggagaggacctgagaaggaaaacatcaggtttgtccaggctatagggttaagtccctctatagactctaggctttggtcagtagggtggtgaccttgctgtattgggtttcaggtcatggtggaagaaggggacaatatagcccaaggctctggtcatgagaactctttggaattggactctagtatcttctcccagtttgattaccaggatgcagacaaggctcttactctggtgcgttcagtgctgactcggagacgccaggctgtgcaggtaggaaccctcagcattccacctcagtcacaggggtttgtgtctaaactggtttgtgcctcaggtacctccctagcctggactatccctttcacttttttgaccagtcatgaggtgttctgtcaatatcccagagtaaatctgcctatgtctgctgaattgtgcttgtgagtagcaggcacatcctccacgccaatggcatgcttcactttgtgtacaatctttgcataacagtatgcaaagattgggaaccagagccctgggagattattgggtcaacgttctccaactctgagagtcttaggcacacttaccactcccccatgccactgtacatttggagatgacgaactctaagaatctagagccacagaagcccaatgacctctgatggcctgtcttcttgaatagttgcatctcccttctcagctttcttttgttgcaccagcccccgacccccttctccagccccactttcggggttctgacatccctcctttgcccttgttcatcatctggtttctcttgctctctctccacaggacctaaggcagcagcttgcaggctgtcaagaggctgtgaacttgttgcaacagcagcatgatcagtgggaggaagagggcaaagccttgagacagcggctgcagaagctcactggggagcgggacactctggcagggcagactgtggacctccagggagaggtggactctctcagcaagtgagcagacgggctgttcatcccaccctcccagcctggtctcagtctcagtcaccatccagccatttacccactcccatcaggtttttggggtgctgatcctgttctccttgagactcagggctgttttgcccagtgtttcacttgtttctccagaacaagcttttggggttggagtctttgtgatgataaaaaagttttgcactagaaacagaagatgggatgttgaaacagggtctcttggccctgtgatgcctgcttccagaaagaattttaggtcctatggtctctgctcatctctgattcccttcttccagggagcgagagctgctgcagaaggccagggaagagctgcggcagcagctggaggtgctagagcaggaggcatggcgcctgcgaagggtaaatgtggagcttcagctgcagggggactctgcccagggccagaaggaggaacagcaggaggagctgcacctggctgtccgggagagggagcgtctgtaagtgagactagtctcctcctcgctgggccctggtctttcttcaattctacaccctccccgtctactcccctctgttacaaagtagagtatgtagaagtctggcatgcagtgggttcagattagcttgctgcttcttcctttgcagaaagatgaatatggaaagttcgtggttggttaagtcttagttgagcacccatatgggatgagacactgagggggatacagaaatgaataagacaaaagccctgatttcagggaacttgccagaagacagacaactcactgtgacatgaggctggatgaagtatgagttaaatagagtttcagaccaagtcctttgggagcacaggagtgacagctaattattgaagactaggaaatgctttatggaggagagagtagactttgagctgggcctttacctatttggttagcagagagtgggagaagagctcaaggaacagattagcaaagaaaaggcggcaggaaggttcatggcatgttcagagtaggctgggctggctaaagggtaagacttatacagggaagtagtgggaaatgtgctagctggtcaagaaagggaaatccagaatcaatggccccagctaatctgtaaattcccctatatgatgtcacagaaaaagcaaggactttgagctaggcagaagcttagtttaaattatggctctgtcacatggacagattatttgtagaatgatgataatatttaccttgaagggttgctgggaagatgagagcaacgttttggaaaacgccagcatagaacctggcatatggtaggtctttaataactgggagcagggatataccttcatctttgctgtatttccctcctctcctgtgccccagttccttgtacctggtaggcatgaatagtggaagcttgaagggctgccataagggtcatgacttgtgctaagaatgatctccctgtaccaaggagaagggcagacaacccctaacaacaaaaaattagctgtagctgaatgtggtggcatgtgcctgtagccatggcaaggtgagatgggaggatcacatgagcccccaggagtttgaggcttcagtgagctaagaagatacacagagaagtctcactctcatttgtgctttctccatcccatttcccttccccctttaggcaaccattttagctgacttcttgtttatcttgccagtgctccttcatgcaaatacgggcatatattctttcttcccccactttcttgcataaaaggtagtgtatcatgtatatactgttctgcaccttgatttttttcacttgacatgtcttagaaatctttccttatcagtgtttatagaccatcctcattctgttgcatagcaaaggtgattatattcctgttacctttggggttatggcccatccctaagagttcctctagacccctctctttcccatcttagtcaggagatgctgatgggcctggaagccaaacagtcagaatcactcagtgaactgatcactcttcgggaagccctggagtcaagtcacctggaaggggagttactgaggcaagagcaaacggaagtgaccgcagcgctggctagggtgcgtggcctcctctcctcacttgctgggtgggcggcttcgaaagtgtgttcccatgcagcctgcctcattcttcaccttcaagccaggatccctcatctttcctcaatcattagtctgcttctgggttctctattccaacataccctctatattggaattagaatgggctttctaaagtatatacctggttatgtcagtctcttaaaaccattcaacggctttctagctctgtggtgccacattcaaagctttttgtcatgtgcctcaaagtgtgttttagcctccccttctactgcaaaacccatcctaacacctcatatcctttgctcctgccacagcagtaattgccttctcagttattccatgttcttcatgactctaatactctgcatgtacttttccctttctctgcactacttctttcctcttcctttatgtgcaaactgttcctcatctctcagtacacaacttaatcgtcaactcctctaccaagcatatttgactcttccaaactatattaatattttttttagttcccagagcactttgtgcttacattttctgtggcatcattacaatcatagtcatttctctatcctaactttggtatctctatactgtgaggtcctgtctcactccttaatgaatgaatgaagggaaaacttgtttagaatgcaggagagggaatggagtattaactgatctctgtaccaaaaagcagcagtgttgggaatgtgaactgtttactgttccaggaaaattggaaatatgaaactctttaatcctttttgttttttaggcagagcagtcaattgcagagctgtcgagttctgaaaacaccctgaagacagaagtagctgatcttcgggctgcagctgtcaagctcagtgccttaaatgaggctttggcgttagataaagttgggctgaaccagcagcttctccaggtgagcaaagattttcctggtccccacagaagggctgggccctaactgagagcaagacggatcagctcccaaatgtaggtctgaaatgagcaaaaggaacatttacaatgcagaggagagcaaagactgtaaggattgggcttagccattataaatattcccctcccacacctccagcagaaccacctctggacttcagggtaagacaccaaggttgggaaggggcccatgtcctctggaaggaagactaggttttttgctggggttttcttgagatggatctccctctgtcacctaggctggagtgcagtggtgcgatcttagctaactgcagttttcatctcctgggttcaagcaattctcctgcctcagcctcctgagtagctgggattacaggcatgtgtcaccacacctggctaattttttttttttgagatggagttttgctcttgttgcccaggctggagtacagtggcacgatcttggctcgctgcaacctctgcatcccgggttcaagcaattctcttgcctcagcctcctgaatatctgggattacaggcatgcaccaccatgcctggctaattttgtatttttaatagagacagggttttacgatgttggtcaggctgttctcaaactcctgacctcaggtgatccacctgcctcagcctcccaaagtgctaggattacaggcgtgagccaccacacttggctgccctgggctagtttttgtatttttagtagagatggggtttcaccatgttggccaggctgatcttgaactcctggcctcaggtgatccatccacctcagcctcctgaagtcctgggattacaggcatgagccaccatacccggcctaagtctaggttgttaatcctgttgggtgagataatagcaatcaccagaaaagaatctgctgaagagcctaagtcccaaagaatcttttctataggttataaatttaacctataattatagcgagggaacctccttgcaatctctgtttccttgagtgttctctattccattattctgaattatttgagagcaggactttgccttgcatatctccgtccccagcatccagcccatctagtacctggaatataggcactagatcaaatgaatggattttcccccatcttataaacactcctttgttcatctttggagaatagattcatatctcacttggatttcagtcttagcatttgattcctaaactaaccatttgtctttgatgcttgtactcccttccctttttggccagtagttagaggaggagaaccagtctgtgtgcagcagaatggaggccgcagagcaggcgagaaatgctttgcaggtcgacctggcggaggcagagaagaggagggaagccctgtgggaaaagaacactcacctggaggctcagctgcagaaagctgaggaggctggggctgagctgcaggcagatctcagggacatccaagaagagaaggaagaaattcaaaagaaactaagtgaggtgagaagccaaaatggacaccatcatgtctaggtgtaatatatgctcattataaaaaattaaaacactacagaaattatctggaaagtgaaaaagtcttacttcctagaaatgaccagtgttactagtttgcagtatatcttccaattttaaaaaagaatgcctataacaattcttcactgaggctgggcgcagtggctcatgcctgtaatcccagcactttaggaggccgaggcgggcggatcacgaggtcagaggttcgagaccagcctgaccaacatagtgaaaccctgtctctactaaaaatacaaaaattagcccggcatggtggcacatgcctgtaatcccaactactcgggaggctgaggcaggagaatctcttgaatctgggaggcggaggttgcagtgagccgagattgtgccactgcactccaacctggatgacagagcgacactgctcaaaaaaacaaaaagaattcttcactgattctccactacttcattcacaccacccagtttgaattagaagcttctccttatactctgatagcacctcatgcttattttaactaccacattcctcatgctataattatctgtttatatgtctctaccattagaccaaaagctccttgaaggcaaagctatatcttatttgtttttatttctccagcttttagcatagtgcctaccacataacaggggccaagtaaatttttttcctgagccaatgaatgacctggctcaaaggtcatctttctcctctacaaaacctctcattgtcctaataattgtacggactctcccttcacagagtccctttctcgggacattgatgactttcttcccagtattatgtgtgcatcttctcaaggccaaaacctccttaggggcaggtcttctgctgtccctagcacagggtcttgctcacaggggagcattcttcctgggctgggggctctgtgggcggatcagggaaatagataaatgccacgtgctattgggtaagcaatccgggctcacagagctgggtccagaatctctgaagaggcaatgaccctaacctggtggtagcggccccaggggaatccagcctctgctccatctctcaccacattcttcccctcagtcacgtcaccagcaggaggcagccacgactcagctggagcagctacatcaggaggcaaagcgacaggaagaagtgcttgccagggcagtccaggagaaggaggccctagtacgagagaaagcggctctagaggtgcggctgcaggccgtggagcgtgaccggcaggacctcgctgaacaactacaggggctcaggtagggcccagactcagttcagccaagcacagagagagctttgcaaggcaaaggcgtgaagctaagctccctgccataagtatgcaggtcctaaattgattatgaatttataattgcccccctaacttctccaggtagccaatacttagaacccagctcctcttgaggaagggtaaggggcttgatgggtaagaaactcttctgattcctgaacctcacagctcagccaaggagctactggagagcagtctgtttgaagcccaacaacaaaattctgtgatagaggtcaccaaggggcagctggaggtccagattcaaactgtcactcaagccaaggaagtaatccaaggtgagaacccaactgggatgggatgcactccattccatggagatgttgaaaggcaggaagatggtgggagactattagaggtccttctccagcagggtgcagggcctctgagatgggagttgctcatgaggtcaggggagagggagaattttattaggtaaaaggagggggcggaggcctgatcctgtccctggcatgttaggggaagtgaggtgcctgaagctggaactggacactgaacggagtcaggcagagcaggagcgggatgctgcagccagacagctggcccaggctgagcaagaagggaagactgccttggagcagcagaaggcagcccatgagaaagaggtgaaccagctccgggagaaatgggtaagtggtcaatgtggccgggtatggcctcccttccatgagtgctctacctgctgcctcttggtccagttattgctgctcgtatgagtgaaattttgtaaccaagctgtaaaatccaacttcctgctattaaatgagttaatatatgaaaagcactaagagtagttcctagcatgtggtgggctccctatatgtgttagccattattattgttgttgtgttggtgtgtacagagaattgagagtggaccctgggatttaggattattaaactggcctcaggatgaaaacgggggagaggaatatcttggatgcattcttgtgcagttcagaactgtgttttgtcttttaataatgtaatttagtccatttggttttattgtggttttaggtgtatttggatttatttgtgccatcttatgttatttgtcttgcttttttatatcttttttttttttttttttccttgagacagtctcactctgtccctcaggctggagtacagtggtgcattcttggctcactgcaacctccgcctcctgggttcaagcgattctcctgcctcagtctcctaagtagctgggattacaggtgtgtgccaccacatctggctaatttttgtatttttagtagagatggggtttcaccatgttggccaggctggtctcaaactgacctcgtgatccacctgcctcagcctcctaaagtgcagggtacagctgtgagccactgtgcctggccatttttatatcttttagggaggggaaatctcctttcttaacttcttttagaggattaagttgggtgattaagttgtattcttttctcacctcttttttctctctgcaactgtggatgatatatactttattttaaaaatcctgttagtggttacctttaatatttttaaacatatacttaataaaatctcaaggttcagtagttttacccttttcctgaacgatacaagggtcttagaacattttacctgggccagggacagtggctcatgcctgtcatctcagcactttgggaggctgaggtgggcagattgcttgagcccaggagtttgagaccagcctggacaacacggcgaaaccccattccctacaaaaaaaaatacaaaaattagccaggcatggtggtacacactgtagtcccagctacttgggaggctgaggtgggaggatcacttgagcctaggaggttgaggctgtggtgagctgagcaccactgcactccagcctgagtgacagagtgagaccctgtctcaaaagcaaaaaagaacattttacttgtttcactgctccctaatttataggctattttgttcagtgtgttcagttctaactagtttaacaccacaaattatgatttttttattgttttatacagtcaatatttgttcagatacaacgaattgataccttttctgttcaccataccttcttgcatgtcagactttctattcagattttttttttttttttttgcctgaagtaggattttctttggtaagggtctgttggtagttaattgtctgaagatgtttctattttatttttattcttttattgaggcagggtctcactctgtcgcctagactggagtgcagtcatgtgatcatggcctactgcagccttggcctcctgggctcaggtgatcctcccacctcagcctcccaagtagctgggattataggcatatgccatcacacccagctaattttatttttggtagagacggggtttcaccatgttgcccaggctggtctcaaactcctgggctcaagcgatccacccgcccttggcctcccaaagtgttgggattacagaggtgagccaccatgtccagcctacttttattcttgaaagatagtttctggctttgttcaggcttaaaaaatagatagatagatagatagatagatagatagatagatagatagatagatagatagattcactaagtaaaacattcagatataagtttctaggatgacaattattttctctcaacattgttggtattgagaagttagctttcattttaatcattccacagtttcttgtgtttattattatttttttgtttgtttgttttttgagacggagtctcgctctgttgcccaggctggagtgcagtggcgcaatcttggctcactgcaaggtccgcctctgggttcacgccattctcctgcctcagcctcccaagtagctgagaccacaggcgctcaccaccatgcccggctaattttttgtatttttagtaaatacaaaaattttttgtattcaccgtgttagccaggatggtctcgatctcctgacctcatgatccacccgcctcggcctcccaaagtgctgggattacaggcgtgagccaccgtgcccggctatttatttttttatatatttttttattttttatttttttgagacagagtcttgctctgtcacccaggcttgagtgcagtggtgcaatctcggctcactgtaacttccacctcttgagttcatgcagttcttctgcctcagcctctagagtagctgggattacaggcacgtaccaccatgcccagctaatttttttgtatttttagtagagatggggtttcaccatgttgcccaggctggtctcaaactcctgggctcaagtgatccacccacctcggcctcccaaagggctgggattaaaggcgtgagaccacgcctggcaatttcttgtgtttagatgtgtatttcttttatttggttggaatttcttagacatcctgaatttaagatttcatgttgaaatatcaattctggaaaattcttatatattatctcttcaatattacctctttcctactgtcctgcttttatttatttactctttaaaataaatttttttttggccaattgcagtggctcatgcctgtaatctcagtaatttgggaggctgaggtgggcggatcacctgaggtcaggagttcgagaccagcctgaccaacatggagaaaccccgtctctactaaatatacaaaattagccgagtgtggtagcacatgtctgtaatcctagctattagggaggctgaggcaggagaatcgcttgaacctgggaggtggaggttgcgatgagctgagatcgcgccattacactccagcctgggcaacaagaacgaaactccgtctcaaaaaaaaaaaaaattttttttttttaaatttattttattttattttttagagacagggtcttgctctgttacccaggctggagtataatgatacaatcatagctcactgcagcctcaaactcctgagctcaagtgagtcctcctgccgcagcctccgacgaactgcaactacaggcacatgccaccatgcccagctaattttttaattttaattttaattttttttttttttagagatgggtcttgctatgttatccaggctggtctcgaactcctgggctcaagctgtcctcttgcctcagcctcccacataagctgggactacaggtgcacgccaccatacctggctcttttcctactttcttctctctttctgtactctggttagttgtatgtcagacctttttactctatccttcatgtatcttcactgcctcttgcattttacatgtttacttttctctttgtatgctgtgttctggattatttttttcagatctctcatctagttactgattttccttttcagctgtgtcgaatctgatgtttattctattcaccaagttttaaatttcactttttaaattttttatttctagatattttatttggttattttttcatatcttcttggtcatttttttcagtctgttttccctaatttgtattttcagtccattcttttaaacatatgaaacatacttgtgtcctgtctagtaattccaataacttttaattaacgttttggggtctagttctgtaatttgttgtttctgttggctcttactcatgggcttgtttccctgtgtttttgtgattcttgtctatgagcatgtctttggaaattttcctttttttttcttttttctttttttcttttttcccccagagacctttgttctgaggaaggttttctgtgggaatctttttaggcctgaggcaaaggagtttttcctcagaggatttgtgcttctgtcaggaagctggaggactagcatcccaggaccaccttaaagtaaattttctgtttaaagttttttgacccacagtcaggcccagaccccatgtgcagctcagcttgtggttatgaattttcagaggagacttttttcctaccctgtatcaaagttgagataagcatatttccttgataatttccttctatagagtttattttgttttgtcccctctccacatccctccagtttctctttttctcccttcctccccatgtcctccttctttttgccttttcccccttaagctgaggtcactacagcccagagataggcatttttttttttctttctagagatggactatcactatgttgctcagtctgatcttgaactcctgggctcaagggatcctcctgtctcagcctcctgagtagctgggaccacaggcacagtccaccatgtctggctttttgttaaggactatatgctaggctttgcagaccatatggtctctgttacaattatctaactttgcaattgtagtgcaaagcagccatatataaacaaatgagcatgactgtgctcagataaaactttatgtatagatactgaaatgagaatttcatataattttcgcatgtcacaaaacattattgttttctaccattaaaaatgtaaaggctgggtgcagtggctcatgcctataatcccaccactttgggaggctgaggcaggacgattggttgagaccaacctgggcaacatagcaagaccctatctctttaaaaaaaaaaaaaaaaaaaggtaaaggctgggcgcagtggcttacgcctgtaatcccagcactttgggaggcctaggtggccggatcacctgaagtcaggagttcaagaccagtctggccaacatggtgaaactccatctctactaagaatacaaaaatattagccgggtgtggtggcacatgcctgtagtcccagctacttgggaggctgaacaggagaatcgcttgaacctgagaggtggaggttgcagtgagccaagatcgcaccattgcactccagcctgggcgacagagtgagactctgtctcaaaaaaaaaaaaaaaaagtaaaaaccactcttagctcatagccagagagcaacaggtggtgagccagatttggtccacatactataatttgttaaccccagtccagatttttgtttgtttgcttgttttgtttagagataaggtcttgctctggtcacccaggctagagtatagtggcacagtcatagctcactgcagcctcaaactcccaggctcaagtgatcttcctgcctcagcctcctaagtagctaggactacagcgtctgcctggctttttttttttttttttttttttttttttttttgagacagggtcttgctctgtcactcaggctacagtgcaatggtacaatcatggctcactgcagcctctacctcacgggctcaagtgatcctctccagcctcctgagtagctgggaccacaggcatgaaccaccatgcctggctaagttttttttttttttttttttatagagatggggtttcgtcatgttacccaggctggtcttgaactcctgggctcaggtaatctgcccaccttggcctcccaaagtgctggggattacaggcgtgagccaccacgcccagccacctggcttatttttatttttattttaaattctgaattacatttgcattgggtgaaagatagtggatttacttttttttttttttttttgagacacagtcttgctctgttgcacaggcagtggtgctgtttcagctccgcctcctgggttcaagcaattctcgtgcttcagcctcccaagtagctgggattacaggcgcatgctaccacacctggctaatttttgcatttttagtagacactgggtttcaccacatcagccaggctggtctcgaactcctgacctcaagacaaggtcttgctattgcccaggctggagtgcagttgtacaactgcactgtacaactctagctcactgaagcttcaagctcctgggcttaagcaatccttctgcctcagcctccagactagctaggactacaggcatgcaccatcatgcctggctaattttttttttttttggtagagatgtgatctcactttgttgcctaggctggtcttgaactcctagcttcaagcaatcctcctgccacagcctcccaaactgctgggattataggtatgaactaccacacctggcctacaccacaagtcttgctttgcttttggcttctgtggaatttttattattttcctgctggttctgtgatacattaaaatacatatttaatattttatccagcattttttgcgatttcgtagctggagggttcagagatcttgtttatcaagtatctggaaatggaagttgacttgtgctttatgtgtatttgtaatttgattgttattatgaggcaggcttattggcaagatgataaccagaagtttgcttatttttggaattctgtgcctagtctatagtcggtgcttaaaagtatttgttgaatgaacactgattctagcaggaatcagatgtataccatgtactgaaaactccataaataaaagatgctataaaacttctgaatgataagccagctacctacgtggccttggtttccctaaaaggattgactatagtggccatatctgggtcatgaaagagccttttctctcttttccttttctgtcattcagctaatcctcctgacttctgattgtcccactttattatttctctatgattgagcaggtcaactgccctcttaaaactctcgacagcctgttcgttttagcagtgactgccttctcctggaatcctggcaattagaagcactcttgggaggccgcgcgtggtggctcacacctgtaatcccagcactttgggaggccgaggtgggcggattgcccaaggtcaggagtttgagaccagtctggccaacctggtgacaccccgtctctactaaaaatacaaaaaaattagccaggcgtggtggcatgcacctgtaatcccagctacttgggaggttgaggcaggggaattgcttgaaccagggaggtggaggttgcagtgagccaagatcgcaccactgcactccagcctgggcaacagagtgagactctgtctcaaagaaaaaaaagaaaaagaaacactcttggcagttgtattctttattcttccatctactgtctgtctcccctttaagagtaatgatattggacacttgttaagcacctccccatgccaagcaccatgctgaatgctttattcacacaataaaggtgaataaatgcatggagaagtcactcagggctgggcgtggtggctcacacctgtaattccaacaatttgggaggccaaggcgaaaggatcgctagaggccaggagttcgagaccagcctgggcaacatagcaagatccccatctctaaataaataaaatataaaaagagaagtcagggttacatggctaataaggggtagaaaagggattcagggcccaaactcctaaccatttcttttttatccacctctgtaatgtcccttccaaatggttgcttagctgctattgtattccatcacttggctgcccatttattttagatagatctagttattaggaaattcatgttgaaccaaaacctattaccaggaacaaatgagccttagatttgcttgaaataccccaccaacatggttgctttcttctaggcatgttacaatttactcatgtcccagtggtgtaaaggtggcactttgaactgggcagaatattctgttcatggtcataccagcaatgctggactgttacttcctacacatcacagaattagctcttcttgtagctataacacacttctaactcacatagagcaaatagatcagtttttttaacacttgcaactgctattaacattcatctttttcatatttttacagttggctttggctttttgcagtcacatactctgccactgagctatacccgctgtctttggctttttgaaccagagggtaaaatgatttgtcattcatgactgtcctgtaactgacattacacattgccgggttttataaggaagaacaaaggaagacctcttttttttctttttattattattatttcttttgagacagggtcttgctctgttgcccaggctggagtgcagtggcgtgatcagggcttaacggcagcctcaccctcaaggccctcctgggctcaagtgatcctcctacctcagcctcccaagtagctgggaccacaggagtgaaccaccacacctgactaatttttgcattttttgtagataaggggtttcaccatgttgcctaggctggtctcaaactcttgggctcaagtgatcatcctacctcggcctcgcaaaatgttgggataatatatgtgaactaccacgtccagccagaccactgtcaattgtatggtctgggaaggcttcaccaaggaagtgttagtttaggcgtgaggaatgatggagtaggggggagaagggctttccaggtagaaggaagcatgagtaaaggctctaaggcatgaacatgttggctgggtgcagtggctcacacctgtaatcctagcactttgggaggcctaagcgggcagatcacttgaggttaggagttcaaaaccagcctggccaacgtggtgaaaccatgtctctactaaaaatacaaaaaaaatagctgggagtggtggcgggcgcctgtaatcccagctacttgggaggctgaggcgggagaatcacttgaacttgggaggcagaggttgcagtgagccgagatcaccccactgcactccagcctgggcgatagagtgagactctgtctcaaaaaaaaaaaaaaagtgcttagtgtgctcaaggacctgcaaggaggcaagtgtgtgtagccagggtgtagtgaatgagggggaaagctgcacaggatgacactgggaaggctgaaacactagaggcgttcccattacatgaataagcaacgacaaacttacaagcattttaaaggaaaagtgcagggaatactaatgtgatgatgatgctggctgttgtgtattgcccgctttctgtgtgctacgcacatttaaagtgattcacatgacttatctccatcctcaatacaacctgaggagaatgacactgttgttatccccattttaatagatgaagaaactgaggcacagagttgtttagaaattgagatcatgctagtagtggtagattaaagattctccacccaggcagcccaactccagagcccttcacctctatcctgtacacctaatagagggtcctgaactagtcagagagcttgggaaagctttggttgctggaagaccgctaagacaagcagcacccctatcctaatgctcttatataatacagggagacatcctcactgggccaggcctgattcttcaggggctaactctgcaactctgagtagaggagagcaggcagcagacagccagaattggccgcctcagttcattgttacaactgtcaaccacaatgtggctgctttaaagataacaaatacggagctgtgtgtggtgtcatgcccctgtgttcttagctactcaggaggctgaggcaggaggaccacttgcgcccaggagttcgagtccagcctgggcaacatagtgagaccccatctctaaaaataagaatgcctaggctaggcacagtggctcatgcctataatcccagcactttgggaggccgaggcaggcagatcacttgaggtcaggagttcatgaccagcctggccaacatgttgaaaccccatctctactaaaaatacaaaaattagctgggcatggtggggggcacctgtagtcccagctgctagggaggctgagacaggagaatcacttgaacctgaaaggtggaggttgcagtgagcggagatcgtgccactgcagtccagcctgggtgacagggcaagactccgtctccaaaaaaaaattaaaaatagaaatacattttaaaacccagatacttgtagcatatataagggacaattgcagtttggaaggtacttccacatgtattatataattttattttttaaaatgaatctcatttggttgtcatgaaatttggtaagatagataaggcagggaatattagccttgctttacagatgaggcaacaggcttagagaggtaccaaggtcaccccactagtgagtagtagagagactttgtttttccaatccagtacccctgcctcccctcctcacccatttggttctaatggtgtttccttcatgtggccaggagaaggagcgctcctggcaccagcaggagctggcaaaggctctggagagcttagaaagggaaaaaatggagctggaaatgaggctaaaggagcagcagacagaaatggaggccatccaggcccagagggaagaagaacggacccaggcagagagtgccctatgccaggtgggaagctaggaggattggagctgcacgtccagtcagcgatctccttaccttgaccacttccttttctactcccaagaggagtgctgcagaggggcttccagaagagagggtagctacccactttgctaacagtgagcagggtggtccgcaccattagccacagttccggcagtatgtcatacttcctgagggagggctgacatgtaccacatcctgtcagcttgcaaaccagtggtaatctttgcacttccttgttctgaacccatgggctcagaccttcctttgccctcagccccttcccatttgctaggagagccctagggcagctgggatgtgcttgtggcctcgttggtgagcatggtaatcctgagcccacaagctgttacccccctacccctccacagatgcagctggaaacagagaaggagagagtatccctcctggagacactgctgcagacgcagaaggagctagcagatgccagccaacaactggaacgactgaggcaggacatgaaagtccagaaattaaaggagcaggtatggagggtggtctcgggagtagggaagaaaggggcactcatttacccattcgaccatgaagggttcttgggcacttcttatgtgccaggccctgtgctaggtgctgacatatgacaagtacataaaggtatggcacaggctgggcagggtagatcacgcctgtaatcccagcactttggcaggccaaggtgggtggatcacctaaggtcaggagttaaagaccaacctgagcaacatggtgaaacccatctctactaaaaatacaaaaattagccgggcatggtggcaggcccctgtaatcccagcacattgggaggctgaggcggacagatcagttgaggtcaggagttcgagactagcctggccaacatggtgaaacctcatctctacaaaaatacaaaaattagctgtgtgtggtggcatttgcctgtaatcccagctgcttgggaggctgaagcaggagaatagcttgagcccaggaggcggaggttgcagtgagccgaggtcacgccactgcattccagccttggtgatagagcgagtctcaaaaaaaaaaaaaaaaaaaaaaaaggtgtggcacagcagtcagcataacagacattgcccctgctctcaaggaacttacattcctgtggcagaaatggatgacaaatgagcagacacaaagtaaatgagattattacagtttgtgataagtgctgtaaaggaaatagaatgatacaactgagagtgagtcaaaggaggttcactttgcacttagtggtcagggaaggcctcactgagaaagtaacatctgagctgagacttgaaggttagaaagaaaccagctccgtgatacaacataggtgaaccttgaaaacatcaggttaagtggaagagccatatattttatatgatatgcttccatttatatgaaacaccaagaataggcaactctatagaggcagaaaacagatttatggtggggaatggggtggggaatggggattgactgtgaatgggcacggggtttattttgggattgatggaaatgttctaagattgattgcgatgatagttgcacaactctgtgaatatcctaaaacccactacactgtatacgttaaatgagtgaattgtatggtatatgagttatatctcaagccatttgaaaaaaaaaatgcctgccatgtgaagaacactttaggcagaggaaacacctgtcgcaagggccctgggacacagaagagggcttgggaagttcaaggacaaaaaggaggcagtgtggctccagcttgataaactcaggggcgagtggagcggtagccagaagccctgtgtcagccattgtaggagcttggattttgttctaagagcaatgggaaactgttgggtggtatgtatgtatgtatttgtttgagactgagtctcgctctgtcacccaggctagagtgcggtggcactatctcagctcactgcaaccttcgcctcccaggttcaagcaattcttgtgcctcagcttcccaagtagctgggattacaggtgcccgccaccatgcttggctaatttttgtatttttagtggagaaagggtttcaccatgttggccagggtcgtctcaaacttctgacctcaagtgatccacccaccttggtttccctaagtgttgggatgataggcgtgagccaccgcgcctgggcagttggatggtatttaaaaagcaggggtgggatatgatttatttatatatacgtatacatatgtatatacatatatgtatatgtattctctactctcctgagtagagaatagtgtgtgtgtgtttttaggggatcgtggcatcaagtggaagtagggatatggttaggagactgtttccatggtctaggtgagagactattaccaattcatggactctgaccaagaaacctgggtgagccagtgcactttgtgagggaggagagggactaggaagtgagaaggtgaggtggaaacaatgtggattgctggctcctgcctcagcttttgccaccccaccaaaaaaaccagtatttctatgacacagatttcctctactcaatgatttcttatccctcttcaggagaccactgggatactacagacccagctccaggaggctcaacgggagctgaaggaggcagcccggcagcacagagatgaccttgctgccctccaagaagagagcagctccctgctgcaggataagatggacctgcagaagcaggtcccctcctcctccccaccaagtcccatggtccttccccaacacagccaggctttcccacttcctcttgcaggacagggagaaccttggccctgctgcctggtttgggagggtagatgggtgggccacagtactgagtggaaaattagagggtgctcagagttgagcatgtgcctggcagagccctgggatagtaatctctttctctgtaatggtcacagagtttttgttttccctggctgtctcagtttcaattgttctttccgtccttgccaaaaatctaatatttttacatactaggttgcttctcctcagaatcctatatcaaatgatgttctgacttttcatttttaaaaaagcaatcacaatacatgttttgcctttgggagtagttatagtcagcctttttttccttctttttggtgggggagacaggatttcactatgtcgcccgggctgaagtgcagatcataactcactgcagtcttgacttcccaagctcaagcaattctcccacctcagccccctgagtagctgggactacagatgtgtgccatcacactggctaatttttaaatttttatagagacagggtctcactatgttgcccagactgatctcgaactcctggtctcaagcagtctgctcgccttggcctcccaaagtgttgagattacaggtgtgagccaccgcacccagcccagccaagatttttatttgtgcctgcctctatgcagcatatgtgaggctgggaggcagatgaccaggccgaattgtattgaggaagggggtggttaagaacagtgtgtaggaattggtagaatcgccagagcattggaaatggccactgactatggtaaacctcgaaggaccctgaagccctaggtgaggagcatcttcccaccggccccctgccctgccatcttggtcttcatgcccttaattttccaggtggaggacttgaagtctcagctggtggcccaggatgactcccagaggctggtggagcaggaggttcaggagaagctgagagagacccaggagtataaccgaattcagaaggagctggagagagagaaagccaggtaggctagataggccatggaggtggcttttgtctatctggctgccatggtcactgtgatattgacagttgtttgctcaggccaccttgcctttcatgtctgcaactctgggatgtacatgtagccatgtggagaggacatggttcctgtcttcaaagcttgaacttcatttatttagtaaatatttcgtgaacgcctgttatgcaccaggcaccatgcttggggatacagtgataaacaagactgtatggtccctgccccagtagaatttatagttttgtggggaagacattaatcaaataataactcaaattattacaggttatgacacatggaggaaacagggtgagagagagaagagactttagaaccattgttagggaaggcctttctcaggaagttgcatttaaactgagcactcagcatgaagtggagctacccatgtaaaagggtgagggggagttctattccgtaagaggagaaataatatgcaaaggccgtgaggcagataaaagtttacagtgttaactgaaagagtggttggagcctgattggattgtaattggagcctggtgaatgaggagagtggcatgagctgggcaggtccacagcattcaagatttggtaggccacagcaaggagttcgtagtttgagtttcataggaaacctctggagaattttaagcagggaaattgatacaatccaacttatgatgtatttgaagggattgtaatgccatgagacatcaggagtgaaagaagaccattcagagtgaagagcagcttgtattcttagtgctgtgggaatttgagaaggggatgggctgggtgctgtgtcccacgactgtaatcccagcactttgggaggctgaggtgggcagatcacttgaggtcaggaattcaagaccagcctggccaacatgtctactaaaaatacaaaaaaaaattagctgggcatggtggtgggtgcctgtaatgccagctacttggaaggctgaggcaggagaattgcttgaaccaggaggtggaggttgcagtgagctgagatcacaccactgcactccagcctcggtgacagaacgagactccatctcaaaaaaagcaaaaaacaacaaaaaaaagacacagtttgagaagggacacattattttggtggtgaatctagaggcaggaagacaagttaggctggtacagttgtcctgatgagagatcctaaagctaaaccaaggtagggtagtggggaagaggaggagagaagagaagaggtttaaaggatgttaagggagttagaatcaattgtatataattatagattggatgtaggtaggttgaagggagaactctggagtagtcaaggttctacgttaggacactgtgtggatggaagtgccattcactgagctagggaacatagtaggagatgattgggtggacaggggaggagaggaaagggatggggaagatttggacatgttgaacgtgaggtactaatataaggtatgtgtgaaatttgccagagaagaataaggttgatagctaggcatggtggcgcatgcctgcaatcccagctactctggaggctgaggcacgagaatcatttgaacccgggaggcagaggctgcagtgagccgagatcgtgccactgtaccccagcctgggtaacagagcaagactctgtctcaataaaaaaaaaacacaaaaaaacctgtgaggttgaaatggggcatcatctgcaggaagtacctaggagcacttattatagtaagtgctcaataaatgatagcttttattgttacatcataatcattatcattactatttctattttgattattaatgctatgtttagaatactcagatgagaaggtaatttttcattccctaagagaatggcccagcactctgacccctctctttttagcctgactctgtcactgatggaaaaggaacagagactccttgttttacaagaagctgactctattcgacaacaagagctgagtgccctgcgccaggacatgcaggaggcccagggagaacagaaagagctcagtgctcaggtacttcccactctggttatgagctctgcatccctggcagaagcctgattctgaagcggtggattgattgctctgagtcctctcatggagaggacccatctatttttcctgattacaggataggctggtgcctcaacacccctacaggagggggaagccaggactagacaaggcgggggcttgggaatctgacccagagatggacatggctcctgtgggaaacctgacagcccacagcaaagtgcacacgggtgtagcccatgcaggcctggttccagcacaccggcttcaaagtatgctgggtctggttggcaagatgtagcagggagaatgagcaaccagaaatactccagatcaggcaggcagcagcaagacttccagggactcagtctgcccccatcagaaccccagatattgtatacagagaaaagatggaactaggagggaaggaatggggtgtaagagccagatggtggcttgcaggggttaagggcacacaggtttggctgttcaatggtcttgagtttgaatgtaagctttctaattgtgtgaacgtcagcttcttcatccataaaacaagggtgaacaattcttgttcctaattcctataaccattataggaatatataaagtgtcaggaacacaataagcattcaatacatggtagctatgttattgtgactggtcttactaggcgcagcgtcgaggtttcagggcagagttctggtcatagcaaggagccagcatatctgcccaggaagccagggctgaagcccattagcatagcagcctgggcccatgtgttcagtagtcggcaggcagccaggtgttagatctagggtaacactcatttcagagcccctctacctgcctgagagctgagctgaaatcctcccagccctgatcagagtttgtacaaggattgagtggggtctggcctgggaaggcctgaggagagggtatccgcttcctgcttatattatgtaaaattcttccttgacagatggaattactaaggcaagaggtgaaggaaaaggaggctgactttctggcccaggaagcacagctgctggaggagctggaggcgtctcatatcacggagcagcagctgcgagcctccttgtgggcccaggaagccaaggcagcccaactacagctgcgactgcgcagcacagagagccagctagaagcgctggccgcagagcagcagcccgggaaccaggcccaggcccaggcccagctggccagcctctactctgccctgcagcaggccctggggtctgtttgtgagagcaggcctgagctgagtggtgggggagactctgctccttccgtctggggccttgagccaggtgagacagcctccccagaactaggtcctttgggccaaagccaggcctggctcccaggggaaagggagaggaatgctatttgttagaccatattgcttcagggttaagattacatacttgggaattaattctgagtttaagccccagctctaccatttgctagctatgtgtccttgggcaagtcacctgtcctctctgagcttgattttcctcaactacaaaatgaggatgttaaaagtatttaccttatagtttcaccaaggagttatgaggttgcagatgtgaatcacttacacggttcctggcacttattaagtgcgtaataagtgatagctcgcattaatctagcacccaccatagtgcctggcccatacttatggagaaaatatgtgatgagtgaactgctgagaaaggggttctttgcggagaggagggaccagttggaaggacagggctgtgtctggagaggtctggctgtttcttttcatagtggcagccaggtaaggaggttttcctcattttttcagaccagaatggagctaggagcctctttaagagagggcccctgctgactgctctctccgctgaggcagtagcatctgccctccacaagcttcatcaagacctgtggaagactcaacagacccgggtatgtttctctgctcccctttcccgaactctttacatccctggaaaagcatgaggcaaaggggtgtgaagcagtttgacctgttttattcctgagatcaagttgggatgagtttcacctctatcacttaccacctggcaaccacaaatgaagcatttgaagttcctgggccttgttttcccttgcagagtagggcagatagtgcctgctcagggttttgaggattagatgagagaggatcttgaatgagccctgtaaaccaaaaaaccctgggtaggccaggcacggtggctcatgcctgtaatcccagtgctttgggaggctgagacaggtggatcacctgaggtcaggagttcaaaatcagcctggccaacatggtgaaaccccatctctactaaaaatacaaaaattagccagaggtggcggtgggcacctgtaatcccagctactcaggaggctgaggcaggagaatcacttgaacctgggaggtggaggttgcagtgagccaagattgtgccattgcactccaggttgaacgacaaaagtgaaactccatctcaaacaaacacaaaaaaaccctgggcagatgtatggcattgttttccatcatcttccactcagctatgaattaattcttggtacccaggcttccaagagaaaccctagaaatcagtgaccactgagatttgaggttggcatttataggcatgttctaggcctaggtctgaaagagctcataaattccacctcacagtgaacctatcagtcaatacaaattgagtgtcatccatatgtcagccactctgggctgggtatacaaaaaggagaaagacctggtctctgcctaaagaaggcttgtgacatggtggaggaaccaaactgcattctactggaaagcagaactgagagaattaattggatcaataacagacgcaagtgatgcactgttggaactaggaggagggggcaattcatcctgatttgggaagggtcagaaggaaagaagagatgacctttgggctgagctttgaagtaggagtgttgagagggaagtggtgacccctgggctaactttgagcaggagctctgtttcaaaagacatagataggtcagaaggggatggattctcacactccatccaagtggagcagagcctgtcatcacttcaggaagctaaatacacatgtgtttaaaggaagtaacccggcaatctgggagtaggtccacaatggcggcccaccacagaagctgagaatgaggagagagcttgagccctgcattgttttgtggaagatgaggaactcacgtttagccatgcccttcctttcccaggatgttctgagggatcaggtccagaaactggaagagcgtctaactgatactgaggctgagaagagccaggtccacacagagttgcaggatctgcagagacagctctcccagaatcaggaaggtgagaagctcaagacaggcagggagattgagagggagaagggataggtggggagcccagaagtggcaggcacaggcctagcagccactctgtttattttattttatttttgagacgacatctcactctgtcactcaggtttgagtacaatgtcacgacttcggctcgctgcaacctatgtcttccgagcagctaggattataggcatgcgccaccacgcctggctaatttttttggatttttaataaagacggggtttcaccatgttcaccaaccagcggagccaccggggtctctaggagctcctgcacaattataggattgggggctagaagggacctccagtgtcatctggctcaaccctgtctggaattgagggccaaggctctctgtgatgaggatgaggacatattgggatgattaccaggcagcgctggggctggcagcagcagggagtgcttgaactcctggcctcaagtgatccgcctgcctcgacctcccaaagtgctaggattacaggcgtgagccactgcgcccagctgcactgcattatttacccagaaatgtgaggtgagatctagatgcacttccaaaggggtgctgaccaccttgaactattttttcagctttgcttggcctttgaggcccatcctggaagaagagattaggaggaacagatttgatgaactgaaagaaggaaatggctgggcttccattttctgtctctgtagatttaaaaattaaaaaaattggagacccagggccgggactgtaagaacattataaaactgcatcttttgtcatccatgttacttatttttatcatcttcaactgtgtcctccaagttagcctttggtagctgagggattatgagcttatttgggagaaagcaaagagaggggatctggggaggatatatccatgtgccagccaaggactagaaagtgtcatgactccttacaaaggacaggagaggaagggtcttgaagctcaagtttctactgtaaaagagaagagttagccgggtgtggtggtgggcacctgtaatcccaactactcgggaggctgaggcaggggaatcgcttgaacccgggaggtggaggttgcagtgagccgagattgtgccactgcattccagcctgggtgacagagcaagactccatctcaaaaaaagaaaaaaagagaagaggacaccttgggtctgggccttttttgaggccgtttgagggttccctgagagccacaaaaataatgggattccaacgcctgttgcagaaatggtgggcaaccagcagagccacccgggtctctaggagctcctgcacaattataggactgggggctagaaggaacctccagtgtcatctggctcaaccctgtctggaattgagggccaaggctctctgtgatgaggatgaggacatattgggatgattaccaggcagtgctggggctggcagcagcagggagtgctgccaggcaaatagaagcagctggcatctgccagctcttgatgtccttgatatctctaggacactggatataattttctccttcttggccttccttccctttgaatctgttccccatcctccatctgcctctatatccctctatatcccaaacatgggtcttactccactacctctcctctcctctcctcttctcaaagagaaatccaagtgggaaggaaagcagaactccctagaatctgagctgatggaactacatgaaactatggcatccttacagagtcgcctgcggagagcagagctacagcgaatggaagcccaggtaaagtggtactggtttcagggaggggtttgcctcaggagtagtcccttgggcccaccttggcctgtggtcctgtgtcccacttccttcagcaagtctgtcagttcctctggctgtctccatgtccctgggggccattattcaggttccaatgaatcctccttcaattgctttttctgaattgaggttgatatttttgccccttgtcctgaaggaccagcgtctcccctgggcatagcagagtcctggaaggtggtagggatgcccttttacagtatcagcttaagtggaatataccaccactttttttttgcccaagtccttatcactgctagtgccacaaaataagaaagagaagggtcggtgttggggtgacagtagcagggaagtgtagtctaaagtggcttttcatcttgtcttctagggtgagcgagagttacttcaggcagccaaggagaacctgacagcccaggtggaacacctgcaagcagctgtcgtagaagccagggctcaggcaagtgctgctggcatcctggaagaagacctgagaacggctcgctcagcactgaagctgaaaaatgaggaagtagagagtgagcgtgagagagcccaggctctgcaagagcagggcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagaagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggagcatcagcttctagaacttgagaagaaagaccaaatgattgagtcccagagaggacaggttcaggacctgaaaaagcagttggttactctggaatgcctggccctggaactggaggaaaaccatcacaagatggagtgccagcaaaaactgatcaaggagctggagggccagagggaaacccagagagtggctttgacccaccttacgctggacctagaagaaaggagccaggagctgcaggcacaaagcagccagatccatgacctggagagccacagcaccgttctggcaagagagctgcaggagagggaccaggaggtgaagtctcagcgagaacagatcgaggagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagctgaccactcagaggcagctgatgcaggaacgggcagaggaagggaagggcccaagtaaagcacagcgcgggagcctagagcacatgaagctgatcctgcgtgataaggagaaggaggtggaatgtcagcaggagcatatccatgaactccaggagctcaaagaccagctggagcagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagagggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcccaggcagtgctcaaggaacgggaccaggagctggaagctctgcgggcagaaagtcagtcctcccggcatcaggaggaggctgcccgggcccgggctgaggctctgcaggaggcccttggcaaggctcatgctgccctgcaggggaaagagcagcatctcctcgagcaggcagaattgagccgcagtctggaggccagcactgcaaccctgcaagcctccctggatgcctgccaggcacacagtcggcagctggaggaggctctgaggatacaagaaggtgagatccaggaccaggatctccgataccaggaggatgtgcagcagctgcagcaggcacttgcccagagggatgaagagctgagacatcagcaggaacgggagcagctgctggagaagtctctggcccagagggtccaagagaatatgatccaagagaagcagaatctggggcaagagagagaagaggaggagataaggggccttcatcagagtgtaagggagctacagctgactctagcccaaaaggaacaggagattctggagctgagggagacccagcaaaggaacaacctggaagccttaccccacagccacaaaacctccccaatggaggaacaatctctaaaacttgattctttagagcccaggctgcagcgggagctggagcggctacaggcagccctgagacagacagaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggtaagtcactccatggggagtaagggccaggggacacacccctgtctggctgagctcagggactgcccaccaccctgggccctgtggcacctcaggggtatgagaaagctgagatcatgagcacctcaacatcggtgggattcaggctactgtgctagtcgggagatacagagaggataagacccccacagtccctgccctcacagagttcacagtctagtgggtaaacaacgataatgcagtgtggttggtgcctaatgggggaagtttagtatgccccaggcatgctggagggatgcccaccctttcctgggagtgggtcctgaaaggctttctggtaaaagtggtgtttaagattagacctgggccaggcacggtggctcacgccggtaatcccagcactttgggaagccgaggcgggcagatcacttgaggtcaggagttcgagaccagtctggccaacatggtgaaaccccgtctctactaaaaatacaaaaattagccaggtatgctggcatgtgcctgtgatcccagctacttgggagtctgaggcaggagaattgcttgaactcaggaggcggaggttgcagtgagccgagatcgcaccattgcactcgagcctgggcaaagaaacgagactccatctcaaaaaaaaaaaaaaaaaaaatagacgtgaagggaccagtaaggaactagccaagcacaggttgaggaggagcattcacgggaagaggaaaagagggcgagaacaagtgtagtatctgtgtagatggttcaggttgcatgggacagagggaggatttgggaagagaccggaagacagcaggggccacacctgtcagggcttacaagtcatgctgaggacctgggtggtgggaagcagatgaagtttttgcagcaggggagtgatgtgatcagacatacagctcacaaagattgctcaggctgccgtgtggagcaacagcatgtctggagagacccactgggaggctgtactgggaagtccaggggagagcttgtgccctaagatggaaagtgtgaatggagacatgtgggtgggtctgagaggtaggacttgattggctaagaggtgggaggaataaagagagggcagaaagaagtcaaagatgacactcaggttcctgttcatgaagatgaagagaagcaggtgtgagaaagaggagtggaatgaatgatgaggtcagtttggaaatggagggaggagcctgttggcaggtcagtaaaatgatctgaagctgaaggatggagttgaagccagagacactttggagtcatcagcagttagaacaaatgggtttcttgtaggcagaatgttgagtgagagaggaagtgggcttaggagaggacttcagggtgtattatttaacctcaaggtcaagcaccgtgtcttagtcacctttgtacccccggtactgagcacaagacctgcagagagcaggcaaacaggaaagccaagttggctcaagagagagaggcatcatctctttttccaaaagacgcccagtccaattttccagggaaatagactctacatcctggtcccttgactgggccccagagaaccccagacacacagtcccccagagagttcattctgggaactcacaaagctctgctcttggtgaagggcaatatgaggagaaggaggtccatctgtgaactccaaagttcacagggtttgaaatacagtagtgcggcttatcagctgtgtaaccccgggtgaatgccttcactctgatcttcaatttctcatcagtaatataggcattggtggtatgacatggcatgatatgtatgaattgcttaggaagaaagcactaagtggacctcctttcctatgttcaggcccattcttacaggcacagcaaaagtaagttatgtaattgggcaggagggcacttcccacccatactcttgggttactgagcagtattcactcaataacataactctggtcagagtcacttcacccactgccacctccaaacacacagggtgagactcttgtctcaaaaaaacaaactcataaatggcaggactggaatgaggtctgagtcatctgcctctagagcgcaggctttctgtcaccaagctcttcctctctcccaggcaacccacatccacctgcgtacacttgttttctcttgttcatctcttcttgactgttatcatttatgaaccacagggcacctagaaagtatctagcatgaggcttccccatttatccaaagggacttaacctaaggacttgatccatgtttcatggtgcatgtagtcgttttataaatgaggaaattggggtttggggagagcttgtgctttgaccagagtcatatagccactgagtggctatatgggccactgggtacgccacagggcacccagccctgtgtgactcgagagtccatgctgttcccacagcacatcagtgctctgagtcattgctcagccttctaggagatgtgaagtgagctgggggctctgatcctagcttccttgctagctcaccgcatatccttgagaagagcccctctgctcctttgttttacctatctgtaaaatgaaggttctgtactagaatgactcagagcctctaggaaaaataagacaaaagcctgaggagaacattgaaccgctgtttgtgtggaggatgggttggtctggatatgaggttggcaaggtgtgattttgctccatacctccgtaccctaggatgaactggagctcaccagacgggctctggagaaggagcggctacacagcccaggtgcaaccagcacagcagaactggggtccagaggggagcagggtgtgcagctgggagaggtgagctgggggctctgggggaacaggtgacccagcagggagctcctgtccaggggtttgtccccttcccttgggaactgggttcctgaagcttaaacctgccagattggtctgtgtgtcctctgtctgttccctacctgtcttaggggctgcccaggtgagattcacaggtctttcccacaggtctcaggagtggaggctgagcctagtcctgatggaatggagaagcagtcatggagacaaaggcttgaacacctgcagcaagcagtggcccggctggagattgacaggagcaggctgcagcgccacaatgtccagctgcggagtaccttggagcaggtgacccctcttcttgtccagtgggcatgcatctccacttctcgtgtggtccctagagcataggctcagtaaattacagcctgtgggccaaatccagcctgctgcctgtttctgaaaattaagtttgtttttttttttcccgagacagagtcttgctctgtctcctagagctggagtggaatggtacgatctccgctcactgcaacctccacctcccgggttcaagcaatcctcctgccccagcctcctgaatagctgggattacaggcatgcaccaccatgcctggctaattgttgtatttttagtagagatggtgtttcactatgttggccaggctggtcttgaactcctgaccttgtgatccgcctgcctcagctttccaaagtgctgggattacaggtgtgagccaccacgcccagccctgaaaattaagttttattggaatacagccatgcattgtttatggctgcttccctgctatgccccacaaagcctacagtacttactgcaggagaactttgctggcctttgctccagaggtctgagaggctggccctgcctcttctgcttcaggagcacttctttgcactgaggcctgccctagctgtgccttcctcagccaggagttctcttcccatggttactgtcccctcatatacctgcacaggcactggccacctctggagaaaggcagctctgctccaaccacagagccaagccgagccctgatttcttatttgcaccttggcaggtggagcgagaacggaggaagctgaagagggaggccatgcgtgcggcccaggcagggtccctagagatcagcaaggccacggcttcttcacccacacagcaggtttactcattttcctcagctgcagccttagagagcccaaccccagccaccagaaactcagccctcctcattgcatatcccgggccaacagcacttcagctagtccagagagcccctcctgactgcattctgccctgctcggcacagctcagtctgtccctgccctgagaaggaggcccaacattggggtgggggttggggtggctagtggccctgccttctgagggacttagatctgtgtactcccagaccagtgccacagactggcccgggagtggggctcatggggctctgcttaggatccctggtgtatgggggttgtgtggtgcttgccagctcctgaggagcctaggagcttgatcacagcttgatctcttagacctttttacaatgttgagtttataggcttagggtccatggtctttcctggagccagtgtcccttttttgggtaagaggcttggggaagactccccaaactactcgtctaggtgaggtatccctgccaacagacacaggcttgcagcctgacagggaggcgctgtttatggtggctgagcactagatctccatcccttgtcctttattgaaagttctcaagggcaggcaccgtgtcttcctctctgcatccttagctcacagcccagggctagcacaaagcagatacatggtgtacttctgttaaattaaaacatgcctcagagaagcaaatgccatccaggccttttggatgttttgtgtcaggtctccatggcgttgcccattatgctggtgtggggcctctccttgctgcagggcctgctgccccatagacgtccagtctgagttcagatgcttctggcccatagcccttgcccaggcccctaagattgtgatgaggttctgcaaggaaacttgcagaaaccccagagtgggaaggcctatgccaacaagagtgctgtttgtcttccttaggatgggagaggacagaagaactcagatgccaagtgtgtggctgaactgcagaaagaggtatgttctggattttctaagcccatattccctcccttgcactcaggccctttgtgcacctccagcagggagaggggaagttcctcccttcagagaacttcagtctccatgggaggcaaaaatagtcccagtcccaaccccatctctcatatgcctagggtgggagtggggaagaaagcatgatcctggcccccgacttccaaatccatacttagaaagggaaaggagtaggaagagggctgaggagcaggcagaagattctaggaggacaggtgggagcaagggaagccatcctggcctccctgccctcagaggtgccctcgcagccaagactgttgccagtgccccagacagaggagccaggcaccagcacaagctccaggccacacagctcagcacaagctccaggccacacagctcagctcaagccgccactcgcagagaagtgacttgaagagccttcctgcctcttaggcctcaactaaaagtccactctccctttcaagttgcaggaatcataagtgttacctttttatttctgagcctatttcagaaatcagtagtcactactggcagggcctgactctgtagctagacctaagctattactttgaattctattaaactcagaatgtttttctattttattaaaaagtcaaagcaggtgcagtagctcacacctgaaatcccagcactttcggaggccaaggtgggcggatcgcttgaggtcaggagtttgaaaccagcctggccaacatgacgaaaccctgtctgtactaaaaatacaaaaattagctggacgtggtggtgcacacctgtaatcgtagctactcaggaggctgacacacaggaatcacttgaacccgatggggtggaggttgcagtaagccaaaattgcatcactgcactctagcctgggcaacagagcaagactctgtctcaaaaaaaaaagtcagatagtggttatacttgagtatatattgttatcagcctcatcaaaatgtacatttaaaactgggcatttttcacatgtaaattatctttcagtgaagttgatgaatagctttgtggttttcaagcgcgctatttgagtcacatgtgcagccaggattgagaatcactggattctagaattcctaagggcccttcctctaaactctctacagcctgtttctgagattcgtgtatgtggtagagttgattcagatgctcagccaacgagcttcagagaacacagagcaggaagagctgggacaacttcagggccctcagctgctctcccttttttttttttttcctgcccaccaggtggtcctgctgcaagctcagctgactttggagcggaagcagaagcaggactacatcacccgctcagcacagaccagccgtgagctagcaggcctgcaccacagcctctcacactcacttcttgccgtggcccaggcccctgaggccactgtcctggaggcagagacccgcaggctggatgagtccctgactcaaagtctgacatccccagggccagtcctgctacaccccagccccagcactacccaagccgcctccaggtagcagccacagccaggagcacacagacagaagactgtgtcatgggtcatggcccctccgcacacctacaggtttgccaaaggaaaagcctggctctgttaggcacccaggagccccaggtcggcgggtgttcccaggaagaggaagtaaatctgcaaccctggggaggaccccaactcacctgggaatgaggcaaattgcatttgcttgctccctatggaatcacccagaggggtgccttgccctggctgagggacatgtactgcctctcatctagaatttattttcctagcacttcaccacctccttcatcttctccttcaacaataaaccctgagatctttgcattcat

SEQ ID NO: 514 - DNA, 4862 bp, Homo sapiens
ccaaggactccgtatcccagcatgcagaggagccggaagacaggcgcttagaggacagcccgctgccgccggggacgcgcaggcgcagcacccctgtttgtcggccccccgagagaagaggtacggtcgaagccaggagccaggccgagcgggagctgaccaggcttgactcgggtacagaacgaggcaccagtccccttgcgaaccgaagggcctcgcagtggatggaggaggcccagccctgaggtcaacgccaaccaggctagcctggcacggggcctacagggtgggtaggcgggcgtgccgcagccgtccagggccttccctcaggtcccgggcgaggggcctacgctgcggcccggcaacaaggcccgactcggcccctcgggaccagagccccacccgatcggaagcggatcctttaccagggccataggccagtgactaggccgggcctgggcctcccatcggggccggactaggacgaggccccggggaggcccctggcctaccagacccttttctcaggccgacagccgccaggaagatgcaacgtgccctgccaggcgcccgccagcacttgggggccattctggccagcgccagcgtggtggtgaaggctctgtgtgcggcggtactattcctctacctgctctccttcgccgtggacacaggctgcctggcggtcaccccgggctacctctttcctcccaacttctggatctggaccctggccacccatgggctgatggagcagcatgtgtgggacgtggccatcagcctgacaacggtggtggtggccgggcgtttgctggagcccctctggggggccttggagctgctcatcttcttctcagtggtgaatgtgtctgtagggctgctgggggccttcgcctacctcctcacctacatggcttccttcaacctggtctacctgttcactgtccgtatccacggcgccttgggcttcctaggtggcgtcctggtggcactcaagcaaaccatgggggactgtgtggtcctgcgagtgccccaggtgcgcgtcagtgtgatgcccatgctgctgctggcgctgctgctcctgctgcggctcgccacgctgctccagagcccggcgctggcttcctatggcttcgggctgctctccagttgggtatatcttcgcttctaccagcgccatagccggggccgaggggacatggctgaccactttgctttcgccactttcttccctgagatcctgcagcctgtggtgggtttgctggcgaacttggtgcacagcctcctggtgaaggtaaagatatgccagaagacggtgaagcgctacgatgtgggtgccccatcctccatcaccatcagcctgccaggcacagaccctcaagacgccgagcggagaaggtactgtgaaattttccaaaatcttgtcaagctaggagcatactggtcgagtcacatgccatctgttgaggtgttcgctgtacataggtggagacctacagtcaggtattggggcacatccggaaagacaaaatcagtctttggccttaaggaactcagcagttaggtgtctggggtccacgaggcacttttctcaccactcgggccacttaataagtctcaagaaatgcagtttcctttggtgctgtgaagtcccagtggagggacacagaaccctggccttgcctcagaatctcagaatcctagacattgggcctgtgggagccagaagcaacctgctggtactttcccctgtgaggaagggacagggaaggaggcctggggtcctcaaaaggtgatctgggccactccaatttccaaatgctgtgtcctcttcctgggctttaactcagatgctgtgcttctctgccacttacttattgagagggaagcttggggtattaccacatttacctctgtctccagcaagcatgtgtcaccaaaaccagggacaggctacatgacccactgagggagcctgctgacaccagggagtggcgatgaccctttcattatctgtaaaccaagctatccacagcatcaggagtcccagctgaattattcactgaatgcactttggccagggcaggagggatctttttaaattcagcttactctctctcccagatctgtggagccagcagagtggtcccagccttcataagatccacagctccatttccaacattattcctcactgttttgaggcaattactcgagtagtaaaatctgggacgggctttgtcttttgcattgccaaggctcctgcttttgctcacctgtgaatggggttgtggcaggaagctctatgaatttagctgcagttatccctgtatttactctccactgggctatggaattgagtgtgggacacactcctttcttgaaggagttccagctggggaagggccacagatcactatggcccaaggtatggtaggtgttgaaaagtatatacagcatgctgcagggcataattctgggccctagagcttgggtctttataggtgataagccctaaggacagaagtctctcttaaccttagctggtattaaagatggggccaggtgagctgggcctggtaggaattgagctgtccctcagagccattcaggtggggccaggccagtggggacccctcctccactgagaggtgttggaatgttagggttggctggacattcaaaaacctctgcctaggcccaagaaaatggacaggggggaagcaggttggtggggaggaagggagggtcaagaggcgggttcttggcatagccttatggttgttagcttacatgggggtggcggttattcctccagccagtttgacatctgactgcatggccacgcccaactccaaagggctaccaggagagggaggcagggtttcctatctgtctctctggtccttgtgaggaagtgactagcgtaacactagctctctgccttggcaggctttagatggaactggcaagggcatcatcaggatggcagcctgggtagcagcagggaaagactgtcctgtctataccaacttgtcatgtgtgagactgacgggcaggggggaagcgtgctagggctttctacacctgtgcccttgttgcctctcttgtcgtgttccctgacatggtggagattttggttctcagctggaacctgaaaggctacacaggctgtccccacattggtggcacagagaggctgaggtataggagtccacagtggtcactgttgaaacggttccctggcagctgcagcactccaccttctggtgggtcagggtcccaagcacatgtgtaaaccttcttctgttggactttcccacctgccctcaaagtggggcctctaagggtccaccctgtggaagcagtaggctctggcctgtgcctacccatgtgagctgtttctccttcttctcctcttgcaagggctccgctaagtccctgctctaacaagggccttggtggctttgggggttcttctgagagggagaatattagcatcagttaggaggggtagactcacccaagttggccctgcttcctgggctgagagccaagggaggtgttgaattccagccttccccattgacccttgccaggaggctcaagatacccctaaccaggagagggggagaattaataacccttcccttggatgtgatgccagcacccaggcagaaactcctggaaactccagaacttgccgttccacccatctgccctagggcactagttccactgacccttagataccaccctcagaaccattcctggtggctggcctcgtgggcagtctggcagacacccagctgaccttcccatcccggaggtgcctcagctatggagggaagattcttagagcctttgggttatcattctgatggcagagtgggtcctaaaccaatctctggggagtcccaggctctgcatggtgaaggggaaacataggattctgggggaggagtctaggtggtacggtgaggagtcagcctgctgcggaagggtagagggcatgagccaaggccaaacccagagtgacctttcctctctcctctggccccaggcaactggccctgaaggcactcaatgagcggctgaagagagtggaagaccagtccatctggcccagcatggatgatgatgaagaggagtctggggccaaggtggacagccccctgccctcagacaaagctcccacacccccagggaagggggctgccccagaatccagtctaatcaccttcgaggcagctcccccgacgctgtaactccagaccaccttgagtgtggcacctcccctcccaagccccccttgacatcctctcagctactccagggcacctgactgctctgaggagagggaagaaggcctgctggggctttccatggccttctgctgtttctcgccaacactacccaggactcttgctacctggttccaactccagacaaccactatgccaggcccggagcctctgaggcatcggccagtccaggccctcatctgaggtaagaatgtacatcagctggcagccccaagcaagtggctgcagggacactgatgccacagctcctgggccggccctcacatctgaaactggttgccgagagccctgagccaaggcaaggatttgccaaaaatgttctgggggcccagcaaatgcaggagccgacctggggctgcacatccctgcccatccccagaaagactgttcctgtcaggatttgtttccctctgctgtggcggtgactgcttctggaccagaacagctccagctcccaggtattttctacaggaccacttgagtgggcagccaagcccaggctcgcagtatcaataaagcagttctctgaggaatgac

SEQ ID NO: 515 - DNA, 17896 bp, Homo sapiens
actcagggtgctaggcgcctattggaggagaaggccgagaggagcaggacggcgggaagaggagtgcggaacccgcgggaggtgaggcccgccgagccgggctgcgagccgggctgcgagccgggcggcagcggggtcggaggtcgtgggcggcagcgggcgtgaggggtgaggcagggtcaaggggcgggggcggccgcgggtctccattgcccgagcctgtgggagcaggcgggcctggggctgcagcactcaccccgggagccccgccgcagctcgggtagcgttcaggcacctcgccggggccgggccgcgtgcgttcggagcggggaaggcggtctccggggcccccggtgcgcgcggggaggcgtccgctcaggggaggccgaggtgggcccgcggctgcgcccccggccttcgatgccttcgctcgtccgcctgggaccgcgctggcttcgcatcgaagtgggagaggtctgaacagttattttaatactttgatttggaaagaaaatcctttaggccgggcgcggtggctcacgcctgtaatccgagcactttgggaggccgaggcgggcggatcacgaggtcaggagttcaagaccagcctggccaacatggtgaaaccccgtctctactaaaaatacaaaaattagctgggtgtggtggcacgtgcctgtaatcccagctgcttgggaggctgaggcaggagaattgtttgaaccaggacccgggaggcggaggttgcagtgagccgagatcacattactgcactccagcctgggctacagaaaaagactccatctcagaaagcacacaaaaaaaagaagaaaatgtttgttcatcctgcctttaattccttattacaaggcgtgaatttttattgttttttttgagacagtctggctctgtcatccggggtggagtgcagtggcgtcttcacagctaggcacaacctcgacctcccaggctctcaagtagctgggaccgcaagcgccactacactggccagctatttttctttttttttttttttttcggtagagagtaggtcttgctgtgttgcccaggctggtcttgaactcctgggctcaggcgaccttggccgccttggcctcccacggtgctgggatgacaggcatcagcagtgttgaagcctgtgaggtggggtccctgtggctgactctgccctctcctggggccattggcagtgcaggggtccttgtgtgtggaggaaataaggagatgatcaaagtatgattccacgaatcacacggtttattgtcaaagaagatttgttctcgggttcacagtgctcagaggggaggagaggggaggaggtgaagacacctggcagggaagcagggcctccatggatggggtgcattcacggcagggaggtgagtggcagaacggccagggtccggttgctctgctgggatggagcgggcccctggagagtgagatctggtgagagttcgaggtttgccttggtagcagtggagagcgtgagagcgggagctctctgagaagctgggaccgaggtccagctcccaggccagcagcgtatagcttgcctcaaagcatctgcacaaccttcaagctgatgtctgtttttgcagtccagcagtcagggtcagtaactcacataagggagtgtctgacaaggtttaagtggcattcccaaggttgcggagttcactcaagtcctcacatatgtggtctgataagacatcacactcttgcaggggggtcaggtcaccccaaaacatcagactatgtaagtgctgtgaatcacttcaaagctacacagcaggtcccagggcccaaggcagaggagtgagtccacctcggaaggctcagagcagctccaggcagtaaccacggcatttccagagtctggtgtgtgagcctaacagctctggtgtgaccgtccgtactcacctagcagcacgtgacatcagctctccccctgaagtcattgctcagctcgggtgctgcaggaagacatacaggtctgtcttgggccagccccttgcctgctgtgggctgctccctgtgtgtggccttcaccccggtgtagagagatgggctggtcacacccctgcccctcacagcggcgagaggacagaggcatgtgccgggctgtctgtggagctcccaggccagtgtctgggatgcggcaggtgcttggtgttaaagggaaaatattccaggatatctgtgaaagcacgttaggcagagaccaggctttcattcagaacctttgagagatgtgggaaccaccacactgcggtcttgcagtgggagagaggctgggctcagctctgaacaggccatgggctggtggcggcttacagctccagagctgggcaggggcagaggatggaaggttgctaagaggaacccccaggggcgaaggggatgcaggttcaactgacctgccagatcaggccgcccgggggacagtggaagatgaggcgcctaatcagctgtcaagggtgatgggacacgggaggaggtcgtcactaaacagactttgagccaggcctgttaaaccaagttctcagcaggatgtgcacagagggcccaggaggagcctcaggagccggactgccgttggccaaccggtgagtctgttatccgtcagtggacactctgcttccaggtgccttggcctcggcccgcgtcctgaaggcgggagacgttgcagccacgtgctggccttcccggtgctcctgccagcgtcccgctgcttgacacagtccaagttttgtatccagacccagcctgggacagcagcctcccgacagcccccaggcccagcctgtctgtgacagtcacgcctgctcagggaaccatccctccgtgcagatctgggctgtgttttgggtggtacctcgggtgtggggtcccctaccaggtgcgaggttcatactccccaggctgcctcctgtcctcagggcttggagagtcccatgttctgaaaatgacctcttttcgagccgggcaaggccgcatctcctttggcagtgtagtgtcttccctggaggtggcattcctttttgatttgccttctgtgcttgggaacctcacttcctcactctggccagctctgccagcagtttggagctggttcagcgccccaccgccctgccttggcctgcgcccggccctccagggtggcttctcgccagttcctgtcaggcctgcctgggcaaccaggcctgggcacctccctgtcccttgctcagaaaacccacaggctgtgggggcccgggagccaagcctggtgcgcgggcaggaaacgcatcctggagcaccagcttccctgccctgcccgcctcacggggtgcctgggggcgtgcctcagcctgctgctcctgtagtctgttcctgtctccctgagcaggctgaacatgggcatacgagtgaccagcgtgatcgtgtccaggccagtgccgcattctgtgtggtccaagggaaaaccttctccaagtccacggcccgccctttcctctgctgggttacggccaagggcgccaggcctcactggaggacatggatcctggacccggccctcgaggctgctgccttccagtttccccatgtcctggacactcttggtctcaccatttgggaggccgacaggggatgcagagtggcctgttggaaaggccttatgtgaccccaggctgagtccctgagcagcctgctgaggccggaggggagaagagctgagcttctcccttgctgggccaggctcgggctgtggaatggctgccagctcccttcctgggagaggctgggtggggtccacagcaccttcctcccgtcccacaggaagctgtcttctgctgttggctgctgggggcgactgatgtttggatccctgagcaccctgccaatcccagactcaccttcccactctttccagagtccccagggagacacttaagggaaattaaactgcagagtgcaagagatgcctcagtcaagtcagccaaaaacacgcgggtcatccccaagccccagagaggtgagtcgggcagggcactcaactgctgcaggaggatggtcttatttctagcactttccacaggaggtaaatgtggtgggtttggggggtttttcaaatgcatcagtgtctggaatgggttctaagctgctaaataattcttagaggtaaatgacagacatgttgccctagatgtagctagacagccttccctctacagtgaagtctcctccaccctcagtgacagagccccgatgacacggacacctcggctgctgtcacttccctggttcgggcctcccacaggctttgaattgaaggcgagtgcctcagaatttgcatccattgttctgtctttcctgggaagttattcatcctggtggccagcccaccgacaaaatggatttggatctactggacctgaatcccagaattattgctgcaattaagaaaggtacatttatttctatttacataaagggtgtgggtgggtgtgtgcagtttatataaggcaggttaacaaaacgctggctggctaagccttccttcctttgcctaccctgattattaaaccgagggcgggatgtactatgggattttcaggtgtgtgtgtgtgtgtgtgtgtgtgtgtgttcttaactacatggatttctttcagttacttttatttttatcaaagtaatacatgcatattgtctaaaaggtaaaatggagccacataaagtcttttagttttttttttttggagacggggtctcgctctgtcacccaggcttgagtgcagtggtgcgatctcagctcagtgcaagctccgcctcccggggttcacaccattctcctgcctcagcctcccgagtagctgggactacaggcgccagtcaccacgcccggctaatttttttgtaaatttagtagagacagggtttcactgttttagccaggatggtcttgatctcctgacctcgtgatccgcccgcctcagcctcccaaagtgctgggattacaggcatgagccaccgcacccggccgtcttttagttatttttttaaaaaatatttacatctgggctcctaaacgtgtttatgttgtaatgtttgatttgtcagtgttactgattatccatggacttctcttgggggctgtgaggactgagcgtgcctacacctgtgtaccccaacttcctctccccccagctccctgcccatacttagaacctagtttgggtgacatcagctgtcagggttgtgactgggtgcatactggccattgttgaacctggtgtggtggtgcaggggatggttttctttcttacagcatcttttttcgcccgagttagtaaatgctcaaaactcaggccccacgtgcagcccctgccccctgctccccatgccagccgcctggctgtcatccggggaccctcctgccagcttccatcctcccccgtctccccgggcctcagctacgtgaacctcagcacgctgtctgtggcgagaagccggagtgctcatggagctgccgcagcagcctggtgacagggcagggcctcgctgtcctgaccctccatccttggctgttggtttttatcctcctgttggtggccttgtgatcacagctgctgccacagctgcagacacgacgcttgcagaccagggacagagaagggctcagccagggagttcctttctcacctgtgtctcttatccaaaaaccaatgtttccagaagtccctgcagacttcacggctgtgaagggggctggggctgtgaggcttaccagggggagcgccctgccacagccccgatcccggtgagtcctcagggcccacagagccttctggagcagcctgtctgcgggaagccccctccgctggatctggtgaaacccaggggcgctttcttcattcccacccttccatctccttgtgttttctgtgtggcttttctgaagatcacaccagtgcttactgttttccagccgcacaatggttgtcttttcactgcagcgttcagcgcacccgtgttgagggggtttctgatgtggtgggtgtaagtccccgtggccgggtggggcgcttcgtccaccactgctccctctcgtgtgcgcttcctcgcacttccctgatcggctgatcagtctgcagcatttgtcgtctttctacaagtttgaaattagaaagtgatgcacttatctgagtccaaaattaacttccttgccctcctccccagatggcaggtcctggggatctgcacccctgtaactgctgccaccgccgttctgattcgcacatgctctgccccctgccctgactgccctgcgcagctggcgtttggacctgggctctgctaccctcccagcgctcccctccccagggcacatgtcctctcccgcggctcagcccagatccatgcctggtgggcgggtggtggaaagctcggtgctggttttttcctgcccccttctggagcactgtctccagctggcatggaactgggtgcctgtcgtttcttctcagtaccggaacctgctctcagcaccgggacctgcccagccctgtcttctggcttctgccccagctcacgaggctggtatctgtccgagtgccaggactcagggcgcagtgtccagcagccctttcctcgtgcctgtgcatcggccacactgtgtccagggtttccagggagcaggggatccggtccctacccaccttgtccccagaatcggaagcacggtgctctcacagtgctcttaacaaagcaccttttgtcactgtgttgccctgcgttgtgacagtctgacattttcctgtaatttatctgtgttatttcagccaaactgaaatcggtaaaggaggttttacacttttctggaccagacttgaagagactgaccaacctctccagccccgaggtctggcacttgctgagaacggcctccttacacttgcggggaagcagcatccttacaggtaggtgggccctggcatctctgccaggggtgacatgtggctccagcatcatggtcccagtggtgcagggcaggggctgtgcagacttcacccagggaccagcctcagggcgtgtggcagctgctccagccccagagttcccatcttgcttgtcctacacccatggggctgtggtcacagcatcgggtcagaagatgcgtgaggtggacacgggctgtgggacctcctggggaccttgctccatggaccagaggagggggtgcaggaagcaggggtggatttggcagtcagcacccagagcccttcaggctctggcagggtgggaacggtgtgagatggggccctggccacggtcccaccaccacgtgtgggaaaccaggtctcagcaggggaaggaggtacccagggaaccccatgcgcctggacggacaaggtttccatccctgcatctcagcaggccctagtaggcagcggggtcctggcatgagcagggccctctctcccctgcaggtggctcagtggcccaggccccgaggaacgtgctgaacttggggctgccgtggtgggcaggtgccacggccacacacacggtgctgtgggcagggctctgggcaggcctcacagtcagggtggcctgctccacctggacggggtgcccaaggcagtgtgcagactccaagggaggggctgctcctcccggcccaggccccaggccaagagcgcagcctgcaccgcatgtcccaccttgagccttgccctgaggggcttcggtgtcgtggaggaggctgtgtcaaatggctcatccaaggccctttagccaagaggctgagaccagcattgctccagaatggtatctgtcacagagaactgacggcatgtggtgtgcatgtgtgcgcgcctgcgggagcccattaaagccgcttgagaactgttcagcaccccagggcatcccagctggacagagctgtgcctttttcttcacatggaggctgttagggagcgcctcggggctctctggaagctttggctgaaggcgtctggtgctgcaattgccccatagggggatccctgcgggcatgtgatggtggccctggggctccccctgactctgcatctcaggtgcacccgcccttcccggctgggcccccctccctgccctcagcaccttgctcacccccatgaccgcaggcacctgtgctccagccacactgcacctggcacaggcaggctgaccatgcctcccgcagtccccagccctgcccgcaggcccaggagagtcaggcctgacactatccctgccctttagcactgcagctgcaccagcagaaggagcggttccccacgcagcaccagcgcctgagcctgggctgcccggtgctggacgcgctgctccgcggtggcctgcccctggacggcatcactgagctggccggacgcagctcggcagggaagacccagctggcgctgcagctctgcctggctgtgcagttcccgcggcagcacggaggcctggaggctggtgagtggccaccccttccgtggggtctgggcaggtgggcggcccctgctttgtgtgggacagctttccgttgaggtggggcagtggccgcctcttgcgctgttcctaccattgcgtctccctccttctcaccctgattgccctcgctccttccagaacagggagggggaagtgaggctgggctcagctgacagcaggaggggtgggagggtacgaaccccaccaccaggcagccggccctcagcagagctaggcccccaggggtcgctggctgagcacagcgatgccggcccacgttccgcacagctgccaagcccagagtccacagagccagcaacgcagggagggcagcacagcctttccccgggtgccccgccgccaggccaggtatgctcctggcgcggccccgtgagcctgtacgctctgtctgtgaaacgagggttccctgcattggactaaagcgttcagagcatgcctgcctgggtctctcaggtgttaaaagttcacgtagttttaaactgtgagctgtgaggaggagagatgtttctcagtagctccttaacttttaaactaattccctggtgtcaacatgcgattcccacgttgtcttaaactccacgtgaacagagtggcagtattttttcatcggtggcacctccgagcacatctgctaggctcacttcccacacagggccggaccccaggccctggacccacaggcccagccagccacctcctcacgggcctgacctgccagcagcggtgtggctgggaacctcacctctgccaccctcaggtcagcgtcatccccaggacccagggtgtgctgtgcctgcctgagcttcagtgctgggtggagggtgaggggtctcctgagcctccgtgtcgggtggagggtgaggggtctcctgagagcccagctggggtctgctcacgccacaggcatttttgtccctgcagcccaggggagggcaccctcttgtcaggtgcctgagtccctgcggctggtcttggggatgagcctggagacagccagaagccgggaggacaggagttggccttgaaaatgggagtctcccgcttaccgcacggaagagctgctgtgaggtggaggcgggactcgagcgtgctcaggaacgggacgggagccgccctcattctccagcgtcctccgtgccaggcttcgtgcaaatctgatttgtgcaatgactccccctcagcttccaccccgttggccttttcagtgaagcccacactccccgatacccagggacacagaagccttaggacaccctccctgaatcccccagctgtgcccagcccagtgactgctgcgggatgacagcacagtccagccttgcgggccaggggaagggagggggccccacggccaccgtgaccacatgcaaggttaggggtcagatgtgctttcctggggaaatgacttcctttcctggatccaatctaaaggcccgaattttgaaaagaaagcggcaggcgggctctgaagtgattccgactcccgtgcttaagccgcgtgaggctctcccaggcctgctggggccccgcccaccgctgggctgtccacagccaccctcctgccagcttcacgatgtccccatgactgtgcagcccctacataacgtcaccccaacaaaaacacgctgcttgaccggttccacctgcttccgagccttccagcccagcctctctccagccaacaggacggaggaagcccagggccccgaccttcctgtggctcctgactaggggcacagtcactgctggggacactggtggggaagggaaccagccacaaaagggatgtggcctcccaaggcagtatttatacgttcctggcctcaagcgggccagatgcttctcagaagcttagttctgacacagaatggggcggggggttcctgacccatttttgcaactcttctttacgtttgaaattctgtcaaagcaaaatcagctcagaattaaaggttacgcggacactcacaaacaggctgcatgacacggcgtgggggcactggctctcccacaactgcatgtgccactgcaggaacaggacgacgccccgtgggccacggggtcctggctgggcagccttcctggcatagtcagtgcttagagagctcgccggccttgtctttttgtttttgttttgcaggaaactggagttttattattactcaaatcagtccccctaagccttcctgttttttaaattgagatgtaatttacatgccataaaattccctctaaaagtgtacagttcggcctgataggcgcagtacctcatgcctgtaatcccagcactttgggaggccgaggctgaggcaggcggatcatgaagtcaggagttcgagagcagcctgaccaacatggtgaaacccagtctctactaaaaatacaaaaattagctgggcgtggtagcgcacgccttgtaatcccagctactcagaaggctgaggcaggagaatcacttgaacccgggaggcagaggttgcagtgagccgagatcgcaccactgcactccagcctgggcgacagagtgagtctcttgtctctcaaaaattaaaataaaataaataaattcagtggcttttaatagaagcacaaagttctgtgcccgtcaccactatccaattccagaacagttccctcaccccaaaaggaaaccctacccatgagcagtcagcccccacccccagcagcctgcctcccctttccctacctgtgactcttcctgtcctgggagctccatgcaagtgcagccggacagcacgtggtctcgtgacaggcttcctgcattggcattgtgttttcgaggttcatccgtgctggagcaggtgtcagaactgccttcccttttaagattcgatcatcccactgtaaggatgggccgcacttcattcgtccactcctcagttgatggcctttgggccgtctccccccgggctgtcatgaaacgtgctacggtggacgttctttctcttgggtatctacctaggagtggggctgctgagtcatgtgatttgtttaactttttaaggaagtaccgattgttttccgagctgcaccattttacattcctagcggcagtgcacaggggtcaggggtctgcctcctacacatcctcaccaacacgtgtcttttcaagctggctttttgaatttcaccatggagcccagattgcaggagctttgaagagaggaaacgcttgctcagtgggggccttgagggtggccatgtgtcggggctcaggggccatttccagaaggcgttgccctgatgctgccacttgctccctgccctgcagtggggaacggaggttcacagggggaaggaggggcagggtggagcaggagaggcctcccatctgtggccattccagcccagggcccaggacaggggaagtccttgcctgggtgtcagaagtggagacccagcccatattcctcctgaggggtcacctggccccggaggtggctgccagtgggagggtgagaaaaagcaccagcctcctccctccccaggcgaggggcaaagaacctgtgaggggcagagagttagaaatggcgggagacatctgcacttgatttgtgtggcagtcacaggcccgtctggagtcccctgggcacatcaggcactcttgcttcccaggagccgtctacatctgcacggaagacgccttcccgcacaagcgcctgcagcagctcatggcccagcagccgcggctgcgcactgacgttccaggagagctgcttcagaagctccgatttggcagccagatcttcatcgagcacgtggccgatgtggtgagtgtgggagaagccccatgacacccccaaggcaagctattcaggaccattggggcaggtgtagccaccacggcaatggggtctcacagcagggcagggagagttggggctcagctctgaacacagcatgggtcatgggggtttacgcccgaggagcaggtggggtcagaggatggagagtgactgagaggaactggcaggggagggaattctggctaaagcatcctgccaggacccttgctgaaggtgtgccttggggatcagacggcctctggggactgtggaggatggaccagtcagctactgagggcgactggatacggagagcaggggtcctgctacaatctcagcagggattgccaaaactggatttcatgaggacgtgcacagatgggcctaggaggaggctcaggagcctgacggcagtttggccaaacagaatcctggccaggagtggctgtgggccaggcaggcagggcggcaggctgcgacacccagttacatctgaatctcaggcagctttgaagcgtgttctagaatgaggatgcccatattcagatcaactttcttcatgatctgaaactcagatgtaactgggcgcctgtacaccatctgtcaaccttgcccatgaagacggagtggggaagagaagccccaggcgggtggcaaggacctcctctgggctgtgggcccctgaccagctgccccaggagaccaccgccctgagaaggatgcgacctgctctccaggctgctgccctggtgagatagctgtgttggtttccccttgcccctgaggggaagacggccctcactaggggcacaggggctccacctggccaaggcctgctgggcacccagctcagacaggtgacctcagatccttgaccactgcctggctgctggcttccctgcagacactggctgggcttggaggagggacctatggcagggccttgcagagagcaggggccactcaccgggggccagtggagtccgtcctgtagccaagaagcaggcaagagaggctgggacccatccctgcagctggggcagcagtgctgtgagctgtcagtgcttagtttatagacatcatcctgggagggagaagtgatgaagtagaaaagacgcagaagaaaagatgggacgtttgggagtaaacccctgaccaaaggcaagtaaggaaattccaccctgtgcagggggagcggctgccatgtccagcccaccctagacatggctgtggcctggcagagcagctcctgggtgggccttcccccacttctcttttttttttttaagacagtctcgctctgtcgcccaggctggagtacagtggtgcaatctcagctcactgcaagctccacctcccgggttcacgccattctcttgccttagcctccagagtaggtgggactacaggcgcccaccaacacgcccagctaattctttgtatctttaatagagacggggtttcaccatgttagccaggatggtctcgatctcctgacctggtgatccgcccacctcggcctcccaaagtgctgggattacaggcgtgagccaccgcgcccgccagccttcccccacttctaagaggtcttataaaaactttcaagtaaagcataaggcatataaacttttaatttaaaaaaatgtacaataaaatacgttatcgcacacaacgtgaggaagttacacatgggaagggagccgtgggcccagctcatgccccaggtctcctgggagagaccacgccgcaccagggcaccagcttaggcccagccccagccccaaggtcacgccagccgtgtggttattagtatcatgtcctatgcacacagacgcaggagaaatgagtgagcgctgcggctcccggccaggggccctccctgccgccctggctgtcccgggccagctccgggccacactcggcagtcccatcctggagcggggccaggtcggggtcactgcaagagaagatagaaggtcagggctgggccgccaaaacctgacagtgttactaagttctgttctggaaacagctctctggggaacccccaccccaagtctgcctagagaagagggtgttgctggttgtgagcctccctggggccgaggggtcatgggggactggtgcgtctttggtctctgctccctggagcaccaaaggcctgcgtctggcacgggggaagccaggggtgtggacacagagccttctcttgcataagcagagcctggtgccattcccacccccccactctgtggcccttgggcttgcatgaggatggggaccctgagccaagcccctcttggaggcccagcctggcagctagcagcagtcaccacttgcccatccccagctccccccagtccctgcatgtgcaaagtccctccctggcccagctgcctgcttcctggggctgcaggccgtgggactcacgttagcggtggcgtcttccaggccactgctgctgctgtcgttttccacaaaaagaggctcggccagagacgccctggagatgaagcacagacgagtttcactcagggcgtgcaggcggccctcaggcgtcttcagagctccgggcgtgacaccagcgtgtggctgcagaccttggacttgagggacagcctaggggccccttagcagcctccatctggccagagctgctggcaaggcccgtggggcctgaactacactgcttggtgccaggagcagctgtgtcaccctcccccatcaccatggctcaccaagctgtgcggtcagaggccaggccagccatgccaatggctctggcacccacaggccacggcagcacccagagggaggccgaggacacctgccttcactgggggggtcctcccctggaagctctcctgggagctggtgggcacagggctgtttccaccccttggccaggccaggccagctcagagcacagggctaaggcctggatgcacgggaggcactggccttgagggtgtctcaacctacagccccatcctgacccccaggtggtctcccagagtgccccacgccttggcagaggcaggccaggcctgactcgcctgagtaacgcctgaagggcatcaggcccctgccttgctgagcgtctgaagaggtcatggccaccacgggctggctttggtggcactgtggccaggtttgggtggtctgagtacctggtgcggggccactgaaggagggggctggttgctgctgacctgtgagggggagagggtgaaaccatggcagaaggagagcagacccccgcaaggactcaggagcctgcgcaaaggacacctctacagaggacggtgttggcacagccaaggggtgactgcctgggggggccagaggaaggacatggggccaagggaaccagttgtgtgagcctgaagcttctatagttggggcctctttgagaaaaatacagaattgggctcagagtatggggactacagagtatgggcactgtgagccccaggtgggtaggaaggttttcagacggtcgagtgacagtccaaacggggtctggtcacctggggcggggacttgctgaccagcatagacaatgacagctgtccccacaggacaccttgttggagtgtgtgaataagaaggtccccgtactgctgtctcggggcatggctcgcctggtggtcatcgactcggtggcagccccattccgctgtgaatttgacagccaggcctccgcccccagggccaggcatctgcagtccctgggggccacgctgcgtgagctgagcagtgccttccagagccctgtgctgtgcatcaaccaggtgagcaccaaggcagggttgcacccctgagctcgtatttttagccaggatgcggaagcagagccggtctggaggtggggcgggtggcagtgaggtggcctccggctcctgcgggtagcagcctgtgcctaaccatcgagaagaccctcagccgttgcagctgacctggactgtgctcttccaggtgacagaggccatggaggagcagggcgcagcacacgggccgctggggtgagtgcagccatgtggtgtgtgcacctctgtgcaggtgccaggggcacagctgggccgaagtgggcggggccaccaagcctgagcgccagcttgcctgcttcctgtttctcaggttctgggacgaacgtgtttccccagcccttggcataacctgggctaaccagctcctggtgagactgctggctgaccggctccgcgaggaagaggctgccctcggctgcccagcccggaccctgcgggtgctctctgccccccacctgcccccctcctcctgttcctacacgatcagtgccgaaggggtgcgagggacacctgggacccagtcccactgacacggtggcggctgcacaacagccctgcctgagaagccccgacacacggggctcgggcctttaaaacgcgtctgcctgggccgtggcacagctgggagcctggttcagacacagctcttccagggcagcggctccactttctcatccgaagatggtggccacagactgacccccatctgagctggggggatgttctgcctctccctgggtctggggacaggcccgcttgctgggtacctggtccccactgctgagctggcccttggggagaggtgattctcagggctggagcctggggtgtcctacagtgactccctgggagccgcctgcttcttctctccacatggaagcccaactggggttgcgtctgaggcctgccccctgggctggggcctcagaccccctcagccttgggaccgtgcccacgagggtctcccctcctgcacacagggcagtccttactcccccaccactcaggccacagtggggctgcaggcaggcggctcctcctcacccacctctgggtccttggctcccgggggccccacctcggcacacactgtgccccacaaaacttcagtgtggtacaaggtggagaaagcatatcccaccaacctccagtgtcagggtccaggagagcctgggggtggggggactgccttgtctctagtagtgtggcctgtgccagcaccacagccggtcagaggagcgcaggcagcgcagggctggcacgtgacaggctcgtcagccacctgggaacacagttctgggcaaagaggatccgaggttgagaggaaggagggtcccggtgtatcctggccctgggggtctgggcgtccagctcagccctggcctggctgggtggtattctggtagggatatggcaggactcctggcagggccacctgcaggaccctgtcctgcagtcccacactgtgcagacccagtcccacactgtggccaggccttacatctggctggaaagcagagcctcctgggaacacatctggctgcacaggctgaaatatccacccagcaggcagagtggcgtggcctccccatgggcacagtggtgacccccttgattcccaccgtacaaccccctccaccccccactcagtgcctccacatgctgcctggcacagaccaggcctttgacaaataaatgttcaatggatgcagttccagg

SEQ ID NO: 516 - DNA, 43567 bp, Homo sapiens
agcaaaccaatcgcaagcctcgttgagtggaaggggtgggatcttccccggaagtgttggttaaagcccctccaatcagcggctcggtgcggcaagtttgaatttcgtggaggctcgggttgtgagggttcctgcttcggagtcggcggtggtcgtccagaccgagtgttctttactttttgtttggttgaggtttcacgctagaaggtggctcaggtaggtgggtgctggagagctggacggagaacactggcccgcttccgttgaaggtctagaagggtctgaggaccgggggctgcgagcgggagcaagtcagaggcaggctcctttaggaccgtgttacctgcccttcccgaagctgataatgcgagcctttagaagagtccatatgtttgccctgacctctgtaatagtcagcgtttcaccaccggggcgtaattgacctttggggtgaaactgttcttcactagctccgacattaaattcccgtagctcttcccaggtcccatggcaactaaaaacgcccggttgagaacctctagtcaagcaagattaacgcattctggactttcaagctggaggaaacgccactcagccaaacaaaatttaggtgtgtgtggagccagggctgccttgcttgggatcccagcttcaccaccttttagatatgctaatgtgagcagttaattgacctcatctgtatgagagcgataatagttaactacctttcagggttattctgataattgtacctttaatgttgtcctcgctcgctctttctcttgctgtggatagtgctatcctgtatttaatacataagtcttaatttttcttcaatctttagcgaattaatattgcaggagataaatagtagaagacagttctttatgaaaagcacagtccattgtcactttccttgggtcttagaggagaatgttattagcatgcaggtcagacagattctcgttttttatattttgttgattgcttagaatcatgtaacaatgtattgcattacttgtgccaatttttctattatctggagttttctagtggatttagttaattcttgttgaagaatataccatagtgtgtctatcacagagcctcccccttacctttttttgtttttgttttttaactgccaagacttctgagaatcagtatcctttctccagtttggcttggtagttctctataccagctacacaggtgaccccctcaaactttctaattttctttgttctccctagttggatctactgacgtcgtctttattgtcctcttttgttttgcttgaatacattctcaaagatctttccaagaaaaaggcatgtgccaattaaactatatgattttgtgcgtgtgtgtgtgtgtgtgtgtgtgtgtatggcttttcttttttaaaatttatagagacggggtcgtgttatgttgcccaggctggtctcaaactcctgggctcaagcagtcctgcctcgacctcccaaagtggtaggattacaggcctaagccaccgtgccggcctaaactgtatgatttcttgtatggatgaaaataatggagcaaactgatagggttattgtgaactatatatttggtcttgttctgttttctggcaaacaactactaaaatccttggagtcttcaaagtggtacctttttgtatgctaatgattgactgatagctggatgcctctaaatagcttcaggattggggctggtcactagacagaccaaggcaggatttctcgagagttggcattttcagccccacctcacaacctctggggaggggagaggagctgaaggttgacttgatcaccagtggtcaatgatttaatcactcatgcttatgtaatgaagctgccataaaaaccaaaaaaaaacacctgtgtttggagagcttcttaggtgaatacatgaaggttcctaaacagtggtgctacctgagagagcatggaagctccttgttcctttccacatactttgccctgtgcctctctatccaactctatctgtatccggttgcctattgattatccctatatgactaataggtacctggtgtggggtttttgtttgtttttggttttcttttggctttagaagaaatgttagactacctgcattcctcatcatgggtaaggaaacccttgtgtacatggtccttcacttaacctattttcacctttatttcacgcttttctttttgcagtgttctctgtggtaagcccagagcctcttttattctggactatcacttactggctttctcttcactggtcaagcaagttcctatttaaaacccccaaataggtagcttcttattctctgataatcttcttctcacttttcagtgttacatatttatttcattgcacattttatatttttatttcagaaggccctgaagtgggacaggaaatgaactgtaatcttaattttttaaataatgaaaattcatgtaagttgggttttgtccttttccttgacaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagggcttgttccagaaaagaccaatgttaagccaagtaagtaaaggtctgttgtaattttaagtactttgaagagtgaataatagttggtttaatgcctgtgtgagtaaaaaactctggccagaagagttttgaaataccattctataaataactttcctttttggtctttttccttttttttttttttttttttttaaattacaagagacagggtctcactgtgtcacccaggcgggagtgcagtggtgtgctcactgtaacctcaaattcctgggctcaaggaattatcttgcctcagcctcccaaagtgtggggattacaggtgtgagccaccgcgcctggccccttaataacctgttatctacaactaactactgtctttaaggcaaaagcctttacctgtggagtattataacactttattatctatattgcttcatagaaatcctaaagttcttacggagcttgggtaggataagtgttgacaagataaattgataagaaatgtaaaaatagaataattaaagaatccatgaaatgagagtactttgtcaatggaaacattagtaagaaaagagcaaagaattcatccttgcagtttgcccagaaggattgggaccattaggatggaaagaaccaactaaagaagaaaggaataatctcagaaaaagatgaaaatagagcatcttagaaggcaaaggatgctacagaaaagagaaagcaaactgagaaatgacttgtgtttagtcaggagtcaccctactcctatttgttgtgttcatatagcaggcgttaggagctagatggcattgaaataatgctaggataaatagggaatggcagaaagaaccaaacattttttatctgagaaagggtggttcctttctcatcttgtcctctcaaatgctccatttcttaaccaaaaatctttcaaattaaagtctaactatctcagtatgctattaaaatatcctttatttcccgtttgcaaaggcttagaggtaggagtgtgcctgatatgttttagtgaatgcaagtaggtaactgggtagaaaagaatgagcaagggagatagattacatagaatcctaaggaccatcattataaggacattggcttttactctgaaatgagaggccattaatgggtgtttatgtaatctgattcatgttttaaaaggatcgctttggagtcaggcctgtagccctagctactccagaggctgaggcaggaaatcttgagctcaggagtttgaagcttcagtgtgctacaatggtgcctgtgaaaagtcactgcactctggcctcggccacacatggagatcctgtctcctaaaaaaaaaaaaaagaaaaggatcaggtcgggcacagtggctcatgcctgtaatcccagcactttgggaggccaaggcgggtggatggcgaggtcaagagttcgaaaccagcctgaccaacatggtgaaaccccatctctactaaaaataaaaaaattagctgggtgtggtgacacacacctgtaatcccacctactcaggaggccgaggcaggagaatcgcttgaacccaggaggtggacgttgcagttagctgagatcacgctattgtactccagcctgggcaacagagcgagactccatctcaaaaaaaaaaaaaaaaaaggatcactttggctgctgtgttgagaatagattatagggtggtatgtatgacatcagggagagcagtaagtagactactgcaataacttagttgatactaaagtattaaaagacaaggggccagatgcggtggctcatacctataatcccagtaccccaggctaaggtgagtggatcacgaggtcaagagatcaagaccattctggccaacatggtgaaaccccatctctactaaaaatacaaaaatcagctgggtgtggcgcgtgcctgtagtcccagctacttgggcggctgaggcaggagaatcacctgaacccaggaggtggaggttgcagtgagccaatcacaccactgcactccagcctgggcaacaaagtgagactccgtctcaaaaaaaagacaagggaaaactagtaaagaaccaaggaacaatgcaaagtaatgtaagaggataaccagaagaacgtgctatcctagaaaccgagtagaaaagtgcatatcgaggagagactgattaactatgttagtcagtactgcttgttagatcaagtataatagaggtgagaatttggacttcaccactgtggaggtcactggtgatcttgaatagttttggtggagtgaggttcagggagtgaaagattggaatggatgagtataatcaaacccttagatataatttgtagtctgtagaaaacatggagcctggaggaatgagtaaataaacaaatacagcttgcaaagacattcaataggaaaactgactaccttttgtcagtaagacaatggcatgaaaagaagagtggggaggaggatctgttttagatgaagagatttaaaaagacattcaaataaaacgtgttgctcttacttggttcttgatttaagtaaacagatggtttaaaagacctctttgaaacaaatagagacgtttaaatctggaccctgtaatagataacaaggaattactgctgattttgttaagtgtgatgatgatatcgtggctatgaaaggaaatgtctttattttattttatttttattttttgagacggagttttgctcttcttgcccaggctggagtgcaatggcacgatctcggctcaccgcaacctctgcctcccgggttcaagtgattctcctgcctcagccttcctgagtagctgggattacaggcatgcaccaccacgcctggctaattttgtatttttagtagagacagggtttctccatgttggtcaggctggtctcaaactcccaacctcagatgaaccgcccacctcagtctcccaaagtgctaggagtacaggcgtgagctatcgcacccttccagaaatgtctttattttttagaagtatatactaaagtatttagagatgaaatcttctaagcataatttgttttaaacaactgcagcaaaatgttcataattattgaatcttggtaataggtatatggggttcattataattgtgtgtatattagaagtttttcataattttgaaaagagagggaatgtaaagagtgttggaaataggctgggcttggtggctcacacctgtaattccagcactttgggatgccaaggtgggtggatcacctgaggtcaggagttcaagaccagcctgtccaacatggtgaaaccccatctctactcaaaatacaaaaattagccaggcgcagtggcgcatgcctgtaatcctagctactagggaggctgaggcagaattgcttgaactcaggaggtggaggttgcagtgagccaagattgcgccactgcactccaacctgggcgacagagtgagactctgtctcaaaaaaggccaggcgtggtggctcacacctgtactcccagcactttgggaggccgaggtgggtgaatcatgaggtcaggagttcgagaccaccctggccaaaatggtgaaactccgtctctactaaaaatgcaaaaaattagctgggcatggtggtgggcgcctgtaatcccagctactcgggaggctgaggcagtagaatcgcttgaacccgggaggccgaggatgcattgagccgagatcacgccgctgcattccagccaaggcgacagtgcgagactctgcctcaaataaataaataaataaaagtgttgatagtagagatacaggtaactctcttgaagaattttgccttaaatgggactagaaaaataagtgctagatgaggatgtaggttgggagaaattaccgcatgcttgtaacttcataatggcaacaattcagtagaggaaaaaatagatgagtaagaggataagttgctggaagaatgtccttgagtaggtgagaagaaatagagtacatctattataataaatagcacctataattgtattagttatcccaaaacttagcagcttaaaacaataaatattgattatttcatacaatttttgtgggtcaggaacttgggtatggctgagctgggtgattctgaagatagcagccaagatgtcatccagagatatatctgaagccttaactgagactggaggatctgcctccaagatgactgactcacatgaacagcaagttgatgctggcttttggaaggaggctgtagttctttgtcatgtggacatctccataggactgcttgagtcttcttaaggccccacatggcacctggcttctcccagagcaagcgacgcttcaagagagagcaaggcaaacactaccctagttttagaagtcatattccattattcctgtaatactctcttggtcacacaagtcagccctattcagtgtgaggggatgacacagggcaagactaccaggaagtgaggatcagtagagggcagcttggatgctggctatcatacaagttaattaatttaaaagtgaagtaataaatgcctattacatagcaagcagttaatatttgaacacatgaaggcaaaatgaatacaaattttaaaagactaggggttgaaataacttgtggttagagtgctaaagaattaacaagaaatattaaaagcatttccctttgtgcggagaggtcttgctttgttactcaagctgaacttgaactcctgggctcaaatgatccttccacctcagccttcccagtagatgggactacaggtgtgttactgtgcctggcttattgaaagcctttttttttttcttgagacggagtcttgctctgttgcttaggctggagtgcaggggcgcaatcttggctcactgcaacctccatctcctgggttcaagcaattctcctacctcaacctcccgaatagctgggattacaggtgaccgccaccacacccagctaatttttgaatttttagtagagatgggatttcaccacgttggccaggctggtctcaaactcctgacctcagatgatccgccctcctcagcctcccaaagtgctgggattacaggcgtgagccaccgtgcctggcctgaaagcattttttagcagcagttgaaatgacacaaaaataattgtttatacatttgcataacttttcatctgaaatgttttatatactgtgtggttttggttttttttctgcctaggggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggtaaatttagtgtcttaatataaaggaatagtttcttttatttggtattttcttcaagacattaagtgactaacccctttcccttagtctcattattaactggttggtagaaggtgggaatgacataatagtagctcagaagaatgaaaatcaggtctcttaagatagctgtaggtaagttgagataggataaaactaggaaaattggtagaatcaggctgaacaatgttatgcaaaggatttggtgtttatcctgtaggttttgcagaatcaggagaagtttataaataagggtagtgccgttgtcaaattaataattcaggaaaataccatagccctaaagattttagtctggaaagggaagcatttatagatagggagaccaattgtgagactattgtaatagaatagatggaaaggggcagtgggttttaaaaggaaaaaataggtgtaagacatctaaataaaggcatttgacaggactggtggccaagtagatggtgaggggtaaaggaaattgaaaaagcagagagaagctctgctgctaaaagagataaggaagataaggaacaagcttaagtgggtgcatgttaataacctttttaaaaatcttaaacttgtgtgggccacctagatattagtaaaaatttggaaagaaggatggaaattggtgctaagatgtcgatttaggatataatattgggaatatggatgagtgtttaagctgtaggactaaatgagaccattccaataaggatatataaaattatgaaaaagtgggctctagagagcacttttaggtaggcagaagccaggtaccaggctgaggactggtcagagaggcaggagaactaagagaggatagaagctcatattaatgatgattccaatacctggaaaatacggtttgaaatttctttctcactgagaaatgtgagtaatttttgaagttactaacttaatttaaatcaagctagaaccagaaaaaggaatttaagtatctttttgctataagagattaaggataaaatttaactttaaaatgggaactttattttgtaataagatatggaagtaaacctttaccagttcatattttaagttcatcttcttttgactgttctaaggctattccatcttctgtacggattacaaggtcaaaggccaaagaccaaatggagcagactaaggtatagttgatagtagataattgttactaaaatgataaattgcacttttttagtaagtaaattcattttaaatctagtatcagattcaaacataatgattaatttactagagttaacaggtaccaaagtcactgtttttagtatggtgatgtagagcaatttcacttaaaatatttgctccaacattccgtatgagatccatggcaaactgtctttgtgtcacactcttgttttgtttagtgggctcctattatgcattccaagttacctgcatgaaatgcatatggggaggaaagcacacagggtaggtgttataaacttacgggtcttcaaaatactgtaatagagatatcaggagggttactaaaacaaagtgaagtgggcaagaagggaaataatatgcctctttatcaggtgaggaagctaagttccacgtatgcatatatattttgcattgctatgatgttcctggtgttgtaggcttttggatataataaactaaattctctttgtggaacttacatgtaaggcatttaaaaaaatacataatatgccagaagatgataagtattatggaagagattttaaaaaggggagatggggtgtactagaaataggtatggggtagaattttgattgggcagttaaggaaggcctccctgagatgaaagccttttgagtgaagtcattatggaagtggagaagagaaccatgggaaagcgctttttatccaggagaagtattttctaggcaaaattaaaaggtcttgaagtgaaagtatgtctaggagtgtttaaggaccttcagaaggcaagttatagtgagctgtttttaatagcttgggttattagcattttccaaattctgtgattgtgaaaaaggatgtaagcttttttggaagcttaatggaaagcttttctttatctcattttatttggggtagttttttgttgttgttgttgggtcatttacgatgatcagatttcatatgaggaatcaatttacagattaaaaatatgatggtctgattcattatgcaattaaatcacatagcacctaatctcttaaatagattgataacgagagtgatgttcgagcaatccgacctggtccaagacaaacttctgaaaagaaagtgtcagacaaagagaaaaaaggtaggaatattagcaattactataaatcctctgaggctaccacagccataattttttttaagtgtcttgaaggtcaactggaatttgttcgtttgtttgtgacagagtcttgctctgttgcccaggttggagtgcagtggcacaatcatagctcactggagcctccacctcctgggctcaagtgatcctcccacctcagcctcctgagtagctgcaactacagacttgccaccatgcccagctgatttttatattttttgtagagacggggtctcactatgttgcctaggctggtttcgaactcctgggctgaagtaatcctcctgcctcccaagtagctgggactacaggcattgcactaccatgcctggcttcacagcaataatttcataactacaagggacatttgatgtagttatttttttttcccacagttgtgcagcctgtaatgcccacgtcgttgagaatgactcgatcagctactcaagcagcaaagcaggttcccagaacagtctcatctaccacagcaagaaagccagtcacaagagctgctaatggtgagaactattccttgatcagtgactgaactagaatgtttggtccttgaggtttttgtgttccgtttcaaaaatcaacaagtacttctttgagtaggagagaaggaaacaggaaattctaatacctgaaaatagattctgtgccctgacatctggttagcacacaatgggtgcccaatcattgaagaccttaattagtataagcagtgtttcaaagtgaaaaattaatggtccgagtaaatcacagttcatttatttggtgcaatacaacgtagccattaagaataatattattaaagaacacttaatgacatggttcatgatatattaagtgggcaaagaaaagcaggtcaaactctgaacagtaggatcgcagttctaaaaagcattatgggaatatgtggacataggactggaaaaccataccctgaagtgacagctgagtaatggaatcctgggtgatttgtcattattgttctttgtagttttctgttatttttctaattgtctgtaataaatatgtacaggctgagcaaccctaatcaaaacatccaaaattctgagcattgacatgaagttcaaaggtcatcctcaaaggaaatgctcttggagcatttcagattttagatatttgtatcaagtatgctgaacctgtaagtataatgtaaatattccaaaatctggaatctaaaatatctctggtcccaagcattttggataagggatactcaatctgtatttggtattcagatgaaaagggtaaaacactctggttttgaaaagagatggtttgtatttggcaggaaattccataaccctttttataatatggcttttaataaaaaaatccttcaagacatatattcctactgttgcttcttttcctttcccaagttacctagtattttcatgtagcatttctatctagtaaaataaatattttattgttgttttagaaaacgaaccagaaggaaaggtgccaagtaaaggaagacctgccaaaaatgtagaaacaaaacccgacaaggtagagaataaacatctttttaattctagatgctttgaaaatctcattgctactttcataaagttgaaattaaacataaagaactgcttcaaaaggttaacctacatgtgtgttaaaacttcctgaaccataagaaagcatcaagaggatttactcttgttatttttcaggtatcttattttcagagctttataggtagagaaagcataattttgttagaagatggagaaaaataataaaaacacagctgagagaaacctgtatgtgggaattagccaagacatagggtgaagtggggtgaaatgcattgactttggattcatttaggcctgggtttgaatactctctctgcttccaattagttgcataaccctgggcaagttatgtagtttatgagcttcttttcttattcctaacatggaatacctgcatagagtagttgtaagaattaaataaactaaaatttctgcctgcatctagcatggtttctaataaggtcttcaaaaaagatgccccatttgaggacccaaccccttggcctataatctatgatatagtttattttcttttattttattttttgagacagagtctcactctgtcgcccaggctcgagtgcaatggcgcgatcttggctcactgcaccttccgctccccgggttcaagtgattctcctgcctcagcctcccgagtagttgggattacagacgtgcaccaccacgcccatctgatttttgtatttttagtagagacgaggtttcaccatgttggccaggctggtcttgaactcccgacctcaggtgatccacctacttcggcctcccaaagtgctgggattacaggcgtgagccaccacgcctggccagtataatttcttaatttaaaaaaagtaccaaagattaagtaacctggctagattcttagtaaaaaatcaaacacagatcaagaaaggaaacacacagtgaatcttcacagataaagcagctggaccttataggtccccccttaagattaacccttaaggattatcactagtttttgctttgactgccatgctggcttcaacagtgttaccacttaaactcttgtccaggttgaaatacctgggtttgagttcatatcttattaaaaatcagaaacctggaaacctctagaaattatttaaataccaagtaacaaattgacttgaaatagtaaatatgctttgtattttatatggttaatcttttgtgtcacattgaaagtattgctcttgtgttaaggttatttataatctaaggttatttaacttaagaatttggtccttaatgatagtcattccataatgttagatttctgattttaaaccattgtaattatcaacataattttttttttgagacagagtctcgctctgtcgcccaggctgaagtgcagtgacacgatctcggctcactgcaagctccacctcccggtttctcaccattctcctgcctcagcctcccaagtagctgggactataggcgcctgccaccacgccccaataattttttgtatttttagcaaagacggggttttgctgtgttagccaggatggtctcgatctcccgaccttgtgatccgcccgcctcagcctcccaaagtgctgggattacaggcatgagccaccgtgcctggccgtaattatcaacataatttaagtaaaaagatacgtatttgttgaataagtttttccatattaattttccattatcttttaatttgttgtaatacccaaaaggtattagttagtctttaaataagaattggttcggggtgggtgcggtggctcccgcctgtaatcccagcactttgggaggcctaggcgggcggatgacgaggtcaggagattgagaccatcctggctaacacagcgaaaccccgtctccactaaaaatacaaaaaattagccgggcgtggtggcgggcgtctgtagtcccagctacttgggaggctgaggcaggagaatggcgtgaacccgggaggcggagcttgcagggagccgagatcgcgcgactgcactccagcctgggcgacggagggctactccgtatcaaaaaaaaaaaaaagattctattcccgggtaatagcaatggatttagcgtaactggtcttctgattccatgtatacacttaattgtatctgtttttgtctctcaaattatgtacatagaacatatatttctgttgtcatattttcagacctataaaaattggttgaatatatcctcagaagagagaaatcttactctactttgttaactcacatcctagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattcctttgcacctaaggattttatgtttcagccactggatggtctgaagacctatcaagtaacacctatgactcccagaagtgccaatgcttttttgacacccagttacacctggactcctttaaaaacagaagtgtaagaatatgatcttaataataagtctcttgctaagatgggtaataaatgcctttcttttttttttttttttttttttttttttcagacggagttcgctctgtcgcccaggctggagtgcagtggcgtgatctcccctcactgtaagctccgccacccgggttcacgccattcttctgcctcagcctctcaagtagctgggactacaggcgcccgtcaccacgcccggctaattttttgtatctttagtagagacggggtttcaccatgttagccaggatggtctcgatctcctgacctcgtgatccgcccgcctcggcctcccaaagtgctgggattacaggcgtgagccaccgcgcccggccaaatgtctttcttatatttggtctatgctcttaaaaagttattattagtgaactgtgttaattaggaatcatgcaatttttttctttaaaaaaaattcttcagaaggtacaataatgtaattgacagtttttatatttcctatgcattgttattttcactatacaatttgggttttttgtttttaataaatgacttaattataacacatacatttttcaaaagaagaaaattgctatactgctttagctcagatacgactttttcctcattttcttctggcttagtatttagaaaaactggccctgaagacaaaaatgattaatttgcaaaacaagggaaaaatcagttggaacctttaaaagaaaaggcaagatcattttgcaaagactggctggcagcaaatatactaaaaactgctcagcagcatctaagactgttaagtgtttatgttccattaagaaatcttcaaaatctttgaatctgattacaattaattagtaaaaatggacattcacactataggtgtttacattttctcccctccagaatacacattttaaaaaaatagaaacatttctattttagcccagatctacaagtgacacaattttgaaaccctttatattagatatatggagttcatgtttcatgaagtatatttttgctattgtttttagtgatgagtctcaagcaacaaaagaaattttggcacaaaaatgtaaaacttactctaccaagacaatacagcaagattcaaataaattgccatgtcctttgggtcctctaactgtttggcatgaaggtatagtatttaattaatttattcattttttagaataatgttaatacaaaaaatattttgctttcaggtatagtaattacatttttacttttctggattattacttgtcagatttgtttggagctctttttcaccatatcatttggggatgtgaactcagggtcagaaaagacgggaaagcatgggtaaagatatctgaagagaatattggaatgaagaatacagacagaagaggggaaataaatgtaaatttaaagaaaaaatattgagagctactttagaggaaatgtgaagtgattgaggcagaaataaaattttaaaattaaacattgaaaaggatttttaaaatgtctttttaggggctgtcattttaggaattgttgctttgaaatttatatgtaagattttctttaatttatagaacatgttttaaataaaaatgaagctactactaaaaatttaaatggccttccaataaaagaagtcccatcacttgaaagaaatgaaggtcgaattgctcagccccaccatggtgtgccatatttcaggtatgtctgtgtgtttctagtgtaagaattttgtattaatatctagacatttaaaaccaaaactaaaaatttttaaccttaatatagtgggggaaaactggtgttaggtgattttcacgtttaaattttaattatttttttgataactagtacattcatgtggttcctaattcaaagggtaggaaaaggtacaagtgagaagacttcttctcagcactgtgacccaaccacatagtttgaacctttcatgaaggcaagtgttactcatttcttgtgaatacttccatggatagttcatgcatatgtagacaaatataacatgtacatttttttcttttttaaaaaatatggacaataggctgggcgcggtggctcacgcctgtaatcccagcactttgggaggccgaggtgggtggatcacaaggtcaagaaatcgagaccatcctgtctaacatggtgaaaccccatctctactaaaactgtaaaaattatccgggcgtggtggtgcacgcctgtagtcccagctactcatgaggctaaggcaggagaattgcttgaacctgggaggcggaggttgcagttagccaagattgcaccactgcactccagcctggcaacagagtgagactccatctcaaaatatatatatatctatatacatatatatatcggggaatctgccctgatattcacgtaggttcttttctgttttccttaagcattggccagcttgagaagtaaagggacagagtacaaaaagaaattttaaagctgggcatccgggggagacatcacatgtcggtaggttccgtgatgccccacaagctgcaaaaaccagcaagtttttattagggattttcaaaaggggagggagtgtgcgaataggtgtgggtcacagacatcaagtactttacaaggtaatagaatatcacaaggcaagtggaggcagggtgagatcacgggaccagggcgaaattaaaattgctaaatgaagtttcgggcaccattgtcattgataacatcttatcaggagacagggttttgagatcaaccagtctgaccaaaatttattaggcgggaatttcctcttcctaataagcctgggagcgctatgggagactggggtctatttcacccctgcagtttcgacagtaagagacggccacgcccagggggccagttaagagacccacccccaggtgcgcattctctttctcagggatgttccttgctgagaaaaagaattcagtgatatttctcccatttgcttttgaaagaagagaaatatggctctgttccgcccggctcaccggcggccagagtttaaggttatctctcttattccctgaacaatcgctgttatcctgttttttcaaggtgcccacatttcatattgctcaaacacacatgctgtacaatttgtgcagttaatacagttattacagggtcctgaggtgacatacatcctcctcagctgacaggattaagagattaaagtaagtaaagacaggcataggaaatcacaagggtattgactggggaagtgataagtgtccatgaaatctttacaatttatatttagagattgcagtaaagacaggcataagatattacaaaagtattaatttggggaactaataaatgtccatgaaatcttcataatccacgttcttctgccatggcttcagccagtccctccgtttggggtccctgacttcctgcaacatgtatatatatatatagagagagagagagagacaacatatatctatagagagagacaatatcatacaatacacactattctgtttgcaaatcaaatagatgagaagtaagtatctcattatagttttactattcatttgttctattataaatatactttttgagagtgacttcatttctttcttttcttttgttttgaaatggttgcactctgttgcccaggctggagtacagtgatgtgatctcagctcaccgcagcctctctgtcctgagctcaagccatcctcctgccagtgggtggctaattttggtgtgtgtgtgtttttttttttgtttttttttttttttgtagagacgggggtcttatgatattgcccaagctggtctcgaactcacaggctcaagcgatccttttgcctcagcctcccatactgttaggattacaggcatgagccactatgtccagcttaatttcttttttagagcactgggttttagaattataagggattttagaggtagctaatccattgtgtcattccactgagttattgaaatattaagcaatctacctaactagataatgtcagaactaaaccatttctgctatctcttctttttttttttttttttttttttgagacggagtctcgctctgttgcccaggccggagtgcaatggcgcgatcttggctctttgcaacctctgcctcccaggttcaagcaattctcaggcctcagcctcctgagtagccaggattacaggcgtgtgccaccacacccagctaatgtttatatttttagtagagacggggtttcaccatgttggtcaagctggtctcgaactcctgaccttgtgatccgcttgcctcagcctcccaaagtgctggtattacaggcgagagccaccgtgcccgaccctctgcctccttattaatcgtcatgttgtgtcattgaatatgaacaactcaaattttttgtttttgtttctgttttttgagacagggtctcactctgtcacccaggctggagtgcagtgtctcgctcttggctcactgcagccttgacttcccgacctcccacctcagcctcctgaggagctgggactatgtctgtttctagcgtaagaattttgtatttaaaaaaaataaaaataaagaattttgtactaatatctagacatttaaaaccaaaactaaaatatttataaccttaatacagtggagggaaactgatgttaggtgattttcatttatcttttaaatacttttttttttttttgtatttttttttttaagtagagattggttttcgccatgtttcccaggctggtctggaactcctaggctcaagtgatctgcctgcctcagcctcacaaagtgctggctggaattacaggcatgagccactgagtctggccctaaatttttttttttttttttaaagaaacaaaacctgccgggttcggtggctcccacctgtaatcccagcactttgggaggctgaggcttgcagatcacctgaggtcaggagttcaggactagtagcctggccaacttggtgaaaccccatctctactaaaaatacaaaaattatctgggcgtggtggtaggtgcctgaaactctgtacctactaaaaaataactccccattcctcagccattccctcctagcccctggtaaataccattctactttctgtctctgattttgactctgctaagtatcttatttaagtagaattatgtagtatttgtcttgttttactggcttatttcacttagcataatgtcctcaaggttcattcattgtagcatgtgtcagactttcctttttaaggccgaataatatttcattgtatgtatataccacattttgcttatccctttgtctgtcagtggacacttgggttgcttccatgttttaactgttgtgaacagctatgaacatgggtgtacaaatacctctttgagaccctgctctaaattatcttgggtgtatacccagaagtagaattgctgggttgtgtggtaagtctatttttaattttttgaggagctgccatactgttttctacagtggctttgccgttttacattcccatcaacagcatacaagggttccagtttctctacatgctaggatactttttccatagacacaaattaaacttcttttaggcctgggtttctcaatcttagcattattgacattttagattgtatacttgttgtgggtatatatcctatacatcgtaggatgttttgtagcatccctggccagtagcactcctccagtcatgacaatcaaaaatatttccaaacaccaccaaatgttccctagaatggggcaaaattgacccagttgagaaccactacctttaagcaagcaaagcctaataattaggatctgtgaggccccatcactataatcctgggattaacagtttttagctttaatttactcttgacagttgagttggctttagtttcatagacaatgctgagaatctgatgcacatttaggaatgtctgactttgatcaacctctgaaaaagaacagaacaaactagaaatgttagcttaaaaagtaggttcttggtattatccagccacataagttttaggtataaaaggatgtacatacaaagggtatcaacttgtatttatggattttaatatatcacagtttataaataattcagtatcaactttgggaaaatattgtggctcccttttataacttcctaatgttatgtatcatgatgttatgctaatacttagctactagtgtaaaaaccacttgtagaactgaaatgtatgtcataattttagaaatatcctccagtcagaaactgagaaattaacttcacattgcttcgagtgggacaggaaacttgaattggacattccagatgatggtgaggcaacatttgtattttttgtttgctttgtttcttttactatggttacgtttatctgaaacataaaaatatagcattgcctaactttattgtttcattatcattcaaagtagcaagaattttttcttttttaacttgatgtctacaataaagtagcaagtgtttttcatatctcaacatatgttccctaacatctgtgctaaaatggtatataacttaaaagatgtaagtaattagaatattgactgtcgttcctttgacttagacatttttctaaccaaccaagcaagtaacagtgaatattattagctttttaaatatgactttatgggtgatatcaattgatatctgatattgtttacacaaaaatatactctgaatgaaaattacctaaatcaatatggaaaagattttctgaagagtttcttaatctgatttatttgggaagctgtttagaaaaaattatgtgctgtcagtatgaagtccttcttagataattatttgcagtgagttgtttgacgttgagttttttttttttaatttatttattattattattattttaagatgagtgttgctcttgttgcccaggctggagtgcaatggcgccatatcggctccctgcaacctctgcctcctgggttcaagcgattctcctgcctcagcctcccaagtggctgggattataggtgcctgccaccaggcccagctgatttttgtatttttagtagggatggggtttcaccatgttggccaggctggtctcgaactcctgacctcaggtgagccgcccaccttggcctcccaaagtgctgggattgtaggcatgagccaccgcgcccgcaggcatgagccaccacaccggctgacgttgagttcttataaagtacaacaagaagtagaatgctatttagtatatagcaatatgtatgagaaaatattgttaattttgagcaggaattgaagcaaatagttagtactcagtatttgtatgacaaagttttgtggtagatattttttgttttgcttaacaacctgtaggccctaggatgtttggagtgaagtcttatcagtgggctgacttgcaatgaatgtcccgttttgtcctttaattttaaaaaatctcttatttccttcagctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcaggtatgtggttcaatatttcaaatatattaacttagggcttttttttttttttttttaagtagcaggagtaaaatggggtaatagtagctgcttatgtacctgtaatattaaataagatgttataaagcactttgataaactgtaaaacatgatctaaattttatgactgatgtcctcttctcccatatattctcaggataattttttttttttttttttttttgagacggagtctcactctgtcacccaggctggagtgcagtggtgtgatctcggctcactgctgtctctgccccccaggttcacaccattctcttgcctcagcctcccgagtagctgggactacaggcgcctgccacctcatctggctaattttttgtatttttagtagagacggagtttcaccgtgttagccaggatggtctcgatcttctgacctcgtgatccacccacctcggcctcccaaagtgctaggattacaggcatgagccaccgcgcccggccaggataatttctatataggttgaaaactgaaattattttcaactctttaatagtctataatgattcgacctgtgagaaatgagtcaactggcctttggtagttgagttcagctaacagttactgagttcctgttgtgtgcccgtattgtattaatctcttattgtgttaggagtattgtattaggagttgataaaatagtgcattccctgtcccagaggagtttgtaatttgattagtgactgagatacaaaatataattctaacatataaattgctgtgatagaagaagttactaggaagatcagtaaaggtatgggggaagatgactctagcgttttgaacttattttagaaataagcatataaaatagcatttcaagaaccaacagccaacaatagacattgaaaaaagcttcaaacctaaaagaaaaaggccaaagcaaacatctaggaagagagctatttggatggacttttaaatgcaagtattcatattctcaaagagaccagacgtttcatctgtcaagtaaaaatacctgttagaaaaagaacattcagagaataaatagctctttgaagttaagcaatatgagaacagaaatgtaagatacaataggtagaatatgaagttaaggaaatctcagccaggcacagtggctcaagcctgtaatcctagcactttgggaggctgagatgggaggatcacttgagcccaggagttcaagaccagcctgcgcaacatagtgagagcccatctctacagaaaataaacttagccaggcatggttgcacatgcctgtagtacaagctgtaagacagaagagattagataagaaaattacatggaccagtccaggaaatatagccaaattataggaattccagaaaaagagaacagaaaaaaaaattggggagcaagtgaacaatgaaggagcctgttgagtgtttagcactgagtagacccacagcaacttacataattagatactgttatgtaactctgggataaagagggtaggctaaagcatccagggaaagaaaacaaattttatacaaagcatcaatggttagagtagcattgatctctcaacagcaatattatgaactagaacaatactctgaaaattctgagggaaattaacttccaacctggatttctataccgaaccaatcaagcatgagggtggaaaggcaattttcagacacacaagatctcaaagttcacctccttccatgtaccctttctcaggaaaatgagaatgtccttcacaaagatgagagagttacccaagaaaagaggagagtgggctccattcccagaaagaggcgagaccctgtctcaaccaaaccaaaaccctgagcaaacaaaaagcaaaacaattattaagtctaaagaaaacgttgtgaggaaggaaatggaatctcagcagctgtatggcccagacatgaatagtgtttagtcataattaagcattactttatgatgagtttttatatatttaccagttttcataatagttggttcactagcacccttcaattctgattgttagattctgtggtgatttttgtatcattattagttgcagatttaaaagtatgatatgtttacattgtttatagtcttttttttttttttttgagatggagtcttgctttgtcacccaggctggagagcggtggcgtgatcttggctcactgtaacctctgcctcctgggttcaagcgattctcctgcctctgcctcccgagtagctgggattacagatgcccaccaccacgccaggctaatttttgtatttttagtagagatggggttcgccatgttggtcaggcttgtcttaaactcctgacctcaagtgacctgcctgcctcggcccccaaagtgctgggattacaggtgtgagccactgtgcctggcctatagtcattatcttgactgatgctcatttcccagctttggcttagtgggagccacttcaagttggccattggggcacttttttttttttttttaaacacaaaagagctatatgaggtataatttacatatgataaaattcattcatttgaaatgtacagttcaatcatttttagtaaatttacagagttatgcaaccatcaccacaatccaaatttagaatatatatatgtatttttttttttgagatggagtttcactcttgttgcccagactggagtgcaatggcacaatctcagtttactgcaacctgtgcctcctgagttcaagcgattctcctgcctcagtctcccaagtagctgggattacagtcatgtgccaccgtgcctgtctaattttgtatttttagtagagacggggtttcaccatgttggtcaggctggtcttaaactcctgacctcaagtgatccacccgcctcggcctcccaaagtgctgggattacaggtgtgagccagtacacccagccagaacattttcatcagtataaaaagatgcctcctgcctgtttgcagtcaatccccatttctactcctagacctaggcaaccactaatctacttactgtctctgtagatttgcctttttttgggatatttcatataaatagaatcataccttatggtggtcttttgcatctggcttctttcacttagcatctttctgagttttatccatattgtagcttgccttgtgtacttcacacctttttactgctgagtggttttccattgtatggatatatcactattcaccaattgatggtcatttaaattgcttccactttttggtgattatgaataacctgtgaatatttccacacaaatcttagtgtggatgtatctttttaaatttctcttgggcagatgcctagatattggtaggtcatattgtaaatttatgtttaactttttaagaaactgcccaaactattttccaaagtgattataccattttacagtcccaccaacaatgtatgagtgttctgtttttcgacatcctcactaatacttattgtcttttttattatagtagcccccccttatcagcagtcttgctttctgtggttttagttacctgaggtatagtacaataagatatttggcagggaggagagaccacattcatataacttattacggaatattgttataattgttctattttattgttgattgatgtctatgcttaatttataaatgaaactttatcataggtatgtatgaataggaaaaaacatatatatagggttcagtactatctgcatttcaggcatcccctgggggtcttggaacagattctttgaagataagggggaattgttgcatagccatcctagtgggtatgaggtatctcattgtagggtttttttggggtttttttttttgttttttaagtcagggtctcgctctgtcaacccaggctggagtgcattggcacaatctcacctcactgcaacctccacttcctgggctcaaacaaccctcctgcttcagcctcccaagttgctgagactacaggcatgtgccaccacgactggctaatttttatatttttttgtagaggtggggtgtcatcatgttacccaggtggccaggtcttactcctgagctcaagcgatccacccttctcagcctcccaaaatgctaggattacaggtgtcaccatgcctgacctcattgtagttttgatttgaatttctctaatgagtaatgatattaagtatctttttgtgagcttattcgccattcatgtatcttttactgagatgtctgtgtaaatcttttgcacccatttttaaatttcattgtctttattattgagttttaagtattctttatgtattctggataaaagtcccttatgagaaatattatttgcaaatattctttgagtttgtagcttgacttttaatcctcttaatggcatgttttgaagtgcaaatatttttattttaaagttaaatttatcaaatttctcttttttttttttttttgagacagagtctcactctgtcgcccaggctagagtgcagtggcatgatctcggctcactgcagcctctgccttccgggttcaagcaattctcatgcctcagcctcccgaatagctgggattacaggtgcatgccaccatgcctggctaatttttgtatttttagtagagatgaggtttcactacgttggccgggctggtcttgaactcctgacctcaagtgatccacctgcctctgcctcccaaagtcctgggattacaggggtgtgccactgcacccggccattttttttttcttttatgttgtgattttgacaccacatctaagaactcttacctaaccacaagtcacaaagattttctcctgtgttttctcctaacagtcttacggttttagtacttacagttaagtctatgatccatttggttagtttttgtgtatggtatgagattgtgagtctaaattcatctttttgcttatggataaccaattttcccagcactgtttgttgaaaagactgtcttttccccgctgaattgtattggcacctttgttgaaaatcagttggtcatgagtgtaattctgagtcattttgacatttacttttttttttcctttgagatggagtcttgccttgttgcccaggctagtctcgaccttctcggttcaagcaatccccctgcctcagcctaccaagtagcttggattataggcatatgccacagtgcccagagacatttacatatttttgagggagagcaaagctaagaggatatgtgtgtataagtgcatagcatggagactaaaagcatggttaccaaactgttgtcagtggcgtaactcttcgtaggagactggaagtatcagaaagatggggattatatttccatcctattaaatacacttgtatcttttaaaatgagattatgtcaagaaaatgagaagacaaggcacagattcggagaaatatttgcaaaagatgtatctgataaaagactgttatccaaaagatacaaagagctcttaaaacccagcaagaaggaaacgaacaacccaattaaaaatgggcaaaagacctgaacagttacctcaccatagaagatatacagatggcaaatacgcatatgaaaagatgctcaacatcatatgtcattagtgaactacaaatcaaaacaacagtgagatactaccacatacctactagggaacagtgaaaattcaaaacactgccaacagcaagtgctggggagggtatggagcaatacgaactttccattcattgcctatgggaatgcaaaatgttatatccactttagaagacagtttggcagtcactcgcaaaactaaacatactcctaccatacgatctagcaattgcgctccaaatgagttgaaaacttatgtccatataaaaacctgcacacggatgtttttagcaatatagcagctttattcataattgccaaaacatggaagcaaccaagatgtccttcagtggaggaatggataaataaaaaaaaaattagattgtgttcacattgtgtaatttaagaaacaacatttaggatatcttttctaccattttagcattttagtcaaaaataatctaggagagttattcatgtatgatattctttatgtagattttggaggtttgtaagacgaaagataatgaaaaactttaccataaaaattatttgaacactaaattgagaatgactcagtccagttttaataactcatcatttctgaatcactatttttaatttttttttagtcttcagctcattcgtttataactttaatatggctagcattaatctggtaaacttgtgctttattaacagatagaagatgtaatccacaaattcaacaatctgatcaaacttgaggaatctgggtggcaagtcaataataatatgaatcataatatgaacaaaaatgtctttagggtaagtttgtgggttttatatccaatttttttttttttagttaaggaactgttatacatacatccaaatttctaatatagattcttctacttcttgtttttaagttttaaaaacatttaggtttagatttctcattattttacaaagttaagtctttatactacttagagtgtacttgattgcctttgaagaaagagcaaggaaatcgatcaacataaaatttaggatagttatgtctagagagaagaaaggaggggctgtgattgaattggggtacccagagggcttctaagttaccacatactggatatatgagtgttggttttattcttcttcttctttttttttttttgagatggaatcccgctctatcaccaaggctgcagtacagtggcgtgatctcagctcactgccagctccgcctcccgggttcacgccattctcctgcctcagcctcccaagtagctgggaatacaggcgccagccaccacacccggctaattttttgtatttttagtagagacggggtttcactgtgttagccaggatggtctccatctgctgacctcatgatccacccacctcggcctcccaaagtgctgggattacaggcatgagccaccgtgcccggcctaaaggttttattctttaaactgtacttacacattttgttataatagtaatagtagtaggtaacttatataatgcttagtatgtgtcaaatattattccaattactttatatatattaatccttacaacagtcgtatgaaatggatgctgttattcttgtgctttgttaacatgacagattttgttcttgtttctagtaattatctttctagtaatgtttttgaattcaaagtttttggtttgggtggacacttttcaaactaagcattgtcagtttttctttatgatatgagaaaaatgcctgtagttataaactcaggttgtctagattggtattttattatactatgtaatccaaataaaaactgtcttaaatcctatcttaagagtttaacttgttaaagtattgttttttaaaccttatttttaaaaaattcttttttttttttttttttttttttttgagacagagtttggctctttttgcccaggctggagtgcagtggcgtgaccttggttcaccacaacctctgactcctgagttcaagtgattctcctgcctcagcctccaaagtgctgggattacaggcatgagccactgcgctcggccttaaaaaatattttactaggccaggcacagtggttcacgtctataatcccagcactttgggcggctgaggcgggcagatcacctgaggtcgggagttcgagaccagcctgaccatcgtggagaaaccccgtctctactaaaaatacaaaaattagctgggcgaggtggcgcatgcctgtaatcccagctactcaggaggctgaggcaggagaatcacttgatcctgggaggcagaggttgtggtgagctgagatcacgccattgcattccagcctgggcaacgagcaaaactcagtctcaaaaaaaaaaaaaaaaaaaattttttttttactaataaagtctcatgacaaggaccctgaggacagtgactaaattgattgaatggatttcaaaactactaaatagtgaaggatgctacttcattattaaagctactgtgggtatttcttattaaggatttagtcctggaaatattaatatcatcagtgatgcagatcatggctatgtcctatagagatttgtaattctgcctgttatcaccaggtgtctctctcctactttattttataggctacctttaagattatcaaacaaagctaatcttttatactatacttggataccactccctactacctcttatttattaatccctcattccatcagttagtcttgttttcctttcctcccttttttccatcagtctttaaacatgtttaagtgtcttatcattgtttacattaaaacaaacctgtggtgtctgcttctccctttaattacttgtacacccccattttttctttctatccagtcactgacaagcatcctaaaatgttttctatactctattatttttgttcctttatttctccaactcattgcaattcagttttacccccctataactttagaatagttatctaaattattaatccactagttgcttaagttattaggcacttaattttaaattctaactcttctaggccaggcgtggtggcttaagcctgtaatcccagcactttgggaggctgaggcaggcagatcacctgaggtcagttcaagaccagcctggccagcatggtgtaccctgtctctactaaaaataaaaaattagccaggcatggtggcgggcgcctgtaatcccagctactcaggaggctggggtaggagaatcacttgaacccgggaggcagaggttacattgaaccgagatcatgccactgcactccagcctgggcgacacatcaagactctctcaaaaataacaaaaagtagtaaataaatctaacctttctgcagtattaaatatggtctactttttttttttttttatatagagtcttgctgtgttgcccaggctggagtacagtggcgccatctcggctcactgcaacctctgcctcccaggttcaagctgttctcatgtctcagcctcccaagtagctgggattacaggcgtgtgccaccacgcccagctaactttttttcttgtatttttatttttgtattttatttattttttgagatagagtctaggtgtgtggcccaggctggagtgcagtggcacaatcttggctcactgtaacctcagcctcccaggttcaagcaatctcccacctcagcctcctgagtagctgggactacaggcatgtgccaccttgcccagctaattttttgtatttttagtggagctggtgtttctccatgttggccaggctggtctggaactcctggcctcaagtgatcctcctgcctcagcctcccaaagtgcggggattacagttgtgagccactgtacctggcctacttccttgtttttgaaattatatttccttcttctttgcctattcttcagtcatatttgcatatttgttttccatttatcccttaaatgtttttgttatttagaattcctacctctactctcttctttccttccgtaattttcctgtgcaatcttacccaacctgtgatgattctcaagtctgtattgcagaccacacttactaagctctaattctatatatcatgactcaatataccttaaaaatcaatatatcccaaactgacagcatctccacacacaccaatgttgccctgtctcataatgctgttaccatcccaccaggtgttcaagatagaagtctcaatatctcttttgagatatccttttgagcgataccctttgcttgctttatttcaccatctccaccccacacacatccaatagatgagtaagtcctctcaattctacctttcaaatatctcttgaatctgtccacttttttcatctcttactccttagtctgagtgatctttctaaaacaccagcttgatgttaatcttctgcttaaaaattaccaataactctctgttcccttgtcctctgtgtaaatgtgactttcttaagaccattacatgcaggtgatttttattataatctagctattgtttaaatccacttttctttgtttcatttctggctttggaaacatctctctagcacttgcctcaccccatcttttagtttgatgaaatatggtttcagcataggtgctacttcctacaacctttcctgatgcctgaagattggtttaggtgtcatccttatttattttcttttaatgttttactttttttttatttactttttttgctttttcttttttatggggggggggtgtcatggttataatctaaaggatgtcccctaaatttatttctaacaggacatttatccttcttactattcttcccagatcttctactaagctgcaaactccttgagggcagcaactctgtcctttacctttttaccttttagcacatactaggaacttgataaatatatgatgaatgtgaaatattttatgtatactttatttttaaaaattaaatttttaagtgatgaatttgtgtttgttgtgtgtttttcttgtaagatggtaatgggcagctttactatgttagtttctctttgcagaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggttagttgtttttgattttttattttttttgtttttcctgagactacttaagagaaatatttgggatagatgggggcttgtgtaaggtgaaaaatagttttttacatgaagagacataagtttttctgtgatttttagaaaatagactatgctcgctcacaaacactgtaaatcacattttgatgggtatgatcagattagtttaagtgcgataagtcttctaagattgcttttctactttctaagtgatttcacatctgtaatgtaattaccatgtaaccctacagtctatgagaaaggtcacaggatcccaagaggtaagagaaatgacggaagcatgaagaagtaaactgattttcttcaggtcagttagaagtttggttagaatttataatgcaaaggaaacttgagcatccagctatcacacttgtctagctgtgctttaaaatgaagcttatgtgctgtgtgtgttggttcatgcctataatcccagtactttgagagaccaaggcaggaggatcacttgaagctaagagtttgagaccagcctgggcaatttagtgagatcccctctctacaaaaaaataaaatattaaccgagcctggcagtacatgcctgtagtcccacctacttgggaggctggggcaggaggatcacttgagcccaggagttcaaggttacagcgagctatgattgtgcccctgcactctagcctgagtgacagagcaagactccatctctaaaaaataaaaggaagtttatgcaaagtggatttggttttatttgcatttgtattaaaacttttgctcagatctttttgaaaggtagtaaacgtactaattttccaatttaaaaatattccagtaaaagcagtttttaatattcaggaaatcatttttttgtgattttctcacagtgtttgtcatagcttttttttccacagactatttttcttgaattgaatttatctcaattgaaattatttatttataagccatagatgtccaccaggaagttttttcaaagtaaacctaaattgttctctaatacctgctatctgatatttatagtgatcctcaagtatattataatattcttgttagtttaggtatcaaatctggtgtacttttgtttcctttaagcagctacactccctggatacccaggaatctcccactactgctaataacatgactccattctactacttgtcaaggatcttcgtggtttttacagctataagctcatcattctgttctttcatatactcaactcagtccttatagatagggagattaaggtttatggcaaaaattggtcatttaaaattgagttttagttacagagcacatagttgatatgaggctaattacaaaacagtagtccctgaagaagcccttctcattccatttgccaatccctagaagcaactactttcaattcttactggagtcttttggacttactggagtcttactggagttttgttgtttaccaccatctctcttgacaaggtttgatctttttcaaaaacacatttttcttctggtagactttttaatctttctttcctgtacttactgttttcttctacttcctggagatttcctcaactttcatgctggctatcatgtttttaattcccaagagccctttcttactctccaaatgttcattttataacattctgcacttgtttcatcagtgtattgttttatctttccaaggatattaatgatagcttttatgttttcttcatccactatagacagtatttgtttcagggtactttcatctagttgtttttggtttctgtctcttgtatttagaggctttcctcgggaatctggtgatctctcactgcctgcacatggttaagaatagggcactaaaaagctgactggaaactctctgcacatgggtaggacctttactttcggggcccttctgttagcggggccattatgctgggaacctacacatcactgcatttaagacttttctcatagtctactcagattccccagagaagatgctttccatctgcttcctggaaggtatcattctggctgccagtctttcaggagccatgtaggggaagaaagctaagtgtctcaacactttgtgtaaatattcacttatttcccttattttccatgtagtaccctgtctctcaactgtatctggtatcctctaaaccagagacccttctgtttttggtgatgggggtgggtgatgacagttgctttgctgtgcagaatgaggaaaggaatctgagctcttcttgtttaaactgactttgagccattccttctgtgtttagctccattttcatctccacttgcagagatacttggagccaccagttcttttgaggggttatgtggtagaaattgggttgattctcatttttctttcttttttttttttgaggcagagtctcactctattgcccaggctggagtgcagtggcacgatctcagcacactgcaagctccgcctcctgggttcacgccattctcctacctcagcctcccaagtagctgggactacaggcgcctgccaccacacccggctgattttttggtatttttttagtagagacggggttttaccatgttagccaggatggtctcgatcttctggccccgtgatccacctgcctcagcctcccaaagtgctgggatcacaggcatgagccaccgcgcccggccaattcatttttcttgattggtggcttagaattagttttcttgagtctgctaagtcccactcaacaatctacattatagcttccaaaatattgttattgttgctatctcttctttagtttcctttgtccttgtagagttctgctttttaagattatctgtgtccaggcacggtggctcacacctgtaatcccagtactttgggaggctgaggcaggtggatcacctgaggtcaggagttcgagaccagcctggccaacatggtgaaacctcatctctactaaaaatacaaaaaattagccaggcgtggtggcgggtgcctgtaatcccagctactcgggaggctgaggcaggagaatcacttgaacccaggaggcggaggttgcagtgagccaagatcatgccattacactccagcctgggcaacaagaatgaaactccatctctaaaaaaacaaaaacaaaaaaaaaggttatctctgttcaggcctggcgcagtggctcacacctctaatcccagcactttgggaatctgaggcaggtggatcacctgaggtcaggagttcgagaccagcctggccaacatggtgaaacctcatctctactaaaaatacaaaaattagccaggcgtggtggcatgcatctgtagtcccagctactggggaggctgaggcaagagaatcacttgaagctgggaggcggaggttgcagtgagccgagagatcacaccactgcactccagcctgggtgacagtgtaagactctgtctcaacaacaacaaaaaaattatctctgttcatgtaaaagtagtgggatgtcaaaaggaagcagcatctaatatgcatttaaatactatctttaacagaaagtcccaggcatttgtctttaacagacattatttgacaggagaaagaggctaattgataggattttcaccgtattcctagttataatgaaaagcaaaagaactatttggtattgaggtgatttctctcatcttctaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggtatttctttaacatgttaataagagtttaacagttgctgatactaaataccatttcagattgttaagatggtaaaaggtgccagacatatatttttaataaatttcataatgaccctgcaacatataggcagtactccctttttataaatgaggaaactaaagcttaaggtttcaggatactaaatggtcacgtttagttgggtaaattctgcagcagtaagaagaaaagaagcaatatggtatcctttggtgctaaacatactacaactttggtgctcaacagttctgagctgagaagagctctgtgacttactagctatgcaactttggggcaagtaattaattctctttagcttcactttcatcatctacaaagcagcagtgctaatgcctccccaaggtggttgagagatggacactttttaccaggctttgtagaaagtaccttgagattgttttcttgacagatggcagagcatattgaaggggggggagttaatgtgtactgaacaactgttatgggctagatatgcttctagatttttttgtttgttttttggaggtggagtctcactctgttgcctaggctggagtgcagtggtacgatttcggcttactgcaacctctgcctcctgggttcaagcgattcttctgcctcagcctcccgagtagctaggactacagacacgcgccaccacgcccagctaatttttgtatttttagtagagacggggtttcactatgttggccaggatggtcttgatctcttgacctcatgatctgccagccttggcctcccaaagtgctgggattacaggcgtgagccaccatgcccggcctactttgtatatcttgtagtttactattgtttgctaagaagattcataattgcatttgagtcataagtactctttaaaaatgttttggattccccaaaacatcctcaaagggcatcatacaaataagcaactttgtgtaataaaggcaaagtaaagctggacactagaaaaatagagcatatcttttttaaaaagtaacttgaaagaagtggagataaattttttttttttttttgagacggagtgtcgctctgttgctgaggctggagtgcagtggcactacctcggctcactgcaacctccgcctcccaggttcaagtgattctcctgcctcagcctcccaagtagctgggactacaggcgcatgtcaccacgcccagctaattttttgtatttttagtagagacggggtttcaccatgttagccaggatggtctcaatctcctgacctcgtgatccacccgccgctgcctcccaagtgctgggattacaggcgtgagccaaggcgcctggccaaaacagatatttctaataagatacaagctagtaacttcaggattagaataccttgtattctaactcaattattgtctagctggagttagctacatttacttgttaacaagcagcagacttaagaacattgtaactcctgttccgctttttgaactttcggataaaattatagaaatagtatgattgaagtcaagtttcttagcaggtacctggattaacaagtaacgagtaaatgtagctaactccagctagacaataattgaattgttgcttctgtctccagaagtcaccttctttttgacttttctttaatatatagctctggatttggctgagattcagagtattgctggtagagccacctgaccctgactgaccaccatggtaacagacttgtgagctttctggggaagaatgcatttagtttgtaaggccatcctgcagtagctatagtccaaaactaatctatctggatcacgcctgatcttgcaccaggctccatgtttgatccattccctaaactaattgccatcattaaaggaaagactcaaaatacaagtgaaacaataacaatatgtttatgagtgtaatgctgctttttttcttctttaggagcagcatagaagatgctcagtgtcctggattaccagatttaattgaagaaaatcatgtaagtacaattccagtgtggttagatagcccagtatgtcatatgtttatatcattatagaaagtaactttgtaaagcatccccagaatttccgttggaaatctaaatcagtcatgtagaattgtagttcttgtttcaatgacatttgggttgtttaaaaccatagtgtcattttgtattcttcaactcatatcagaatgaatatggaaccagtgaactagagcagaaatcagcaaactttggcccctatttttacaaatcatattttattgtaatagccacacatttgtttatgtattctatctggctgcttttgcaatacagtggtagagttgagtacttatgacagagaccctgtgactcacaaacctaaaatatttactatttgatcttttacagaaaatgtttgccagtccctgagctagagtataggtacttgctgagaaacttgccttcaatcatactatttctataatattatctgaactaattgttgaagaagcaggatagtaggatttataatgttcttaagactgtgtccgggatgtcatccttctgtttttcttgtatttaatagcaacaagacttttaaaatttgttccaagtaattaaattgataattaaatataatgccatttttacttccaggttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcaggtgagatatttaaaatatatttaaacgagcctttattaaagaaatgaacttggattaaggtataaattatcctataaggtccattttacattagatctaactattgaggatccttcattgttagtgaagaccctgaattagaacaattccctcaagattttttttttttttgagatggagtctcactctgttgcccaggctggagtgtagtcgtgtgatctcagctcactgcaacctccacctcccaggttgaggcgattctcctacacatgtaccaccgcgcctagctaatttttttatttttagtagagacagagtttcaccacattggccagcctgggctttttttttagttgtccttttcaacacatatccccaagtctttcttcaaaatatcctatttttcttccctactgcctagttctacctatattgttgtgatggttctgcaataggaaatggctcctatatttttgttataatgtgtgccagttttacctgccattttcatcagttagtctgtagctggtctaactggggcctatggtaaaacaaaaggttttaacctcggccagacatttaatgtcctccagctgttcttcatcagcattttctgggtacctttaatgttacaagcatgagatttgtttacagaagtctgcttttataccaaagttaaggataagaatttaactactttcaaaaaacattatagcataggggtctatatttttgtcttagcatttgatatgtggaacttttcatatttttcatggctttgtccatttctaacagccctcgaatgtgagaatattctttaaaaagtttttttttgttgtttttcagaactatttgataataaaagtctcactactgaatgccaccttcttgattcagtaagttttccaacttgacaagtccctttatattctagatttgttttataaaatgaatattgcttttctatttgtgtacaaggcttaaaatgtatatcttgtcattgttttgcttactcactcttcatttttcacagaatgaagaaaaatttggtgtttatatactttaaaatatagtatgttttaatattaaccctgaagatatgtttttctatatggtttttctatcaaatttgctctgacaaactgggtacttgaatatctgaatatatttctaagtgattcaagaaaaatataaggcaaagtttctgcccttctggggaaataatatctatcccaccttcagtcatcattggttatttatgtcctgctattttagtggctacttccctgcttttacttctggtgacctcttgcctctaaatctagttcaaacagcccttttgtgaagccttctgtaaaagctcttatctctctcatgttaatttatatataggtacagatgcacataggcatacagtgtttacatttcatctcttattcagggtataatatgaacgcattccaaaaatataacttaaggaataaaattccttattaactgtaaattccacattaggtagagctgtctgattcatacctttgatactggcactatggcacgaattaaatagtgctctctttcctgctgtttatatatatagcattggtttcagccccatcccagactttttttttttttttttgagacagagtttcactcttgcacccaggctggggtacaatggtgtgatcttggcccactgtaacctctgcctcctgggttcaagcgattctcctgcctcagcctcctgagtagctgggattacaggtgcttgccaccacacctggctaatttttgtattttttagtagagatgcggggtttcaccatgttggccaggctggtctcgaacttctgacctcaggtgatgccccccccccgccccgattctcaaagtgctgggattacaggcgtgagccaccgtgcctggccgatatttttatttcaatgatctggagttagggatttgtcatttttttcttcatcaagtgattcttatggtttacacctgtggttacagccttaccttggaattttccaggactaattactagaatagatcagaaaacggtcttggttttattcttctttaatctcagaatatgagaaattcattcataaagcaagtataggatcaaacaaccacagttttagttaacttcatgaaacctggcaaatacttagcttccataagccacaaattccttaaagacccttgtatatcttgtctttcattatttttcaaagctgccttttttgtggtcaggctctgggctgccctgtgtctcaggagcagaatgaaatgtgttactgtgacccacgtaccattctttcttggttttagccttctttaatcataaactgagacctagaggatcagggctttcagcataaagccaacttatgtaaacctgatttaaccctgttcccagatcgaaccctgaatgattgattctgagaatgtatgttgttataagtaaatccagagattaccaaatcgtaatattttaatagtaatgtgattaagagtacatcacaattatcttatatgttctcattgttaagtcttaataccttatcatttagtctgatatttttttcacttctgtaaatattagtatttagatgtctattttagacccaaattattggttgccccagtagcataatttgaacttgaagcagggcttgagggagtaaaaagatcccagcaggatcacacagtattaaaaggtctattaagtgctattatatggtttaggatttatggaatctatgtaagtggcttaagatacagcctcagttttattcattctgcatacactgcttgagtccatttacatattattcacatttttgtacatatattctgaatatacctttccaataaaaaaaactgtaatatacatttgaaataagatctactggaaagtagcataatcattgttgtttataattttattgttatatagggaaaatgtttacgtgtttcttgtttgtttgtttttgaggtgggatcttgctatgttgctcgggctggtcttgaagtcctgggttcaagtgatcctaccacctcagcctcccgagtagctgggactacaggtgtgcaccaccgcacccggtttatttttgttattaattaatccactatagaatgttgaagaattaattggtgaaactcttgatggatactttactgacttctctggatttgttctccagccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtgccttgcctctcttgtttaaaagg

SEQ ID NO: 517 - DNA, 17532 bp, Homo sapiens
gtcacatggggtgcgcgcccagactccgacccggaggcggaaccggcagtgcagcccgaagccccgcagtccccgagcacgcgtggccatgcgtcccctgcgcccccgcgccgcgctgctggcgctcctggcctcgctcctggccgcgcccccggtggccccggccgaggccccgcacctggtgcatgtggacgcggcccgcgcgctgtggcccctgcggcgcttctggaggagcacaggcttctggtgagcgctccgcggcctccgggaccccctggccgcacggggagagctcgggcgccccctgactgcgcactgtgagagcttcagagaccggagctccctcctctggggccctggctctcccgggcccgccccccgccgtgtttgtgggtgggtcctccacctgagtgggcgccggggcgtgagcctgggccgccccctgcagcccaggccgatgcccgggatcctgctctttgaggtaaaccaggagtctcccctgggagtggacggccctgcagcgggacctggcctgcctgtcccattccttccacctagagctgaggtacccgccttcctggcagggccagggccagggctggcgttggcccctcgtcttactgctgctgccgttccccatgaagatgggacctccccacattcctggccctaagggtcattttattagtcactgaacgcacgggcagcgcctggatcctgcgcccgggcagtcctgggcttgaacgtgtgtgtcagccgcgctgccagccatgctgaggctcgggactgagccgcccctttgttgtccccagccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccaggtgggcggcgggcagggtctgggcgtcccagagccccttacagaggcacagatgggaggggagggctgggggctgctcggaagaccccttgttcccccacctcccgccgaagcaccctgttggggagagcgtgtccttgctggctgtgctggggtgagggctgtgtgctggagggagcccctgcatggggcacggtgggcttcctgcaggtctccctgcaggctcagggttggctgcgccgcacctggctcctggtgcacccgtgagcatccctgtgtgtgtctgctggccaggctgggtagggccactgcacctgagggctgagctgaggtctcatcggtcacagcaccctgggccctgacgctggtgcaggtggccaccctgtgagggggaggcacgaggtgtgaggggcacttgggtgtgtggggccttctggaaacacagagaccctcgtgcacttggccagagccgctggctcctaccagcagggtgggcaccgggcaggcctgggcatagggagtcctcttggcaccttggaggctgcatgatggcgggggacccttgttcaaataagatgtcaaccctgagcgtcaggtcaggcccatccctcctgagctgagggacggtgcattggggcccagccagcactgtgggccagcctgtctcggaggcagaggttcttgatttctgagtgtttgggtcctgcgtgtgatcagagggcctcctttcccagttggggttccccggtttccccagggcagctgtggcacaagagtgcagctcttgggtggctcctccctgggaagggtctcagcagtggcttgcagacgtctgctgtgggtccccaggagggagcagaggctgctgggcaggcctggccctgctacagatgggcatcggtggcctccagctccctgtggcgggctcgtgctgtctgcacggcatcgtgcacactgaggaacagctgctcctcctcagccgtgtccccggggccctccccgaggaagcctcctctgctcagaatgtctctcacaggcgggctgcagcaggctagcagcaggctgatgcccagggccccgtagtctcggcgcaggtcctgcagcgtgctcacaccggctgcgtctaggaacagcagcggggcgcagtcgatgaccactgtgtggaagccggccgctgcgggcaccagcgcagccctggtgctaaccgggcccaggtcctcgccctgggcagggcctccctcaccgacccccgtctctgagcccccctccttcctcctggcagccatgcaccctgcgtccagccccgtgaggctgtagagtgactgcaggaagaagtccttgttggcatagtacagcggccccccaaagcggaacacccgcacgccgggctcagggacgaggccctcgaactctgtggcatcctcgtagaaggccgtgtccccgatgcgggccagcagggcggtgcgtgggcgttgggtgcggccggccaggctgagcagcgagaggatgacgccagccagcagcccggcctctgtgctgaccagcatacaggtggccgcggtgcctgcccagaccagcgcgtcagccgggctcatccgccacagccgcgggaggtcccacaccttgcgcagggccccccgcaggctgaccacgatgacgcaggccagcacgcttcgctgtaggtcgtggaacagcggtgccagcgccagcagcaccagcagcaccacggtggcgctgaccacgctggacagctgtgtccggcagccagtggctgtcttcaccaggctcttggccagggcggcgctggtggcgaagcagtggaggaaggcgggtagcacgttgcagcagcccacagccagcagctcctggttggcacgcacagagtagccgtgactgcgggcgaacatctccgccagcgagatggagaaggcggcagccacgagggccagggccacggcatccaaagccacacgctgcatcagcctgggctctgggacctgagggggcatgaaacccgtggggatgtcgccagccacgctcgagccaaagcgcttgtggagctgcccgaagtgcgacacgagtgtggccaccacgatgaccagcagctccgtgggcagcggcaccctcaggcggtgtcggtagcggtctgagagctccttcgcggctagcagcaccgccaggcacaccgtgctggtgaccacgtcgcacacgttggcctgcccggcgccgcgcagcaggctcagccatgtgaggaccaccatgccgggcccctggtgccgcgggatccgcacgcccagcaggtgtttgagctgcgaggtcaggatggtcacggaggcccccatggcaaagccatcgagcagtggctgtgagaggtaggcggacacgaagcccagccggaggacgcccatgaggacctgtggacggagtgcggtcaggccagcaggcgcctggcgggagccacctgcccctcaccagcacctggcatggcccgaggggtggtggtcacggcacaggacctgacaattctgtgttgcggccccgtgtgttccaaaccagactcctcacacgggcctgagttctggttccacgcgtgctcatgcccgcagacaactgtgacatccacgtgagcatcacacgtgcacacagctggccatagacacgtctaacccttgtcacgtgcagcagcccgttttatttcagaattaagacctctggtatcagaaggcaaccccttcctgctgcttcctacacatggtgcccactgccccccatgcagatgtggagccaacgggggccaaggtggacaggccaaggcaggagaccttcgggggtggggaggccatcccccactccacctaggacagaaggcctgggaggccacatggcctcagtccagcaccactgagccacagccacacctggcctgctggtccccaccaaggccatggcccaccggactggctccccgtgcccctcccctcctgcatccacagcctctccgcgtcggtgcctcgccctgggatgccccggcacgccccagctctgcccaagccttgctgtcttgggccagcacctcctctgccaaccctgtgcttgcccccagccttgccctcgtggatggccaaaacctaagggggggtgccctgggcccctccctgtgcccaagcagggctcctcacctggtaaagcccggtcatcagcgtgagggcggtggcgacacggatggcgtagcagtcacgcccgcagtccagcatggcagccgagccgttgagggtgctgctgttggctccgggctgcaggccgtcctgggaggggtcaaagccggccagctggagctcccggtccaccacctgccccaccatgaggcaaagcaggctgaagatgcccacggagacatgccgtgaggtgcccatgaggaagtagatgaggttggcgaagaaggacgtatagaggctgtagatgggctgcagcccggccagcaatgagtaggcgatggcctgcggcaccaggatgatgccgatgaccagcccagacatgacgtcgcctgccaggtactcccgcgggcggtactgacgcagccagcgcgtggcggggagcaggtcctgcaccagcgcccggacgcacagcacactgcacgagcagctgcaccacagcctggccttcagcatctcacgcagaccccggggtgctgggcgctgccgtcggaccggcaccggccctctgccctgctgcagaggctcaggggactcgtccatcctgttgcgtcaggtcccgtggccgacctgcggccgagaagagggcatggtcacaggagcccccggatccagggccaaacgacaaggtccccggcagcaacgggccccttggggcggacccctcgcccacccagggccggggattggtgctgggccttctcctggcagcgcgggccccagccccctgcccggtatggatggacgctgggccctgctggatccagaatccatcgtgaggtgagatgggattacgacaccaagcccatgccatggggtgtgctgaggccagcagtgctgaggggcggcgtggcggcaccctgtccaggctcagctccggcctattggctctgcggttcctggctgaaaaccaccctgtagcctcctgaagctcacctccccaacggggcaggaacaggctgggctgccaccacgcacatgtgcctaccgtcagaatgtcacagtcactggacacaggtgcaggcaagcctgagtccagctgctccgtgtccacctccctggctccccaggttggcaaacggtcctgctgtccaccccatgcccacaccagagccctccctcccccatccaaaccatcgcctgctctcctggagacacctccacccacccctctgtcacctgccctgtgggtcctggggctggcggaagtctcaggaagaggcctcctatgtccctgccaagctttgtgggtactgggaccccaagtctgctgggggagcagcactcagacactagcctagcccatccgcctggacttgggacagaattctgagaatatgcctggacgggggccccatcagggccagctgggaggggaggagggtgactggcgtctgtctcccctgcccagacagttctgggacgtgaggcgccctttttcccaggctgcaccagctcactgtggaacggccatgacacactgtcccgaggcagcaccgagagggcccagcccgctgcacacagtcaccctgggccggcagagccggaagggcacctgacctttcccttgatctcggaaaacaccgtggcgttagggaggcggtgcttagaggcctgactggtcccacgtgaggcctcgggtctgtcctgtttgcagactccaatgtactttcactttaaacattcttctcagcgacgttaggcaaagactttgctcccaggacaccaggtgcccaggacaccctggagcctgggctgagcctgctgtttgcacgctggcccagggtgtgcgagctccagtctcctggcgggtgtgttggggcagtgagcccagcctggtaggttgacacatgcaggctgggcacagcacccctggggcacagagcgggggtcctggccctcaggcaacattgcaagagttgtgtccccttccctggaagaccccaccacactgggtccctggatgccctgaagcccaccccaagcccctggggtccaggtgtgtggaatggggacagtagggccacctgccttgagcctgagggtgcccctaagaaaccacgagtccagggcatttctggcctcggctcccacgcccccctctgctgcagctgagatctgggcccaggatggttcttacctgagggagtcctcacaggcgcggagggccctgggatgacgaggggctggcaagaccaccgaggaccgcagggccctctggctcccgcgagcagcggggagagtgggggtggtggcgccaacctgcaggcagtggtctgtgccctggactctgtagttcaattatttacctacagattgctgagtcatgggtttctccagccatgttacctgatcggctgatccgggagttgaactgtaatcaggggcttgtaggagttagagctgtgtgggcctctgaggagctcccagcctcccaggagccgctgcagctgtggctctgcggccctgccgggggggcttagggaccagcgggaggcgggggctcaggggctgagcacaggtaaaccttcagctctggggtctggggtcgagtgcagcagccttcaaacccaggcggggctgagggaggcttggtctccgtgtccagtcgccggacaccctcctggtcctgcaaggagccagcctggtccaagctggagcagggcagaggctgacagccggctcagcccaaggctgccggtgcgtgcatatgcgtgtgtgctcgcgtaagccctgtgtgtggtgctcaccgcccagggcgaggactgccggggtcaaggtgccgtgactggccaggagtcctggtctgactggacccagcaccgacccacagcgcctggtcaccctcacggctcctctgccctcccctctaccacagaccaggaccggcagtgcctgcctcatagggctggggtgaagataaatgatttttttaagtgaactaaattaggcccacacgtgaaaataagggtaagctgctttttaaaaggaattattagccaggcacgatggttcactcctgtaattccaacactttgggaggcctagacaggaggatcgcttaaggccagcagttcaagaccagcctggtcaacatagtgagacgccccccaccttttctttttttttttttgaggcggagtcttgctctgtcacccaggccggaatgcagtggtgtgatctcggctcactggaagctctgcctcctgggttcacgccattctcctgcctcagcctcctgagtagctgggactacaggcgcccgccaccgcgcccggctaatttttttttttttgagacggagtttcgctctgttgcccaggctggagtacagtggcatgatctcggctcactgcaagctctgtctcccgggttcaagtgattctcctgcctcagcctcccgagtagctgggactacaggcacccgccaccacgcccggctaattttttgtatttttagtagagacggggtttcaccatgttagccaggatggtcttgatctcctgacctcgtgatccacccacctcggcctcccaaagtgctgggattacaggcttgagccactgcacccggccgccccctgccccccaacctttaaaaaattaaaagtaaaaaattagctgggtgtggtggtgtgtgcctgtatcccagctactcaagcggctcaggtgggagcatggcttgagcccaggagtttgaggctgccatgaggtatgattaggccactgcaccctatcctaggccacagagcaagagcccgtctcaaaaacaaacgctgtcattggcccagcactttgggaagctaaggtaggaggattgcttgagccctggaggtccaggctgcagtgaggtatgtttgtagcgcttcactccagcctacaagtcttttttttttttttttgagatggagtctcgctctgttgcccaggctggagtgcagtggcacaatctcggctcactgcagcctctgcctcccgggttcaagcgattctcctgcctcagccgcctgagtagttgggactacaggcgtgtgccaccacgcccggctaatttttgtatttttagtagagacagggtttcactatgttggtcaggctagtcttgaactcctgaccttgtgatccacccgcctcggcctcccaaagtgctgggattacaggcgtgagccaccgtgcccggccagttctgtctcaaaaaaaaaaaaaaaattccttgggagcctcaggtccccccgactttgacagtgagtactgggtgggagcctgcacggggcacctgtggccggagggtgagtgtaacgaggggctgcagccctcagtgctctcccatcccaagggaggccaggaggctgcggtgggtccctcgggtggggctggaaggccaacccggccctggcaccttgggcagcctgactctgtccggggaacagaagccacaggctctacttctcctgtccatgtgggattgaagccgagggtctcgcagaaccagctgatgtgccggggctccatttccccaagacgaggacactgacattgatggggcacagccccggagggaggagaccctggacactcaccccaccaaaggtacctccttgtggaagccgtctgccaagcgctgctagttccccacagccctgggtgagcccagggaagactgggctgcagtgcccccatttggaggtgaaatgggagtggaatgtagttgggatggccagagagtaggagacatcctaagtgtgagatgtggacagggctgaatgctccagggtctcgtaccccagagtgtgagatgcgggcagggctgaacgctctggggtctcgtacccctgagtgtgagattcgggcagagctgaacaggctccagggtctcatacccccatagcctccacctgggatgccctctccaagtctgatttctcctcgaagcccctgccctgtcctccagagtctgagcccttgcttccaccccagcccaacctgggccccagtggtccctgggaagcagctgtttgctcagcagttgggagctgtgctgtaagaagcggttggccagtgggtggggtaaggcagtcacgcagggcctcaggtccctccctgggacagataagggcccctctgggtgcagccaccagcagggttgttggagaactggggagacccagggggctggggttgttccctcaaggtctccctaaaggaggcagggaggacctgggtgctacagcaggggtggggcacctggtgcagacgcctgcatgcagggtggggtgggcagtgccacctggggccacagaaaaacctggagtgggaggtggcccttcccccctcaggaaaggtggtggaggtttccagaggctggcttatggggacctgtggtgaggttttaggcaggtgagcgtagttcaggaacagcctcagccgcactgcaggggcctggcctcaggtcttctgcaggcattgggccttatgcccttttagtccccacctaggctgggtgtctaaagtaggtgaggtcatcactgcaggatccttggggcctgacctgccccctcccacgtgtctctgcctcagtttctctgagcattgaggcagtggctggtgctgtcctgtggccaggcccagaggctgagtgcccagggggtccaggggccttgctggccagagagagtgggtagcccattctaccccgagcctgtgcacgcgcagggctgccaacacctccttccttccccgcttggcccacgcaggacagggggcgtgggggccccagcaactgggacctgcctgaatccgcctccctcctgaacccccctcccgcctgaacccctggccagtcttgtgtcacacgcttacttccttagttttgtctttaaatcagccgttttacattggagtccatttactgggaaaggagaccttgcatccttgcctcccacccgtgggaagaagcccggccgacagggctttgagaccggacccgagtttattcccagagaccctcccgcgggtgggcgagctccgaggtctggagaagaggaggccccggcccgcaccctctagcacctgtgtccccttcgtcccggccacagatgcaggttctcccaagaggcgggtctgtacccgccccgcgcccccagcccagcgggcccggcctccgcccctgccccgcactcccacccccaccctcaggagagcgcggccctgctccccaccccgcgcggtctccccccaccgcctgcgaacccccatgcacgcgcggccccgccccgcgcactcaccaggcccggcagccgcgcggtcttagcggctcacgcgctcgggcccaggggcggggacgtggggacccgggcggccgctcagccgcggccgcgcggtgaatgagcccgttgtgcggccgccgcggccccagcgacaccccgcgcggggtctacaagggctgacgcgcccccgcggcttccgttcccgggctgggcggtggctcgtctgcgtctccggccctgggggtgggctgcgcgctccatctcgccggcccagtcccctccccagcgtcggtctctcaaggcccctcccaatgggggccaggcggagggtgggccctcgggcctgtggactgaccccggggttcctgggcctgggggcggggatccctgtcccgggctcccctcgctgcgaggctggccctgccagatgacactcagaggcgccttgggtgtcaggccagggacatctctgatgctggggctccccccgctagggtcaggggctgccgggctatcgccttggggttctgcagagaaaacctgaagcccagctgggtcttcactttcctccaggtcaccgtgccccgctactccaactccgtgggactttggaatgcaccttctgggcatttaattcttatccaagtgcctcttaagttatacttctttgctaccagtgtgtcctttggatggaggggaggagaggtggtaggggccgggtggggtggaccccagggactcctgctgctcctgctggacacccagcccggggtacaggagcaggtggggaccagcagaggcggggcggagcaggagcccacacccaaaggctgtagactcctgccaaggctctgccttgatcttgtacaccatgggaggaccagaagggaggcgttgaggtgtccagacctttgctgtggagctgggggtgctgtggcatggggagactgacagacggggagctgtatagggccagattccggtccatggtggtaaccccatcccccaccactgcagatgcggcacaaagccagctgccacaggaggtgcactgccccacgggcagctgtgctcacctgcgtggcgtccgcaggaagccctcagaccctggccagcctggtctctgcttctcactccaggctcaaggctggctgctattccattcaccccattccctttccctcaggccagaagcatcactcacaactccagacccttgcacaccaatctcctcactcagttcaccctcagatgtccaactccacatggccaaaaccgagaccagtctcactccaagctcatccacccgcctagctgcccaagctgaaatccacagttgccctgtacgaccccccgaccccccacctcaccccccagctcacctcaaacctcatcagtccctctgctcacagcctgcacagccaccacccagtctgggcaccatacctctctgggcaacccccatggcccccagccagtcttccagctcccaccctgactccagtgagctgccagagggatccttgaaaaatgctctggaagccaaggtgggcggatcacgaggtcaggaaatggaaaccatcctggctaacatggtgaaactccgtctctactaaaaatacaaaaaaattagccgggcgtggtggcgggcgcctgtagtcccagctactcaggaggctgaggcaggagaatggtgtgaacccgggagggggagcttgcagtgagccgagatcgcgccactgcaccccaggctgggcaacagagtgagactctgtctcaaaaaaaaaaaaaagaaaaaagaaaaatgccctggcactgctcagctcagaaccttgaaagggatccttgtttcgctctgggtcagggtcccatcctcaaagcagtcacttccagagccccatggagcctcatatcccatgatatccacccttattctgtctcaggcccaccagctgcctccctgctgcctgattgtcatgtgtgcattcctgttccagagcctttgcactggcgatgccatctgctgcctggatgtcttcctgctggctggtcccgttgcatggtagccttaggtgtctcctcagagaggtccctcgctgaccatcaggctcctcactccctgtcgtatccccttcaccaaagattcccattccctgacgacgcctgtcccctcggaatgcaggcctcgtgggaattcagcccatccgcaagtgcagtggcagggcggcccccttcccccttgacgacgcctgtccccttggaatgcaggcctcgtgggaattcagcccatctgcaagtgcagtggcagggcggcccccttctcccttgaggacgcctgtcccctcgtaatgcaggcctcgtgggaattcagcccatctgcaagtgcagtggcagggcggcccccttctcccttgaggacgcctgtcccctcgtaatgcaggcctcgtgggaattcagcccatctgcaagtgcagtggcagggcggcccccttctcccttgaggacgcctgtcccctcggaatgcaggcctcgtgggaattcagccccatctgcaagtgcagtggcagggcggcccccttctcccttgacgacgcctgtcccctcggaatgcaggcctcgtgggaattcagccccatcggcaagtgcagtggcagggcggcccccttcacccttgacgacgcctgtcccctcggaatgcaggcctcatgggaattcagcccatctgcaagtgcagtggcagggtggcccccttctccctttcctgtgcactcatgttgcctcttggggtgtgggaggggaaatggggcactcctgggcctccaggaggtgcagagaaccagggtgaggtgtccaccaggtcctgcctggctcctgacccctggcccctgctgctcgcgactggcctgcctcgtgccactgagcctcagagccattccgaacccccaccccaagttttccatctcttgatggtgtagggttggggggtctccatgtacagatactctagttcataccaggccttcatagggttattttccaaggggaagggcccctcgggaagccgggatcggagtcctgtgtggcaccttgcaggctcccacatgctccgttgtggccacggttccagcctggagcatggagctgtgtgggcaccctgcttcctgacgctgaccgtccttctgcagggggtccactggacggggcctgagctacaacttcacccacctggacgggtacctggaccttctcagggagaaccagctcctcccaggtgagctgtgggctctgccctcccagcccgcctgcacccccttgccctgcccaccctctccctcacccagcccctctgagtccttggatgtccattcagggctggccttggtgccggagcacaggcctggcagagcatgggtgtggtgtgtggtgggcggtggggcagccctcctgtgttccagggtttgagctgatgggcagcgcctcgggccacttcactgactttgaggacaagcagcaggtgtttgagtggaaggacttggtctccagcctggccaggagatacatcggtgggcgagcgcaggccctggggccctggccggggcgggggtactcctgggcaggttgcacccctatcacgcaggctgctgcctggtcaggagatacattggtgggcaggcgcaggcccttgtggggggatgggggtgacaagggataggttggtggtcggcgcaggccctggggccccaggctggggggtactcctgggcttggtgggtgggcgaaggccctgggcccctggggtggggggtactcctgggcaggctgcacccctatcacccaggccgcacccctatcacccaggccgccgcccaggtcttggacccccttgagccagcgcttcctgatgtggggcgggaggctggcctgcatggagatggggttcatcttgagtcagacgcccttcatcaccttgcaccctccctccgtgggagtcactgaggcgagattcacctgtgctggggggacagcaaggctcctctgcaggtaggtacggactggcgcatgtttccaagtggaacttcgagacgtggaatgagccagaccaccacgactttgacaacgtctccatgaccatgcaaggtgtgcaccgcttcctggggtcctgcccggctgaaagggggcagaggaaggcaggagcagaggctaagccgctcatccccagggcaggtgtagacgcagtgctcccccggcccaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaaggtgcgccctgcccctccgtccgccccggtgttctgcgccctcagccgctgtgccccgggccgcgctgaccctggtggtgctgaggcggccccgcccgcagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtgggccggcccaacgccctgcgcgccccccggccaccttcctcccgagacgggacaggcgagcggtggccgcgccacccggtcccagctgccctggacacccgcaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctgggtgagccggggccgctggggtgggccggccagggccctccaggctggggagcggctcctgcgaaggccccgctgcggggagcgcacttcctccagccgcgcgcttcccggggtcggcctccgcgtggcggggcctggggactccttcaccaaggggagggggagcgagtggtgggaggcccggccctgggtcggggggcggctgggcaacgaccccacgcggcgacggcccccccccgccccgcagatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggtaagccggggttccagggaggtctctggccccgctggggctctggagggggcggcccggggagccgaggcctgagtgtcaggccccgcaggcctggtctacgtcacgcgctacctggacaacgggctctgcagccccgacggcgagtggcggcgcctgggccggcccgtcttccccacggcagagcagttccggcgcatgcgcgcggctgaggtaggtgggccgcggaggggcgaggggccgggccgggccggggtcccgggggggtggggtccggggcgggggctccgaggcggtgtgggtgggaggtggagcggtgggccgggggcgttcgccctgaggtcgggccgagcgtccccagctcccctggagaaccctgaggaccggccactgcgcccaggacccggtggccgcggcgccccgccccttacccgccggcggccgcctgaccctgcgccccgcgctgcggctgccgtcgcttttgctggtgcacgtgtgtgcgcgccccgagaagccgcccgggcaggcaagtggcagtcccctaacccgcgccgcggcccggactccccttccccgacgccatcacagcccttccctcccccaggtcacgcggctccgcgccctgcccctgacccaagggcagctggttctggtctggtcggatgaacacgtgggctccaagtgcgtgagtggggccgcccctccctctgcctggtcctaggcaggtccctgggtcccgaccccttcacccatgcggtcactcgggccacttgccgtggcccatcggctccctccctcgccgccctgcgtccctgcccttcaccccacacactgtgggccacgcgccaggccctgccagtggggtgtgggttctcctaggggacatgagatggacattcgggctccagccctctcctgcctgggcaggaagagtgcccaggggctggggaggtgccgccgaggggcttgagggaatgaggctgtgggtccacgcggccgtgccctgcctgctcccacctttgaggactgtcttgaccccagccttgttcttggcctgacctccccaggtgcctgtggacatacgagatccagttctctcaggacggtaaggcgtacaccccggtcagcaggaagccatcgaccttcaacctctttgtgttcagcccaggtgcgcccaccacccgctgccctggactcggccaccccattcttgggcctcagggcagtactgggtgggggcctcgagaagcctggggtcagggggctttcgggtgggggcaggttccggttggcacacatgtccccttgtctccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatattttattattttcttttatatcttggt

SEQ ID NO: 518 - DNA, 27490 bp, Homo sapiens
ctgaggcgccgggagcctgcgccggcgtcctgccggcttcgtctcctcagcggccatgaggcggacaggccccgaggaggaggcctgcggcgtgtggctggacgcggcggcgctgaagaggcggaaagtgcaggtgggacgctgggggatgagagggcgttgggaaccaggtagggcctggaggcgtaagacgggaggagtttgggggacacctggagatgatgaaagcgaagtcggggacagagaagggaacagcgttggggattcacaggcgagagggattgtggtctgaagaaggttgaaaaacggggcttggggaggatgggagggacggaaggaaagagcgtgctgttggggggtctggaggagcggtgcgcagggaggggcggcgaaggttcaggtgtgggagaggcggagggaaagttcgctcggagcagttgaactgaccaggctccctaggaggccacagtccctgcgagacgtcctagtagaggctggagcattgggagatggatgcgaatgcaaattggggaaattctcaccccggggtctgtttccacccaatttgccaagttgcaggccaactacctgcccagaaccggtaactttgaggggaaaagtagaagctatgggaaggggagctggcctcctatgtactgagcagtcactgggtgccggatactgcattagatactgaatatgcgttatatgtgtcgtcattcttgctgggaatgaggaaactgaggttcagtaactaacctaggcccgcctaactagaaggagctggaaatcacattcaggtctgtcacctaggcaagatgctcttcagtcactgtaaagaaacaaaagtgcgacataataatcattcatgtttattgagcattttatgctggtgctaagtgttttaggtatgttaccttgtttggtacaattctatatggtagatagtgtaatgatacccattttacatacggaaaacaggctcaaaacagacactaggggcaagattcttgctctcaggttgctcacagtcttatagggaagaaaagaggtgtataaataataacaacaatacctaacctttattgagtgctttctatgtgtcaggcattttgccgagactttatacactttatcaatggcaggtactcaccaaaattcagtaaagtagattttgtcattatcctggttttatagataagaaatttgatcattttattattattatttattattattattttttgagatggagtcttgctctgtcgcccaggctggagtgcagtgacacaatctcagttccctgcaagccccacctccggggttcacgccattctcctgcctcagcctcctgagtagctgggactacaggcggccaccaccacgcccggctaattttttgtatttttagtagagacaggttttcaccgtgttagccaggatggtctcgctctcctgacctcgtgatctgcccgcctcagcctcccagagtgctgggattacaggcgtgagccactgcgcccggcatattattattattgttatttttgagatggagtttcactcttgttgctcgtgctggagtgcagtggcgcgatctaagctcactgcaacctctgcctcccgggttcaagcgattcttccgcctcagcctcccgagtagctgggactacaggcgcccgccactacgctcggctgatttttgtatttttagtagagacagggtttcactatgttggccaggctggtcttgaactcctgacctcaagtgatccgcccgtctcggcctcccaaagtgctgagattacaggcttgagctaccgtgcctggccgattgttttattttttcaaaaattatcaaaatggccgggtgcggtggctcacgcctgtaatcctagtactttgggaggccgaggcgggcggatcacctgaggtcaggagttcgagaccggcctggccaacatggtgaaaccccgtctctcctataaaaaatacaaaaatttgctgggcgtggtggcaggtacctgtaatcccagctactcgggaggctgagacaggagaattgcttgaacccaggaggtggaggttgcagtgagccgagatcgtgccactgcactccagcctgggtgacagaagactcagtctcaaaaaaaaaaaaaaaaaaatcaaaatgtgcaatagctatttattactccttgaattaggaataagccatttgtaccctttgaatacattcttgaatgacatgggatgcgtgggaaacttgtataccactttgatttgttagttaattttggagacaggcctcagtccgtcacccaggctagagtgcggtggcgtaatcacgactacctacagcctcaacgcccccgggctccaggtgatcctcttgcctcatcctcccgagtagctgggactacaggcatagtgccacaaagcccagctcattttttgtattttttttttttgtagagacggggtttcgctgtgttacctaggctggtcttgaactcctgagctcaagtgatctgcccaccgtggcttctcaaagtgctgggattacaggtgtgagccactgcacccagccaccagtttaatttagaaagagaacagaaatagaattaggaagagttcaggagagcgagaaagggaatattccacagggaagaggagagccaatatttgtctctctgtctataattctgttttgttgttgttgttgttgttgttgttttccgaaatggagtcttgctcttgttgcccgggctggagtgcagtggtgcgatctcagctcactgcaacctccacctcctgggttcaagcagttcccctgcctcagtctccagagtagctgggattacaggcatgcaccaccttgcccaggtgaatttgtatttttagtagagacggggtttctccatgttggttaggctggtcttgaactcccaacctgaggtgatccacctgcctcggcctcctgggattacaggcgtgagccactacgcccagcctaatcttgttttattgtttgttttgtttttttttttttgagatggagtcttgctctgtcacccaggctggagtgtagtggcatgatctcgggtcactgcagcctctgcctcccagattcaagcgattctctgcctcagcctcatgagtagctgggattacaggcgtgtgccaccatacctggctaatttttgtatttttagtagagacagggtttcaccatgttgaccaggctggtctcgaactcctggcctcaagtgatccacctgcctcagcctcccaaagtgctgggattacaggcatgagccaccgtgcctggtctgtctataattcttatacccccaaatcctgcctttttccctggcaatgttatggtgaaaacatttgtcttgttgatgtagtacatgacagttatagaatcctccaggatctctaggcccttaacttattctgatttctagaggcctggaccttatgaccatactcactaacaccatttctccttcttgttacttgattcccaaagatacttgttaaaatctttggttcctgactattaactattactctgacttccaacccagagaagagtactaaagattccctttcacaaggtgcctcttcctagagtggctatcaaataggcatacagtcctttgagttttaatgtcagggatggatgggcagtacctagtgtctgtgtttttgaaaacatgcctcttcccccttgatctctaaacagaatggtttgctatttttgagagaatgagtagtttgtagtctggccagtagacaatagtagtctatgtttggagtgagtttgcttctctcctaatttgaactacccatttggcctcgttacttaggccttgtatgtatactagatttgctttcattttgtttttatattatgaaaataatatatgtttgtttaaaaaaaattaaacaggactgtggctcgtgcctgtaatctcagcactttgggaagctcagcactttgggaagccaggaatttgggaccagcctgggcaatataatgagaccccaactccacaaaaaataaaaaaagtttatcatgggcggaggagtgtggcagttttaatgtacgtccacaaattcttcagtacttttccttctaaaagaacttaattcccctttccttgagcacagacagtatttagtgactccaatgaatagaatgtggtaggttatagtgttagaattctgagtctaagcctggccaacatggtgaaaccccatctctactgaaaatactaaaattagccaggcttggtgacgggtgcctataatcccagctactcaggaggctgaggcaggagaattgcttgaagccagaaggtggaggttgcagtgagccaaggttgcgccactgcactccagactgggtgatagagtgagaccccatctcaaaaaaaaaaaaaaaaaaaaagaaagaattctgaatctaggtcataaatgacattgcagctttagcttcattgtctctttgggagaagccagctgtcatgttgtgaggacactcaagcagctctgtggagaggttcatgcagtgaggagctgaggccttttgccaacagttgtgtgagtgagggagtcatcttgaaattggataccgcacctctagttgatattttgaatgcaacctcactagactgtgagacagacccacccatctaggcttaacccaaattcttcatgcacagaagttgtgagataataaatgcctggctggatttcagactggtgacccacttatacctcttatctccccctttttgaacataatgtctgtaacagttatgcccgttccaaattgtatgttagatgtatgagggaagataatttgtctttagttcacaggcctgcagatctaaaggaactgtatttaaactacatttttggacttcacatgtacctgttttagatgctagtatccttgatattaagctaatgctataaagagatgagatttttgtagagttttgggagggagggagtatattttgcatatgggaagaatgtaagtaatttgggccagaaggtggactgtgatggtttcaaaatatgtccacactcttcccttcaagaggtggagcttcattctcctgcctttatgtttggattggacttggtaacttgctatttatttatttatttgtttgtttatttttttgagatggagtcttactctgttgcctagactggagtgcagtggcatgatcttggctcactgcaacctccacctgctgggttgaagcagttctcctgcctcaccttatgagtaactgggattacaggcgtgcaccactatgcccggctaatttttgtatttttagtacagacggggttttaccatgttggctagactggtctcaaactcctgacctcaggtgatctacctgccttggcctcccaaagggattacaggcgtgagccactgcgccgggccgtaacttgcttctaatgaatagaatattgcgggaactgatggtgtgtgactttttcagattgggtcataaatggctttgtgacctcttttgattgctcactctgggaaaagctagcttccatgttgctacatgaagcctgttaacagccatgttagtgagctatcttggaagtggatcctttcagccccagttaaggcttcagatgattgtagcctgagccaacatcatgaatgcaacctcatgagagaccctgagccagaaccaccaagctaaccaccctgagaagctgtgtgagattaatgttttttgttttgtttttgtttgtttgtttgttttttgagacagagttgctctgtcacacaggctggggtgcagtggcacgatctcagctcgctgcaaactttgactcatgggttcagacgattctcctgcctcaccctccttagtagctggaattacaggcgcccaccaccacacctggctaattttggtatttttagtagagatgagatttcaccatgttggtcaggctgttctcaaactcctgacctcaggtgatccacctgcctccgccacccaaagtgctgggattacaggcatgagccaccacgccggccgaatgtttattgttttaagcttctaagttttgtggtaattcgttacaaagcaatacaacactaatacagctaatattaagaaagattttgtgaacaatatttggaaactttaatacccactttcaatcatggatatcaacaaggaaaaaagatttgaacaatactataaaccaggtagacctaacagacaaaaatatagaacagtctacccaacaacagcagaatacatagtcttctccatgacacatggaacattctccacaaatactaggtcacaaaacaaatctcaataaatttagaaagatggaaatcatacaaagtatattctccataatggaatgaaagtagaaatcagtaacagaagaaaaagtagaaaatccacaaataggttgaaattaaacagcacatttctaaataaccaagagtcaaagaagaaatcaaaaggaaaattataatagaaagtactttgagataaatgaaaacaaaaatataatgcaccaagatttatgggatgcaactaacactatgcttagagggatatgtatagctgtaaatgcttttattaaaaagaatctcggccaggcgcagtggctcacacctgtaatcccaacagtttgggaggctgaggtgggtggatcacccgaggtcaggagtttaagaccaacctggccaacacggcgaaaccctgtctctactaaaaataccaaaattagctgtgcgtggtggcaggcgcctgtaatcccagctactcaggaggctgaggcaggagaactgcttgaacccaggaggcggaggttgcagtgaactccagcctgggcaacaagagtgaaactcctgtctcaaaaaaaaaaacaacaaaaaaaaaaaccttaaataatctaatcttctaccttaagaaactagaaaaagaagagcaatctaaacccatagtgaccagaaggaaggaaataatacaatttagagtgaaaataaatagtaaagaaaaacaatcaacatcaaaagttggttctttgcaaagatcaacaaactcaacacacctttagctagactgatcaagaataaaagagagcacagtggctcacacctataatcccagcattttaggaggctgaggtgggaggatcccctgaacccaggagttcaagaccagcctgggcaacatagggagaccctatctctaccaaaaaatacaaaaattagcctgatgtggtggtacatgcctgtagttccagctactcaggaggctgaggtgtaaggatcactgaacccagggaggttgaggctgcactgagcggtgattgagccactgcactccagcctgggtaagagagtgacaccctgtctcaatcagtcagtcagcaagaggccaggtgaggtggctgaaaaaaccctatctctactaaaaatacagaaattagccagttatgttggtgtgtgcctgtagtcccagctactcgggaggctgaggcaggagaatcacttgaacccgggagacaggttgcagtgagccgagattgtgccactgcattccagcctgggcgacagagtgagactgtctaaaaaagaaaataaagagataaaaataattagaatactataaacaactgtatgctaacacatttagataacttagatgaaatggacaaattcctaggaagtcacagactaccaaacttgcctcaagaagaaatagataaaaatcaactgactgtaaatgtaagggtttacttctggactttcagttcaattcctttggtctatagacctataacgaagagattgaattagtaattttaaaacttcctgcaaagaaaagtccaggtccagatagtttctctggtgaattctaccaaacatttaaagaattataccaatccttcagactctctcaaaaaaatagaatagaagaggagggaacactttccaactcattttgaggccagtattactctgatactaaaactagaccaagatatcacaagaaaaggaaattatggtctggtatcctttatgaatacagatacaaaaatactcaacaaaatacaagcaaaacaaatttagcaacacataaaaaggattataaatcatgaccaagaggaatttatcttaggaatgcaaggttggtttaaatttgaaaaccaattaatataccatactaatagcataaaagacaaaaaccacataatcatgtcaatagacacagaaaaagcattttgactgacatcattttgtgattaaaacactcaacagaccaggaataaaagggaattttctcagcctcacaaagggcatctatgaaaacccagttaacatcatacttaatggaagaagactgaatgtttccactcctaaatcagcaacaagacaaagatcttgccactctgtttaccattgcactagagattttatgcagggaaatttagcaagaaaaagaaataaaagatacccagattaaaaaggaagaagtaaaattatctgtttgcagaaaatatgatcttatgtgtagaaaatcctaaggaatccacttaaaaaaattagaaaaaatgagttcagcagtgtgacaggatacaaaaatcaattgtacttccgtatggtaggattttatccaaaaaatgaaactaaggaaataatttcatttacaatagaatcaaatagaataaaatacttaggcataaatttaacaaaacagtgcaagacatacactggaaactataaaactcattgaaagaaattaaaaatgtaaataatggaaagacattacatgttcattgatcagaagacttaagataggaatatgccccaattgatctacagaatcagtgcagtccttatcaacatctcagttgtcctttttgcagatactgacagtctgatccagaaattcatgacatccgagggatctagaaaagccaaaacaagcttgaagagtaacaaagttggaggaatcacatgtactgatttcaaaattactatacagttacagtacttaagatggtttgatactgtcataaaggtagacacattatagatcaaaggaattgaaagtccagaagtaaacccttgtatttatggtcagttgttttgttgttgttgttgttgttgtttttagaatcagggtctcaatttgttacccagactggagtgctatgatcacacccagagtgctgatgtgatcatagctttattgagatatgattcatataccataaaatttgcccatttaagtatgtacccccgagagataggaaaacgtatgtctgcacaaaaacttgcacacaaatgttcttagcagcgtttctcataatagccaaaaagtggaaacaatccaagtagtcatcaactgatgaacatcaactggtaaacaaaatggtatatctagggttgagtgcagtggctcacgcctgtaatcccagcactttgggaggctgagatggggcagatcacttgaggtcaggagttcaagaccagcctggccaatatgatgaaaccccgtctctactaaaaaaatacaaaacttagccaggcatggtggcaggcacctgtaattccagctgctcaggagactgaggcagaagaattgcttgaacccaggaggcagaggttgcagtgagccaagattgcgtagctgcactccagcctaggtgacagaataagaccctgtctcaaacaaacaaacaaaataacacaaaatggtatatctatataatggaatattatttggcaataaaaaagagtgaagtattgatacatgctacaacatggatggacctccaagcattaggctcagtgaaagaagccagtcacaaaagaccagatattgtatgacacataaaaggcccagaataggcaaatctgtagaaaagaaagtaagtgattttctgggcctggggtgggatgggaatgaggaatgactgctaaggctagagggtttcttttgggggaaatgagaactgttctaaagttagattcggtgataattacacaacttcataagtatactaaaacttaactgtatacttaaatgggcaaattttatggtatgtgaattgtatctctattaataaagctgttaaaatgaaaagaaagacgctttgtggaagagttagaccttaaatgaagggccagatttggttggaaatgggagtgcagtgggacattatgaatagtgccacagaagcaggaagtataagggatgtttgtgaaacacgaaataaaagttaaggagtcttgaagaccaccataatttttgacagcaacttcaagtttgggggtccccagaaccattctcaggtttcataatttgctagaagtactcacagaagtcactgaaagctgttatggttacagtttattgcagtgaggagacacaaatgaaaatcagccaatggcaggggtatagagagccaagtctgggagaatcccaagcctaaatcttccggtgtcctcctagtgaagaaacagacaatgccaactgctctcagcagtgatatgtaacagtacacacagagtactgccaatcatggaagcttaactgagccttgatatccagagttgttttgggggcttagtcacatgcatgtggttgactcaccttcctgctgactttagttttcagcccttatagaggtcatgctgttaatgcatggcctgaagacccctccataaatcacattgttagcacagattatttggtgtggcccaaagctcccaggttaaaaaacaaaacaaaacactcctatcaggtgggacattccaaggatttagagattatctctcaggagctgccaggcctctccttgcataagattctttttttttttttttttttttttgagacggagtttcaaaaatttttgcccgggctggagtgcaatggcacgatctcaactcactgcgacctccgcctcctgggttcaagcgattctcctgcctcagcctttcatgtagctggattacaggcgtgcaccaccaacccaggctaattatttttgtaatttttgtagagacggggtcttactgtgttgggattacaggcacgagccaccgcacctggccaagattctttactacatagggaataattcaatttggctaaagtgtagactattccctggagttgaaggtgagcttaggagggtaaactagtgctatgttgttggaaattgatggaaggcgtttgttgtcatgggagctatctcttaagaagattaacccattagtggttatttgagagtgtgtagtatcctgacaggtaggctagaggaatttggaggatactgctgaagtttaggtaagaaataacaagggcttagtccaggatggcagaagttgaaagttgtttatttttagttgtttattttattttatttttgagacagggtctcactctgtcacccaggctagagtgcggtggcgtgatcttggctcactgcaacctctgcctcccgggctcaatcgattctctcacctcagcctcccaagtagcagggaccacaggcatgcgccactgtacctggctaatttttttgtatttttggtagactgggtttcaccatgtggccaggctggttttgaactcctgagctcaagtgatgtgcctcccaaagtgctgggattacaggtgtgagccactgtgtctggccagttgtttatttttattttggtttattagtctctctctatataaaagtataggtacgctcaagaaggacctaaataggcttagtaggggattgcttaaatgttttttaaggtcgggtgtggtggtttatgcctgtaatcccagcacttttggaggctgaggtgggcagatcacttgaggtcaggagtttaagaccagcctggccaacatggtaaaacctcatctctactaaaaatacaaaaaaaatttagctggcatcgtggcgcatgcctgtaatcccagctacacgggaggctgaggcagcagaatcacttgaacctaggaagcagaggttgtggtgagccaatatcgcgctactgcagtccagcctcggtgacagagtgagactccgtctcaaaaaaaaacaaaacaaaaaaaacacaactgttttttaagctgtaattttggtccagttatttggaccagctctcagtgtcttttaaagcccttttgcatcttcacatatgattacatttagcagctggaaattggtagctgagtaggtaaaggacagagaaaaataaaaatagaaaatgtgacttgaaatagtatttggaaattgggagaataggtatatagctgctgattgtatccatatactacaatacttctgttgaagttaacactttccagggggattcaggatttgctccagggtgaggattcttcctccactgcatttcagttgaggcacaatggtcgtctttcttttataggactgtcatctctgtgaccgagagagccatatgcagccactgctataatggaagtagttaaaataagagaagatttaaacagatcttcaataagtagtccttattagagcaaaactgagagtaaatgtacaatgacctctgatatgcatgcattatggcctttaagtgaaaaaaatctcattagcagggagtacccttttttgagacggagtctcgcttagctgcccaggctggagtgcagtggtgcgatctcaccgcaaccactgtctcccaggttcaagcaattctcccgtctcagcctcctgagtagcttggattagaggcatctgccatcatgcctggttaatttttgtattttagtagagacagggtttcaccacattggccaggctggtcttgaactcctgaccacaggtgatctgctcgccttggcttcccaaagtgctaggattacaggtgtgagccaccacacctggcttttttttttttttttttttttttttgagatggagtctcactctgttgcccgctggagtgcagtggcccaatctctgctcactgaagcctccacctcctgagttcaagtgattctcctgcctcagcctcccaagtagctgggactacaggtgcacgccaccatgcctggctaatttttgtgtttttagtagagatgaggtttcactatgttggccaggctgatctcgaactcctacctcaagtgatctgcctgccttgacctcccaaagtgctgggattacaggcgtgagccgccgcacccggcctgggagcacccttttatgagacttagtaatgccagtggatgtagacatatcaggtctccaattaggaattgtgatagaagaaatttgcttttctcctttccccgttgaattttcatgaggtttagatgaaaaaccaatacagagtggtgctcgagaagattcctgcaataaatttgtgttgttagattactttgggacggaaaacttcatagttctctgtgggtgtacgcttccatcccatctgtgttctggaccttatctgtgacatcaattatagtgacaggagctcatcttagcttggatcacagcattagaaaagccttagtgttttctgacagcactattgctgttgtgctgaaaatgtaatgagtagctataaataaaatgaaaacgggaaatccttcctgcatatctaccttcctaaagtatttattgaattgagtacctattatgtgtattaagctatattaagttctgtgcaggataggaaaaaggtatgtgaatcacatgctgatgttgggattttgtaggatgataagttttcagacaccaagtgataaatggccagttcagaagaggaagagaccacacatggctgggggaatcaggaatgcttggtggtaagctgaagagtatgttttggagctgggtgtaaaaaatgcctttctctgtgaggcatacaaatgaggagattggaggccatcagcagggactgacatgtagttcagtattatgttatgggatgcatggagggcttttggtagtagagaaaaaggtaaactggaatcatcaatgtgtgcagtgtgagtctacactttatgctacaggtaatagagaaactgttgacagattttgagcaagatgacgtgatcacagctgtactttgagattaatctagaagttatgtgggggatgaattgaaataggtggtgaatggaggcctgaccagctaagagactattgtcatagtttagggctaggcaagagtttatgagatcctaaactaaggtagtgtgttttcagttctgcagagaactaagagaggtttgaagttgaagcaagttttgaatgaatacttggttactaattcaacagagctaacttaagttgttggagatgtataatgatgagaccctgatagcttttcttggtaacacttcttaaacaatcctccttagggcatgcttatgaggtagcgtcatcctttcaacctgactcagtgaggcatgacagtgctgactagaaaggttttcatcctaaatgtcatcaaattaatgctgggaaagactaaaaggaaagagggacttggtgatgatgctctcagtgactctaaaagtggaggagaatgagtaggggccctgggaagcataaaggaagaaggagtgtggcaaaaggaataatactttcatgtgtgtcaatggtggaacatgagacttcatatacaaatttaagaccagagtgaccattatgaaaaaaggaagttacatcaaattatgtactagagttgaaggtcatagtgaatcatgaaaaaaaaaaaggaattatatttgtttgaagcaaaactttaagataaacttatagataaattatcggaagagttaaaagataaaataagagctaaacttaatttaagtgctgtggaaccatgagaacattttctaatagtgagaggagttatgtatatgatcccagctcttttttgataatagatttgttgagcataagaaagggtcacacttggccgggcacaatggctcacacctgtaatcccagcactttgggaggccgaggcaggtggatcatgaggtcaagagaccattctggccaacatggtgaaacctcgtctctactaaaaacacaaaaattagccgggcatggtggtgcacacctataatcccagctactcaggaggctgaggcaggagaatcgcttgaacccgggaggtggaggttgcagtgagccgagattgcgccactgcactccagcctgggcaacaagagcgcaactgtctacataaataaataaataaaacaatgaaacttgctgcctcgatgactcttcctttcatggaagatttctctgcagcatatgttgctgtttgatagcattttacccacaaaactcctttcaaaattggagttaatcctctcaaaccctgcctttgctttctcaattaagtttatgtaatattctaaattttttgttgtcttttcaacaatgttcacggcatcctcaccaggagtagactccattgcaagaagccacttttttttttgcttatctattagacgcaatttctcatccattaaaatttttattgggagagtgtatcaattcagtcacatcttcagggtccacttttaattctagttctcttgctatttccatcacatttacaattacttccttcactgaactcttaaatactgcaaagtcatccacgagagctggaatcaaattcttctaaatttctattcgtgttattttgacctcctcccatgaatcatgaatccctttttttttttttttttttttttttttttcaaacagacaggagctcactattttgcccaggctgatctcaaactcctgagcttaagtgatcctttagtctcagtctcctgagtaactgagattataaggcagcaccaccatggccagataatcacgaatgttcttactgacatctagaatggtgaatccttttcagaagattttcaatttactttgcccagatccatcacaggatttatctgtggcacctgtggccttatgaaatgtagttcttaaatagtaagacatagaaattgaaattactctttgatccatgggctacagaatgaatattgtgttaacaggcatgaaaacattaatcttcttgtacatctccatcaagctcttgagtggctaggaacattatcaatgagcagtaaaatatatatatatatatattttttttttttttgagatggggtctctgtcaccctggctggagtgctgtggcatgatcatggctcactacactccagcctgggctcaagagatcctcccactttggcctcccaagtagctgggactacaggtgcatgtcaccacaccttgctaatttttaaattttttgtagagacggagtctcaccatgttgcccaggctggtctcaaactcctaggctcaagcaatctgcctgcctcagcctcccaaaattctgggattacaggtgtgagccactgtgcccagctaatgaacagtaatattttgaaaataatctttctaagcagtagaaagtcaagagtgggcttgaaatattcagtaaaccatgctataaatagatgtgctgtcatccaggctttgttgttccatttatagaccacaggcagagtagatatagcataattcttaaggcctaaggattttcagaatattaggtgagccttggctttaaatcactagctgcattagcccctaacaagagagtcatcctgtcctttgatgctttggagccaggcattgacttctctgtagctacggaagtccgagatggcatcttcttcctatgtaagactatttcgtctacagtgacaatctgttgttttgtgtagccaccttcatcagtgatcttagctagatcttctggataacttattgcagcttctgcatcagcactcgctgcttcacctgtactttttatgttatagggacagtttttttccttcaacctcatgaaccagcctctgctagcttcaaacttttcttctgtggcgttcctcacctctctcagcttgcatagaattgaattcaagttaaagccttgctctctgaattaggctttgacttaagcgaatgttgtggctactttgatcatttatccagaccactcaaactttcttcatatcagcaataaggctgttttgctttcttatttgtgttttcactggagtggcacttataatttccttcaagaacttttcctttgcatttacaacttggctgtttgatgcaaaaggctcagcttttggcctcttggggcatgtcttcctcacttaagcatgatcatttctagcttttgatttaaagtgagagacctatgacttctcctttcacttgaacacttagaggccattatagagttcttcattggcctaatttcagtattaaatagggcagcccaaggagagggagagagttgaggcagtggccagtgagtggaacagtcaaaacatgcacaacatttattgatgaagtttgccatcatatagagatgtggttcatggtgccccaaaacaattacaatagtaacattaaagatcactgattggccaggcgcagtggctcacgcctgtaatctcagcactttgggaggccgaggcgggcggatcacgaggtcaggagatcgagaccatcctggccaacacagtgaaaccccgtctctactaaaaatacaaaaaaattagccgggcgtggtggccagcacctgtagtcccagctactcgggaggctgaggcaggagaatggcgtgaacccaggaggcagaggttgcagtgagccgagatcgtgccactgcactccagcctgggtgacagcgagactccatctaaaaaaaaaaaaaaatcactgatcacagatacaataatgaaaaagtttggaatactgcaagaagtaccaaaatgggacacagacatgaactgagcacatgctgttggaaaatggcactgacggacttgctcaacacaggcttgccacaaaccttcaatttgtaaaaacaaaaacaaaaacacatcttcaaagtgtaaagcaaggtgcaataaaataaggtatgtctatactgtataaaatacaaacagccgcctttattttgaggtagggataatcagctgaaggactttgtacctgggatctttctcagttccaaataaccttttctcacacagtcataacagtccactgagatagaggtagatccttgaagccatgggtcttctaagagagctataactgggacagtatcagttctgaccgcactctgacctacggaaggtacatccttcagctcctgccaacttggcaaaaagctttattcccagatgttttgctaattgaggtcttagtgttttctgataatctgtagttttctgtaaaacttctttataggacttagcatacttgtagtaatttaaataactatttattagtctattattctctcttaagctataaactttactggagcagaaagtctattttgttcatcgctatcttcccagtcctagcatataggtactcaaatatttgttggcatactaaccgcattattttacatatctaggatgtggctcctataaaatttagagagccatgtgtcagcttgggtatcctcaaatgtattgagttggtcccaagagtgagcacctcaagagggcaaggcagaagtgcatggcatttttatgacttagttttggaaatcatgtatggtgtttgttacttctgtcataccttattgttcaaagtagtcataaagtactttccaagttcaaggtgagggaataaggacttcataacacttgatgggaagagtgtcatagtcacataagaagaacatgtgaaatgggagatctcgtattggctatctttgaaaaagaatgttacagttgtttataattttcacaaaatttggaaaactttttggcccttatttcttcaaacatattttctgtccccctccacattgtttttttgagactaattatatgtatgctttatatctcactaagactttgcttcttccttttcagttatttttttctctctgcttcattttgtatagtttgtgttactattgtcttcaggttcactgttattttcttctgtagtctccaatctgtcgttaagctcatctgttgaatttttttttatatcttctattttctcaccttattatgttcatattttccttcaaatccttgcgcatatttattccaactattttaagttaactgttaacttgtctgctaattctcttatctatcacatttctgggtctgtttctattaacagattcacccccaccccaattacagtatttttctgcttcacatatctagtaattttttattgcatgctagacattacaagtgctacattaagtatctggatattgttgtctttaaagaatattggccaggcgtggtgggtcacacctgtaatcccaacacttcgggaggccaggtgggcagatcacctgaggtcaggagttcgagaccagcttggccaacatggtgaaacctcatctctactaaaaatacaaaaattagccaggcatggtggcaggcacctgttgtaatcccagctgctcaggaggctgaggtaggagaatcgcttgaacccgggaggcagaggttgcagtgagctgagattgtgccattgtactccagcctgggcaacaagagtgagacttcgtctcaaaaaaaaaaagaatattgaaaattgttttggcaggtagttacttgctagtcagcttgatactttcaaagcttgcttttaagctttgttaaggcaagtgtttggaatagtttttgctctagggctagtttagctctactactaaaggatgattctccttagagctctaatgaatgtccctggtattcaagatcatcctatccagatagtgggaacgcagatgtcccccagcctgtgtgagctctgggaattgctcagcttgcaattccagtttgcagtttcattgcctggctttgtggggtttcacctaatacatgtgtaggttagtattcagtaatggactaaagggatccctatgcagaggtctcccttctggaggtctttctctgcactgcaaatctcagccacctcagtttccacaaattccaatctcagtctactcaattcctgaagaaagatacattgtggtctgcaaagcacttctgggcagaaagctggaatgatcacagggctcaccttatttgtttcccttttctcaaggatcacaattctttactgcctgttgtctgctgtttatatcaattttttcatgtatctttgatccagttttctagttgtatgtggtggaagagaagattctgtaccagcaacacaacatgttgaagtatgaatttacccccatgatttctttctttttttaaccacttaaagtacaacttagtttccaaatgtaaaaatgaagtcaactttgagttagaataaataactcggcttcaagattcaggcctacctctaacttgctgcatgaatagtggcaaatcttacttgttttttggcagacacagcaaaattgaattgaatataatcctatttgccctacttctcaggcattctttaacaagcaaatggaaataaaaacaaatcacattaaataaggatgaggttatatttatagttagttgacaactcacttttcaaacctctcttgcctatcttccagttccattctctaaagaataaaagcgcctgagttaaaagtgtagtgagactggtgctgttccactgctcctcctcttaatattagccaactgctactgaatgttttctatgtgccgggaactgtgtaagccttttatgtgaataaatttactaaattttcttttttccttttttttttttgaaacggagtcttgctctgtcgcccaggctggagtgcagtggcacaatctcggctcattgcaacctccgcctccctggttaaagcgattcttctgcctcagcctcccaagtagctggggctacaggcgcttgccaccacgcctggctaatttttgtatttttagtagagacagggtttcaccatattggccaggctggtcttgaactcctgacctcgtgatccacccgcctcggcctcccaaagtgttgggattacaggtgtgagccaccacgcctggccttactaaattttcataactgccatatggataggtactattattgtcatttgacacctaagaatgagattaagcaacttggagaaggtcacatagcaaagtggcagtggcagaactaggactgatttttttttttttttgtatttttagtagagacggggtttcgccatgttggtcaggctagtctcgaactcctgacctccttatctgcccgcctcagcctcccaaagtgctgggattacaggcgtgagccaccgcgcccggccaaggactgattcttgagccatgctcttaaccaccactatgtgactactttaaaactactgaaaatgcatcaactgctgctgtagaatcattaattatccttaaatataaaagagcatcatctctgccatcctgttaacaaatcctgtttgtttagtcagcctgatttccatggggaagcagaaagattgggctatcattggaatatgtgattcctgagaaaaacaccgttacaatggctggaaatggaagatgatgtccagcaccaactaccttgagaataggctataagtggagtacagaggatctagtgtggttctcagaggatcactggtgtgtactgaatctctactgtatgtcttttaatattaataggctcattattcttttttctctcctttctcagacacatttaatcaaaccaggcaccaaaatgctaacactccttcctggagaaagaaaggctaatatttattttactcaaagaagagctccatctacaggcattcaccagagaagcattgcttccttcttcaccttgcagccaggtatggtgacccatatgggaatacttcattatccagagcaaaaaaggagtgtgttcatttgtccatgttagaccatttatgagaaatggtgaaaccagtgcattgtgttaaacttagcctgttagaagaggttataaaacataagttgttgccttttgaaaagcaatatatgtgtacttttacaaacatacttttctggttctgttttgctcagcttaatattaaatatttgtatttgctgacagagcagtcaggaagggtgtacttgggagttggaggtgcactggggagttgccctgccattagttaggtggtatatatcttgggttggccacagtgggtactctgtctaaggttaattaataattgatacttttgtgtgacgcttctcaaattagtgaaaggttcaaagatgctttttcttagcctcacataaagttggcttatgtctcttcctttggctgttctttgcttccaggtccctgttcaggggagcagctgactcagagcaggctgggccttaaacagcagggttcctgccacttggagggtgttgggaagagtgctctaatgccgggtgtgattctcaggattgctttgcctaaaccttcaaaatgccctctccctcctccaaacaaaaacgtacactcttttgctttatgtaagggcagatttaaaaaaaacaaacaaaaaacccactttttccacttacaaattctggtgtattttatagtctatattgaatgctaaggaaaagttgagaattctcacaaaacctagtttctgcagtataattcttattgtagaaggaaagaggaaatcagttattctgctttgtttttataattagatcttggaacaatttgagccaagttgggaattccatgtcctccatccttatcttaaggcagaacagaatccactctatgcctgataaaattaacaggctggacactagtagttgtttcactattctacctactgattgacttagcatcctaattgtgtcttcactccctttccaatgaaatgcctggggagtggaggacccacgtttttcacactgtcaccagaaggtttctcagagttggatagttaatgtcatctttaagaccttacaaaactagtatgtgtttagcatgtttctttaaggataatgtctaggaatgtatatttgaccaggatcaccatttagtaaaaaaccacattaaataaaaaacaaaagcaaaactgatgtgccgtatgttaaacaaacctacaaatgaaaactcagctggtaaagtaggctatggtctgatcgtatgcgatgtttgactttattaggtaggtgatgggaagtatccatgtatttgagtagggaatataagatctgatgttttagagtttattcatgatagactggcaagattgaaaacaggaagattggctacaaagttatgtgaagagtcttaagactcctgcactaggtagtaatagtagctgatactgatttcagaaaaagccaactgaatcctgcttagggcagtttttctgcagaataatatttgttcattcctgttttattaggaaagacaaatggcagtgaccagaagagtgtttcatctcatacagaaagtcagatcaacaaagagtccaagaaaaatgcgacccagctagaccatttgatcccaggcttagcacacgattgcatggcatcccctttagccacttcaaccactgcagacatccaggaagctggactctctcctcagtccctccagacttctggccaccacagaatgaaaaccccattttcaactgagctatctttgctccagcctgatactccagactgtgctggagatagtcataccccactggctttttccttcaccgaggacttggaaagttcttgtttgctagaccgaaaggaagaaaaaggggattctgccaggaaatgggaatggcttcatgagtctaagaagaactatcagagtatggagaaacacaccaaactacctggggacaaatgctgtcagcccttaggcaagactaaattggaaagaaaggtgtctgccaaagaaaacaggcaggcccctgtcctccttcaaacatacagggaatcctggaatggagaaaacatagaatcagtgaaacaaagccgtagtccagtttctgtgttttcctgggacaatgaaaagaatgacaaggactcctggagtcaacttttcactgaagattctcaaggccagcgggtcattgcccacaacactagagctccttttcaagatgtaaccaataactggaattgggacttagggccgtttcctaacagtccttgggctcagtgccaggaggatgggccaactcaaaatctgaagcctgatttgctctttacccaggactctgaaggtaatcaagttatcagacaccaattctaaatgtttgaagctttgtttctaaaagtaccttgaaatgatagagatgtaggaaaatatagttgtgggtggagagaggagtgagtttgtttaggtgggaaggtggcatgggatgaagttgtcattactgagcatcttctctgtgtaaataaagggcagtaccattgttaagacagtgggattggcatcatggctttccctcaggaaggtggtggctggtaaattccctgaatgagtctatgatgaacactgaggcagcacagtgggtatttatctctatgaaagtgccttttactcagcctgcacagagccatctctttgcccttccagatgtctgactgggaccttgcttatggatgtgtttttttttttttttttttgagatggagtctcgctctgttgccaggctggagtgcagtggtgcgacctcagctcactgcaccctctgtctcccggattcaagcgattctcctgcctcagcctcccgaatagcagggactacaggcatgcgccaccacgcccagctaattttttttggatttttagtagagacgaggtttcaccatattagccaggatggtctccatctcctgacctcctgatccgcccacctcagcctcccaaagtgctgagattacaggcataagccaccgcgcccagccagatgtgtgagcttttaatctctggctgatcttaacccacatcagcctaagcttgggatgattactcttgacccttttttttcagtgattagcaaatctccccacaacccaggtgtggagagaagagaggtagaatggtgctagtttcctattttatttttgtggtaactgtacagcactttaaagttatatactctatgtttaaatatctcccttaaaaagcctgagctgtacaacaatctggatgtgactctgttacccttttcccacaagataggagggaatcccctttgtaaaactatgaatccaaataaatgtttacaaagtggctcttgtgataattggtaattaaaccattaccaattttatttttgaaaaggcaacactgtaatagtatatgctgtcattgccctgagcctgatctgaaccagagtctagtttgacctgtcttctacccaaggcattattccttgttgttgatgtggtatctaagaggcttaaacaacctctaagggacaaacttgcaaggttataagagaactgcttctttttttttttttaacttaaattttatttttttgagacacggtctcgctctcttgcccaggctggagtgtggtggcatgaacacggttcactgcagcctggacctcctgggcgcaagtgattctcccacctcagcctcccgagtagctgaactataggcacatgccaccatgcccagctaattatttttaaaatattttgtagagatgaggtcttgctttgttgcccaggctgatcttgaactcccaaagtgctgtgattagaggtgtgagccactgtgcctggcctaatttaaatgttaaattctacttttatcgtgtatgtcatctctccagtcattttcctggaagacctgcttttaagaatgtatggggcttagtgcggtggctcatgtctgtaatctcaacgctctgggaggctgaggtgggaggtttgcttgagaccaggagtttaagaccagcctgggcaacatagcaagaccccatcgctacaaaaaaatttaaaaatttcctgggtgtggtggtgcatacctgtagtcccagctactcaggaggctaaggtgggaggctcacttgagcccaggagtttggaggctgcagttagctaatgatcccaccactgcactccggcatgacagagctagatactgtttctaaaaaaaagaaaaagagtatagggcaaaatctctacagaaagggggaagaaaccccctagaagggcaggaccttataaggaaagaggagaagccagtagcctgtttaagttcatacaccttaaaattaacaataatcctatgcccctgaaggatactgggtaatcgcaactcaagagatggacacagcaaatgcattctctctccaagtccttcctttaatgtcaggtagtgcttcaacccaaacacaagcagtatacataccatagagaaagggacctgagggcatctgagtcatgcatggtgtggtacatacaaaccttggcccagcccaaaggagcagtcaagggcctggaagaaagatggtttgctctttccccctcctcctctctctttcctaccgggcttaaagtccgtggaagagaaagtttttaatcagtggaactgataaggcctcagggccgtggagggtagatttggttgttcagtaatataaaatgtgtttaagaaaaaaaacagcccaggcttcccagcagtagcccatgtgttggctggttcagcagcctgacctctacatctagacaaggaagtgaggagggtgattgctgggcattggtgtaggtttatgacggagcagcataagattttccgtgccctgtgaacatgtatacaaacattcatagccccttcccctcagccctgctctgctgcaaggaagctgctgagtgagtgacagctgggcacaaagtgtcttgtgagaccagctatagggtctaatgcagtgaagtcagtcatttaggacctattttcacacaggggcaaggaaaaaccagaaacaacttctctcttaccctttaaactaagatacttcattctacacgattacctgaaacaaatgtctcaggtcaaatcacaagccttagcttctgctagggtttgaagtctgggaaatatataatccagctcttctctttcagtccaagctctagcttgtcagcaagactgttgcagaagatctatccttaagaggcagaaacatctgcggtgaggaaggcagctattgaaggtattccaggagcatgagactgagtttgcagagctgagggttgtcaatttccttttctactgatatcttcttcctttagagcaaacttcctccttaggacctcagagataagcacagcagggtcttcctccttcaataaactccggt

SEQ ID NO: 519 - DNA, 12516 bp, Homo sapiens
gagcctcggagcccgggcacccctgacgggctgcactggggagggggaggagcctcgaggccggtttggaatttttggcgcgagcagctccgcgcgcgttcacgggccgttccccctcacgggagtcctccgcccgggcgtccggaacagtcgacggcagactccggcccgctgagccacccgaggggtcccgtggcctccgcggacccggaatctgggccctcgcggacccgcgccccgcccagtcgccccaggtgagcccagaccccgccgtgaggggcctcggcgtggccacctcgccgctcccctccgcctcgccaggtctgcgttacccctgcccctcaggcctccccggcggcccgctcgcgtcccctcaggcccgcccccgcgagcccctgcctcccgtcctccccaattcctggttcccttgcctcgagccccttcccagcggcggtcccgccctactcgcccctcccggagaccccgcctgctgtccatcaaccccgcgccgccgccctccccgtgacagtccttcctccgtgacagcccctgccccgggacagcctctcttcttctgcaacagcccctcttccctcgtgacagcccgtccactgctctgttcgccagggcttccccacacccacggagtgaagtcagccgcggccctgcctgggaggaacttaccgtctaccgggaaaggtggccagcagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtcatgctagaacgtaagtcgtagggcagggacggtgggagaactgggttaagatgcacaggcccaggtccccgagtgtgccagggttgggcctggaggctgtgcttgtgaccagtgacctccaggatcccaacaccctggctcctgacttggagaaaccctgggctgggactctgaggtagttagagtcagaggaagagtctccacaagatggagggcagcctgccagccaggcccaggtagcatcgctcccctcacccctgtactccctcaggtactggagactgctctttttaattttttatttactattatgtatatttttttgagatggagttttgctcttgtcgcccagttggagtgcaatgccgcaatctcggctcaccgcaacttccacctcctgggttcaagcatttctcctgcctcagcctctgagtagctgggactacaggcatgcaccagcacgcccggcaaaaatttgtatctttagtagagatggggtttcaccatgtaggccaggctggtctcgaagtcttgacctcaagtgatccacccaccttgcctcccgaagtgctgggattacaggcgtgagccaccacacccagccgctctattgttttttataatactttggtgcaccagcctcaccaacatggtgaaaccacatctctactaaaaatataaaaattattctagtgtgttggcacacgcctgtaatcccagctactcaggaggctgaggcaagagaattacttgaacctgggagtcggaggctgcagtgggccgagatcataccactgcactccagcctgggcaacagagtgagaccctgtctcaaaaacaaacaaacaaacaataccttggggcataaagtgttccacggtccaatccaattaaatttttttttttttttgagacagagtctcgctctgttgcccaggctggagtgcagtggcatgatcttggctcactgtaatctctgcctcccaggttcaagcaattcccctgcctcagcctcccgagtagctgggactacaggcatgcaccaccacacccagctaatttttgtatttttagtagagatggggtttcaccatgttggccaggctggactcgaactcctcacctcaggtgatttactcacctcagcctcctaaaatgctgggattacaggcatgagccactgtgcctggccagatccaattaattttgagctcctttgacagggtggcttttgaggtcagtgaggtttgttctgacagcaggcaggctcttcctagctagctctttctccacttctctgtggtaaactagctggcctatggttcagctggttgccctaatgcgggtaccagtctcttcttaatggcgcaccaccaaaacttccactgattttgacagcccctttaaacttgaacttccctacgcactgtttcaaatcaagccaattttcagggggttggtgggtggggagagctctatttatgacctacgtctacccctaggctaaatctctgtctgagccatgctgtggaactgggggcaggacagcggggcacctctctgagtgctgctattgctttaggagcaggtcgctgggttgggcaggagcctctggccttcttggttgccctctcccagtgtggagcctccttcctacaaatgagctggggctccatgttcccagcctgccgggcctgagatatagcctctattctatgcttgggggcaggtggaagaaaggagcccctggcctgtctgccacactcagctggaatttagcctctgccatgtggagctgggagggttgagaagtgctgagaacctggccctcctgggcaaacaccctaacccttgacggggagctgggggagagggagcccttcttcttggccacacctgcccccagtgctaggcggggggagaggggtgctggaggtgggagggcaggagtgtcatggctcaggtgccaacaggcttgccattattcccaggccttggcaggttttcttgtgtaaacctttgtttgctgtgtgccctgggcaccatgcccagaggctttcagtgcttgcttttgaataatcgtcatcagttgtgctgtttcactggggcaggggtccacggagctgcacacactgccattctggaagtggacaccactaactgggttttggcacgacagttatgaaaaagaaagacacttgagggattccgggttttcactttggaattggagataagggatcgtgggcccgtgtagtctcggaagaggttgtgtagtttaggatcaaagagctggccgtgatgagggcagggatgcaggcgcagcccgtctgactccaaactgccttgctcttaacccgactgcaagaccctcaagaacacgggccccatggttttcctcttatgtttctatcatctctaaaatacaacagcctggtgggcaggtgagtatgaatctgtcctctgccttttcttggtaggtgcttattgctcccattgccgtttaaagtagaataagtgtgtggtatagacatagctctcttctgtggcctctttggagccacagggccaggtggtatcagagtggacatgctgccctgtactcagcctctgtctctgcccccagggcctcctgcactggccatgcccatgcccacggagggcaccccgccacctctgagtggcacccccatcccagtcccagcctacttccgccacgcagaacctggattctccctcaagaggcccagggggctcagccggagcctcccacctccgccccctgccaagggcagcattcccatcagccgcctcttccctcctcggaccccaggctggcaccagctgcagccccggcgggtgtcattccggggcgaggcctcagagactctgcagagccctgggtatgacccaagccggccagagtccttcttccagcagagcttccagaggctcagccgcctgggccatggctcctacggagaggtcttcaaggtgagtgaggggacggcttctaggcccatctgggggacctcctttgtgtttctgcacctcccttggcaggacagtgtcctgggcagcctgatccccttccgttccctacagcctgtccctgctgggctcacaggctccctccacatttgacttggctgctcccatcatccccaatgcaggcccctccaggggttgctctgtgcatactggccccttgtccagagtctggcacgccctgcagcagcccctgtgccatctcctccggccctggcgccagctgtgcagcgtccttggcgagtcggcccagcctctggcactggccctgagtgcagtgcctggccagccctccccaggctggcaggctttgagctaccccctgcctgccatcttgcttttcttaaacacagtttccagtcatttatattttcttttagagaggagttttcccttgtatgagtcctgtatgaagacaattttgttaaaaagtacaaacaacattggcccccaggtcagctttctcacaggggagcccacttttcacaccacagcctgggctgcctgtgttgctctgcagctgctttttccacctcgtgacacatccaagaggtcccctggggtcagtgcaggtcggccctggctcctccgtcgctgggtctccacagacccagcccgagggatggaggtttgtctggttttgttattaccctgggcaggggtctgagacagatgccagctacaccaccgtgccccgtgtgtgaacccttaatggggtctgccaggttgtccccctatgtgattgtgccacttgtggctcaccctcactgtgtgcgtgggtaccacctcccttccaggtgcgctccaaggaggacggccggctctatgcggtaaagcgttccatgtcaccattccggggccccaaggaccgggcccgcaagttggccgaggtgggcagccacgagaaggtggggcagcacccatgctgcgtgcggctggagcaggcctgggaggagggcggcatcctgtacctgcagacggagctgtgcgggcccagcctgcagcaacactgtgaggcctggggtgccagcctgcctgaggcccaggtctggggctacctgcgggacacgctgcttgccctggcccatctgcacagccagggcctggtgcaccttgatgtcaagcctgccaacatcttcctggggccccggggccgctgcaagctgggtgacttcggactgctggtggagctgggtacagcaggagctggtgaggtccaggagggagacccccgctacatggcccccgagctgctgcagggctcctatgggacagcagcggatgtgttcaggtggggaccggggcacgccaggtgtttggcaggctgtgggaggcccttcctgggacggaagctccattccccaggagggaagctccaccctagcccaggacacccggcctcagagccacaaggctgagacgccatccctgccctccagtggagagcgtctctggtcaggctgcctgtgagcctcgaaccctccagagccactttgtgtaacctgcctcctcacagctccacaggagaaacaattgtcactccatttacagccagattaagggccttgccggagcccactgctagcaagtggcatagctgagactggccctaggtgctgggttccagggtccacactggtaaccactgccctgatcatcaggatagtaatacctgccagcagtaactgtggtgcctgtccatcagggcactgggaggactcaccactgtggcttgtgggctccctgggcacagagcccatattccatgatgtccccatcctgcccagggttcatgatcaggcctgttggggtgtcccttccccctgcttccgcccctccctgactgatgaagacagcagccctctcccacccacctccaagaggcagccctggactgggtctgtgtcccagggccaaccctgcccctttctgtccccatcccgtccctgccagtctgggcctcaccatcctggaagtggcatgcaacatggagctgccccacggtggggagggctggcagcagctgcgccagggctacctgccccctgagttcactgccggtgagtaggtgagggcgggagggggtgctgccacgggctcctggggagatagtggctggccatggaggcactgctgggctcagggtgcagtcggtgttctgggaccccgatgtggcccttcctcatgggcaggtctgtcttccgagctgcgttctgtccttgtcatgatgctggagccagaccccaagctgcgggccacggccgaggccctgctggcactgcctgtgttgaggcagccgcgggcctggggtgtgctgtggtgcatggcagcggaggccctgagccgagggtgggccctgtggcaggtaagctcccgacagtggcggctgcctgccctgctccccagccccgggggtccgcccacccacatcctgagctcctctcccccacaggccctgcttgccctgctctgctggctctggcatgggctggctcaccctgccagctggctacagcccctgggcccgccagccaccccgcctggctcaccaccctgcagtttgctcctggacagcagcctctccagcaactgggatgacgacagcctagggtgggttcaagtgcagggtatggggggctagggggaaggtgggggatatcaccggggctccatggagattcgtggtgaatggggaccactcccacaaacctggcccccatcacatcctggggaaggggaccaagactgggggtgtgtggcctggccaggcttaatgcagctgggcatgtggactggccgttcagggcatggcttcacacttagggcaccagcaccccagggagtggctggccgcgcagccccgaccccagtggaggctgccagtgcccagggataaaacattgtcccttctctgggaagagaaagcctctggagtctggggagccctgccctgggaacaagtccttggtccctggggcctggtgtcttgagtgagaggctgtaattaggaaaccacacgctcagggcagacagctcttggggactctgccgttagccccttccttacaaacacatcacctcatccctcggggcacttgatagcagacaagaagttccagaaaggcttacatttactaaaagtttatttcaaatctgcctccaagtccatgtgttctgaaaaggacagagggggccttggagtgcagccagatggaaggactttgaaggctgtccaagtgctgctttcagagtgcaccaagtttttattgtccctgactgtggctccctgcctgtttgtcaggcgggagcctggagcctgcacagggacagagctggtttcatccggcactccctagccctggacaccctccttgtctcgcctgccctcctgcaggccttcactctcccctgaggctgtcctggcccggactgtggggagcacctccaccccccggagcaggtgcacacccaggtaagcaggtccaggggctggggtgggcagggctagcttttggatcctgagtgtcactactctctcctcccagggatgccctggacctaagtgacatcaactcagagcctcctcggggctccttcccctcctttgagcctcggaacctcctcagcctgtttgaggacaccctagacccaacctgagccccagactctgcctctgcacttttaaccttttatcctgtgtctctcccgtcgcccttgaaagctggggcccctcgggaactcccatggtcttctctgcctggccgtgtctaataaaaagtatttgaaccttgggagcacccaagcttgctcatgtggcaacatggcccttcctgtccctttattgatgtcatccagggtcttaacgcccctgaggctgagccctgctgcagaacccagcgctcctggccttgggccagcagctgaagccccatgctgtgtggagcaaagaggtttcctgagcaggcacatcccccggtgggtacctggagctgttgggagtatggcactcaaggtggagggcaggcacggcccaggggtcccaggatctgaggccgctgagctccctgtgtcagtttcctggaagaagcagctgcagcccttgtgcctgtggccagctggtacaagacgggtccacgcccccttggtccttttgtcctgaatgccttactccatagtctctgggcagagggagccagggcgggcaagcttgtggctgctgggagggctggtatgcagggcagaaagatggagatcaggaagactggccacaggcctggtgggaggaacaggatagggtgaggaggctctgggctggcggcctggcaggacttgaactctcagagcaagacgtgaccccagagtccctctctggtctaaccccacaggtcacagagggtaaagaggtcccaagagggaaaggtttccttccagctgacacagtaaaataggagcttggagggaaaaggcagggaaggaagttggagcgccacggcgtgggtggaagaggtcagtccacagggaagaacgggtgaacagggctcctgctgagacatctcatgagctggaagcatccaaggagccagccccttgcagacgagttgggaggaacacctggtgttgctaactctaggaggctgctgtgggcaggctggcatggcagctcagtcccggggacaggcgtggtgggcagcccagagcaggtcgggcacgacgccggcgtgcagctgcaggatggagcccacgctcagcaggtgcatgatctggtgggagttgccccagtagtcaaagcggccaggtccccagcgctcgggcagacgggctacatttaccagtcccccaagcagcgccagtgcgtccatgcgcaggtagcagggcagggagcctggagcccctgaacccagacccactccccgggccccaaataccagtaggcgggcagcagcctgccatccaaatgcccggagccgagcactggtggagggggcggtgagagcacgccagccggccacacccgacaacacagtgtagcccaccagggcagccgggcgcagccagggcctgcaggccagggtgcagtggatgatgggcagggcccctgcacaagaggagagaacaggagagggcatgtcattgtgagggtccacccgcccttccctacccatggcttgtatgcgtgccccatgcctctcccgccggtggctccagctcccatcccttgggccctgactcaccaagggtgttgacaaggcagaccccacacatgtccagggcgaggagccgggcgtacacagcgctgcccccttggtggcacataaagaggtgatagagcacggagcctgcagggggtgcaaggcaggccacgcaatgtgtgcctcccagccagccatccttgcccagctgaccccagggcatggtcattggcaccagcaccaggaagcccagcagggccagccctagggagggagacagtcatctaccagatagtttcagtcacatcctcaaggggaccacggttcagacacaacacaggacagggcaagacaggtccaggtaatgctgtcatccagttggcggcctggccttggccagagacaggccctgggcaaaaggcttttggcactggttacttatcatggctcaggatggtctgggaagtagagaccatgatccccactttgcaggtgaggaaacagacttggaggggctgagtgaccggccccgggtgagcccagcaggtaagcaatggcagaggacaggcctaggccgtcccactcccacactgctctccccatacaagcaggtcacaggagaaggctaaggcagcgaaacctcaagttgagttgtgaagaggacacatgagcagtgatgccagcccggggccacttggcttgctcttcccaacccaagtcctcccctctccataagtgtccagacaaatggaggcactgggcctttttatcttctataaaggggtgaggccaggtgggggaagacaagtccagaatgaagggaagggggcttcgaggggcttgtcccatctccccagacctctccctggggagtttgattccagcctagccctttctgggaggtctccacccctccctgccggcctctagtactggcctcccaggggccaaacggggctccgaaggctgcccacccttgtgagaatgtggcctggcaaaagctcgggaaaggcacccaggctgggccaggccgctcagggccccttgcccgcctggggcagctcaaggacgggcagggctgtgtcagcagagctccgcggggcgcggaggaggggccggacgcctgttgggggaagaaggagccgccaccaggcggagccccaagacagagcggcttggggcgggggcgtcaggacggcggcgctgggaggctcctcccgggccctcctcatcgcagtcaacaccatctcccggctgggtgctggcgggagggggttcccagggcgctgggattacagaggccggacaccatgctccctacccctggggctcagagggattaagcaggctcagaccctactctgctcccctctcctgacccggcccccacccgccgggaaaacggaagctggcagcgcggcccgggacaatggcagctttgtcaccgcggctactggcggtgccagggccggggcagccctggacttgggcgctggggccctcctcggcctcagtgcccccggcccaacgcaggtagggcggccgggggtgtgggaagcgcgttgcgggacgcggctcaccgtgcgtgtagatgttgcccagttcgttgtgcaggtagaagaggctgcgcaggcagcccgagccgctgctggcgggccggtacccggtcagcacgaacttattgaactgcaggtgcggcggcgagctggcccagtccagcaggcgcggcccggccaggaacgccatggtccgcaccgcgcgggcagcccgtgctcctgctgtccccgagcctcctcctcagtggggccgcagcgcgggaaggcccatcactgcctggcgcccggcgcccggcgcccacccatcgccctgcgctcgatcggcgcacgcgctggctagggggtcccagcccgcgcccctccggcgctgcgcacgcgcgagtccgtcgcccccgcgccggggcggaggctggggacgcaccggacgcctgagcgcactgcggtcggctccgccaaggcagacgcgccgcagggacagctcgcggcggcggcggcggcggtggccggtagtctctctgcagccaggaggacgggcgcggccggacgcgggaggggacgccaggctccgcccaggctcctagttcccgccggccggccagcgtttcgcgcgccgggctcctgacgtcggcgcagcgagagccaatgggcgtggccggcggggaggctccgccccgaggccgcccaggcctcgcctcctagcatagtgtgcgcgctcccagcctcatttgcatggggtggctgtgggcttgcgacccaacgttctgggtcctgcgggctgcgctagagtgaccctggcacctcgcgtccctcagaactgtgcatccgggctttccgcgtgacacccaggtctccgtacctttgggcacccaccctcgggggcatagtcctgccacctagccctaccctgcagacggggctctgtccaaggtgctgccggacgggtccggcctacatccggtacgcccccgctccaaagtgatctttccgcaggctggactcccgagtgcagcaaggcgctccacggtacccaggcctctgaaggcgtgcctcacgcgcccgcagccgtcgggagaggccctatccttcgcgctaggcttctcggagcgtgggcccggcccaacttgctcccagttatcgcccacaaggagcacccttgcggggccctaccgaggatagacaggaaacagattggaggccaggggagcaaagtcgacctccgccccgtccaccctgagcagggaccgggaaggcaccccttattcagcataacgctgcccacgatcctcctccccttccaccccccgccttctacaggactccacccacccacccatctgtctgtgttctaggtccttctctgcattccaggcagctccaccaaagtctgcgtgcaacgcccttcatttgcatggacacacgcaaccctcggcgtttgtatggtcattaacatgctcctcccaccacggaagaactttcgaggcccgtaccaaagtagatcctttattcaaaatctgtgggggttttttgactgtttttgctgacctgtgacctctcactgaggacggcagtccaggaccacccccagaggggttcaaagacctccgaaaccagagaccacccccacatacaggtccatggagagggcctggaccatctggacccccacggtcaggccaagtcccagataatagcaccagatgtttcctgtccgacttttggtctccccaaggcgaccagaggccgagctgcccctacacaggcgcaaggccgaggcagggcgcagcacagcatctcaggtgtccatctcgccggcggcgggcccagcggaccctcggggccca

SEQ ID NO: 520 - DNA, 12692 bp, Homo sapiens
atgcacgtgaatgcctctgcccgacggtgggggcggggaggggctgcagcactaccaggcccggcagccaggtctgcccgcagcgcgggttagggctggggcctcctcgctccccgcagtccgcgcagacccgcgccccgcacaggcccggtgggcaggccgaccctggctccgagcccctcccgcgcccacgcccacgccaagaccaacctgctgccgggccgtgcagtccaggcccccgatgccgtgcccggcgccggctccagccgcgcgcccgcgcgctggcgacccagagaccctggaagctccgctccggacgcctggcagcgcttccgccctgcaccgctgcgcgcgcagccccgcccccccccccggcccgcccccggcccgcccccgccgcggaagggcggctgcggcggccaatggcgagctccccaggacaggacgcgggggctgcggagcaggaactcgccccgcccacccctcgcgcagccccgcctccgccacgccaaccaatggcgcgcgccgccgggcacgccggctgctgattggcggcgcccggcacgctcggggcgggcagtgcgcgacggcggcggcggcgcgggaggttcggagcgggagctcgggctcgcggacggtatggaggactacgagcaggagctgtgcggcgtcgaggatgatttccacaaccagttcgcggccgagctggaggtgctggcagagctggaaggtggggcgcggcccccggccgttggggaggagctgcgaaagccgggacagtggcgacctcggggagggcgtgccgggggccgaaggggcctccacgtcgccgctggcgggatctgctgtctcggggcggccgctgacaatctcctctcccagcaggggcgtcgactccgtcgccctccggggtccccctgttcaccgcgggccgacccccgcggacgttcgaggaggcccttgccagaggggacgcggcctccagtcccgccccagccgcatctgtgggcagcagccagggcggcgccaggaagaggcaggtggacgccgacctgcagccggccgggtccctgccccacggtaggttggcggcattgccccagggcctccggagtgggcgcgaggctgaggaggcctctggttccctgcatgtgtctcccccagcccccaggatcaaacggcctaggctgcaggtggtcaagaggctgaacttcagatcggaggagatggaggagccgccccctcccgactcctcgccgacggacatcaccccgccgccgagccctgaggacctcgcagagctttggggccacgggtgtgtggcttggacatgggcgtcccatcccatctgtccagtgggactcagatggagcccatcccgtgccctggatgaggcctggggggtggggagggttccatggctgagagcagtctcggacacccatatccaagggtgaccccacgcttgagtttctgccactgagccccggtctctctccagagtctcagaagctgctgccgacgtgggtctcacacgggcctcaccagctgcccgcaatcccgtcctgaggcggccccccatcttggaggactacgtccacgtgacatccacggagggcgtccgggcttatctggtgctgcgtgctgaccccatggccccgggggtgcaggtgcgtggctgtggccttcctgcacggtgggtgggccagtgctgctcaggaaagggtccttggagcccctcacccctgccatttgcttaaagcgggtcctgtgcagagccccaggggtgcagagggggaggctgcgtcatggggcgtagacttagaggacacagcctccccacagcaggttgctgtccagcctgtttgtatggcctcgggtggagagggcctccttgcttcccctcctgcttttgccctttcctcctttctcctaaagctgcccccaatttccctttgcagctgacccatctggatggcttcattcctttggcacccctgtccagtctcccacccctcactggccagcttactggggttgtcccacccgggtccctgagcactgatgggggctgacgtgaatcctgtgacctaggaggggcccagaggcaattgtcctcccttccccacagggctctctcctccacgtcccatggcgaggcggtggccagctggacctgctgggtgtgtccttagcctccctgaagaagcaggtcgacggcgaggtaggggctgcgggtttgctggggggcggtggcggggccgcctgagccctcctgattccagcctgttgtttgcacagcggcgggagcggctgcttcaggaggcccagaagctttcagacaccctgcacaggtgacttggttggcccttccgccctggggacccttgttggctcttgcaccaactcctagctcctagcgtgtgggttggcatggtccctgcgagttgtttgtggctcaggacgtggtcctctccagtctcaggtcgggggaggaggaggcagcccagcccttgggggcccctgaggaggagccgactgacggtcaagacgcctccagtcactgcctctgggtggatgagtttgcaccccgccactacacggagctgctcagtgatgacgtgaggtcttgttctcactcaagtgtggctggcttcctctgttcccaagatggaagaacctgggcccagtgatttttgcacagccaatccactgggcctcggagacggagtgggctctggtttgcccttttgagttgtaggtggtgaactgagcacagggctgtgtgctactggtcccctgtgacctgtgaggcaggctaggggtccagggtgtcacctgatccaagtctctgttccctttcctaccttcacagcagctgacactggagtgcccctggggagggcaggggcctcccagatgggttgtggccagagccgtgggggtggagcccctggtgtgagccttgcggtcactcgctggcaggaagacgggggtggccattcatcctgtggcttggcatcccatggggcatggggctcatggtggcaggtggactgtccgtgcctggaggcggtgccctcaggctgtgcttcccttcccgtccttcccgcagttcaccaaccgctgcctgctcaagtggctgaagttgtgggacctggtggtgtttggccacgagaggccttcccggaagcccaggcccagtgttgagccggcccgggtcagcaaggaggccacagccccaggcaagtggaagagccacgaacaggtgctggaggagatgctggaggctgggctggacccgagccagcgaccgaagcagaaggtgagccccgctggctgtgccgccgggaacaagcctgaggctttgcactcggcgccggcacccttgcagcctgttgactttctccaggagccgtgggtgtggtgacgtgtgggtcttggcgtgaagcgccattagcgtgagttagaactggagcgttgcagtaacaactcgggggaagtcgttgtccctgaagggctctgcggctggccaggatgatctgggtggacggtgggtggtttctgggggccagtcacactggtatcagctgtgttttgtctgcacgaactttgctttgtgtaggtttttttttccgttgccatcttggtgtgtgaaagtgctcaattttgttcttatttgatggctggagtggggtggagggagcgcccagcctgtgggacacatgtggcagtccctggctgctaggccgggagcgtcctgtaggtgcggtgcacactacgccttcatctacctgggctgcaggtggcactgctctgtgggcccccggggctggggaagaccaccctggcacacgtgattgcgcgtcacgcggggtactctgtggtggagatgaacgccaggtgagtgatgtgaggtccgtctctggctcgccttctgtcctgacgtgtttgagttctggtggcggacctgaaaccgggtgtggatgttcccgtcttgagggtggtgggggcctgggtgtgtgggccgggaaaacgtgtccttcctcggggttcacgggatcggcagcagccgcgtcatgtgacggtctccacgcaaatgcggcagccccggccttgggaggctgccctgccagggacgcccactgccctgacgacccctgacctccccattgcagtgacgaccgtagcccggaggtcttccgcacacgcatcgaggcggccacccagatggagtcggtgctgggtgctggcgggaagcccaactgcctggtcatcgatgagatcgacggggcccccgtggtgggctccttgatgcctgggtaggtgggtgggcgggcaggcaggcgggcagcagggcctggactcaccgtgtcctctgacctcccccaaggccgccatcaacgtcctcctgagcatcctgaaccgcaaggggccacaggaggtggggccacagggcccggctgtgccttcgggaggcggccgacggcgccgggcagagggggggctcctcatgaggcccattatctgcatttgcaatgaccagtgagtgcatgggcgggcgccacagtcaggagaggctctggtgcctggagggagggttccggcccgtccctgtgtcctgggctgtggtgccaaccctggggtccctggccctgccgcctctcctcaggttcgcaccgtccctgcggcagctgaagcagcaggccttcctgctccacttcccgccgactctgccctcgaggctggtgcagcggctccaggaggtcggtggagccccaggagccgtgtggctgatggcggggttgggggcgtggcctcgttctggcccctgtttccctgcccctccccatggaaccctggtaacccctgaaaggatggggcataccatcgggccctccagcagcccttctccaccaggtctccctgcggcagggcatgagggccgacccaggggtgctggccgccctctgtgagaaaactgacaatgacatccgggcctgcatcaacaccctgcaggtgggcggccggcaggcaccgggtggggtggggtggggtcaggagttggccgcttctcatgcccccgccctatgtctagttcctgtacagccggggccagcgggagctgagcgtgcgggacgtgcaggccacacgcgtgggcctcaaggaccagcgcagagggctcttctcggtgtggcaggaggtcttccagctgcctcgagcccagaggtaggcggtggccacagcctcggcccagatgctcacggtgcccggacctcaggacgctagccctgtgtgcaggccagcactaccttcgaggcggggactcagtgtcctgagcccgcggttgcctggtccagcctccagggccctcctcagccttttcctggcttgttctcgcccctacagccttggggggtcagctagagaagcctccagggccccctgtgggaaggacacccccagtgtggtggggcctccagggcgtccctctccagggcgccccttgactcagctgctgtcccagttgcaccctcatttttgccacatttggcctgggctgtggtctctgagcccctgcctgcccacactgcttggcctcccgtgggcaggagcagccagcatgtctctgtcctgacgtgccatgggaccccaggggatgctggcctggtcgtgctgcaggatatgggagacgctggcctgggcctgtgggatgtgctgctcctggcctggacccggagggggactttccctggggtcccctaaccccagagggtcagggcagggctcctctcagagtggggctcctcggcttaagggaatgtttcagggggttgaggtccgggcgtgtctttggctgtctccacctgagcgaggcagcaagggccctgctgagaagaatgaagtgggtggcagctctgatggggcctctgagtgtcccggggagacgggtggggctgcctgtgcttttaacacgggtccatctagcttcagcaccccacctgcaggcgccgtgtgggccaggaccccgccctgcctgctgacacactcctgctgggtgacggggacgcgggctccctcacctccgcctcacagcgattctaccgtgtcctgcatgccgctgcctctgcgggcgagcacgagaaggtggtccaggtacctgtcttccaccaaaatgcctgcctggggccgcctggctaggacctgggctgtgcccctgcccctgccggtcctcccgtatggacggggaggcgctttgggggtgctgagagaggcaggttcgggaaatggggtgccaggaagtctctgaggtggggagcaggagccaggagggtgggaggggctgcagggcacgggccggcaggcaaggaggtaggggcggccgtctgacgggggaggtcgctctggtggctgcttgggactctcagcgggttggggtggagcccctgccggacagcctggcctggggctgcgaggggctggattctggacttaagatgcacatggggtggagagcagtgcggtgagggcttcctgccgccctgcccgcgggagtccccgcctaagctgtctgctgactctaagcggctttggattagcagctggggatccacaaccaatccccaaatcccaaaagccgcgatgtggaggggcagcgtggagcagcggcggggatagactcccccacggaacaggggtggggacgccacggcctggactctggtgggcggaacttcctcaggcagtctaaggaggggctgagtgaggctggatccctttggttcctggaggcctcctggtgggtcaccccctcgtgtcagtctctgtcaagtcagtctctgtcaagctgtagcgaggatgctcagggtggaccctcccccgaccccttgggcccagtgaccccttgctggtgtgtgctgctgcctcagacgcccagcgtcgtggggacccttgtggagggtctgcgaagcctcgtggggcaggcggcaggcaggagtggagggtctgtggcgggaggtggagggtccgtggtggtgcaccttccctggggtgggcaggagctcaggggttgccggccgcctgcagggcttgtttgacaacttcctgcgtctgcggctgcgagactccagcctgggtgctgtgtgtgtggccctcgactggctggccttcgatgacctgctggcgggggctgctcatcacagccagagcttccagctgctgcgctacccacccttcctgcccgtggccttccatgtgctgtttgcttccagccacacacccaggatcaccttccccagcagccagcaggaggtgtgctcgtccctgcaccacgcctgcccccggccccgtgcccgcccccctgtgctgcccgtgtggctgcccccggccccgtgcccgcccccccaaacacactgcccgtgtggctgcccccggccccgtgcccgcccccccaaacacactgcccgtgtggctgcccccggccccgtgcccgcccccccaaacacactgcccgtgtggctgcccccggccccgtgcccgcccccctgtgctgcccgtgtggctgccctggccccacccaccattcccccctcgcccgggaggcccaggtgaccaggccttggctcaccccctgccccaggcccagaaccggatgagccagatgaggaacctgatccagacgctggtgtccggcatcgcgccagccacgcgcagccgggccacgccccaggccctgctcctcgatgccctctgcctgctcctggacattcttgcacccaagctccgccccgtgagtgccgtccccggggtgggggattccccgcctgctgccctcctgtcctaggtgagcacacatttgtacagcctgctcagctccctgtctgctgcctcccatcccctaggtgagcacacagctgtacagcacccgtgaaaagcaacagctggccagcctggtgggcacgatgctcgcttacagcctgacctaccgccaggagcgcacgcccgatggccagtacatctacaggctggagccgtgagtcccccagtgcctggggtgtgctccagggtcatgctccccggctgtgctccatgttcagggcccgcatggggccaggagtctgaaagcacggtcatggcgtctgggggtggcgggccccagcttatcttttgctcagatgtaaccgtgaaggggggtcacttccagctacttgagattggctctgggacctgagttttgctgcagagctgctcccagccttagcacccccacatggaactggagccgggggccccgagagtgactgcactttccaacactccgtttcccgctgtgggatggccatgggggtggtgggggtgaggcatggggcagtggccccggggtcctgctgccccagcgacggcaccaacttgcaggacgctgagtcactctccgtggcagccatcggcaggtttcatcatcatcccacgtacacttgcagttggggaaactgaggctcggggcagttaaacctggctgccgcagggttggggtgcggtggcaccaggactcagccccacattcctgctctggccttgtggcttttggggtttgcggttggagtgcccggcggctctctggccctgagcctggccccgctgacctgccctggtgtccccctgtgctgagcaggaacgtggaggaactctgccgcttccctgagctgcctgcccgcaagcccctcacctaccagacgaagcagctcatcgcccgcgagatcgaggtggagaagatgcggcgggcggaggcttctgcccgggtagagaacagcccccaggtgagcccacccaggctctggagcaggttgcagtctgggcgtgcaccatccccactgtatccctgtgtggccagatctcacaatgcctgctccctacaggtggatgggagccccccagggctcgagggtctgctggggggcattggggagaaaggggtgcaccgacctgccccacgcaaccatgagcagcggctggagcacatcatgaggcgagcggcccgggaggaacaggtgtggaatgggcagctgtgggggtgggaccagggtacatacctttgggggtgtggctagggcagtcatgaggcggggccaaggcacccatggggtggggccagggtacctttgtgggtgtggctagggcccctcatgaggcagggccagggtaccttcagggctgtggctagggcagtcatgaggcggggccagggtatctttaggggtggggccaaggcacccatggggtggggccagggtacctttgggggtggggctgagccacaggaggagtctggctgagggtggggctggctcagtgccctaaggggggctctgaaggaccagctccttaccctcagcatgaccagggttctacccaggcctcagtttcccatctgggcagaagagtggctgtattggctcttcttgattggcacctggtggggagcagatggcagtgaggggtgaggggcagctggcctgggccaggttccgaaaggtgtctcagaggtgttctggtccctcctccctgggaaggctctcggtcctcctgtcttgggtaggggctggatggggcatctgtcctatacgactgactagtccttcctcccatcagcctgagaaggacttctttggacgtgtggtcgtcaggagcacagcagtcccgagtgcaggtgtgtgtgggggtgttgtggggttgtggggggcctgggggttgtgggggggccttacagctgaggagcaaccctgtggccccgcaggggacacggccccggagcaggactcagtggagcggcgcatgggcacagcggtgggcaggagcgaggtctggttccgcttcaacgagggtgtctccaacgccgtgcggcgcagcctgtacatcagggacttgctctagttctctgagccgcggacatgccctcgcattgcttcccgcagagtgcagagacaggaagctggagatgtctttataaagtcacacctttacagactgtaatcacgtgcgagtggagtggggttcacaggatggtgggagtggggccgggcgtgggctcataggatggtgtgagtggggccaggagtggggctcacaggatggtgggagtggggccaggcgtggtctcacaggatagagtgagtggggccgggcgtggtctcacaggatggagtgaatggggccgggcacagtcttacaagatgttgtgagtggggccgggagtggggctcacaggttggtgtgagtggggctgggagtggggctcacaggatggagtgagtggggccgggagtggggctcacaggatggtgggagtggggctgggagtggggctcacaggatggtgggagtggggctggaagtggggctcacaggatggtgggagtggggctgggagtgggactcacaggatggagtgaatggggctgggcatagtcttacaagatggagtgagtggggccgggagtggggctcacaggttggtgtgagtggggccgggcatgggctcacaggatggtgggagtggggctgggagtgggactcacaggatggagtgagtggggctgggcacagtcttacaagatggtgggagtggggccgggcgtggtctcacaggatggtgtgagaggggccgggtgcggggctcacaggatggtgcatttgcccttttccacccatgggttgttcttcatcaggtcggggttcaggaaggggtccttggggatcccgtcctcgatccacttcagcagcctgcgggtgggcgggtggcaggtgagtggtggcacctgacccccgagggcctcctgctgcacctgcctgtcggcggcggtggtcgtggctatggaaatgagcagccagcgcagggcagacaaatgagaggcaaatcaggcaggtggggcactcactcggggatggtcttggacgccatctcccgctggaaggccagctggtacttgaggctctccacctctttcttcatctgtggcacgtcccactcctccatggggtcaggggcttctgaagcagccagcctggggctggagggcacaggaggaagccacagggccgaggccaccagcctgtagtccccacccccgctgctccccgcaggcctgagctgaaccccgcaggatgaagcggggagagtccacaccactgcctgggccagtcccctaggcgttgctagggtgcagggcacagagcgagttcccacaaggccccagctcccgcctcctgcactgggactaattaactgcaagaaactttacatcctcagctactcccccataggcccccacaccttacgaagatcccttgcaggcaggagaaagggtgctcagcacggcaggcccccagctcctaccctcccactgaggcccacgcaggctgacccagaccacggtgtgaggtgtggggcgaggtcctcaggaggtggcccctgccccgccccgctgtgtgcccctttgctttgcatggcagagcccagtccagagccaggactcctggacaggaatgttctgctgcagtttgcttctctggcaggtggggtgtgtgctcaggatcttgggggctcaggctatactacccgagtctgggatatgggctgtgggtggcccctgggtccccagtgtgtctgggaaccacacacgttacctgcgtgctttctgcttgtggccagcctgggaaagccacaggttgacacccctcagaactgccacaagttcgaggcaagtgggggtgggttgccccctgcctctccccctacccactccaggggcccagggagtccctcactccgtcccaactctggcccccgtccccaaggttgggagacagggctgaaccttgggagggtgggtgggggttggcgtcaagtttcggggagcctgcctctggctgtgaagggggctcctggcccaacagtctccccatcctttggtcgtgcagctgcaccggccacctagggaggggcccagggcctgaggctggtggggtcccggtggtgaattgggcagactcccagcagccagcagagggtctgcccgtagtggggtgggaggccggggagcgagcgggggcaggtttctgggggagtgatcagggtcatgcagaggattccctcccggagactctggagttccagcacccctacccgcccccatccccggtgcaggccttttctcggagaccctacactcagccccgtgggcgcaggactagctgcgtgcgggtcctcccaggcccggggtgttggcgccccgcccacagcccagtccttgctgcccagccctaccttcgcgcagctgccgccaagcctggccacccaccccgtgcaccccgtggacgcccccagccacgggactcggtgggcactgcaggcggcgcacggcgctcagatggacacagctcccccgcaccgcgagagccgcctccctgcctgcagcaccggctcgggttgggttttgctgcctgcggggcagctgccctcgccccgggagttagggtgagcccaggggactgacctgggccagctgagagtcgaggggcctccgggccctccctagccccgggcgcctgttcatcggacctaccttgaaaaggtgacagcggagggacaatgacaacggccaggcgaccgcgagtgagagcgagggccaagtgat

SEQ ID NO: 521 - DNA, 169807 bp, Homo sapiens
tacgtggagacgaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaaggtaggagagcccgaggcaaccgggcctgcggtgggaggcggtggctagcacggggtgggagggggcctgggaagcggagttcgccgcagccccagtgcactgcccgagagggaggtgctgcagggtcttagggtctgcatctctcctcgccctcctcctttcccctttttccagttgggggacaaagccttgtgctagctgataatacttccgcgaggattgaatattgtggctcctttctcgtgaatgtccaaataaaactccccttttactgtattgctgtaaactagtgtttagttgcttctaaacctccgatctttcatttttttaaggagttttctgggtggtgcaggcattgtgctttccagggtggggatttagggcttttctttattgggttggggatttgtgcgctgatcatcagcttgtcttccttaggtagcacgctggcactcttgggtgtgtgtgattggcctgtgacagctgtctcagcagtggcttgtgtgtgccacaagtgccagctgtgaacttggctttaggggcgtttttagaagcgtgtctttgtatgtttgtacttgaaggtctttgtcatggcatgcgcttttgtgtcctatggaatgttaatgcagtctgtgaatggaacttctgaggaccgaaaggttccatatgccaacacctatagaattcctgctttaaataatttagttgttatatatctctctggcgaatcctggttgtgtgtgtgtgtgtgtgtgtgtgtgtgtgaacggttatggaaaagcctgtaaagcaaacaatacaatacacaattatacacaggcatcgttcattgggcttcatgagaaatttaacatatacagaatataagctgcgtagcatatttcttttaaaaattacatatttgagcatatattttgtctgggctcaaaagcccccttcctcccttcaatgaagtcttcttttatggattatattatttttagagataattgttagcagtcatacttggacaaaaattgtattacaggtaactgtttttcctctcttcctttctcttctcctcacataaacaaaggaaaccaggttagtgatttattatcaatgaagggccataccgcagagatgcagtgatagaagctcaacacaagtttgttaaatgaatatatatataaaaactagcttcatatttctaaaatatagttgactttcctataagctccctctatttaagatcaaggtttaaatgcttgtatatagccaggtaaatttttactttcgaatctataaatggtgggaaaggggaatcagggtatctttagaagtccaaagcctacacttgtgcaatctgaggggctgagcaagctctatgcatctacggaagtagtggaggtgaagtgtgtgcccctccaaaagcattgaagatctgattagatgtcttacttgtctgttacctcacaatttttattgcctgcccccagaaatgtctttcctgaatatatgtgaagcagtcctacaaaacatggtttactttggacatacacatttcataatagaggatttatttaaattgcttgcagttgtagttgatgtggcaaaatacaattctagtttctttgtgtgtttctttatctttcagaattctatgtatggggtaaaaacctgtttaaggtgaatttttgttgtaaaagattatcttcttttagaatttagccctttttccagtaagatataaatctatgagacttgtaaggcaaggtgtgtttgctgcaacattagctatacaatataaaaatgctgacattgggagcctggggcgagaggattgcttgacaccaggagttcaagaccaacctgggcaacatagtgagactctacaaaaaattaaataaaaaaaaaaaatagcagggcatggtggtgtgcgcctgtatgtagtcctagctactcaggagtctgaggtgggaggatcacttgagcccaggagttcgaggctgcagtgagctatcatcatgctactgcactccagcctgggcaacagaatgagatcctgtttcagaaaacaaacaaacaaaaaaaaacccctggaaataacttttaaagacaacacgaagggaatcattttctaagttatataaatatgatggaatattttaaagccattaagattatgaagactgataggaatatgaaaaatagtgtgaaaagggcattatcaaaaatagtatgtacattatttcatttgtataaacgtgtgctttcagattagaactgaaaaactctggattataattttattcagcaaacgtatattgaatccctattttatacctagaggtggtgacagtgtctgctctcaagttgctcactgtttagtgggagagacagactctgggtgataagtacaaagagggatgagctgcagtaggatttgggggatattcttccacgttttgttaaagtgttttaaatactactatgtcattttatagaattactaagaaagctttactattgatattaatgcaccataatataatgcctttcaaatagttattcatacatatttgcttaatgaatgaacagaatgattaatgagtcattaataagtgttactttcctagcacggttgtaatttaataacattaatctagaattctcttaatgtgaaatccatattgctggcatcagaaacaactttaaatgatcattttccaaagtttatctgagacttcattctgcaaatgtctcatttgttcactggacttaagtattgtatttgataatctagttttgcaaaccacaacttacaaatctttttgggggtaatttattgataaacagttccattggaaaattccctttctgtatctaaaccttataaatgatcactttttaaacagtttgtcatgtatgcagtataatatatagtatactgtataaaatgttttatactaccccaaatctgtaataatgggttaataaattatgatatgtaaaataattctacaaagactttttgagtgtggaaaatgcccacaaataatgccaggttaaaaagaaaaaagttaccaggaaaaggtatatgtacatatttaaatatgaagacacctgaaaaaaagcaccaagatgtaaatcgtggctatctctgggtggtggcttataggcaattttaattttctttatacttttagtattttccaaattcttgatacaatgtatctcttttatgaccagaaaagaatattcaaatgccattttttttttttttgagacagcctgtctcccaggctggagtgcagtggcaggatcttggctcactgcagcctccacctcccaggttcaagcgattctcctgcctcagcctcccaagtagctgggattacaggcatttaccaccacgcctggctaatttttgtatttttagtagagatggggtttcaccatgttggccaggctggtctcgaactcctgccgttaagtgatctgcctgcctcgacctcccaaagtgctgggattacaggcatgagccactgcactcagcctcaaatgccattttttaaaaaacataaaggcttatcaaatacattatattaaacacatgttatagtgtatgaccattatccagaacaggaaaatgaggcacagaataactaggtttcctattttagcgtaggcctggaattgtaattgctatttcagtgcagagtgtataatatagttgggattatattgttagacattttatagatttcctttctgtttttgttgtgcttattctttccttgctgttagttcgtattgctatgggcatgctcttactcctcatctgcctcttttcctaatttgctgttttagatttgctacgactaaggaacccagaactgaggttgacagaatactatgtaaaaagaaaaaacaacaacaacaaagaccttaggcggggtgtgatggctcactcctgtaatcccaacactgggaggctgaggtgggaggatcgcttgagcccagaggttctagatcagcctgggcaatgtagtgagaccccatctctaaaaagaaaaaagtataaaaaacaaaacaggtggggcgcagtggctcacacctgtaatccaagcactttaggaggttgaggtgggtggatcatctgaggtcaggagtttgagaccagcctggccaacatggcaaaaccccgtctctactaaaaaatacaaaaaaattagccaggcgtggtggcaggtactaatcccagctactggggaggtggaggcaggagaatcacttgaacccaggaggtggaggttgcagtgaaccgaggttgtgccactgtactccagcctgggtgacagagcaagactctgtctcaaaaaacaaaacaaaacaaaaacagaggccagtgtagcctgcccagtgggctttagggcagtttagtttttctgctgcttgttggttgttttggtttactgttgggtcctcagctatttcctcagtattgatgttgcaagaagcatgaccctgggagatgtgagacattactgcattatgtattaagtaaatattttcagagctgggctagctccctctgcagtgttttgacgaggatggcactacataggttgtccttgtgttgaaccaaactattttaactccattttaaatgacttcatttttttccaagtataattattcatggcacgtaaaggaagtattgtaatttaagtgaacagaattaaatagaggacagttgtatatttaatataaaattattactcatgtaaatttgcattaggtatactttttaaagttattcagtattttatataatgggcattatttgctgaataattataaaaaactactgtctattatattcagtaatttgtaattacatgacttttgtttaacaaacattttcagtgtgaagagtagttccaattgtgtacaaaaaaaaggatggtgctccatgcaagctgtatattgattattgatagcaggacttttcagttactgtttccactgtgatagacaaagctggttatggtgtaaaactgttctttgcatatttcagatactttgttccacagctaagaaagtgttttcccttcctgttttaagcattctagtttttcatacttagatgtggcagagcttacttagcattccgagtagatgcagcagtttgatagcttcatcaacatttattgcagcaatagtgcagtgcctgtgacttaaaactaattcataaccttcaggctttttttttttttgagacgagatctcgctgtgttgtccaggctggagtggcagcctgccttgacctcctgagctcaagtgatcctcctgcctcaacctcctgagcacctgggactacagatgtgcaccaccacacctggctaattgttaaaatttttttgtagagatgggatttcaccatgttgcccaggctggtcttgaactcctgggctcaagcaatcctcctgccttaacctcccaaagtgccgagattataggggtgacccactgcacccagcttaggctttgtcggaatgaagcaaaacatggtgtttagagagagaatgtggaggaaggaacgtgatgccctgtcagtgaaactgaaagttgaatgatagctcatggaaagaggaagtgaaaaaggtaggatacatccaagtgattgaaatatgacaagaatggaacaaaaattttttcaaacaaaaacatctcttattttataaataaaaaggttcatagtaaaagctaaactatgtctacaaaatatctattataggctactgaatattgaaatgtaaatgaatttcttctaatatagctagaaaaggttatggtaaattgctaaacaataagggacattatttatattcatttcttagtaagattccactaaaattaagattagtcactttatgtaattgcttaacatccatttaaaaactataatttggaaaagctacggaatttttcaaaacttatttataaaagtggtttggtgtctggggtgtgtgtgtgtgtgtgcgtgtgtgtgtgtgtgtgtgtgctggagagagggagaaagagaatttataatactgctatctggtctggtagaaatggcactaggactttggagacatttatgtgttcatttgttcaaccaacatttttgaatgcctacgactgcagctatgaacttttacttagcaagcatttttttttccccccgagatggagtctcactctgtcacccaggctggagtgcagtggcacgatctcggctcactgcaacctccacctcctgggttctagctattctcctgcctcagcctcccgagtagctgggactacaggcgcccaccaccacacccggctaggtttttatttttagtagagacagggtttcaccatattggccaggctggtctcaaactcctgaccttgtgatccgtccaccttggcctcccaaagtgctgggattacaggcgtgagcaaccgcgcccggccgcaaacatttatttaaatgatcacaaattctgtgccttattgtctgttggaataatcttatgatgtgtacctcaacaggtgttttgaaggataaatgaaataatggttgggagctttttgagttctctaggtgctagatataaagaagctataattttttttaattgaggtgaaattcataagcaaaattaaccatctttaagtgaacttaacacagtggcttaacacaatcttatgcaactactgcttctgtctacttcccaaacatctttccatctcaaaatataaccctgtgcccattaagcagatattcttcattgcttcttccctctagccactaacaatcaccaacgcactctctggatttaccagttgtagatatttaatatgaaaggaatcatataatatgtgaccctttgtgtctggcttctttcacttagtatgttttcaaggttcatccattttgctgcatatatcagtacttcattcctttttatggctgaataatattccattgtatgtatataccataatttgtccaatgataggcatttgggttgtttctgtcttttggctattgtgaatagtgctgctgtgaacatttgtatggatgtatttgagtacctgttttcatttctcttgggtatatacctagtagtagaactgagcaaggtcatatggtagttatatttcaactttttgaggaactgccaaactgtttccatagtgactgtaccattttaccttcccatcagcaatgtataggacattccaattttcccataacctcattaacagttgtgttttctgttttttttgtttgtttgttttgtttttttgtttttttaatactcatccttgtgggtattaagtggtttctaattgtggttttggtttgtattttcctaatgaataatgatattgagtatcatcttttaatgcactttttggccacttgtagatttctttttttttttttttttttttttgagatggagttttgctcttgtctcccaggcttgagtgcaatggcgcaacctcagctcactgcaacctccacctcctgggttcaagtgattctcctgcctcagcctccctagtagatgggattacaggcatccaccaccatgcccgattaatttttttgtatttttagcagagatggggtttcaccatgttggccaggctggtcttgaactcctgacctcaggtgatctgcccgcctcagcctccccagtagctgtgattacaggcatccaccaccatgcccgattaatttttttgtatttttagcagaaatgggatttcaccatgttggccaggctggtcttgaactcctgacctcaggtgatctgcccacctcggcctcccaaagtgctgggattacaggcctgagccactgcgcctagcccatttgtagatcttctttagagaaatgtctattaatatcccttgcccattttttaattgggttgttaccaacttcttttatctaatattaattatatatgtatataaaatatatatatatcctttccgtatgtgtggagagagagagaacgtgtgcactcaagcaccagagaggaatgggtagaaatacgtatccccagtgggattatcttccatatatatatatttttaggctttttgggctttgccaaaatttaaattgttgcttcctttgagtgataggttcttggtgagttgataacagcatgatgctgaagcttgatttctttgttggccagtgagtcattccattccatgagcagctgttttacaagtgcatgcagttggttaaaggggcacctgttggatttttggcttgatcattgccagtccatttacactgtgagaaaaaagtaacttagtgttcaaaaatgaaaagacctgtcattttaaacatgggggatctgtagctacttcactagtatgagatgtctttgttgtcatattgacaccccttttattttttgtcttagtcatcaccaaactgtaacttacaacacttagtgcccttctaggtacattgcataaagctttggttgatttttgcatgggtttaacagtattcaaaagtgttcaatattcagagtattcaaaaatttaacattatttcaggagtagttttgcttaggttctttgtttaaatttatagattcttttgtaatatgtaaaattcctttttcctccttgttcactaacaatgtagtgtttgttttcagttaccatcagagttaagattcttattgtggtttactgttctctgagatttttgtgtggtgtgaaagtttctctgtaaaagtctaagagtttttcccccttttaagaaataatttcttaaagcccccaagattattgttttgatgattcagaactataatcaactttactatacaaagtcctaatctgtaaagattgatttcataggttctctgatttacagatctctgaaaaactaatagggtataaaatctaggctctctctcctattagtactgaacacactataaaattccttgttgtttactaggattgctcattgtgggctctgtggttaggctgtatttattcctccagggtctcacttttttttttttttttttttgagacagagtcttgctctgtcacccaggctggagtgcagtggcactatctcggctcagtgcaagctctgcctcccgggttcacgccattctcctgcctcagcctccccagcagctgggaccacaggtgcacgctgccaagcccggctaatttttctgtatttttagtagagacggggtttcactgtgttagccagtatggtctcaatctcctgacctcatgatccgcctgcctcggcctcccaaagtgctgggattacaggcgtgagccacaacgtccaggctagggtctcacttttattcaagttagtattgccttattagttgtttccccagagaagatagtgacagggatcaattataactaaaatagtagttctccatatgtatcatgaatcaaattttgtgtgtggagaccttgtggggattgcagtgggcatggggcagagatctcagttaattcttacgccgtttatatcctctactccatttcttgagagccaaataaattagtagatcttcttctaaatggcaagatattagaaaatatgttaaaactgcattaggaaatatctactaggagtttatatatgaaataatgagttttggctgaaagttacagaaactcttttctattcatatacaacttaaaaatactggaaattcttttggtgtgaaattttttatatttgccaaaataatatttaattttaatttgtataaattcatttcacaatgaaaattcatatctgagcatttctaatgactcaacaagagaactctcacttttccactttaaacaaccattagtaatttttataataaagtttgagaaaaagaaaagataatttgaggttttttttttagttgagaagaatgcgtaattttttaataaattcaaagggtgaaataaggtaggcaattttaataagcctcagaattttaattgtatggcaggagagtctgtctactttttctctaggatttgtacttaaatttttttaatgttctaagctttctcttctttctttctctatctcactctctttctctctattttcttttatttctcttttttttcttttctttcattttttgagacaggatctcactctgttgccccagctggagtgtggtggcatgatcacggctcattgcaacctcgacctcctgaattcaattgatcctctcacttcaggctcccgagtagctggggctgcgggggctcaccaccatgcctggctaatttttaaattttttgtagagacagggttttgccatgttgcccaggctggtcttgaactcctgggctcaagcggttctcccaccttggcctcccagtgtgctgggattataggtgtgagccaccacgcccagccaattttctcttttctgtctcatgtatcatcatattttctaggctcagtagtttagttcatacctattaatatattcagaaagcatcttgattgaaagatcctttgaattattctgtgattattttcctttattctatatactcataaccacatcctactttttaaattaaaaatttgtctcacacgcttgcagtgagccaagatcatgccactgcactccagcctgggcaacagagtgagactccgtctcaaaaaataaaaataaaaaataaaaataaaaaaatttgtctcccacttaacctttttctttctattctaatattgcagtccaataaaatcaggcccacatcccctcatctgtctagttcccttgcctctattcatcttctctggttcatcctatatattgtcactgggttcatcttaaaacacccttttcattttgttaatcctctactccattcttttcagtctttcagatcaaatcctagataacttagtatttactcgagcctctactttatgcaagtcagtgggaattcagagatagtcacaagcttgcctctgatactttcacattcgagtagaaagtcaatcacgatacaataagttaagtattcagagtgatctacagggagctatttatttactcattcagtaaatatgattgaacacttactacttgctaggcactttgctaagatgataggatatgagagacatggactctgccaagcataagcattatttagttagtaggcagacacataaagagataattataaatacacaatgggtaatataattctgggtccatgaaaaacacagaagagggatatctgattctatcttggcagttagggaaggctttctggatggataaacactgaatgaagccttaaaggatggggaggaactgcccaggtgagaagggagtggaaggtgagtagaagcttccagaagaatgagacaaaatggaaaaagcacagagatgtggaatcgtttgacttgttttggggaaggtattgtattacctaccttgtttggtattattggagtataaagctattagcaagatgtggcaagaaatgagactataggctagggctccatcttgaaaatccttgaatctatgttaaggagattggattatatcctgtagattgtggggatctattaatgaggggtatttttgtgttttatatattttttagaggcagagtctcactctttcacccaggctgcagtgcagtggcgtgatcataggtcattgcagccttgaactcccaggctcaagcagtcctcctgcctcagcctcctgactgaggactacaggcatgagccaccccacctggcttattgatgagtgtttaagctggggaataatatggttagctagatttgcattttagatagatgtatttgacagctgtgtggaggataggttgaggaggataaaaccatttacgaggctgttgaaagtacaaatgacagacagtgaggcaggaacagaggggatacatcagtaaatatttagaaggtaaaatcagcagaacttggtgactggctggatctgaaaggtaaaggatagtgagcatggagaggaggtttctgttactactaagaaaaatgtggtcaaggtttcagttgttgacctaggcaagattgtgaaatcagttttgtacattttttaattagaagttctttattatacatctaaatggaatttttcaaagattttgaattgataattgtagtggttatgaggttggactggaccagaccgtctaggctcaaatcctgactgccatttactagttttttggcatcaggaatttacttaacctctctgttgctctgttcctcctctggaaaatgagaacaataatagtacctgccttggtacttgcggttgttgtgaggattcactaataagtctaaaacatttagaacactgtcagtctataagaagtgttcaagaagtgtcagtcattatcatcattatcgtcattctggagcatagaggattaagctatatagcagaaaatgggattggagaactagggatcagataatgaggagccacatatgacatttaaaatggtgtggatgttatcctaacagtagtggaaaactgttaaagaatgtctgtcattgataacttctaatgttatttctttaccccccgccccccaccacacacaaaaatctcatcttaagataggtatgctgccaccaggtggcagttatatgttatgttgtacaaatgaagtagtaaaaaccattatgtgtttcttttttaacataaaatatttacttgattaaaatagccaagtgtaagcagtctaattctagtaggactcttttgttccaaaacaaaacaaaactcgttaagcgaaggagagaaaagagagggttattgtaaagatgtggagatttcagaggaaggtcagtgtatagctgggtctcatggaaactgaaaagccattggaaactggtgccattctctccatcattttttctctcactttcacaatatgttatactcctctgtttgtagatcagcttccttgcctgcatgtcagtttgcacatgaccaaaattatgggatgagtctccaaatctgttctatccaatggaattgtttcctactaaatatacccttatttatttattttgagacagggtctcactctgtcacttaggctggagtgcagtggcatgatcattactcactgcagcctcaacctcctgggttcaagtaatcctcccatctcagcctcccaagtaactgggactacaggtacacaccaccatgcccaattattttttatagaggcagggtctcactatgttgcgtaggttggtcctggactcaagtgatcctcccacctcagcctcctgaagtgctggggttatgggcgcaagccactgtgcccagccccagtaaatatactttaaaaagaaagaaggggaaaataaaaattatataaatcatagaaacacatctactcatagagtaatcatctagcctagaggctcccaaattttgctgcatataggaaacacctgggaagctttacaaattttttgatgcctacattacatcccataccaaaatcagaaaatctgcagtgtcaggcctcactattttttgtaaagatccccagtgagcaatagactttaggacccactaacatagccactttacttgattctacaatactgtgccagctactttacttggtgtggaactaaaggaatagggatgattcaatgccagaaggaaaattgactatgttggatacaaagagaagtgttttatagtctgtaacatgtttaataggttgattatataaactgtactttatagatgattttaggagtatctgtagattgatatgattattgtatgacacactcattttagaatcctttatataagatgaatctcctcgtgttatctttctggacagcttcttacctccttgttccctaattctaagagaagaatctaagtgactgacctttctttccttatcaaacttagggtgggaggagaggcaggggtgtcatggatgggagaagctatgagcactgaccagttccctcagaaggaagttctacttactttaaaaatacttaaatatttcttctaaaaaagaatatatgtaaaatgtatgtataaaataaagactgatgataaaaagaacacctctatacctatcaccctgctgaagaagcatacacatacgaatatatttgaaacctttcctcatctaatcccaacccctcaccacttgaggtacctatagttctaaatttgtttatttccttgcttttctataccacatatatgtacacatacaacatactagttttcctgtgcttgaacttaatggtatcatatgaagtcatcagtgatttgccttttgttcagtatcatgtagagcatgttcacgtctgcatagtattccattataggaatttacgtcagtatccattgtgaggtcagtaagtatttgggttgtttccagtttttgctattgtaaatactgccactaagtgacatgatcttggcttgctgcaacctctgcctcccgggttcaagtgattctcctgcctcagcctcccaagtggctgggattgcaggcacctgccaccatgcccggctaatttttgtatttttggtagaaacagggtctcgccgtgttggccaggctggtctcgaactcctgacctcagatgatcgcccaccttggcctcccaaagtgctgggattacaggtgtgagccactgcacccaaccgccttgaatttttttctaagtttactttttattttcaaaaaattattatgtatttcctcattttccataagaacattttagtagtgtttcctcatcaataaacacaaaaaagagtctttactatgctattttcactattaactttaattcagtaataagcaaatctttgttaaaagtagagatggaggctgggcgcggtggctcacgtctgtggtcccggcactttgggaggctgaggcgggcggatcacgaggtcaggagatcgagaccatcctggctagcacggtgaaaccccatctctactaaaaatgcaaaaagttagccgggtgtggtggcaggcgcctgtggtcccagctgctcaggaggctgaggcaggagaatggcgtggacccggggggcagaacttgcaatgggccgagattgcaccactgcactccagcctgggcaacagagtgagactctgtctcaaaaaaaaaaaaaaaaaaaaagtagagatgggatttctagcctcctaaatgccagacaaacaatctaacataaaatttaccttgaataagatatatgatattgattctgagctgctttgtattttttctaactttggcatctgtatcttggtgctttctattagactgatagagttttagaacctaaggagtatgcattgtacttcagcgcttttttcttcattactttctgtgtatatagacagcatatttttttttgtagaacattaacccagattgctaatagcttcatgttatggcattcttccacacagtccagattgatttaaggaaaagcagaaatggaagtcaaagtgtgttataaattgagactgaaaaacgtgctctaaaaaaatagatttaatttcttacactgtgaatagccattgtattgttttgtttctgataaatcagttgttttgggcttctatttttgaactgttaaaaaattttgatgctttttgtggataaaagtagtgcctctctttatacaactgatggggttttgaaaagtatgtaagttgccttttttgttaaacttattttaaatgctttagtatttaaagggtatatgtttttaattaatctgcatatttaaaaactttttgtaacgcgaataactacttcctgatttacatctcaatatattctcctttcatttgcccaattaaaaaaatatgtagtctctattattgctgtttactaatagttttagatcccaatgtgtattagaattatagctacaaaaagttgcaagtaaaatttaacaatttcctattgaaacaggatctcattattatgtttttaaatgtgtagaattaacactttaaataaacaggtgtgaaaattgtaaaggaatatatatgacaactattttctgtacattaacgtccaaacattatacttgtttttcataataaaaaacattttgaaacaaaatttgctgagtttagcataaaagcatctttgaattatttctgagtttcctaaaatatgcaacattttaatcttggcatatctaatcctatgtgctgttctataagaggtacactggacttctaaccactatatgtatttagtagaataatggaatcacaaaggaacaagaattccagacttatagtttgaaatgtatcataaacaaccctttcatattttaggttagtagctttggatagctatttaacacagatgagtacagttagctttatatatattatcctctgagtcttatctatgacaatgtatatttagattaaatatgttcctcctgtaactaaagttgcatctttgcaaatgatgaaagttcatttcagcagacacaaattctttaaaagatttgggctataaactaacacttcaaattttgtaataatcagtatacttttatcaagaatgaaattatttcatgcttaattaccctccttattttgtttccataataaaactattttcagaaaaaaaaatactgcccctgtgctatttttttctgttctgacgtacagcacatgccaagggtttagagatatgcagagattatgatcccaaggtccttcagtccttggggagtagtgactacattcaggaatggagtaagaagagggagtgaagtcaaaagcaaactgatattcatgtgtttattacatgcctggtttcatcacataaatgatctctgacagatgtccatgggagctgatgatggatacctgatgtccatcaacatggatcactatgctgaccagatgcagcagttcttttattttttagtaaatatttcctgcaaaaatatatccatatgaaagggaataatgtataatgtaggtttataaatgagttaacctcagatggtaaactggcatgcattttatgctgttgagagagtgtctatttgttacaaatataccttgctttgggcattctcctttacataaactgtgcagtgttatttgttgtttatttttaatgggattaaacttaataatatacttagggtagataacgttaggggtaaagtgccgttcttctcactgttcattgttagcagtaactgagatgactgtaaaatgaagcagagataggataggtgacatctaaacagcactttctttagggataagatttctagtaggtatgtagttgtatatatcctttaaaaatagtgatattagcatatgggcccacgataattttattagtaaatatactttagagttgtgtgagggaggcaggcagtaaagatctttcaaagagaaaaacaattacctgttgtgttataacctgcaagtaatgattttgaatagtttgttgtttattctttttcttctatgcataagtaaaacgttacttaaatcttactctatatatgcagctttgttcttttttatccaagtttatgttgagagcatttttgctcattaagattttttttttgaaaacatcattattattattattattattatttgagacagggtctcactctgtcacccaggctggaatgcagtggcatgatcttggctcactccattctccacctctcaggctcaagtgaccctcccacctcagcctgccaagtagctaggaccacaggcctgcaccaccacgcccggcaaatttttgtattttttgtagagatgaggtttcactatgttgcccaggttggtctcgaattcctgggcttaagcaatatgcccacctcagcctctcaaagtgctaggattacaggcatgagccaccacactgacttgaaaacattatttttgacagctacatgttattacattgcatagttgtgcaatagtgtaaccatggacctgatattcaccttggtttttaaaataattttaattttattattactactatttttgagataggatctcactctgttgcccaggctggagtggagtgcggtgatgtgatcctagctcactgcagcctcgctcctgggctcaagcagtccttccacctcagcctttcaactagctgggaccacaggtgtgggccaccactcctggctaatttaaaaaaaaaaaaaaatttacttttttaagagatggatcttgttatgctgttctggctggcctcaaactcctggcctcaagtgatctttccactttagcttcccaaagcacatactctttttgaaacattattttccaacaaacatttgtgtctactatgtggcaggcagtgaaattgtgttaaaatatgtaacattaagatggttccttaagctgcagaatttgttttctttttagacatgacggtggtccaaaacctttatttaaaaaaaaattatattaaatgagattataggctataagtaggactggactggtcactcaatatgtaaagtcctgtggtcttttccattcctgattccctcaggcctgtttggcactgttattttccaacagtttgtatctttgtgatatttaagaatactttaaagcatccttaaaatgttgcttttgtcttctttactttcagttgccttacttcaacttcatttacaaatggtctttgggacaactgttataatctttttatttccctagttaggctactggagttttgttgtagttgtttgtattagcattcatgtttatcattcattaaggaatactaaaaacgtttaaaggcagcattgacaagtatatatagtcatcataattagaattaattggtatttcttagcttttctacagcaaaaacaaaaaacagctctatttactgctatttttgaatactggagaaactaggtaacacatttaagtaatattttgtaccattctctcgagtatatttgtttcatcgtgtttgtttttattttctctccagtcttgtcaaaaaagcacttgtctgtttggtgatatcacttgctcatgttctttaagttactgttctaggattggggtgtaatgacagatgaatgaaaagcaggatgagaatgcatggaaagcaaatggtataatggaaagttggattttgagtcagatattgttgttccattttattttgctgcttactgcttatgatcttgggcagataacccatattcatctttaaatcttggtttccacattctttcaacatttcctgacttctccccacacgaccccatttaaattaaattttttctgtgtgaggctctcctaatacctttttcttcaaagcactttttatcacttgagatgatatatttctgtgtttatctatatttaatttgtttttcccacctgtattacaattcatgagagtagggtttatacctcttttattcctcactacatgtcttactttagcacaaagttgcatgcatgatgggcagtcaataaatatctgttgaataaataaactacttactacctgacatatgccaagttattttcttcacaggtaaaactctacaaccacatctcttttggaaagacttatatgaagaaatcaggacaagggaggttcccataccacctccttaaatatatataggactgctgagtttatgaaattgtgtattaacttttatctcatttatttctcacaacttgatgaaatgagagactgttattaaataatagtagactaaagggtcctactgttaagatcatatattttgacacatgtctagcacagtgcctggcacataatgaacaatgaacactcaagaaactgaagagattccaaatagttgatttttttgaattgacattataaaaacttggctttttttttttgagacggagtctcactctgttgcccaggctggagtgcagtggtgccatctcagctcactgtgacctccgcctcccgggttcaagtgattttactgcctcagtaaaatcccgagtagctgtaatcccgagtagctgggattacaggcgcctaccagcacacccagctaatttttgtattttagtagagacggggtttcaccatgttggtcaggctggtctctatctcctgacctcaggggatccacccgcctcagcctcccgaactgcagggattacaggtgtgagtcaccacacctggccaaaacttggcatattttatacagcattttgaaaattcattgttttattcagaatgatcatttgttaagttaaaaatattgagtttggctgggcgtggtggctcacgcctgtaatcccagcactttgggaggcctaggcgggcggatcatgaggtcaggagattgagaccatcctagctaacatggtgaaaccccatctccactaaaaatacaaaaaattagccgggtgtggtgccaggcgcctgtagtcccagctactcgggaggctgagtcaggagaatggcgtgaactggggaggcagagcttgcagtgagctgagatcgcgccactgcactccagcctgggcaacagagtgagactccgtctcaaaaaaaaaaaatcttgagtttaaggaataagttattatttgtattaagtcatttattcatgttctgatcagggtaagacatttgcttgagatccgaaccagttttgaaaggcaattatatatggacataatatctttccagtaaatcttgcaactatttctgtgactacatatgttaacatttttataattggcttccaaataacaaacacagatggctgtagtctgaattttcaccatgttttagaataaatgttttctcagaaatttaaagtgcatcatttcagtataagatgattacctaattgagtagaattttttccttatctgctagcttgccatttttcagattgagagtaaatagcttaaatatctattagtataagaaattggatatatatgatcttgttccctctctcacatttttaccaaacagaactcttgctaaaaagttattgtagatattatttttctgagaatttaaattttgttttgctttttgtcttttggtggaggagggagattataattttttgtgttttaattcatttaataagtaactagaaatttgttaattttgaaaccatgagtttttaatgtagtagaattaaatatgcccgttaaactgttttggttctcaagtcttgtgaagtggtgcttgaaatcattgcttagtggtgacttttctgtaaaagataaattatctttttttactctgaatattattttaggctttgtatatatagcagagaacaaaagaaagccctaaccctcagtgaacttaccttccggttaatctgaaaaataatatgacttcatataatcagtaacataggcctaaaacaatgccatggtaatttaatgtccttaaaagtgattcgttctaagcactataatagaaaaattcctattttgattccatatctatccattatctttttaatttgggttcatttagtaatgaatattattgtttcagatttttaatcgaactgtttatgatgcaaagttttagtttttctcatttattatgtgtttgcacatctgaataaatattaaatataaattatgtataccctaattacagttggaatctcaaaccaaattttcacctttgccctgatatattttgctgtctaaatgtattttctaatgcagacaatgtggaattttaagtttctgaaattgagcataaatatcaaaaatgctattaatttcttttggttttgcattctctctgagggatcttttctttttaaacaatgcacctagaattctgattccatttacagataatatatttagcagtattccagttggtttatttttaagaatgaatttgctaccctccaaagtagtttaagtgcattccagtttcttaatgtacaagtagaggcaactggtcttgcacctgttcctcaaggagacatgaggtggaataactgtgtagttgctgaataactgggaaaaaatttaaatataatttatttttatatcctactaggctagtgattagctatttctgatttataaattagatgtctttattaagtaaatagtacatatgctttccttcatccacagcagacaaaataagtataaaatatgttgtgtgttattctgtagataacatatttgtcacacacacacacacacacacacacacacacacacacacacacacatatttttgagacggagtcttgctctgtcgcccaggctagagtgcagtggcatgatctcggctcactgcaagctccgcctcccggattcacaccattctcctgcctcagccccctgagtagctgggactacaggcacccgccaccatgcccggctaatttttttgtatttttagtagagatgtggtttcgccgtgttaggcaggatggtcttgaactcctgaccttgtgatccgcccgcctcagcctcccaaagtgctgggattacaggcgtgagccaccgcgcccagccatttgtcacatattttgatagtaatatgagcatcattaaaaattgctttatttttatgataaattttctggccattgttgtaactggtctaattaatagttatattaatactagtagtatatttcctttttttaaagcacaacaaagcttacaccttttcttattctttggtttctctcctctcagaatgaccaaagagctcaaattcaatttaggaataggtggctaatagttgcttcttagaaaaattagaaaatctattgcataacaaaaggaaatttcacattagcaaaaggaaaaatacctgtaatctcaagtcagagatacaccaaagttctcagttatattcttccagagtttctctatgcctacaagtacaatgttattaaaattcaagctagatacgattgttgaaggatgtgagtttgagtcctgccttctctgttaaaagaagtgtacattatttttttcataaaaatagattatgcagcagtaatatacctactactgtgtcatgaacatctttgttagcaataatggtttacataaatattttaatatggcgtcatcatagttaacctaatgttgcctaaagcatgtaatacatacttctgatgttaggtggtgatattttaggtctatcctgatccagtattaaaaacattggataaatgggtacaatgtacactatttgggtaatgcctaccctaaaaactcagacttcaccactatgtaatatatcgatgtaacaaaactggatttgtaccccctaaatctataaaaataaaaaaatagaaagagaaaaacattagatagtattgtaagaaagttattatgtttgccagttttcttttagttcatctgcttgtgatagccaagagtctgtttgatactcatatatctttaacacccttttaacacttgcccatttctctcatacccttcaacaaaatctaactaaaattttaataattttttcattgtatttatttttgtttacttttctaaaaaagaaatgacagtgatactgacttttagtttgtgccaaggatagaaagtctccttttagaataaatttactttaaaatttttattgttatgtaatgtatatattttgggaatacatgtgataatttaatgcactcatatagtttgtaaggatcaaatcagtgtaattgggatgtccgttagctttaattagtgaaatattcaaatattttttagaaatattcaaattattttattctagctattttgaaatatttagtagttttttgtaaactatagtcaccctaccaatctatcaaacactaggttttatttcttctgttaaactgttctttgtatccattgtcagcccctcttcatcttctccaccttcctactcttcccagtctctggtaaccaccaatctactcactatttgcatctactttttcagctcccatatatgagtgagaacgtctgatatttgtctttctgtgcttagcttatttcacttaacatagtgccctccatttgtgtccatggtgctgcgaatgacaatttgttctttttttatggctgaataatattccattgtgtacataccacattttctttatccgtttatcaattgatgggcacttaagctaatttcatattttagctattgtaaatagtactacaaaaaaacatgggaatgcagctatctcctttgtatattgattttctttcttttgaatatgtcccagtaggggaattgctggatcctgtggtagttctatttttagttttttagaaatcctccatacagttttccatagtgtgtgctgatttacatttctgttaacagtatacaagggctcttctctctccacatcctccccagcatctgttattccctgtctttttgatgaaagtcagtttaactgcagtgagataatatatcgtggtggttttgatttgcaattctctgatgattagtaacattgagcattgtttcagatacttgttgaccatttgtatgtattctcttaagaaatgtctgttcagatattttgcccatgttttaatcagattatttgctcttttgctgtccagctgtttgaacttcttgtatattctggttgttgttaactccctgtcagatgaatagtttgtagctattttctcccattctgtgggttgtctcttcactttgttgattgtttcgtttgctgtacagaaactttttagctttaaaaacattttttaaattatttattttttgtagagatagatctatgtctcactatgttatccaggccagtctcaaactctcaggctcaagtgatcctcctgcctcggcctcccatggtgctgtgcttacaggtttgagccaccacactcttctgaaactttttagcctggttccatttgtctgtttttgtttttgttgcctctgcttttgagatcttagacaaaaaaaaactttccccagaccaatgtcctagagtatttctctactgttttctttttgtagtttcaggtcttagatttttaaatccattttgatgtgattttttttgtatgtggtaagagatacttatgtagtttcattcttctacatatggttatccagttttcccagcattatttattgaagagattgtccttttctcagaatatatggtctattctggagaatgttccatgtgctgaggaaaggaatgtgtattcttcagcagttggataaaatgttttgtaaatatcaatttagcctatttagtgtgtagtttaactctgatgtttattttctgtgtggatgttgtatattcttggcacctttgtagaaaatgagttgactgtaagtgtgtgaatttatatctgggttctctgtttcgttccattggtctgtgtgtctgtttttatgccaagaccatgctgatttgtttgtatggctttgtagtatattttgaagtcaggtaatgtgatgcttccagctttgttctttttgctttggctgtttgtgatcttttgtggttctatcaaaattttaagattgttttttctatttctgtgaataatggcattggtatttcaatagggattgtattgaatctgtaaattgctttggatagtatcatttttacaatattcttctaatccacaaacatggatttctttccatttttaatgtcctgttccatttctttcatcactcttttatagttttccttgtatagattttttacttctttagttaaattgatttctgggtattttatattctttgtagctatagtaaatgtgattactttcttgatttctttttcagattgtttgctgttggtatatataatttctattgatttttgtatgttgattgtgtatcctgctattttactgaatttgtttatcagttctaacagtttttggtggagtctgtaggtttttctaagtataagatcatattgtatgcaaataaggctaaattgaccttttcctttccaatttggttatcttttatttttttctcttgcttagttgctgtggccaggacttccagtatgttgcatgaaagtggacctccttgtcttgttccagacttagaggaaaggcttttaatttttccctattcagtgtgatattagctgtgggtttgccatatatggcctttattactttgaggtatgcatcttctgtatccagtttgttgagggtttctatcctaaaggcatgttgaattttaaattttttttcagcgttaattgaaatggtcatagggttttgttcttgattctttcaatgtgatgtatcatatttattgatttgcacatgtttaactatccttgtgtctttgggatgaatcccgcttgatcatggtgaatgatctttttaatgtgttgttgaattcagtttgctagtattttgttgaggatttttgcatctatgttcatcagtgatattggcctgtagttttcttttttgttgtgtccttgtctggttttggtatcaggctaatgttggtttcatagaatgagtttggaagtactcccttctcttaagttttttgaagagtttgagtataattgttattctttaaatgtttggtagaattcagaagtgaagccatcaagtcctgggcttttctttgatgggggattttttgtgtctgtgtgtgattgggtctcctgttgcctaggctggagtgcagtggtgtgttcatagatcactgcaacctctgcctcctgggctcaagccgtcttcccatgtcagcctcccaagtagctgggaccacaggcatgtgccaccatgcctggctaattttttgtattttggtagagacgaggttttgccatgttgcccaggctggtctcaaactcctgagctcaagctcaagcaatccacttgcttcggcctctgaaagtgctgagattacaggtgtgagccaccgctcccagcttgatgagagactttttattaaggctttgatttcattgttggtttgttgaggttttctatttcttcatggttcaattttggtaggttctatgtgtccaggaatttatttatctttttcttctaggtttttgaatttgttagcatatagttgttcataatagtctgtaatgatttttgtatttctgtggtctcagtttttacatcttctttttcatttctgattttatttgacctttctccttttatgaaaattagtatagctaaaggtttgttgattttgtttatgttttcagaaaagcaactttttgtttcattgacttctgtattgactgttttggcctcaatttcatttgtatctgctctgatttttgttatttcctttcttctactaattttgggtttggtttgttcttggttttctagtttcttgcagtgcgttgtttggttgtttatttgaagtctttctcatattgttttattggtataaacttccctctcagtactgcttttgctttatcacatagattttggtatgttgtatttccattttcatttctttcaagaaatttaaaattttctcttttaatttcatcattgacccatttgtccttcaggattatgttggttttttgtttgttttgttttttgagacagggcctttctctgttgcccaggctggagtgcagtggtgtgaacatggttcattgtagcctctacctcctgggctcaagcgatcctcctgcctcagcctctcaagtagctggcaccacaggcgtgggacaccatgcctagccaatgttttgaaattttgtaggtttgagaccaacctgggcaacaaagtgaaatcttgttgcccaggttggttttgaacttctgggctcaagcattcatcccacctcagccactcaaagtgctgggattacagacatgagccaccatgcccagcaggaacatacttaattattatttgtttgtgttttctgaggtacttcttgtgactgatttttagttttattccattatggtcagaaacgatacttgatatgatttctaccttttgaatttgttgagacttgttttatgacctaatatatggtctattctggagaatgctccatatactgatgaaaacaatactcttcaggagttgggtgaaatgttctgtagatgtcagtttggcctatttggcgtagtgtatagtttaattctgatgttttctttaattttctctttggatgatctgtccaatactgggattggggtatttaagttccctatattactgtattgcagtctatctctccctttagatctattaatacttgctttttatacttggggctctggtgctgggtgcatagatatttataatagttatatccgcttgctaaattgacacctttatcattatataatgaccttctttgtctctttttatagtcttgactggtagcctattttatctgatacaagtatagctactcctgttcttttttggtgtccagttgcacggaatatccttttccaccccttcactttcagtctgtgcgcattcttaataggcgaagtgggttttttgtgggcagcttatggttgggtcttacttctgtattcattcagccactctcgccattttaattgaagaattgagtgtatttaccttgagtattattattaataagtgaggtcttactaatgctattttgttgcttgttttctggttgttttgtaattcctctcttcttcctttcttactgtctttctttgaagttaagtgatttttttttctggtagtatgtttgaatttgttgattttttatttgtagtgaatttattatagtttttggcattgtggtcaccatgagacttaaaaagacataggttcaagcagttattttaatgatatgacaacttactttagatcacaaagaaaataatggaaacaaaagaaaaaaaaaccctctatactctaactccattccctccacattttgactttactttgtctcaatttacatgtttttatattgcctatttcttgataggatgctgtagctattaatgtttttggtaggtttgtcttttggacttcatcctagagttatgagtgggcgctacaccacaattacagtattagagtattgtgggtttgtccacgtacttaattttactagtgggttgtatacctttacatgttttgttttttcacattagtgtttttttctttcagattgaagaactctctttagcttttcttgtcagacaggtatgtgttagtgaattctctcagcttttgtttgtctgtgaaagactttgttcctcttctttgtatttgaaggatagctttgctggatacagtatccttgggtggctgtttttttccttcagcactttgaacatgttgtcccacatcctcctatatggtttcttcctcctgtatgacctgtatggtatctgttgagaagtctgttgccagacgaattgtagctcttttatacattgtttgcttcttttcttttgccacttttaggatcctctctttgtccttgaccattgagagtttgattattacatgctttggagtaatcttttttgggtcaaatctgctttgttctctaacgttcctatacctggatattttatctctttctcaagttttaaaaagtttttattatttcttgaataagatttctacccccttgcattaaagttaggcattatattatgtagtgctgaaaaacaggcggtgacatggtaccaaaaaaaagatacaaaaacaatacataaattgcaaagactctctaagtgaacacattcagtaaaaaacaagccagacagtgaagactagaactcccttttgaacactgataattcttagatttgatatttcgaggtaattttctgtgtcttctaggtgatctttgttccttttcattctttccttttctcctctgtatttttaaatagcccgtctttgagctcactgattcttttttctgtttgatccattctcctgttgagagcctctaatgattctttctgttcagcaaatctttctcagttccaaaatttctttttgatttataaaaaacttttaatctttgttaaatttttctaatacatttctgaattgtttttctgtgtaatggagatcactaatttcctttaaactgctgttttgaattcttgttcacagagttcacatatttctgtcttgttagggtcattcactgattcactggttctttgtgctttgtccatttgactaagtcaaggtttcccatttgctgttgtttcttgtggatatacatctatttctttttttttttttttttttttttttgagacggagtctcgctctgttgcccaggctggagtgcagtggcgcgatttcagctcactgcaagctctgcctcccgggttcacgccattctcctgcctcagcctcccgaatagctgggattacaggcgcctgccaccactgccgggctaatttttttgtatttttagtagagacagggtttcactgtgtcagccaggatggtctcgatctcctgacctcgtgatcctcccgcctcggcttcccaaagtgctgggattacaggtgtgagccaccgtgcccggcctacatctatttcttaaagtgaagattttgttatttattctagtcttctctgtctggcttgttttagcttttactggatatgtttgctcatagagtcttttatgttttgcctctcttttttttttttttttttttgcactatgtcactgcctctgtttcagtactacataatataatgtatatgatgtctttagccccagtttgcttcagttctagtaaacaatcagtgttatccatccttgatcggtaaggtcccaaaggcccctagtctggctaggggctcgtgcccagaggacctgtggcatgaacctcttacagtgtgatgctgctgaacagccagtctgatttggcgtctcctttggccaagttacaaagcagggtttttcagggctaggaatggtagtcttgccttcccgctttgtctctggctgttaggaatatttctcccttcagatattcccagtacttcctggttgtccctggttgagccagggacagatctcctgtcaaggagcccaagttgatggagaagctggttgtccaccttgatctcactttttccagtgtagaaactgtgagtcaggggaatattttccatgtttggtgatgggcagattaggagaatgggaatcatgaaaatcaaagtctaattcttttaacttctgctcagagttttttcacttctccatggtcttgaatactgtttcttcctcatatttgagttctgggatatcgccagtaataatctaagctctgtatatttgcttttggttttctgttaggggaagcgaaggcaacttgcttctgtgccaccattttggagctattaggttggtgcaaaagcaattgcagtttttgtaccgacctaatggaagcctctgttcttaaaataaatttaaataagaaaactacattggttaaaacatgttaagtaaatgatacataaaggtggctctaggataggacaaaaatcctgatgatgatatgtaaacgattaagggctggaaagcactgctgtttgatatttaagttatttccagttttttttcccattatgaataaggctgcagtgaccactttatatagctaaatctttttgcatgaactaaatctttttagtatatagtaatagaagacacagaaattccagaaagcaaattcatgtagtgctctgtgtgtgcatgtgtgtatgtgtgtgttttcatataatctaaaatccagagcttggccagcacactggctcacgtctgtaatcccagtattttggggaggctgaggcaggcgaattgcttgagcccaggagttgaagaccagcctgggcaacgtggcaaaaatctgtctgtacaaaaaaatacaagaattaaattagccaggtgtgatgacatgttcctgtagtcccagctacttgggggctgaagtgggaggatctgtggagcccagaaagttgaggtgagctgtgatggcgctactgcactccagcctggatgacagagtaagaccctgtctcaaaaaataaaataaaatcttggtgagattatattctcactaagcagtgaatgacagtgcctgatttcccttattctgcctaattctgggcttattttcttttatttagacatgacattttcagttcttacccctcaatatttcagtaggtttattcagaaatgtttctttgcattccagtagttacattaaagactgtaataattgttctttattttttcatttttatttagtgatagtttgatctttaaaagagagactcccaaagctgcttttttcttggtggcaataaagaaaaattatctttgacaataacggttattttcttttttcttagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaagtaagtattctcccagatttttaatcattatggttctcgatggaaagtagtcataacaacagtcattagcaactgtgcgcaatttgatcatgatttttatgtcctcttgaaagttttagtagtatggtaactaaacagtcataactaaaatatttgatcatctcagagagggagttttgtgagtttaatttaatatatgttgaacaactgcagtacaccaaagactgagcaccagagttacaaagatggatatgactatctctgccctttaggaaaattattctagtggagaaggcagacttaaaggtatgcagtgtgctatgattagacctttgctagtatgagagatagatgtccaacttcattttttttgtttgtggctatccagttgtaccaataccatttgttgaaaagactattcttttcccaatgaactgtcaatgaatataaaggtgagggtttatatttatcccctcaattatattctgtagatctgtatgtttagcctttgctactatgcccccaagtcttgattaatgtagctttataacaacttttgaaatcagtaagtgtgagtcttccaactttcttctcttttgggattgttttggctgttgccttgcatttccgtatcaattttagggtcaggtttttctgtttctgcattaaaaacaccacggattttgacagggattgcattgaatctgtagatgaatttggggagttttgtcatcttaacaatattaagttttcaacctatgaacacaggattttttatttatttaggtttttaatttttttaatgttaccttgttttcagtgtaaacgtctcacatttgttttgttaaatatactctcaagcattttatttttattttaattttcatttatttactttttgagatgggttctcactctgtcaccgagactggagtgcagtggcatgatcttggctcactgcaacctctgtcacccaggcccaagccatcctcccacctcagcctcctgagtagctgggaccacaggtgcatgctaccacacctggttaatgttttgtatttttggtagagatgggattttgccatgttgcccaggctggtctcaaactcctgagctcaggagatccacccaccttggcctcccaaagtcctgggagtacaggcatgagccaccgtgcttggccttgtttttgttattttattttattttagttttttgtagaaatgtggtctcactttgtgtccaggctggtctcgaattccaagacttaagtgatcctcccgctctggctcccaaagtgcttatgcctgtaaagttttatttacaggcatgaaccactatgcctggccaccaagcattttattgctattttatttctaagcattttactgctattctaaatataattgtattcttaactttattttctgattattcattatccatgtatacaaatacaactaaatttgtatattgatcttgtctcctgtacccttgcagagctaactcatctgtaagttctaataggttttttgttttgttttgttttgttttggtgaattccttcgatttttcctgtatgcaagaccatattatctgcaactaaactagaaatgttcaacttcttcctttccaatgtcgatgttcttttttcttttttgtaattgccatagctggaagatataagacaatgttgaaaagaagtgttgaaagcagacatccttgtattatttctcctaataaggggaaagcattcaggtttttttttaaccattgagttttatattagctgtttttgttttgttttgttttgtttttgtagctatcctttatcagattgaggaggttcccttttattcctggttcattaagtgttttcattataaagaaatgttgaggtttttttgttttgtttttattttttagtttattggtttgttttttgtttgtttgtttgttttttttttttttgagacaaagtctcgctttgactttgcactccactgctggagtgcagtggggtgatctcagctcactgcagtctccacctcccaggttcgagtgattctcctgcctcagcctcctgagtagttgggattgtgagccatcacgcccaactaatttttgtatttttagtagagatggggtttcaccatgttggccagggtggtctcgaactcctgaccccaagtgatacgtccacctcagcctcccaaagtgctgggactacgggcattagccactatgcccatccacttattttattgttttttgagacaggatctcactctcgtccaggatggcatgcagtggtgcaatcatggctcactgcagcctcaacctcccagacttcagtgatcctcccacctcagcccgacaagtagctgggactacaggcccatgccaccacacctagctaatttgtgtatttttttgtagagacggagttttgccatgttgcccaggcttgtcttgaactcctggattcaagtgatctgcctgccttagcctcccaaagtgctaggattacaggcatgagccactcactgctcccaacctgagtgttgagttttgttaaatgctttttttgtgtctatttgcaatgactttaatacaaaaaccatcactagggacaaaagatgttacagcacacattttacattatataaattcagccttttaaaatattttgggtatttaaatggtctaacatatagtcatctttctgttcttcagagtggataattgcaattcatctatcttgaagtttgctgattctctcttcctacttagatctactactgagtccttctagtggcttttcatttattttccttttcaattccagaatttttatttgattattttataatttcttcgttttattgatattcttcatttggtgaggtgttgttcttacaatttaaattttgttttgttttgtttttagattttatttcctttagttatttgactgtatttaaaatagctgagtcagaatctttgttggccaggcatggtggctcatatctgtaatcccagcactttgggaggcagaggcaaggggattacttgagccgaagagttcgagaccagcctgggcaaaaaagggatattctgtctttacaaaaagtaaaaaaaattagccgggcatggttgtgcacacctgtggtcccagctactccagaggctaaggtgggagaatcgcttgagcccaagaggtggaggctgcagcaagctgtgatcacaccagtgcactccagcctgggtgacagagtgagatcctgtctcaaaaaacaacacaagggccgggcgcggtggctcatgcctgtaatcccagcactttgggaggccaaggcgggcagatcacgaggtcaggagatcgagaccatcctggctaacacggtgaaaccctgtctgtactaaaaatacaaaaaattagcggggcatggtggtgggcaactgtagtcccagctactcgggaggctgaggcaggagaatggcatgaacccaggaggcggagcttgcagtgagccgagatcacgtcactacactccagcctgggcgacagagcgagactccgtctcaaaaaaagaaaaaaccaagacaaaaccaaaaataactttgtctgttaagtacaatatctgtgttcctcagggacggtttctattgaccattgtttttcttgtgcatagactatcctttcctttttttgtacatcttgtaatttttgttttattaaaactggaattttaaaaataatgcagtgtggcaactctactgcttgatttggctcaaaggtatattatttattttttaatataacaaaccaatatttgggttctctattctatagttttagcattttgaatgcaacaactgtcttattcaccatttaattctcagtactaccgtttctagtacacaatatgcacttaatgaatatgagggattgtatcatgaaagtatttcagatttaaaagataatctcggctgggtgcagtggctcacgcctgtaatcccagcattttgggaggctgaggtgggcagatcgctagaagttaggagttcaagaccagcctgggcaacatggtgaaaccttgtctctactaaaaatacaaaaattaactgggcatgttggtgcgtgactgtaatcctagctactcgggaggctgaggcaggagaattgcttgaacctgggaggcggaggttgcagtgagccaagatgatgccgctgcactccagcctgggcaacagagtgagactctgtctcaaaaaaaaaaaaaaaaaaaagagaatcttatgagttaggaaccactgttaataggattttagattacaggcaagtttatttttgttcttggcctcagttactacttcatggagaaggtagttttagaacttagacttgaatgttgaatagaatttccataggtgtagatgagaaaggagacagtgacagttaatatttgttgaatgaaagggtgaaactctctggagagggtcaacagtgagaatagtacttttggagtcagaaaatttggatttgttccttgactctttctactacttcttttagggaagcttgaaaaagctactcacttcatacccaaatccaggcatgtgatagtgaaacaagaatgactttaaaagtgcttttgtaaactgtaaaggtgttataacaaaagtggttattttttctttagttattactttttttagcatcatgatgatatgatttttctttcagagaaattgaacttttcttttttattgatttattttaattattattattattttttaaagacagggtctcactctgtcacccagaccagagtgcaatggcatgatcttggttcaccacaagctctcccttccaggcccaagcagttctcctgcctcagcctctcaggtagctgggattacaggcatgcaccactaccgcctggctagtttttgtatttttttttttttttttttttttttagtaaagacgagagttcaccattttggctaggcaggtctcgaactcctgaccttaaatgatccacccacctcagcctcccaaagtgctgggattacaggcatgagccaccacacctggccgaacttttctaacagtagcattttaggactttgtttcattttaaagaggtacggtagttcctccttatttgtggagagttgtatcattccattttcatgctgctgatacagacataccggagactaggtcatttataaagaaaaagaggtttaatggactcacagttccacgtggctggtgaggcctcacaatcatggtggaaggcagaaggcacatcttacatggcagcagacatgagaaaaatgagagccaagggaaaagggaaaccccttataaaaccatcatatctcgtgagacttactaccacaagaaccgtatgggggaaactgctctcatgatttacttatctcccaccaggtctctcccaaaacacatgggaattatgggagctacaattcaagatgagatttggatgggggaactcagccaaaccatatcaagagtatagtccaacacccccagtggagacctgaaaccacagatagtactgaactctgtatatactgtgttttttcctatactcatatacttatgataaagtttaattgataaattaggcactgtactcttgtgctttggggccattacttgaacacaagcactgcaatactgcatactgccataatgtatgatagtgcatctgataatggaggtggctaccaagtaactgttgggcaggtagcatatactgtgtggatatggtgtacaaagggacgattcatgtcctggatgggacagagtaagatttcatcatgccacttagaacagtgcacaatttaaaacttatgaattgtttatttttggaattttccattttaatattttctaaccacagttaaccatgggtaactgaaattataggaagcaatactgtggataaagagggggctactgtatgaggattggaggaatggtgtcttacttcatgcttttggcttacaaatgatatgtatataagaccctgtatgaaagtacctcttgatacttttatatttagaaaaatgcctactggtacattttggttgcattattttgccattgttatttataattaaatgaaaattttaaagatttgagtaatttttactagttttttagtggtattttatgtgacttttctatcatatgttaccaatagtaatggtttagtaaagtatgatatttagcacaaaaaagtcataattatatttggtttttatttttgttttagctggaaagtgaaatttcaaccacagcagatgactgcagttcagaggtaagactaaattatattgatttctaatatcataaatgtatatttatattattattgaaatcattgattgttgctacttgatttcttgtcactcatgcttctattttatttttataaatataatgttaagtgactagaacctgaggattatgtattactgactttttttttttttttttttttttcagattattagctaaggtcttaagtctggttaaatagcttggtctctgttttagtttctggaaagtatttgatattgggtttcttagacatgtgactgttacaaggcatccatatttagcacagtaaaaatatcaaaaattttttgagactttgaataggatatttcattttgagtaatgcttttttataaatgcttgaattctagttaatcatatgaacttgtttattgaaattaatgtttcaatagtagtttttactttaggtgataaaggtattgtccactttaggaaataccctctttgtgtgttggtaaaagtatatgtcattttgttatctttttcttattcttttagatgtgattgtcatttctttactccagaatttgaggagactataaactattctgtactctgaatggtttagcaactcagtgtattcagtaagtctcaatttattgtaggtttctaataggaaaaaaaaactccatgttcttaaatgaacgtattactgttttagattgctaatagcaataaaaactgctactttagaagttaatgtgcttaaaagttggaatatacttactagtaatctggccaggaaaataattagccaacattaaataaacacattggtgcctgatttaggctaaagttgcctctatgggaagtatcttgatttaaaatcactgcttaaaattcagagtctgcttttgtgacattaaatttggggcgcatacagttggccctccatatccctgggttctgcatttgagggtatgaccaaccacagatagaaaatattctgaaaaaataaaaaataacagtacaacaatagaaaatatataacatttaaaaatatagtataacaactaagtatatagtaatcttagagatgatttaaagtatatgggcagatgtccacaggttgtatacaaatactatgccattaagggtcttaggcatccgtgattttagtatccttaggggagttcctaaagctaattcacttgaagacaccaagggattattgcatttgaaaactttttttttctttataatgctctaatttttatatcttgtatttcttttttttttttttttttttcaccaagatggagtctcactctgttgcccagactggagtgcagtggtgcagtgttggctcactgaaacctctgcctcctggatctaagcaattctctgcctcagcttcccaagctgggactacaggcatgtgccaccacacccggctaatttttgtatttttagtagagacggggtttcaccatcttggccaggctggtcttgaactcctgacctcatgatctacccacctctgcctcccgaagtgctgggattacaggtgtaagccaccgcacctggctatagcttgtatttcttgactgaaagtcataaatgctttggtgcttaaactgcctgtatctctgggggcaccccagagttccacgaagtgcatttttctctttacactaaagtgaatattttttaatatgctagtggctgtaggtcagaccctcccatatatgcccatgaaatttggttacaatttgtatagctgttttctcacattgagataatagagcaaattttaatttaatttttttgtcattctaagtattttacgtacgtatgtatgtatgtatgtatgtatgtatgtatgtatgtatgatactttaagttctagggtacctgtgcacaatgtgcaggtttgttacataggtatacatgttccatgctggtttgctgcacccatcaactcgtcatttacattaggtatatctcctaatgctatccctcccccagcgccccacccctcgacaggcccccatgtgtgatgttccctgccctgtgtccaagtgttctcaatgttcaattcccacctatgagtgagaacttgcagtgtttggttttctgtcattgtgatagtttgctcagaatgatggtttccagcttcatccatgtccctgcagaggacatgaactcatccttttttatggctgcatagtattccatgatatgtatgtgccacattttctttatccagtctatcattgatggacatttgggttggttccaagtctttgctgttgtgaatagtgccacgataaacatacgtgtgcatatgtctttatagtagcatgatttataatactttgggtatatacccagtaatgggatcgctgggtcagatggtatttctagttctagatccttgaggaattgtcacactgtcttccacaatggttgaactaatttacactcccaacagtgtaaaagcattcctatttctccacatcctctccagcatctgttgtctcctgactttttaatgattgccattctaactggtatgagatggtatctcattgtggttttgatttgcatttctctgatgaccagtgttgatcattttttcatgtgtctgttggcttcataaatgtctgcttttgagaagtgtctgttcatatcctttgcctgttttttgatggggttgtttgctttttttttctttcttttattattattattatactttaagttctagggtacatgtgcacaacatgcaggtttgctacgtaggtatacatgtgccatgttggtttgctgcacccattaactcgtcatttcatttggtatacctcctaatgctatccctcctcctgcccgccaccccacgacaggcccccatgtgtgatgttccctgccctgtgtccaagtgttctcactgttcagttcccacctatgagtgagaacatgtggtgtttggttttctatccttgtgatagtttgctcagaatgatggtttccagcttcatccatgtccctgcaaaggacatgaactcatccttttctatggctgcatagtattccatggtgtatatgtgccacattttgttaatccagtctatcattgatggacatttgggttggttccaagtttttgctattgtgaatagtgccgcaataaacataggtgtgcatgtgtctttatagtagcatgatttataatcctttgggtatatacccagtaatgggatcactgggtcaaatggtatttctagttctagatccttgaggaattgcttctaaaatatctactaaaaataacaaaaattatctgaacatggtggcgcaagtatttttgtatttttgttagagatagggtttcaccaactgtcttccacaatggttgaactagtttacactcccacaaacagtgtaaaaccgttcttatttctccacatcctctccagcatctgttgtttcctgacttttaaatgatcgccattctaacttttgtgagatagtatctcattgtggttttcatttgcatttctctgatgaccagtgatgatgagcattttttcatgtgtctgttggctgcatgaatgtcttcttttgagaagtgtctgttcatatcatttgctcactttttgttggggtttttttcttgtaaatttgtttaagttctttatagattctggatattagccctttgtcagataagtagattgcaaaaattttctcccattctgtaggttgccttttcactctgatggtagtttcttttgctgtgcagaagctctttagtttaattacatcccatttgtctattttggcttttgttgctattgcttttggtgttttagtcatgaagtccttgcccatgcctgacctaaaggttattgcctaggttttcttctagggtttttatggttttatgtctaacatttaagtcttcaatccatcttgaattaatttttgtataaggtgtaaggaaggagtccagtttcagttttctgcatatggctagccagttttcccagcgccatgtattaaatagggaatcctttcgccatttcttgtttttgtcaggtttgtcaaagatcaaatggttggagatgtgtagtgttatttctgaggcctgtgttctgttccattggtctatatctctgttttggtaccagtatcatgctgttttggttactgtagccttgttgtatagtttgaagtcaggtagtgtgatgcccccagctttgttccttttgcttaggattgtcttggcaatgtgggctcttttttggttccatatgaactttaaagtcgtttttttccagttctgtgaagaaagtcattgatagcttgatggggatggcattcgatctataaattaccttgggcagtgtggccattttcacaatattgattattcctatccatgagcatggaatgcttttccatttgtttgtgtccttttttatttcgttgagcagtggtttgtagttctccttgaagaggtccttcacatcccttgtaagttggattcctaggtattttattctctttgtaggaattgtgaatgggaattcactcataatttggctctctgtttgtctgttaatggtgtataggaatgcttgtgatttttgcacattgattttgtatcctgagactttgcttaaggagattttgggctgagacaatgggttttctaaatatacaatcatgtcatctgcaaacagggacgatttgacttcctcttttcctaattgaataccctttatttctttctcttgtctgattgccctggccagaacttccaagactatgttgaataggagtggtgacagagggcatccttgtcttgtgtcagttttcaaagggaatgcttccagtttttgcccattcagtatgatattggctgtgggtttgtcataaatagctcttattattttgagatacctcccatcaatacctagtttattgagagtttttagcatgaaaggctgtggaattttgttaaaggccttttctgcatctattgagataatcatgtggtttttgtctttggttctgtttatgtgatggattatgtttattgatttgtgtgttttgaaccagccttgcagcctagtgatgaagctgacttgatcacggtggataagctttttgatgtgctgctgtatttggtttgccagtattttattgaggatttttgcattcatgttaatcagggatattggtctaaaattcttttttgttgtgtctctgccaggctttggtatcaggatgatgctggcctcatttaagttagggaggattcccccaccccctttcttttttctgtggcggagtctcactctttcgcccaggctggagtgcagtggcatgatctcagctcactgcaaccctcgcctgccgggttcacacaattctcctacctcagcctgctgagtacctgggactacaggcgcgtgccaccatatctggctaatttttcgtatttttattagagatggggtttcaccatactgttcaagctggtctcgaactcctgacctcttgatctccccacctcggcctcctaaagtactgggattacaggcatgagccacctcgcccagccaattccccctttttctatttattggaatagtttcaggaggaatgataccagctcctctttgtacctctggtagaatttggctttgaatctgtctggtcctggactttttttggttggtggtctattaattattgcctcaatttcagagcctgttattggtctattccgagattctacctggtttagtcttgggagggtgtatgtgtccaggaattcatccatttcctctagatgaaagaaatgggacctgctgagccaggcacgggagagaatctcctggtctgccagtttctgagaccattggaaaagcgcagtattgggcgggagtgtcccgtttttccaggtacagtctgtcacagcttctcttggctaggaaagggaaatcctccaaccccttactcttcctgggtgaggcgatgccctgccctgcttcggctcaccctccatgggctgcacccactgtccgaccagtcccagtgagatgaaccaggtacctcagttggaaatgcagaaatcacccgtcttctgtgtcgctcacgctgggagctgcagaccggagctgttcctatttggccttcttggaacggatcctcacaaattttaattttaaatattgatttgaaaagctaaagaggtcaaaagatggtgattttcaggttttctgtaggaaaatgttaattaatagtatgggaaattcttgttataataagacagtcttcagctaaattttttaaattaaaaaactggtggagattatcaggttccaaaaaatgtattgaacctatttatctgagatgcctagtaaatatatgttttaaggtaaggtacaaatagtatttaagtgtaagtactaccgataaaacttagaacagtatttatcatacttgttgaccatagctcatggtgagaaatatattttacatacgtttgtaatttcatatatatacatatatagttacatatatttatagttatatacatgaataattatatatgaataaatatatacatatgcatacttttttccaaacaagtttttggaaagatacttattcttacagtatgacatatcttgtgatgatacagtttcttgttaatgttggtcaaaaaaactaaattgatgagctatcttaccgtgtggaataaacagtgatttagaagattacattgaaaaaagataattatgagccaggcacggtggctcattcatgcctgtaatcccacactttgggaggccaaagtgggcggatcacctgaggttaggagttggagaccagtttgaccaacatgctgaaaccccatgtctactaaaaataacaaaaattacctgaacatggtggcgtatgcctgtaatcccagctacttgggaggctgaggcaggaaaattgtttgaatctgggaggtggaggttacagtgagccgagatagtgccattgcactccagcctgggcaacaagggtgaaattctatctcgaaaaaaaaaaagaagaaaaaagataattatgaaataatttttgacagatttgacctggtttgaattataaccctagtaatattttgtgtgttatgtatggattcacaacggattatactttgagaaatttatagattcactatgtctagagaaaacgtagaagtaaagttgatatttggtgaaatgtttgatatgtgtcatcaaaattgctaagatggatactagttggatctgtgatgctctaggctagttttgaggcttgaattcctccatttaatgatattagactggcttgactcaactagaattacaggagacttctaagccatatccacctattcaggaggcagaaaaatcatcagtggaccaaatttataacccgagaaataaactcatactgtaatagtttttatattggaacttttatggaattatctctcaataacacacctaaaaaatgagatttattggccgggcatagtagctcacacctgtaatctctgcactttgggaggccaaggtgggaagatcactggagctcaggagttcgagaccagccttggctacatagggagacatcatctctacaaattaaaataataaaataaaattagcaaggcatagtggcgggcacatgtagtcccagctacttgggaggctgaggttacatttttcaatgtaatcttctaagtcactgtttattccacacggtaagatagctcatcaatttagtttttttgaccaacattaacaagaaacagtatcatcacaagatatgtcatactgtaagaataagtatctttccaaaaacttgagcccaggagtatgatcacaccactggcactccagccttggtgacagagcaagaccccctctcaaaaaaaaaaaaaaaaaaaaaaaaaaaagctaggtgatagtgtgtgcctgtacttccagctgctcaagaggctgaagtaggaggatcccatgcacccaggagtttgagtttgcaatgacctaatgatcacaccactgcactccagcctgtgtgacagagtgagaccttgtctcaaaaagagaaagagagagagagatttctgggcagtatgtaacattataacttcactgcaatgccatatttgcaaagtttaataatcttggcagatctagattgtatttgagtattctaaaattttgaaatcaagtagttttaatcatagatcacataattatcttgtattttacctaaatatgactatcatttttctggtaaatagggcaataagatgtaagaaaagagcagggggactttggagccagaaagtcctgtttacatacttcatcacctttgaactgtatgaacctgggcacatcacttaaactctgaaatacagtttgtttttttattattattatactttaagttctagggtacatgtgcacaacattcaggtttgttacataggtacacatgtgccatgttggtttgttgcatccatcaactagtcatttacattaggtgaaatacagttatttaaactataaaatgggggacgatgatatctacctgatatatttgcatacctcacaaagtagttcacaaaataagcttgagaatgtttaatatgtgtttggcatacattagacgttcagcaaagtgtggttttttaaattgctcatcactagaaatacacttttctttacactacatttatatgaaatgagtgatgatgattcccttaataaattgttctcagaaggatttcaggttctgataatatttgattagaacttaatttgtaaattgtatttatttaggtatattgtgggtttaatgttcttgacttctgtgactagtacactcattgggttggaaaattggttccatcttagaattagtcaaataatattattccaagatctcttttgtagaaatatgtatcctattatgtacactagagaaatcggactaaatgaaaaatactcttcttacaaattaaattatatgcagtcatcttcaatcattaatgaagggacgtttcatgtccagaataccatatttacatgaattgtttttgataccctttgagcagggttatttggaggaagttgggaatacaggcaatatagagtcaagacaagtagataaatatactttgccatgtatagaaagatgaaatgatagtaatagggtattcactcttattatagatttcatctgattattgaatactttttaaccaagtgcttatatggtttatgacatttattttaacctcgttaattacttgactgcaactccataagtcatttaggcacattgaactcttataattttcatgaacttttatgagccatcagatttttattttttatgaaaatattcaatattaatgtttttaatttatatatttccaaattaagtacaagaataaggtattaatcataaataaggatgagttgttcttttatatttcatcaacctaatgttcaccacaaggatgagtttttatgtgaaggccattttatagtcacatagtgaaagttacctttcctctgattctttctgaatagcaatgttgttatgatgtgatacctctataaaacattttaaaatttaaaatgtacctcacttgtactttcccagatctttaagttatctgtacagatagagtaaatttttctgtgaatgcagaaagaatacattaacatagtctgtaggttaaataacttcaacaaatgccacaataaaaaaggacattgagagaagttgagcttttttcagttgaaggagtctgttaatctaatcttcatgtttcaagtcatttatttactttcatatgaaggtttacttagtgttagaagactaatgttagaagaggagataaatactctaccctttagttatcaataaaataattatctaaatttaaaaacagaataatttattgttaactattaatgatcctgatattctgttaagtgttcctgttctaactttggaatatagtgtgttttagtttagttctggtgaataatcttttatagccaatttgtatgatgttaaacttttcagatttattaatattgataagttttacatttattataacataaatatgttttgaaacagtcatgtattaatggtattttaagaattcaatacatatgagttcaagtataacatttgcttatctgaattagagaaaaattaaacagcagtggctaaataaagtactagatgaaactataaacataattattataaaatggtaactgataactgattcatgtaatactgacagttattacaaactgataactgataactgattcatgtaatactgacataatcactccttaaaggaatattcattgctttgtatcatatttgaagaagcagtagtcccccatccctgtttttactttctgtagtcaaccattatctgaaaatattaaatggaaaattccagaaataaacaattcataagttttaaattgtgccttgttctggtagcatggtgaaatcttgctccatcccattcatcccacccaagatgtggatcatccctttgaacatacagtggatctacaccatatactctgtccatctcatgttcatttagtagctgtctaccttatcagatcaaaaaaccatagtgtatatagggttcaatactatttatgatttcaggcatctactgggagtcttggaacatatcccctgtggattaaggaagactactgtattcataaacatccatttcgttacactgataggctacagtaaaatattttagaggacacatcagaatgcttcatttcaggatcaagaaaagctaattgcaatttagaagtatttaatttgaaagttattgcaaatgtcttgatattaatcttttaattaaaaaaattttttagagacatggttctcagtatgttgcccacagtggagtgtggtggcaattaataggtgtgccagttgtgcactatatcctcaaactcctgggctcaagcagtcctcctgcctcagcctcccttgtagctggaaaccagccaaatgggaagaactctttttttttttttttttgagacagagtcttgctctgtcgcccaggctgtagtgcagtggctcgatctcagctcactgcaagttccgcctcctgggttcacgccattctcctgcctcagcctcccaagtagctgggactacaggcacccgccaccacacccggctaattttttgtatttttagtagagacggggtttcaccgtgttagccaggatggtctcgatctcctgagctcatgatctgcccgcctcagcctcccaaagtgctgggattacaggcgtgagccaccacacccgacctaaattgttttacttgaaaatgaatagggcttaataaataattatttgaaccattttaaggaagcctttcatagaagagattttattgaggtttatacttctgaagagcaaacagaaactgcacttagaactttaattcacttaagtgaaaatgtatatatgtgtcttttgcattgtaagcactcagatttgtgaggaatgattggcatttgaaatggtcattatgtctcttagatattttaaattaatctctgtatctgttttcgccaatgatgcattttccctaggaataaaagacatacacgtgaatacagttaacagaaatattgttagctaaataaaattatgtctaagatcataatatatcaggaaattgtttttatacaggtaaatggttgcagttttgtgatgagaacaggaaagcctacaaatttattaagggtacagtatttaaaactacttgtgatactaatgttggatactatttaaaatcatctggcttactaacaaaactttttcctgcatgtacttctttctgtgtgtgatttcaaattaattttaatgtttactaaaacaaagttatctaccatttattataaaactcaattgtaggccaggcgtggtggcttacgtctgtaatcccagcactttgggaggccgaggcaggtggatcacctgagataaggagttcgagaccagcctgaccaacaaggtgaaaccgcatctctactataagtacaaaaattagccgggcatggtggcagccgcctgtagtcccagctacttgggaggctgagacaagagaattgcttgaacccgggaggcggaggttgcagtgagctgagattgcgccactgcactccaacctgggtgacagagcaagactctgtcaaaaaaaaaaaaaaaaaaaaaaaactcaattgtaacagaatttgcggataacctgtttatgttcttgaggtaaatatgttaacgaagtaggttgccataccataatcttccaggtggtgagtgatgttttaaagtggaccttgctatggatttcagtatttgaatctctctccctaaggaatattgctaatactgaattctttaaaatcttggattgatttaggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcaggtatgtttattttctgtggcttttgatttgctactcacaaaaacaaaaacaggaaatgtgaataatagtagtctttaaagatggggtttttaaaatttttttttaacttttttcttttcttttcttcttcttcttcttctttttttttttccatacagggtcttgctctgttgcccaggctggagtgtagtggtgcaatctcggcccactgcatcctctgcttcctgggctcaagcgatcctcccacctcagccttgtgagtaactgggactacaggcatgcactaccacacccagctaattttttgtagagacagggtgtcacctcagattcctggactctccttggcctcccaaagtgctaggattacaggcgtgagctactgtgcctggcctaaagaagggggttttaaaatggtaacttagtgggacacagtggcatgcacctgtagttctagttattcaggaggctgaggtgggaggatcacttgagcccacgagttcaagtccagcctgggcaacattgggagtccctgtctcttaaaaaatcaaacagaaaagtaaatgataatatcactcataatttttgtctttatacattgcataaacaaccctgtttaaaagtaggatttcattaacagggttaatataacacagactcttttttaactttatgatagctagcctgaaatcactttaataagacagatgtttttgtaatcagcctgagagaaaattatggtgcaaaccacatcaaaatattataacttaagtccattaagaatgtcagcaagttgggcatggtggcttatgcctgtaatcccagcacttcaagaggctgaggcaagaggatagcttgagtctggtagtttgagactggcagggtgaaaatagcaagaccccgcttctacaaaacatttaaaaattagccaggcatagtggtgtgtgcctgtagtcctagttacttgggaggctgagacaggaagatcactgcagcccaggagattgaggctgtagtgagccaaaatcacaccgctgcactctagcctgtacaacagagcgagaccctgtctcaaaaaaagaacagaaaaacgatgtcagtgggtccttgtaagtaacctcttgtggttagactaacatctgtggttagactgccataactgtctatggcagtcagttatgaaaacaagatgaagtaggacattgatgaggatgacaaaaatacatatcagtttcatcctcttcagaaacaagttggaattaaacatgtctagggtggtgttgcctgggaacagattaggggcacccctaaatataaaggcacttgtccttctataagtaaatatatggataagccagatcaattttttccttagttcagataaattttttgaagttgatttggaagcaccaatttctgtaagttaatagttttcaaatgtggaaaatactgattacaaagtgtaagaattatgccaatgtgttttgaattcttattttgaaaaagttacctgtaataatagtcaattaaaaaaaataaatctagcacttactattttctttcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaagtaagtattactaatgcaacaaaattcattatttttttagtaatgaattttaaaaattcactttcaagaacaaatctaaatttgttaaaaaagccatttcgtattatatcatgtatgaaaaattagtgaatatgtgttgctatattaaccaggaatttaattcatacttcttaaatggttctctactaatattttcttttcatttcctccctgtctctattttgaaatcttacaaattgtgtaaggttgattgagggtatttctgcagaaattaacctgtagtcacatcctacctttgccaattctggtatggtttattttagttaggttctaaatgataacaaaactaaatatattccattttcctttaattagagccacaggaatctaactgcattaatcagaatttctgatggcaagtagcaaaacaatttgaaatagtttaagcaaaagggaggtacttagtgtaaggattcaggctgtttccagaacccaagggcagaaatacaaccaggcctctgaaagggattggaactacaaactggaaagccatagggaattcgggaagtactgtctttgatgccccacttttcttcgtatatctgcctcagtctcaggagacctaggttctctgctgtatcatggaaaagataagtttattggctcggcttgggtatacctatctagtcagccaaggtagcatgtttgctagggtctcaagcctgcagagttcccagagagctattgcagggacaccccaaaggtgtctgttccctaatacagtcacttcagaatttaacgttttgaggtttctttctattttcagttacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggtatgtttattttaaggaagtcagctaacttgtagaagctttagagtttcaagttttttatgcaagtggtttttttttgttaggcacatgaatcacaaaatttcataattaagctctttgtgtaatttatttcaaaagcaaatgggaatctcagtaatgtagtttttaagataatagtcattactgagttccctaaaagtgatcagcctatgttaaactgaattagcaggaaaatacaaatttatagctatagttttttttgtcatttataattatttccacttattttagccatggttgtgaaattcagaaaatattttcacaacagagagaaattttatggattttaatgagaaaaaaattgaatgtagtcagttatctttatttacataagttatgttccataaacttaagtgtttctgggaacacttatttagcaaataagttctctggtgggggattgttgggaggaatatgtgtccgtgtatgggtgcgtatattttacatatatgtgtatcacattgattataatcttaaatcataaaactactcatcctggaagattctttttctttattttttaaaagggaaatcaaggttcagaagtgacttgcctgaggccaccccactaacaggtgtcagactgggattcagatcctgtcagttgccccagagctggagcttcctgtactacactgcactacctcgggtcctctccatccctctggtcctctctataagggatgaacaaggcagtgtggtcaccttgtttgacctcagctagaagtgtatgtccagcaactcaaattttttgtcgctctgtgcacacctacaaatgactaaaagcaccatgagcattgatttgggggttacaaataaattttagcaagaactcacaaatatggaatctacaaagaatgaggatggattgtacatgcaatataatactttttataaacttaggaggttcttctgcaagaggttgagaaattaccaagacaagaatattgcttggatgataataataatagtagtagtaattagcatttattaagtgcttactgtgtaacaggcagtattcaaagcatcttatattaactcattgaatcatcaccataggcctgtgcaatagaagtacaattatcactcctattttctaagtgaggacaccaacacaaagcaagatgaggtaaattgctcaggtatacacaggtagtaagttgatagagccagatttcaaatctaagttgtctgactccagagactgcttttaaataatagggaatgtacaaattgaagacaatgaaattatgaaaaatacatgctttaccactaaggtaatttaaaaattattaggtaaatatttacagaacacctatttttgtagcaggcccttgcaagaaatacagtgaggcttaaaatgtgcccttttcttcactggaactcagatgagtaggagagctgtggcatgtacaaaggacaccacaaaacagggataagtgtgggcaaaaagtgctttgaaagttctgaataggtctggcttcataagagaagagattcagggtaagctttagtggaagagtttccatttgaggtaagtttataaattgggacaactttttaattgtattttgtttccccaacaattggcctaatgcctggaacatagtagctactcaatactcactttgtaaacaagtgggtaaattaaggatctcaactgatagaaatggggaggactttttagatagagtgtggagtaggcataaagactcaggatgaaacatgttaaaaatcagtaaggagcaaaaaatggtgtaacttgtctagaaacagtaatctttgaaagttaatctttccaggaggtaagagtgggaggataatctaggactaggtgagaagagcctggagattggattgtattatatttactctgtgggcagtgtaaattgagattatttaaaattcaagtaattcattttgtagggggaataacctttgttatttgaatataacaagaatacttttatcaatctgtttttcactatatacatttttttaaatttttattcttaagaaaatgaatccccccaagtaataattctatcggcagctgagatattagggtcagctaaggcattggggtcacaaatgaaatggtcttggttccctagaccagtggtccccaacctttttggcaccagggccagtttcgtggaagacactttttccacagacatgagggaggaatggttttgggatgacatcaggcattagttagattcacataaggagcttgcagcctagatccttcacatgcacagttcacaataaggttcgagctcctagaagaatctagtgccgcagcagatctcacagagatctcgctggtaatgcttgcttacctcctgctgtgtggccccatctctaacaggccccaaccggtaccgggtctgcaacctggaggttggggaccccttccctacacaactgtgttgatgatcaaaagctcattctcattgtcctaatcctccaaacttcccattggtgccgtagcatagtatttccccccatctcaggtgtatttccaaaagatagtgtattcaaccacagggctctttttttttttttttttttttttttttttttttttttagaattcagagtaagtggtttaaaaccatgtactttgaaataagtgatactaagaaaaataaaccataaatttgtgttgtttaacggttgaaagaagaattattgttggttgttattatatcaggtgttggacaattttgaattaaatgattaaatgatactgttttatgaaggccccactcccctatataaatcaggaaacagaaaagttaaattttgtaacattaacatttttcaaacttagttacttatttaacagtttaactggaattgaccaccatgaactgattttactttctcatagattccaaatgtgttacagatttctttctagtatgtaaatatattacactcgtatatattaatagtacagtaagaataaaatgctttaataggtgatgttttattttagcatattctgtgagatagaggaaataataatatttatattgtatggatgaaaacactgggattaaaggagattaaactgatttattaatatcctattgtagtgcagagtttgaagtaagaaggctcaggacttggtaataacatggtaatattgggtgggatatgtgataccaaggcacaagctgatagaattttgcccaagaggctgcataggataacattcattgccttggttaatttatatagtacagaatctggccttcgacttgtaggttcagaagtctgatttttttttcccctgtcaactgagacgagctacctcagaagtgaactcagatttttcaaagttaacgaggctaattttttttgtttgttttgagacagagtctcgctctgtctcccaggctggagtgcaatggtgagatctcagctcactgcaacctctgccctctgggttcatgtgattctcctgcctcagcctcctgagtagctgggatcacgggcgcccagccccacgcccagctagtttttttatttttagtagagacagggtttcaccatgaggctaatgtttaaagcttgaataagattattaatttacaatgagaaatcattatcacagagacctaaatatttcaagttcattggattttatattatttccatgggcaaatgaattttaaaagccacataataattagaaagttatttagtgaccatgagattaaaaggttttagaggaatcagatgttcaggggcattaggctgagataacctgatctatctatctcacagtaggaatggtcatgcctatagatgggaattcttaaatgctgtttgctgcaacccctgacatttctttctacatttggtaatgttttttctagagcaaccaaaattctcaaaggctgtacttgaatgggcactgccaacatttccctctgaggcttttctttttctcagccttgacatttcttctttagttatgttcattcattcattcattcattcattcaaggcacctttaagtcctgtttgcctgggactcctgtctctttaaaatgattttacttacctacttatgtcctgatccattctgtagatttcatgtatttatttgtttttgagactatagccctctattacttacagaggcaagtaagttactgaagcaaaactttgacctagggcctctgcttgactttgtcatgctgaagtaatcaccataacagatatgccttggcctgtgtctgggcgtagccctatctccattccaaaatagaatcccaaataagaactgggggagagtatctgctttgctttgaaaattctgtttaaaccaaaagtcctaggaccaagttgttatgccataaatggtatagttgtcttagatgtcacttgaggttcagccttttaagcattgcatatctctaaatttctgactgacttaagagcccaggactgaagttaagacagaccgttaggagtctgtttttgttgtttttctttttccatagcccttgcccatgacacacattgaagtcaccagaatacatgtgaggaacttttatttatttttatctttctgaatgtgtctagagtatatgcagtactttagctatagagaatactaaatatttagaatgttgatcagttaataagaaaaatgaaaatgtaacagtttggagacatctaaaatcagactgggtttttaaactaaaaattttaatcacagaaatgttaagagaaatttcttctaagaaggccaaaactactgtagtgtttgctcacaagtagtgttggttacacgagttctaagtgtcattattgtggaaaaaattgaggggcaggaccaacatttactttttgtagaattttttaaaagagaaacttctgtcagtcttttggtaatgagatgaagcagtataatttgccagaagctaaaaatgccattcttacattttcattttttttcctaaaggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaatgaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgaccatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacaggtatgtttacttcttcatatatggtaaagcacaatgaaaaaaatgtacatttcacactaaggtttcaccttcatagaacataagttcatatccttacaagagaatgaaaatgaaccctctgatgtaattttaacttgagcctatcatttatttatcatttaagtacttttttttttaaaccattgttgcctttctttcagttaatctatcttgtatattctgctcaggaaataaaacactaatggattcagattttctttggaaagacaagagtttgtataactttatggagaatctcagcattagaaaagttattaatttcattttgtaatttttgttataatctcaaagattggtttcagcgtttttatttcatagtgatgttttcaagtctctacaactgaaaatgaactcctaagctttttaatagtctctatagttgttaggtggttatgaaattatattttcctgggagaaaaaaaaacctttgatttaagtcctagagttttttcagagtctttattatacctgaaggggaaaaaacagtattaactctaaatatagttaaagaattatatgtatataataatagatcactcctgataatttatatttgccagatactgatattaaaataacaggaaaattctgctatctacaatgtaatggtgctaactaaagttttatgtgtttcttcatttttctaacatatttattgactctcttggcaagtacgaatatagtggccaacaagagagaggtttctggtctcaaagagcatatattttagtgagggaggcagatgataaatgaaacaagtaggatagtgagaaatagtgataaattctctgaagaaataaaacaggataatgtgatagggaatgatggaattatttctgagggctctgttctgttccattggtctatatctctgttttggtaccagtaccatgctgttttggttactgtagccttgtagtatagtttgaagtcaggtagcgtgatgcctccagctttgttctcttggcttaggattgacttggcaatgtgggctcttttttggttccttatgaactttaaagtagttttttccaattctgtgaagaaagtcatttctgtgaagaaagtcattcctgatgggaatggcattgaatctataaattaccttgggcagtatggccattttcacaatattgattcttcctatccatgagcatggaatgttcttccatttgtttgtatcctcttttatttcgttgagcagtcgtttgtagttctccttgaagaggcccttcatatcccttgtaagttggattcctaggtattttattctcattgaagcaattgtgaatgggagttcactcatgatttggctctctgttcgtctgttgttggtgtataagaatgcttgtgatttttgcacattgattttgtatcctgagactttgctgaagttgcttatcagcttaaggagattttgggctgagacgatggggttttctagatatacaatcacgtcatctgcaaacagggacaatttgacttcctcttttcctaattgaataccctttatttctttctcctgcctgatttccctggccagaacttccaacactatgttgaataggagtggtgagagagggcatccctgtcttgtgccagttttcaaagggaatgcttccggtttttgtccattcagtatgatattggctgtgggtttgtcataaatagctcttactattttgagatatgccccatcagtacctaatttattgagagtttttagcatgaagtgctgttgaattttgtccaaggccttttctgcatctattgagataatcatgtggtttttgtctttggttctgtttatatgctggattacacttactgatttgcgtatgttgaaccagccttgcatcccagggatgaagcccacttgatcatggtggatgagctttctgatgtgctgctgcatttggtttgccagtattttattgaggatttttgcatcgatgttcatcaggatattgggaatgttggagagggtagtaacaacattaaatatggtggtcaggaaacatctctaggaggaattgacatttgagctgaaatctgaatgacattgaaattagagcaattgtaaagacacgggtaagtttaaagaacagaatgaaggcttgtgtagttgagtttgagagagcgggagagtggaagaagagtttgaaggaggaagagaccagaccttggagaatcttgcagactttggaagccattggaaagttttctctttttattcctaaatatatcatatttatgatcttatatcaaatgtcgagatattttatatttatgatttatatcaaatgtagagatattttatatatttacttgcctaaatagagtcaagaaattcgaattgcttaacgatttttttgtttgtttgtttttgagaccgagtctcactctgtcacccgggctggagtgcagtggcgtgatctcagctcactacaacctccgcctcccgggttcaatcaattctcctgcctcagcctcctgagtagctgggattacaggcatgcaccaccaccacgcctgggtaatttttgtatttttagtagagacaaggtttcaccatgttggccagtttggtctcaaactcctgaccttaggtgatccaacagcctcggcctcccaaagtgctgggattacaggcgtgagccaccatgcctggccaaattgcttaactgttaatgttctgttaaatgtctggaattgttttcaaaaccaaaatgtatggcagttacttgtgaaaatgtcacacatcttttaaaattttttaggaagcatttttgggagaagacctgaatttgaccctcagatggtcaaattttcttattaggaattctaattttctttttctttttcttttttttttgagacaggctctcactgccgtccaggctagagtctcatggcgcaatcacagcatcctgcagccttgacctcctggactcaggtgatcctctcacctcagcctcctgagtagctagtattacaggcatgcaccacacacccagctaggtttttgtattttttgtagagacagggatttgccatgttgcccaggctggtctcaaacttctgggcttaaatgatcttcttgccttggcctcctgaaatgctgggattacaggcatgagtctttgtcaccagccagaattctattttctgtactaaagagatactaaaaagatacttttgatggcattcagattccctctatttgacattgactacataaagtaaagcctgtaaacttcctgcccgttcatcattaccaagacaaacctttattgatgggaagggaagttcacagaagaaatcgagcagtgacttacacaatagtaacacctaagagcagcctaaatatgcttgaaataatgtggatgccacacagatatctctaatacacttaggtagtttgggcagaaggagaaaaataaaaacatcatagaagtcttttcagtgttgggatgcaaggaagaaggaagagtggcaggaattttttagatactgattaattattgatgctgggagaggtcatagattgaagtgtatgtgtttaaaattgaagatgattattagaatcaaaagagataccggagcttagaaactacaggaggaaccactagaatatcagctccttgagaacagggacccagtctcctgtatctctaatgcctagaataatgtctgacacatgataggcagttaataatttttttaaatgaatgaatgaattcatgaataaaagggggggaataaataaagcccacttaccaagaaccaacagtgaaatagcacaggccttcatgttagagtcaggaagaagatcagaatagcttttgtcacttgcttttctattgtgtaggtcctaaccattgcaaagacaaaaagatatatggtatgaatggagaaaaagatacttaattgtcataattcccatgtataattaaattaaaaattaagcatgagaactgaaattctttttttttttttttttttttttttttttgagacagagtctcactctgtcacccaggctagagtggatctcagctcactacaaactcagcctatcaagtaggtgggattacaggtggcctccgccatgcctggcaaatttttgtatttttagtagagatggggtttcaccatgttggccaggctggtcttgaactcctgacctcaagtgatttatatctttaatgtaaaataaatatgaataaaacaatgtaaataaaattataacactttaatgaaggataggaggcttgaataaatgaaaagtctcatttctgagtgggaaaatttgaatatcgtaaaaacccaggttatctctagattaatctgtaatccttatgtagttccattccaactcacaatgaaaagttactgaagttcaacttagtaattggtttatagtttatctggagaagaaatgcacaagaagagtcaataatatttttgaaaaacgcagaatagtaattggtgtatagtttatctggaagaagaaatgcacaagaacagtcaagaatatttttgaaaaatgcagaatgcatttaacatgatgtgttgaacaatgtttagccttaaatatattgattttataaatattgaaaacaagttaagctgttagttctagaggctagaatatcagagcatgtagacttaagaaaagtaaaaagaaggaaataataaagttaagaacaaaataagcaaagttagaataaccaaaacaggaggaaaagttttcaaggattttgaaagtttattatttgaaaacactagtggctggccgtggtggctcacacctgtaatcccagcactttgggaggccgaggtggacagatcacaaggtcaggagttcaagattgacctgatcaacatggtgaaaccccgtctctaccaaaaataaaaaattagccgggcatgggggcgcgtgcctgtaatcctagctactcaggaggctgaggcaggagaattgattgaacccgggaggcagaggttgcagtgagccgagatcgcgccactgcactccagcctaggcgacagaaaaaaagaaaagaaaagaaaacactaaaagtattagactttcaagaatatgggccagcgggcgtggtggctcatgcctgtaatcccagcactttggtaggccgaggtgggtggatcacgaggccaggagatcgagaccatcctggctaacacagtgaaaccccatctctactaaaaatacaaaaaatcagctaggcatggtggcatgcgcctgtaattccagctactcatgggggctgaggcaggagaatcccttgaacccaggaggtggagaatgcagtgagccaagatcgcatcactgcactccagcctgggtgacaaagtgagactctatctcaaaaaacaaagaatatgggccaggcgcggtggctcacacctgtaatcccagcactttgggaggccgaggcaggcagatcacgaggtcaggagatcaagaccatcctggccaacatggtgaaaccctgtctctactaaaaatatgaaaaattagctgggcatggtagcgtgcacctgtagtctcagctactctggaggctgaggcaggagaatagcttgaaccctggaggtggagtttgcagtgagctgaaatcacaccactgcactccagcctggcaacagagcgagactccatttaaaaaaaaaaaaaaaaagaaaatgatcgggaaaaaaagacataaaccaaatgaggcttgatgcagttgctcacacctataatcccagtgcttcggatggctgagacaggaggagtgcttgagcccaggagttcaagaccaacctgggcaatatagcaagatgcctgtctccacaaaaaattaaaaaatcagccagatgtctgcagtgagctatgattgcaccattgtacttcagcctgggtgacagagtgagaccctgtctctaaaacaaactaacaaaatcaaatgaatgaaaatcaaaacctacgtatagataccaaagagattcataaaagtcataaaagaatactataaataaacatccatcaacaaatttgaaaatagacataaactgatggttttctggaagaatataaactaccagaatcaactcaaatagaaatataaaacctgaataagccaataacaattaaagaatttgaaatcatagagattttccctctctcctctcctccaaccagaaatattagactgagaccatttcacaaatgggtcttaccaactctcaacgaatatataattgcttaataaaataggattaaagggagagaactagggggaagaaaagaaggaaagaagaaaggtaagctagacaaaagaaaaacccagttatctaatgagactggtacaatattgatacgaagacctgataagaacactacaaacaaataaaattatagatgaatcttacttatgagtggctgtagaaatcttaaataaaatattagcaaattattctaagaatggaagaatagttcaacatctgaaaaatccattaatgtaaacttcacattcatagatagcaggaaaaaaaatccatatgataaattttattttttattttgttttgtttttgagatgaggtcttgctctgtcacccaggctggagtgcagtcagacaatcacatttcactatggctgcaacctcccaggctcaagtgatcctcccaattcagcctcccaagtagctgggaccacaacaggcacatagcaccatgcctagctaagattttttaaaacatttttttacagacaggaggatctcgctgtgttgcccaggctggtcttaaatgtaggggattggtcagggtggtgggagataaagataaagttataggaaatagacacaaaccttcttgggaggccgggaggtttgcatagcttcagtgaaagatttggttgaaggcagctgaattctcttaaaagcttagggcttagctacataggaatataagggagtttatctaaagagcttgtttactcatgtggtcctaagaccaacctttgatcattcgcaggactgctctctggggagggtgaccagataattacccacaagtgtgttgactcaaagcctttgtcattaaatctatgctgaataaatgcccgcagggccagctagtcagggcgtgcactactgcaattcttttttgtgagcggcccagccccctagccactctttcactgaatactggtgtctgagtacgttattcatctgttatgcagcctgactctgcaggtcaaaccctggcacttaaactcctgggctcaagcagttattccacattggcttcccaaagtgctgggattacaggagtgagccatcatgcctggccttattttatttttttagagacaagtttttactcttgccaggctggagtacagtggcatgattatagctcactgcaaccttgaactcctggactcaggcaatctcctcatctcagcctcctaagtagctgggactacaggcacatattaccactcctggctaatttattattatttttttagagatggggtctttctgttgcccaggctggtcttgaattcctagactcaagcaatactcctacctgaacctcctgagcagctgggattataagtacaagttactgtgtccagcccatatagtcattttaatacatattggaaaagaatccataaaaaactaataactcataattttttttcaatggagaaaatccagaatagaagggaaatttcttaaccgcagtaattgttttcattaaaacatttagcagataacatttctaatagtgaaatttagaagcattcccattaatatcaagtatagaataaaatgtgatagaagcattcccattaaaatccagtatagaatcaagtataggatacccactttcaacatcactatttcaacattgctttgtagttcctagccaatgcaatttgacaagaataagaaatgagataaagaatatgaaaacttatttatgaataacaaaataaaccctacataagatgctttgaacttttgtcaagaaaattataaaacactgaagcatgtaaagacctcactatatgccaatatgtaccgtattcatagtggaaagatgtaaagaaaaatgtcagttctctccaaattaatctcagtattcagtgtacttccagtcataattacaaggaaatttttcatggatcttgaaaaactgattgtaaaattgatatagacaagtaaatactcaagaataatcaagagaaccctagaaaaatgtattgcatctgacagcaagatttactacaaaatcataatagacagtatggtttgatgctaggatggacaattaggtcagtggagcgtaatggaaagcccagaaacacattgagatccttgtgaaattttaatatataggaaagagaccctacaaatcaacatttatttaataatactgagtgagcctctactgcattctatgcactgttttagtccctggtgacataacagtgaataaaagcaagtagtaggcagggtgcggtggctcatacctgtaatcccagcactttgggaggattgcatgagcccaggagtttcaggccagcctgggcaacagagtgagaccccatctttacctaaaaataaaaagttagctgggcatggtggcatgcaccagtagtcctaactacttgggaagctgaggtgggaggatcgcttgaacccaggaggtcaaggctgcagcgagccatgattgcaccactgtactccagcctgggtgacagagtgagtatttgttaatttgggttgtgagtacataaatgtttattacttcattatttccatgtctgtacgtttaaaatcttttagaacaaaaaatcaaagatgagtcatgctagctataccaaatatcacaatttagtataaaactgaggtaatgaaaacattgtgctactttccttgaaaaagaaaggtagatcaatgcaacagcacgaagatagaaaaaaaattagacttcagttctcatgaatttttaaactcttgtagtcagtatatgcaaaaaaaagaagttaaattatttgatttgtcatttaagaatattataatgtttacatatgtttactttaagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtaaaatggtttctgacttataagtaccatgatccaaataagtattggatagagcccaccattctataattttttccttgtcatagaacccacagaggaaggtgatttgtttaccagttgttgatataatcactagacattcatttaagtgcttgagaaagctaaaatcattttcccataggaagtcacaatccattgcgaaagcatatataaaataaacaatttctccaacagaagaatgaatagaaagaatgggaggagaaaggagaaacatctagtacttcctggcaggatgagtagggtgaggtggtagacagtggtggggttggaattttttttttttttttttttttttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccggggttggaattttaaggcaggctctggagtctttagaattgaggtgtaagggtacacccattttggaaaattgagagttcaaggtgtgtgagaaagtagttggggttatagctggagagattggcaacagtttgattagaaaaagttttattctgaaagaagcatatataagccttatgctgttggtgataagacctactgcaggattttaagtagagtaacacaatatggtttttattttatgatgacaccactgcggtgagttgggggaggtaagagtagtgattagaacaccagttaagcaactaaagctgtcctttccataaacagtaagtattaactaaatgttaatgaggatggaaaagaagtttgcattcaaaagtagaaatttgagagtggcttaaataacagtaccaaacttttaaatttcaggagtgctttgggtttgaatttaataagattttaagcatgtgatatttttaatgatgtcctcttcaaacaggctagtgtttttcaaactagaggctaatgaataggtccattaatgggtggtgaagtcagtttagtgagtaatgatcaacatttttaaaaaaaaaaacaaagtagaacagaagacattggagtacatggcactacagtagaagaataaatattgatttctgagatttttatttcagttttacatagatgtatgtaataggttatgatatatgatgcatttttttgtgttgggttgtagtaaaaagaagtcactgctttgtaccattttgtggatagaaatggaaaatctcacaaagtttctgagacaatgttgagcaatggaaaataactcaaagaaataaagaatttaaaatgattcttattgcaggggagcttccagttgaaacataagttaaatatgatcatagttcttaagtatgtaaattgaatttcttaatccattatctgttctattaggtgatgaaggaaagcctttacatctgctcattggaaaacttcaaaaggcagtgtctgaagaatgttcttattttttacaggtaaaatgtttaaaagtacttttatggccagatgtggtggctgacacttataatcccagcactttgggaggctgaggtggtcagatcacttgagttcgagaccagcctggccaacgtggtgaaaccccgtctctaccaaaaaatacaaaaatcagtccggcattgtggtgtgtgcctatagtcccagctacttgggagactgaggcattggaattgcttgggcatgggaggcagaggttgcagtgagtggagatcatgctactgcactccagcctgggtaacagagtgggactctgtctcaaaaaaataataataaattttaaaaaataaataaaaggtacttttacacaaggagtgctaaattgtaagttgctactaatttaatgatcacccagcctagttttcttcactaccttcagaactgtgcctagaaagtattcctgagtttttaacttaaaatgagcattaaaaattttcctgataatcggtttgaaacaaaagaaattcaggtaaattatctcgcctgtagaacagacactaattgttgatgttgccatagatgagttataaggacaagatggagacatcctgggagacggtgtagagtgagccaaaacactaagatggcacccatctttctgggtcccagtttctttgtctgtaaattgggtgattgtttaaggtttctaaaatcaactctaatgtgagaaaactgcatcttaggggctatgctgaaaatttaataaacttaattattaattgacagtatagtttaagcaaatctcaagaaatctgaagaaatagcaataaacaatttgatttttaagtctagaagttggtggtggtaattttttagttatatgaggaacaaaggtaaaagttatttgagagcttatcaaatgataatgggacatgtattgttttaaatgatgatagaagtgtctgttgctcaggagaagaaccggaacaacgcgtcaaatattttcaatttttgtgtgtgcatataaactacataaaactattctcatgtgttaggaattttttttttttttttttgagacagtcttgctctgtcgcccaggctggagtgcagtggcacaatctcggttcactgtgacctctgcctcctaggttcaagctattcttgtacctcacctcccgagtagctgggatgacagatgcacaccaccacgcccagctaatttttgtatttttagtagagatggggttttgccatgttggccaggctggtcttgaactcctgacctcaggtgatccaccttcctcgacctcccaaagtgctgggattacaggcatgagccaccacgcctggcctcttgtgttatgaatgttaagtatatgaatgttactcttttgcttgatatgatttctttagaatttatagatttctttctgatcagcatttctgaacgtccatccttgtcctgtgatgttttttcaaaggtatttgagattacagagataacatcagaaataggatccaagctaggaagtggttgattaaagtataagataaattttattattataaggaagcagaaaaaattatagttttgtgcaatgaagtttattatcttcctgatataagaagatttcatgccagagagatagatttagacttgtttcttttgcagattgataagggtatggagagaatgttttcttaattatttttgtgtgccattttgaccgccttgcatctaggagaattatgtttaatctttagaagcagaaatcaaaatttaaattccttaaaatacacaattttgttgttaacagactttatgcagtgtccttggtgaatattatactcctgctttaaaatgtgaagtaaatgcagaagacaaagagaattctggtgattacatttctgaaaatgaagatccagaattacaagattatagatatgaagttcaaggtaataaaagcttaccatactattaaacagtatttaatcctcttaaattaattgatgacagatttttacttttgattatgatttaatcacccagccaagttgtttttcatcttaacattttatcctcctttcagattcatgaaatctcatatttaatacacattttaaatttttataatgcgataatggtgatatgaatataattggagctgtccactattgtctgtcctctgtctctctactcctatctttttccttatcctaattcttttaactttttataccatagatccaaatttttaaagttattgtatttattgaataagttcatatcaatggtttttgctttaaaatgagtaagataaacattaagaaataaaaaatatattagtatctttcttaatatagatctgctataagtttgttttaacaaatagtaacatcaccacttttttgatgttctttcacagagaaaatgtttcctagccctgtccatttgtataatgaacaaaatgtatataaattaatgactaccaaaagaaattaacatattttaatatgaaattttcaagttatctttgtagcaggcatttcacatgaatgagatttcaattttcagttactaaatatctgaggtttacttctagcaggcaatttttttaagttataaataggtgaataatatttattgaaagatgcagacttttactgtgaagtgaaattattgtaattgtttgtttaccatccagactttcaagaaaatatgcacactcttctcaacaaagtaacagaagaatacaacaaactcttggtacttcaaacacgactaagcaaggtctgtgagatggaaaatatattgtaatatttgcatttattgtattgtctgcttttttgtaagctgcttttatcaaccaagaatttctaaagtaagagaacatgaaaaaggagattgggaaaagtgacatatatttgtagtagataatttatattggtaagctgaaagaatttctgcaagtcgaataataacccctttagagagtttttagaattatgataagttaaaatatatatatcaacttgtaaactgtgtgaaacaattgcatttaattttacatataatgtaaaattaaagcagtgggccttctgttttagagaaaactggtaatgagtttagttgcttagcatatagctaattagtttcacacagcattatacatgtcaattttattttcaagcaattttttaaaagtctgtagaaaactaggtaagatagtatacatggcacagtgtaatttattaactcttatcagtaaaacaacttaaggcacatattggcaaggataagtgtaattctcatgtagaaggaaatccagaaagatgtctgtgtctatttatttggggtgctttttgatgttcagttaatattaaaatgtttaggcagatttgaaagatttaattgatagtgaaagttataatgttgatgatttatgttttggctgaaattcttcctctccatctctctccccttctttctttccctcctgtttcttcttgcctactctgtttctgtgcaattaagtacaaccttatctagcctttccaaaaatctataaacctactccagtagatttatatgagtagaatctcttttggtttcatctcttattttcttgttcattatggatttatgccttttaaatattctttatcattttaattgagtaatggaaagggaggaggtttatgtcagtaatcacaaatgtaaatgcctacattaacttagctaataaaataaatgaagaaggccaagtgaaacctggagaaaacatgcctcatccaaaaggagcggcggctgcccagcttgtgcatcgtgttgccattaagtaggaatcagggcccagtgttgctagtacttttaatctattaattttatatgatttttttttcttttaaaaatattaggaagtataaaccaggcatggtggtacatgcctgtcgtcccagctacttgagaagctgaggtgggaggatcacttgaacctaggagtttgaggctgcatgagctatgattgtgccactgtactcctgcctgggcaacagagctcaagacctcatttctaaaaatataacacacacacacacacacacacacacacacacacacacacacacacagagaaatattcaaaactaaatgttctgttttaaggttgggaaacagaaagcagccagacaacaacaaaaactgttttgtccccaaaagagcacttttatagactggatttaaagttcaagccttcactttgtaacctcagatataaacacatgctcagtgtactatcttgaactagttttctttttactttattatttctcgactgtagtatttgctgctttctgataacattttcttcccttagcttctgtagcttttcaagcctccattttggactttacctaccctgtttatattaccagggatctttatttgatcctcgtaatctgaatgcttttttcatctactttcattgcttctagatctctatgtttaggtcagtccttctgagctgcagagtcatatatctcatcagatatctctactcaaaaatcttttaggtatatctcaatcagcatattgaaatttgaatttattaactactgctgcttaaaccagcttctcctctcatatcagtttcaaaggaacaacattcaaccagaaacttggggattgtcttagatagtcttctcttttcactcctggtcttctaccatactgaaatatacactgaagggagtacaaagaatatgaaagaaaaatttatactttgttctcattcagttatacagtcaacaatttttatttttattttactttcctttttttttttctccaagacagagtcttactctgttgcccaggctggagtacagtggcgtgatctcggctcactgcaacctctgcctcccaggttcaagcgattctcctgcctcagcctcctgagtagctgggattacaggcacactccaccacacccggctaatttttgtattcttaatagagaagggctttcaccatgttgaccaggctggtctcgaactcttgaccttgtgatccgcccaccttggcctccctaagtgctgggattacaggcatgagccaccacacccgacctacttatttatttatttatttatttattccttagatctgaggacagactggtcagccaatatttattatttgctaattaaatgccaggttgttctgtgtactgagaataaagtaatgaagtcactagactgaagaaatgtgtaaattaatgggatttatgaactagtttaaggaatgtcatatacatatatactattttacatatatatatataatatatacatatgcatatataaaatagttttccttggcaacattttagtaggtgtttagaagagaaatgtaaggccgggcatggtggctcatacctgcaatcccagcactttagttggccaaggtgggccgatcacctgaggtcaggatttggagaccagcctggccaacatggtgaaaccccatctctactaaaaaaaaatacaaaaaaattagctgggtgtggtgacacgggcctataatcccagctactctggaggctgatgcaagagaattgcttgaacccagaaggtggaggttgcagtgagccaagattgcaccactgcactccagcctgggcaacagagtgagactccatctcaaaaaaaaaaatagaaaagaaatgtagataaatacgtttacttaacaggtagatgaatacagcaaacaggtagatgtcttttctgcacaaggggtaataagaggatatatatttgaatgcagtaaattagctgcaattacagaggcatttcagagttactttgggatcaggatcaggactgcaatacatcactgtgtaaccttttggcttcatcttctaatattcctcctcatttcagccatactgaaatacttagtttcccaaatgcaccctgatctttggcaccctgggcttctttgcatgctgccctttctgcataatactgcccatcccctcccagcctttttggtttgttcctgcttgttccagttggttcaaatgtttactccctctgtgtcatcttctttacctgtctttctaggcttaggcatttcttcctctgttcccttagcaacagtacaggccttgcttatcgcgtttctcttttttcgttactttaaatacttgattacccttctgtccttcttccatgttcctgtagctccttatacacatttgcatttgtatcacattacttttcatgttatataattgtttaccattctgcctctttcactattattctaaacccttcagaataagagaatcttctgtttatttttatttccttctcttaacacagtgttagcatacagtaaaggcttaataaatgtttgctgaatgagttagaaaggttggactggaaacttaataatttacctgatgatctttattttccctgggaactaagaggcaagatcctctgttgaaattactcatggggtaggaattgggtagaggatgtataagagtagtgaacagttaaaacagccttcttagcaaatagctgttttttcttttgctcagctgcttctacagtatcctttgttcatctggtcttgcaagtccatagtctttccccttgcttttaaagtcttctgttatttggatctatcttatttaactagctttatttccccctccgtatccaaattaaaccctcctcaagaagatcattgtcaattatggcatacgtcattctttcacaaatactcttactctttcttccttatagccttcccaaatcattaccagaaatatatgagcctaaatcaaaactgacttccataattactcagatccacatcagtcttctgtatcattgttgttatagtcaaattttatagtttagccgttctctaattgtttattttcccatctgattgatgaattctgtgcaggcagatatattgttattttttaaacggattttatatttttactcttgtcacagtgctggtcacattgattattaagtatttgatgaataaataaattagtacacacaggtatctgacatattgctgcttagttttatgtatttatttatttacttatttttttgaggcagagtcttgctctgtctcccaggctagagtgcaatggctcaatcttggctcactgcaacttccccttcccaggttcaagaaattcacccgcctcagcccctcaagtaactgggattacaggtgtgtgccaccacacctggctaatttttgtatttttagtagagatggggtttcactatgttggccaggctgatcctgaactcctgaccttaggtgatccagccatctcagcctcccacagtgctaggattacaggcttgctgctttttaatagttaaggaaataagctgagatttatctattttcattattttcttttctttttgtttactgtacagagcaccataccatttgtcagttacctggttgtacataggatatatctagagataaacaagctgtattaatcaagtattgctaatataaaatttattatgtatgaattgaaatttcaaagaccaaggtatactataaatattgttatcagctttctaccaaaattctcagaagcacttgtttttgtagtaaaatgaacttcctttcagatatcaaagaacattactaatataatttcagtgctatgaaaggtatggaatattaattactgttacagaagagaacagggaataacttagaagggaaaatgcttgtattagagtgccacaattttgggtggttttaaaaaagcatcttaaatgcagagttgctttaatacagctttctaattgctggattatgtatttatgttactgcttttattctgtggttttcaatagatctggggacagcagacagatggtatgaaacttgaatttggagaagaaaaccttccaaaagaggaaacagagtttttatcaatccattctcagatgaccaatttggaagacattggtaaattttgatcatataccacaatgtggtgtttttatagcaaatattgagtaatttgcttttttactttaaaatgtgagctaacgtagtgacctttggcatttcactgtagcctctctgatctcaattttttcatccttaaaatgaaagatttggactactttctatttggtcctttcccccttcttatgttctgtgattctgaattgttttaaattttaaagatataaaattttggatttaggagtactacagcatgaggatcaaaaagatgatcttgaattgtactatttatgttttcttgttttcatcagaatgagtttaaattgaaaccagagttattaccactaaaaacatactttttcaaaaaagaattaatattttctgtacacagtgattgtgctatttcactaagaaacttatattgaaatgtgcattttttgtctctttatataacatagatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaaggtattcatctgcttatagcttcattcaacagtatttgtagctttgtaacaattatagtatcatccagaatggttatttaaaaaagtaacttaagcaaagttgctggaaagagataggatgtagcattttttagaaagaagagcaagagatcattctatatctttgaaatgcctgaaaaaaatgttgatgtaaaccaaagacattataggaattttacttaaatttttacattataaagatgttggttgttgttaatctgcttaattaaatcggcagtgtgcacatatttgcagtttattctgtacctagtctttgctactttgatatggtgaatacttaaggaatataaggtaggatcattccagtcatggcagggtttcctccactttgttgtctcatgttcaaattcaccacgtccaaagtagaactctggctcttctcaaaatttgctccttctgcagctatatccatctgtcgttactcctctttctcttatacctctcttctagtctatcaagacgtcctattttctccaccttcaaaaatatatccaaactgtaccactccttaaaaccttgctggtctctgccatccttttgtctcaactggattaccctaactcccccctaaagtctgttctcaacacagttaaagcaggtgccagaatcttgcttttaaaatttaaaatagattgtatcattccaaagctcttctgtcctacatgatgagtacccattacttttctgatttttaatctcctactgacttgtctgtcactgtcttctgaccccaagatactggtgacagcatcttggggtccttaaacaagcattatcagtatgcttctgctttagggacttctcattggctgttccttctacctagaatggtcttcctccagatacatgcctggccaacaccctcaccttctttggatcattactcaagtgtcatgttctcgtgaggcttttcttaaccattctgtgtaaattaaaattgtctcctagaatgctgattcctatttctctactttattttttctatattacttaatattgtctatttatatgtatgtatacattatgcacattttatataatatatatcatatatataactaggctggtcgtggtggctcatgcctgtaattccagcattttgggaagctgaggcaggcagattacctgaggttaggagttcgagaccagcctggccaatatggcaaacctccatctctactaaaaatataaaaattagccgggcatggtggcatgcacctgtaatcccagctactcaggaggctgaggcacgagaatcacttgaacataggaagcggaggttgcagtgagctgaatttgcaccactgcactccagcctggatgacagagcaagactctgcctaaaaaatatatatatattatgtgtgtgtgtatatatatatatattatatatataaccaaatatgtgtaaatttggagggggtagattcatttttattttgtttattgttcgtctctggtgaaagactttaagctttataagggtggggctctttttccatttaggtcagtgatatatcacaaacacctaagataattccctgcacataataggtactcaataaattatttgtttaatgaatgaacagtttataatttagttgggaagtatgctatagtatataactagctctataaaaccctcagagatttcttctaactgtggctggctctgctattgtagcgcggatgtcttcctagacacttgctagtaaaacctcaacacagtttttttgtatagtggacgaaatactgaatgtctgcttgtttggaactagtcgttactcttttttatttgaaacctacatatgggctttggaattatttgctttagccttataaagcttccattttctttgagattggtggtttctaaacatgaccatacatcagaaatagtggaggtttttgaactttaatataatttttttaattacttacaatgaaagatcactgaattataatttggagagtcatactcaatagctttgagatggaacttggaaatttgtgtttttaacaatataattcagaggcacggaacccatagattgacatttggaaaccactgctttctgatatgaaacaaaataggtaattaggaagaactttctaataaacagtatttcaagcagtcttcctttaattagtgatgctttctgtccaaagcatgaagaaaagagaggcttctggaaacataggcttacattgttattcctgcatttgggcttctgcaagctcaccaccctctctcagagtttctataatactccatggaaatgtgttgacaaggcctttgaatgaaaatcattcgtttgctccctgcacccctaccaaaaagagttttactcaccaccgtcctcattcttactaatagtaatgagtcaaaattattttgtgtaaatagcatcacatattttggacatgactgtaacacattttgaatagagtatactgttccctgtgggtagacttgaaatagttaagaaaaataattgaatcattcttttaacaaatatttggtgatttcatactagaaacctctaagagaaacactaaggttggaaagatcatgggttttagtcagacggatctgcatttgaccctgatttgaccttttactggctatatgatcttggacagattatttaaacatttctaaatagtaatagggataataataattacccttaagattgtgaggattaaatgaaacagtaactgagaagagccttagctagataccctggaggtagaattagatgtttatgtaaagtggctgtttccttccagggacttcagtgtaatcactgaaataataattacttgcaaaataatttttcgaaggtaatggttggggaatataacatagtgatataactaaaatgctggaatttaaacccatgtctttgtggcgtttttcactgcacatctgtaatactgcctattagagtaataacagcaaaatggaaatgaaggatgaatatttagacattgcaatggaaggaatgttggaaacaaagcagaggggaaaaaacaaagataactctgtgttgcttgagcctagggaatatggaaaatgaaggtacatcatataaataggaaaatcaacaggggttgcagatagtaggagcttaattgcaagaggggaacaatgaattaagtttacgccagactgtttttttcagtttggagtaataaacactttcaaatactgtaaagcttaaagaatgaagtcgctctccctctccctctccctctccctctcttctctcttctctctctttccacggtctccctctgttgccgaggctggactgtactgccgtgatctcggctcgctgcaacctccctgcctcgggctcccgtgattctcctgcctcggcctgcctagtgcctgggattgcagtcacgcgccgccacgcctgactggtttttgtgtttttggtggagatggggtttcgccatgttggctgggctggtctccagctcctgacctcgagtgatctgcccgcctcggcctcccgaggtgctgggattgcagacggagtctcgctcactcagtgctcaatgttgcccaggctggagtgcgtggcgtgatctcagctcgctacaacctccacctcccagccgcctgccttggcctcccaaagtgctgagattacagcctctgcccggccaccaccccgtctaggaagtgaggagcatctctgcctggccgcccatcatctgggatgtgaggagcccctctgcccggccgccccgtctgggaagtgaggagtgcctctgcccggccgccacgccgtctaggaagtgaggagcatctctgcctggccgcccatcgtctgggatgtggggagcgcctctgcccggccgccctgtctgggatgtggggagcgcctctgcccggccgcccattgtctgggatgtggggagcgcctctgcccggctgccctgtctgggatgtgaggagcgtctctgcccggccgccccgtctgggaggtgaggagcttctctgcccggctgccaccccatctaggaagtgaggagcatctctgcctggccgccccatctaggaagtgaggagcgcctctgcccagctgccccgtctgggaagtgaggagtgcctctgcccggctgccgcgtctgggaggtgagcgcctctgcccggctgcccatcgtctgggaagtgaggagcacttctgcccagccgccccgtctgggatgtgaggagcacctctgcccggccgccaccccgtctaggaagtgaggagcgcctctgcccggccgcctcgtctgggatgtgaggagcgcctctgcccggccgccctgtctggaaagtgaggagcgcctctgcccggccgccctgtctgggaagtgaggagagcctctgcccggccgcccatcgtctgggaggtgaggagcccctctgcccagccgcccttcgtctgggaggtgaggaacgcctctgcccggctgcaccgtctgggaggtgaggagcacctctgcccggctgccccgtctgggaagtgaggagcgcctctgcctggccgccccgtctgggatgtgaggagcgcctctgcctggccgccccgtctgggatgtgaggagcgcctctgcctggccgccccgtctgggatgtgaggagcgcctctgcctggccgctgtgcaatcttccaagtgtgaagtgacagcctttctgcaggtgtacccaacagctccgaagagacagcaaccattgagaacaggccataatgacgatggcggttttgttgaaaagaaaagggggaaatatggggaaaagaaagagagatcagattgttactgtgtctgtgtagaaagaagtagacataggagactccattttgttctgtactaagaaaaattcttctgccttgggatgctgttaatctataaccttacccccaaccccgtgctctctgaaacatgtgctgtgtcaactcagggttaaatggattaagggtggtgcaagatgtgctttgttaaacagatgcttgaagacagcatgctcgttaagagtcatcaccactccctaatctcaagtacccagggacacaaacactgcggaaggccgcagggtcctctgcctaggaaaaccagagacctttgttcacgtgtttatctgctgaccttctctccactattatcctatgaccctgccacatccccctctctgagaaacacccaagaatgatcaataaatactaaaaaaaaaaaaaaaaaaaaaaaaaaaagaatgaagtcattgtggactaagtagtactttttggagtttagatcataatgaccggatagataatcaggaggattttctaggctgtgaaagtaagatccaggacataaagccaaggatcagagcagtatatacaagggacaatgaggaaaacagagacaaaatagtaataaagaaaaagcaggaaagggcagagaagaaagacaagggaatgagtttttagaagcatgggatggtcatagaacatgagaaggcagttcacagcaggaaaaacctaaacggccaataacatttgaaagaaaatgtcttctcaaaaataaagacatacatgttctagcaaagttttacaattgttataacccccgattgctgaagttttaagaaaatacttaaatgatactattatgagaataaaattaataaaactttttggaatatgaccctgtattaaaacattaaatattaagcttaacaattacttataagattttattatgtagaaacatccatggaagtgtgccaagatatgtttgtggagatctgtattatagcattgtttgtaacagtgaacagttggaagtaatcaaatggccatcattaggggtttagttatataagttatgaaatgggatgatgacaactttggccaattttggacagaatttagggtagaaaagaataggagaaagaaggttatgtggacaagaggaaggtcaaactaagaaagcagcatagttacacatgaaaatgggtatggaaaattatatttgccagaaatgaaaattataatttgctccttttttttttcccatggatcctaaatgctgatcttaccttagtttttatgacctaagttaagcgttttaagaaaaaaaaaatttttaatcatgtaaaaactacacaatacagatgtgaataccaaaagataaaacaaaaaagtccgaaagtgaatatttgtaaattaagattcttctctttaccaccactgctcctgactgagttccactagaggtaaacattgttactttcgatgtgtatacataggaagataatcaaactttttgtatccaaatatacatatgtatgttaaaagaagtttctcataaaagtgagattttacaaacttttttaaagtcattaatatatcttagataactttaaaaaaaatgttagtactggccaagcacagtggctcatgcctgtaatcccagcacatttggaggctgaggcgggaggatcacttgaggccaggagtttgagatcaacctatgtaacgtagtgagaccccatctttccaaaaaaacagtcggtacttatggttccatatcatacatttgtagtgtaaaatgacataaaattcagttgatcacctggtaaaatactgttattcaattgtgttcttttaagtggaaatattagtcaaaaatatgatttaacttgcaatacctataaccctagactcatttttgtctcccatgccccagtacacattttatgtgtggtgtagattttgcatgaacactaaagcacatatacaactctaattctttaaccttttttatttatattcagcttacctgttgattcggtggtaattacagaatctgatgcacagagaacaatgtaccctggaagttgtgtgaaaaagaatattgatggtacaatagaggtattatatttttaatttttatcttttaactgttatatacactgatttttctatcatttttatgtctggtttactatctaataaatagttgctgagaagtaagcataataaatatgaggataatgccttatatagaaaactcagaatacacatgtaaagaaatttaatctatttttatagcataggtaacacacagaggaagttaagtttgggggttatatttcccttaaatatgttatagtttaagatttatcttgttttttgtaacatgtgggctatgtacaaattagtttcagtgccctggtcaacaaagctttgtcttcccagcatgggaagttggacaaggccatctctagaaaagtgtttaggggccaggtgtgatggctcatgcctgtaatcccagcacttcagaaggccgaggtgtgtggatcacgaggtcaggagatcaagaccagcctggctaacatggtgaaaccccatctctactaaaaatacaaaaaattagctgagcgtggtggcactcgcctgtagtcccagctgctcaggaggctgaggcaggagagtcgcttgaacctgggaggcagaggttgcagtgagctgcgattgcaccactgcactccagcctgggcgacagaacaagactgtcgccaaaaaaaaaaaaaaaaagggtttaggaatccccagaatccaagacaatagggctgggataatagaattaggcctattccaataaggtccgtatggtatataaaaaagttccacatcttttaaagtgcatgccatctaactaaaccaccccctgcctctgctcaacattgtattattctaaatttctcacacctgcaactttctcaaactggcaactgccaaaccctggtcttcactcagtagatttttagctcttaagtcttagaaaaaagtaagatcatcgttcttcctcgctcagtatacagaggaaagatgttagacacatccttgattctgctatactcatcccatgtcatgatgattggtaaataaagaaatactttcatactgagaacatatttatgttttttaaaagtttatggttttttctattgataaaagtaatttgtatttgtagaaagttagatagtattaataaataccaagaagaaaacaaaatttgcttgtaagtttatgagcaaagatagccactgtttaacattttacttaaaaggaaatctgtacacacatatatattttattagttatatttaagtatccttttcccactctagaactgtatgttggcatttataaatatgtaaacatatttctctttgcatctttaagttcacggtagtgagtataattatttggtagaattatttactagaattatttttaattgagagaattaaaatttattttttgctgaaagtatgtagaacttttctaaaaatactgatactttggggagattttgaggtagaagtttaaaaataagtggtgtataattaatgtaaataaatgtcatattttgcttttaaatgtagttttctggtgaatttggagtgaaagaggaaacaaatatcgttaagttgcttgaaaaacaataccaagaacaattagaagaagaagtagctaaggtaggcttatagcttatctggaagattatcttggtttatattccctttgagccttcaaaaagaacatagattttatcgatggtatgtactttataagtttcatatatagttcatctttaagtgattggataatatcaattatagttgcctttaaacaaaatatcttgtgaatttttatttgagaagagcattgttcttgatgtagactagtaattagaagcttttcagaatgccaaaacaagtctatgtatttgttgccttgtgaagaagtttggtcttccttaaaagttgggaagaagataggaaaagaaagagaaagtggttggtcctctgtatatattatctgtatctatttccaatcagagaagttttgttaggtaatgactacagatactaagggaggattatcactgagtattaattagctcctggctaagtgaaggagtttatcaatgtgagttttgctcatctctgtatgcttatccactgtgtccagagtcattctttaatattagccatataccctagtgtaacattatggttccatttgttttgtctttgtattccttttcaaaacgtgtatacctgattggcttttaatattggaactggccgggtgcagtggctcacgcctgtaatcccaccgctttgggaggccgaggcgggcaggtcacctgaggtcaggagtttgagaccagcttgaccaacgtggagaaaccctggctctactaaaaatacaaaattagccgggcgtggtgacgcatgtctgtaatcccagctgttcaggaggctgaggcaggagaattgcttgaacccgggaggcagaggttgtggtgagctgagatcgcaccattgtactccagcttggccaacaaaagcgaaactccgtctcaaaaaaaaaaaaaaaaagatatatgtatatatgaactattgaattatgagtttgctttttttgtataatatttcagctgtcttaatataacaatcccaatggaatatgtgcattttaaagggttaggattgattggtaggatataaaggaaatatataaggaattaggaaaaacataaattcgatgaggaagtcaagacctaaggaaatatctgggccataaggacttattcacttatgcctaaagtgaaaagtgaaacactatcattttttttttatagctttcaatgtctagttcttggaggaatgcaaattttctcttgcatgtagctcttacacaaatttatcaaatggaatggtgtatcagggtatagtaattaacatgaggtttggtattggatataccatcctttaaattcttgttcttttggtttactagatttgtgaccttaggaaagttacttaacttgtgaatctcagcgttttatatgttgaaagaggaaattggcttagtagcaatttttataaggattcaatgagctaatgcatatagaacacttagcaaatgagttgatacatagtaaagactcataaatactattttaaaagtagtcattactgtgataatggtggtaacatgatgatgttttataaagcattactcactcaagctgatagcagagcaccaaagtactggtcagtgatgtaacagacctgcacgttgtgcacatgtaccctaaaacttaaagtatttaaaaaaaaaagactcttctaaatgcagccaagatactgtggtccaagagattatgtttgatggcccagcttggtcctagaataatatagattgttgatattagtcaccagtaccgatgggattatgctgtactctgtacccctcagatatgatagaagaagactgagagccatttttcttttcttttcttttctttttttttttttttttttttgagacagggtctggctctgtcgcccaggctggagtacagtggcgcaatctctgctcaccgcaacctccaactcctgggctcaagccatcctcccacctgagcctcccaagtagctggtactacaggtgtgcaccaccaccccagctaatttttttgtagagacagggttttgccatgttggccaggctggtcttgaactcctgatctcaagcaatctactcaccttggcctaccaaagtgctggaatagcaggcgtgagccaccatgcctggctgagaatcatttttctaaaagcacaaggctatatagaagaagcccaatagtagtgatttccagtatatatcatattagagtcctcctgtgatttgagcacatactactgaaagtagacattcatttacatttcactgttaagcaatgttctgggtgctgaagtataacagagaataaaagaggatgaaatctttgtttccatagaccttacattccagttggtacagatagacaacatacagatgatgataagtactatgaagaaaaaaagcaggactaggaaaatccatggggagtgagatggtgttattttatatagggttgtcatggaaggcctgacttatgaagtgacattagaggaaaatcctaaaggaagtgagggagtgaatcaggaagatatcaggttgaggaccttttaaagaaatatgaaagggaaagtcaagagagcaagagaaaaagaaaggtcaaaaattactctaacaggtgtctttaagacacggtcaggagacttgactagagtttgtggaggctgcttgcccagctgctacctctggtgagttggaggacaattcagtttaatcctgcaactcccatattcatggtgaaatattgtgaaatcctggcacagatttgtcttttctgcagatgtaactggatacaggaggaagaaatcagggaaagacagcaagggctcacacttccggtgaatttatataggtagagttgtattgtagtgtatatatctatatatatatatatatatttttttttttttttttttttgagatggagtttcactcttgtcgccaggctggagtgcagtggcacaatctcagctcactgcaacctctgcctctggattcaagtgattctcctgcctcagcctctcaagtagctgggattgcaggcacgcaccaccacacccagctaatttttgtgggtttttttttttagtagagatggggtttcatcatgttggctgtaactcctgacctcaagtgatccacccacctcggcctcccaaagtactgggattacaggtgttagccaccatgccctgcctgtagtattcttttatcatttaatgtctgtggcatctgtagtgttatccctatttctcacctttttgtcagattggctagaggtttattgattgtattgataatattaaggattcagctttttgtttcattgttgtttttattgtttttgtttttattttcaattgctacccatatctttttgatatcctttttctgcgtgctttggacttaatttgctcttcttctgcttttctaaaaggaatttcttttctaatgtatgcatttaatgctatactcgaaagcatagcgttacagctttaaacattatagcttgtaagtatagcaatgcttcctcgtaagcaatgtttaaagctgcattctgcaaattttcattcaatccaaatatattatttcccccgtgacttcctctttgattcatgggttatttagaaatgtactgatttccacatttttatgattttcagatagcttcccatggttaacttaattaatttttaagtttctttgtggtctggcaaaatacctcatataatttcagttcttttaaatttgatgcccaaaatatggtcttttctgggtgaaagctccatgtgtacttgaaaagagtatgtgttttgctgttatttaaatttcagatttccctctggtgccatttttctttagcctaaaaaccttcctttagcatttcttttagaacaggtatgctgacaatgagttcaacatacaacgaattttatgttgtctaattttgaattgtatattaaatgttttgtgttttgtatgctctggatgtcattataattctttgaagaatgtgaattttttaaaaaaataggcagtccacccagttaggttcagactaaaaatcctgtttcttctttcccatacaaatcacctaagttttgacttccctctgcagtctcctagccattgtttactcttcagaattctttagttgttttgtattgtgctcagagtttttaggtaatcagtgggagaagcaggctgtagtgggcttattttatgttgcctggaagcacagtctttgtgttttcttattccacaattcagatgcaattattgccttatagcatcagtatttcaatttacccacattttttttttaaaaaggatgtttacgctctaatcctttttgcatcttaggccatccttttagaatcttatttctttttgaagaaaattctttagaagtttttttttttttaactgattatctattgggagtaaactatgttttttagttgtctttattttatgtctttattgtgtttttatccataaaagtttgttttgtttactgtttgaacctggttagcagttatttttatgccagaactttgaaggtaacattccagtgttttctgatttcttgtttctgtcgacaaggtccttgtcactttgttgttccctcgtaggtaatacgtcttttttctttagcaacatttaagatcttctttttgattttggtgttctcttttctcctttttttttaattttttttattttaagagatgggtctgtcagccaggctggagtgcagtggtgtgatcatagctcactgtagccttgcactcctgagctcacacaatcctctcacctcagtccctggagtagctcaccacacccagctacaaatgtttttgtagagatgaggtatttgtttttattataattcattgatcatcttgaatcttggcagtggtatcttctgtaaatattctcagccattatctcgtgaaatagttcctttccattgttctctattatatcctcctggaactctaattagatgttggttgaccattctctatccttcatatctctgttcttctctttcatatttttaatccttttgttccatgttacattcttaatatattcagtatgaagagacagaggcagatcaggttcaagacaggaaattaaagcaaaactcagtcataaggttttgatcactagttacagaaggttaaaaatatgttttgttaagttgtattctatggttaattatttttaattatctttgtcttttgacattttgccgtaatgggtatatgttccagatgacatcgttgttaccaaaccctggttctttctgagctagcataggcacccagaggtccaatttggtaggtgagatatggtaccaggattatctgggaagaaacagaatggcatataatgtttaaggtgcttgagctctgtatagacacattttgattcaaatttctgccgtaatatttattaaatatgtgacctttgatgtggttcctaatgttgcagcacttgaattttctctgcattggctactggtattataattattcctcaagtcagttttagcattatacttctagacagattcatttagttgtggaatagtataatgttaccttttagaaagtgagcttaggcaagattataggattttgaaccccagcttcaatgatttatttgctttgtgtttttgagtcaaattactccaaaggaggctagcacaggaaccaggtgggaatcaggaccccagataggtgaatcacattcaggacaggaaattaaaactaaagttcagttatatgacctggaccagcaaggaaaataatgctgcagatcagtaaatacaaatatttctaatcccaggcatactttattctgggtttattacagccagccttctttcattataaattatctatggaaaaaggacttaaagttattgatacggttggttctcaaaggtgtagggacttgtcagagccaaaactgctagtcagaattcctaagtacctgtgctggggtgggatgggaggctagaataagcagggattcaggatcatagttgtagtgaaaggtcaaattggattataatgaaatgtctactcatatttaccagtcatacaaactaagtgttccgcttctgggaatttgttttgaggaaataagaaaagatatgcacaattatataattacaaatatttcatcacactggtgtttaaaatagtaaaagactggaatcactctaaatgtccaatatagagaattgatttaataaacttatactacatctatgtaatatgaaactttgaacccattggaaattacatagaaatgtatttctatttcttaacttgaagaggtatttactatagttaagctacaaaaactggttacagtattagaatatgatcacgtttttataggaaaattatatctgtatctattcatatctatctctgcaaagaagaataagaagatttgggaaagtattcactaaaatgtttacattgatttttcttggaagagagaaatataagggcttttattttctaatttttactgaacatttatgtctgttataataagaaaacattttactttttatttaaagtggcaggcagtaaaataaatactttgacattagatttattgtaaaaagagaatccatctcggtattactttattataggatttctttttgtttagaaccgtgaggccatgcttttttctgtttatacaattttgagtactaatttactttttaaattcctgctgatatttctaaatctaatcctttattgtttgcttttatttctttaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctgtaagtatgcctccttgaatataaaaaacttatttaaaaattgtgaattctttcactttaaaaatattagcaatagtgctgcttaatgtttggaggaggaaaatatcaaattcagtcttatgactcacgttgttttgttttgttttgtttttgaggctgagtctcactctgtcgccagggtggagtgcagtggcatgatctcggctcactgcaacctccatctcccaggttcaggcgattctcctgcctcagcctcctgagtaactgggactccatgcgcgtgccaccacatccagctaatttttgtatttttagtagagacaggattttaccatgttggacaggatggtctcgatctcttgaccttgtgatctaccctcctcagcctcccaaagtgctgggattacaggcatgagccaccgtgcccagccagttcacactgttaatgtgttttattaattgtaagatatatggataagtgacttaatattagtatcaaataaaacaagtctggttcatagtattcttgtttatcttaaagatgttgtacctggtaaaatcccattgtaagttgtacgtacattaattctgtttcaaccaattcaagattaattatactacaatttggtaatatctgtgaataaaagatttgcttaattaaatataacaacattagaaggaaatagctacctatttaggaagactaaaagattttactatctatatcctaattcttgatttatgtacttatttattaatagaagatccattctgtgtctgtacctcaactgttcactgcctttaacagaaagtaataaatcctacttcttttaacattatctgaattaaaattttttattaatattcaggataggttatgttttgttcagactaatattcaagtaaaattgccaactccaggccgagtgtggtggctcatgcctgtaatcccagcactttgggaggccgaggcaggtggatcacttgaggtcaggagttcgagaccagcttagccaacatggtaaaaccccctctctactaaaaatacaaaaattagctgggcatggcagtacatgcctgtaatcccagctacttgggaggctgaggcagaggaatcacttgaactggggagatgaaggttgcagtgagccaaggtggtgccactgcactccagcctgggtgacaccaagactccctctcaaaaataaataaaataaaattgccaactctttatggaatgcaaaacttgttaggtgttcttcaagacctctttaatttaccagcaactgttcaaagcaaaattatttgtataagtaacattcctccaggaaatgatgtactcgtagaacatattaaggagttgacttcttatgagtgtgagactctggaatgtaaagcttttatcttcaaataaaatgtattgaaaattattttttatcagtagttctctgtagtactgtgataaccactgtgtaaattaaatgggtagtttctcatgtttcatacatttaattttaaaatataaatattccatggatattattttcccttcataaaatgtcaagaggaataatggcattatagcttcgttaagagtagaaggaatcttaagtatcttagttcttttttttctattagaattagattaagtctaaactaattgataaatagctgttttgcttttggaaaataatgataaagtagctttatgttgttttagagttgtaattaagaaaaacaccattttaaaaattatgtttttgtttaataataaaatatcacatgctttatgggataaggaatagaattgctttcgtatttgtttacaatattaatgctgacagatttttacaaaatgtgttatggttgaattgtttttttttttttttttactattaaagattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccaggtaagggtcttgtagtcccctttctctccccagttatttttttttccaaacaccaacttgaaccagatccccaattaaaacaacagtattttttatgtagccataatttttttttttttttgccgaaatctgaataaactacatatatttagcatcaggaacacactctatactaagacagcagctttagatcttgttagggacacctatctcaaccttggagtgggcattgtctttctgtcattttatttaactcctttttcaagcactggaaaagtggctacacggttttgtttttttcttttaaatcattccattagccatatatagcaaactcactttgacattttggaaataacattgtgctgaggtgctccattatgcagttactatcattcagttttactatcttcatttatagttttgtgagtccaccaattagcatctcgaaggtttacctttatctgtctttaatccatctttttaatcatgaatggaaatcggaagtagtatgcttctgaaactctttccagggaaacatctcttcttgatttgagaaatgcaaatttatttaacattcttatccctttcttgactaaatttaaatacttcttggtatttgggagctggattcttgtcaactgctgtataaaatatactcacaaaaccattgcagaaaagcaagaaatatttatgtagaagttcttatgaaaacttattgaatttaattttgaaaactgaagctaagagagataataaatatctagagataactattaacagtattctttcaaacataaaataataagataattgggagctgagcataaaacattatttggaaaaattaactttgcttttcttcattgcattttgtgaattcaaacttcttaattttcaatgcaaaattgacaaaaattaattgaactgcacaaattcctgaatatatagacttaattggcttttaaaaaatattttaaattttgcattgatctttgtatatacttttaaccccttacgatggaatatgaatcataagtagaaccagggcctgttggtcccgggggttaaaagaaatctgcttaatatttctaccctttttctctatcacaaacagtattctttcatgaccttttttcttatttagagatcctccatagataatgaaaacctggtttcagagagagagagggtgcttttagaggagctggaagcactaaagcagctgtctttagctggaagagagaagctgtgttgtgagctgcgcaacagcagtacgcaaacacaggtagtatggactttgccccacctaggagcaatggatcaccaattcagtaggatttgtttgtctttgttgttggtatgagatgtattcttttataggtactgagcttaacatatttgtgactgcatgtgtgtaaggtaggtggagtcaaaatgccttacatttcatttaaggtaatttgaatctgacattctgttaacagcaagtattgtttcaccaaagagaacctaacaaactttattgttgcactacagcatggataatttgaacccattaaaattttttatttgtgtacgagaatgttttatcctcttttgataacactaatctcgagtgtagttaaatattataccaaccagtatcaattttgtgcacagaggtttctattttatctcataccaatatagaagaatgacatgctgtttccaagttgacaggttttctttctgtcttctcctctcttcctttacacaaacttaaacagaatggaaatgaaaaccaaggagaagttgaagaacaaacatttaaagaaaaggaattagacagaaaacctgaagatgtgcctcctgagattttgtctaatgaaaggtatacaaaatgtgtactttttcagtgcaaagtaaattaaaatggttgtttcaatgtaatagactttgtccttatttttatcttgtacattgatactttgtcttaaaaatcatcataccatctgtgtatgaaacatgtccatgtatgtgtagtatgtaaaggattttcagtttttcatcattaaatagataacattttaaaaaaatcttttctatataaattttgattggatattaatcacatacttaactgttaatcacctgatgttagcaaaacttttccttactttgattttgtagaggttaatataaaaatgtgaaatattaagtgagaatagttatcctacattagtattaaagactttaagcacaatattttaaactttgttttgttcaaatgaaaataatttctttaattttaaattaaaactaatatttacttcttaatttcctccttttccaatttctgtgactgtcaaccctcttgtgtcctcctaacctccttcctcagcttgcatggaggaatttggcccctaagattttggcttccccattggatcatcagtatggaacgcagtcagtatggaactcaaacaagaaagacagtgtatgaaaattagagttaccacggcaatataaaataaacactttgtttattttatattatttatctctaattggtaaattttgaaaactatgcagtatttaatttctaggaatttttatagtaagtgccaataaaatgagtatttttttttaaccaccatattaattttaatcatttctcttaagtagaaatattttcacattattctagttctggggtttggggcttaaacaaaacctcagaacaagttaaggaaataaaacccttggcttcctactaaattagtttagttttatttttagtattcttgattatataagcagagaacttgatctaggtgcaaaaatagaaccgtctctttcacttgacaaatactaacggaaaacttctccatttattatcttgtcttaaaatagatatgtcatgtgcctgtgaaacaggtatcctttagcctgatttttggcaagctcctacagtgtgaagctaaaagataaaactgtcttaaggcagaagacctttaccatgaaaatcttttattttgtctgcatgtataaagtgtgcctttgttgaactgagttgctaggacaagagagttgtttagtttttaagaaaattaatcaggcagtcttctgaatcaccatttatggaagtagctttctttgcatggtagaatgttcatgttaagcaaaaaagagagtgtacaaaaacactttgttcgggatgatctcatttttgtttttaaaatacgtatatatttataagagaggcaggaggaaaagtctagaaatacaggcattaaaattgtaatagtgattgctgaggttttttggtgagtggttagcagtattttccaaattttttaaaataaggattactttttaaaaagagagacacaccaaattcattctagttgaaaacaggtttcttctgccgacttaaatgagtgtggtgagtgtaacttgagaaatttctgtccctggagcagatgtaataaaaacggcctatgatactctctgtggtgttgacagatagtgaaatttcattacagacctttttaaaaacacatcgctgcctaactattactttttgtaatttaaacattcagctcattaccattaacttgtacaaatactaccacataattttttctggtgtgattttaaaattatgtttcaaaatatgtttttatgtttaacatatagaaagatttaaatgtgcaaaatacatatgtataaccatgggcagcaagctcaataacttgcatatgctttggcactaccatactttttaaaacttaaattttgtctcccaagattttctcttaacctagttactggcttaagactttagttatttttttcaagtcaattaaataccgtacattttaaaaaatggtatgattaagctaattggccaaaatttttcagacaaaaacaaatcattttataatatagttacaaataaaaaacaagaagcactttattgtagatgctattgggtattttaataaaaaggatcatctgttatttttcaaatcaaatattttgcagtgtactttttagtggacataagcaaagtgtttgcttcaaaaatattaaacattttaatcagtgcttctttatctatacaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagaggtactagttttctgtgttgtggaaacaatcatttcaacaaatctgctgagttcaaggcattttgccatgtgttgaaaatatagaagagaaaataagtattttccagcaaatggaccttcaaacagaaatacattagagcaactcttttcaaacaccattattgtatagcatttgcaagtgggtatcatagagttgtcattatatttacccagggttgccacagtgcctacataaaccagaatgctgttacatttctccaccgataaaagaaaatttatatatcagcacttagtactcttaccagtatctgtgaggtatggatgacatcctgaaaccatcctatagattaaggaaagattagaaataaagactttttaggaacccagcaccagcttcatgtacctgttgaaatggttagaagaaagtcttgataagaaacccaagatttggtgttacctttggactgtcctttgctagattctttcttccttttgaaaaagtgagttgaaatattacacaatgtgtatggatccagagattaggtcctgatatgccagagctgtcttcgtaactctgtcttccttcagctgtgtggattcagctcttctttccgtttctttttttttttttttttttttgagacagagtcttgctctgtcgcccaggctggagtgcagtggcgcagtctgggctcactgcaacctctgtctcccgggttcaagcaattctcctgcctcagcctctcaactagctgggactacaggtgcatgccaccatgcccagctaatttttgtatttttagtagagacaggattttaccctgttagccaggctggtcttgaattcctgacctcaggtgatctccctggtttggcctcccaaagtgctaggattacaggcgtgagccaccatgcccggcctcttctttctatttcttcccatcacattgctgaactccattgtctcttgttttttcaatttctttttccttgtaggagagggaaatgaggaaatcaaaagaggggaaaagttttgtgagatggagaaacataggatgtggactcctggctcacaagatcaagcccacagttcactaccattccacactcaagcacttctcccatagaggcagacctaaaatgccagtttttgtaatttttgagagaattctgtttgttaaatttcatgtggagaaatgaaaagaaattatcccatttatggaaggtttgcctaattataagttggccagtagtgtgtttctaggtacagagaaaagcttgatttggaattgcaaataaaactgatttttaaacaccttagctgagttcaaagatagttttaaaaattgtttttagtaaattaagagctgaaataatactgaattttaaaccttgctttcaaattcactcttttcaaacttggtggaaggatttttcaaattaacttcactcttggttaagctctcagtcacggctattttatttctgcatatggatctttatagagaagaattaggtaacattttcttggtctgataaaagtgtttatcaaattatgctttttaaaaaacaattatttcacaagcttgtttcacttaaccatttagggagggattttgctgttctgctggtaagacctagaccaggttgactgccatattcagaagagactctgagaatgttctgtgcattacagatgtattttgtgcttttgttgttgttgttagcagttctcttagatacttctcaacatggctgccaaagtattcagcagacaacataccttgaaagacagtgaacttacttccagagcactgtctccataaaagggaataaatggataatttaactcaagcacagaggattatatttatgttcattttccatgagaaagcagacctaaaaagacttctgatccactagcctattttcttgcataagtgtatctaaatcttccaacacacatgaaatatgtatatcctattttaagatacagtaatggttttctttccttttttttttccttttgagtctcgctctgtcacctaggctggagagcagtggcgcaatctctgcttactgcaacctccacctcctgggttcaagccattctcctgctgcagcctcccaagtagctgggattacaggtgcctgccaccatgcctggctaatatttttgtatttttagtagagacagggtttcactatgttagccaggctggtttcgaactcctgacctcaagtgatccaccaacctcggcctcccaaagtgctagaattacaggcgtgagccactgcgactgaccatagttttcaattataagcaattttatgagtttaattctgcagacatttactgagctatttctctatgctctcagctttacagcaattcatagtctaatgaagaagtcattgctattctgattcaaagcaaaatagagtcataatatttaatattttgcctaaaaccactacgtatatttgaatcaactaaaacctttaaaattttagttatttaactgttgaccgattctgaaagaataatattgagataagagaaaaagctaaatccacagttaagaaatatagtgtatagaatattgtagcagagataattttgctaggattagtatcattggttacatttactttccatttagttaactccatcttactgtttttatgtttagcagcagtgtgatcatcttactaataaaattggagcaaccactaatattactgggggacagttaatggatccatcttgcatctttaaggatatattgagttaatagaatttataatttaaaatttttaatttttatataaacctgaaagaaaatactggctttaaaatattaacactgtgttccatatgtaagaattttttctgacattccttcataaatataatgggagcattatttttaaaaatgaaaaacttttgacagttttatgttttttagtataacaaaaaaattaaaccagtctaattgcgaagcaacttttgcttttcagttttcatatatgactttttgttgtaacacttctgatgtgttttcagccttcaggtctgaacttgtttcgattttaaacatgtatggacttgttaacactcaaaaagtaaagaataaagttgctaatatttgcttcctcataagagtaacctagtttatgaaattgaagggaaattttgagctaacataaaatcacttaaacctgaatgaatattagatcagttcataaaaatgaattccccaggttgtgttgaaaaaaaaatttcctttaggtcttcactgtgatgattcagtggttttatgctcacctctcccataggaggccagggatggaatcttgtctgctgctgcctccttttggagaaatgctgtcttatagaaggaatgctaggggctgagagtcatggctcatgcctgtaatcccaacactttgggaggccaaggcgggcagatcacctgaagtcaggagttcaagaccagcctggccaacatggtgaaaccccgtctctactaaaaatatgaaaattagccaggtgtggcggcacatacctgtaatcccagctattcgtgaggctgaagcaagagaatgcttgaacccaggaggtggaggttgcagtgagccgagatcacaccactgcactaatcagaaggccttgttttctttttttctagttcattgtgatattgggcaaacctcttaagtctcccagggcttcagtacagttttctcaactgtcagatccagggtcagactaaagcctagtggtttccattggagccattagagattcagagagcctttggggcagagaaggctttatcacattgcctatcccacttaaacctgaggagtttatcgttacctgtcagggaatgaacatgatataatccataaagttaataactaaaggacttgaataaccatcatttactatgttttaagacataaatccaagaggttcaccaatttgaaatgattctatttaccaaactggatgttctaagattattattggcatcttgtgaagttcccctgctaatctatattatcctctgaatttttccctccaagactggttattaaaaataaagtttagggccaggcacagtggctcacacctgtaatcgcagcactttgggaggctgaggtgggtggatcacacggtcaggagatcgagaccgtcctggctaacatggtgaaaccccatctctactaaaaatacaaaaaattagccaggcgtggtggtgggcgcctgtagtcccagctacttgggaggctaaggcaagagaatgacgtgaaccccggaggcggagctttcagtgagcggagatccagctactgcactccagcctgggcgacagagtgagactccatctcaaaaaaaataataataataaaataaataaataaataaagtttaagcttgatgtctttctcatatttctattttataggatttttttaaatttggttttttcttggaacatattcagattatttcagattgtttatactttcaaaatgttattaagaaaataccttaagctaggtgacgtctttgccttttctaggtactttaatgtctatttttaaaaattagccatttggcttaaaaaagccagaggccttttataagtcactttcacgcaccctctttattttgtgcttgagatttgctcccatctaatacaccataccttcaatcttttcctcatgttgattccttctctatagcccaaaacattagactgtcttcatactgccttaaaaatttaagaagtgttgaattttctcacctttgttccctgctcaaggtaaatttcagcaaactttttttttttttttttttgagacggagttttgctctatcgcccaggcgggagtgcagtagtgcaatcttggctcactgcaacctccacctcctggattccagtgatcctcctgcctcagcctcccaagtagctggaactacaggcacgtgccaccatggccagctaatttttgtatttttgtaatttttttttttgtatttttgtattttttagtagagatggagtttcaccatattagccaggctggtcttgaactcctgacctcgtgatccacctgcctcggcctcccaaagtgctgggattacaggcatgagccaccgtgcccagctgatttgacaactgggaggtcagtgttgtcctctgagagagcagctttggtactgcaggaatagaaatcaaggctggtaaacacaggagtctccatagcatcttcccagtcgttgtcttgtttgtctttctagacaaataacattactaaagtgtcttgaagccgtctctttttgtctgttggaacatctctctcctgcctctctctgatattttttaacacaggttcttttgttagattatgatatacagagacttcaactttgtcttccttctctcactgagtattactcctaggacaaatgtatctacttccaaggtttcaactctcacctttctacaaatgactcctaagtcattgcagacccaaaattccaacagttgactcatcttcacaaatcccattaacacttcagactaatcatttttcatccctactctgtatactttttcctgattttttagtatttttcttaatgatttctctgtcacctaagaatcatctaagctggaagcccagagtcatcttacgcatatcttctttccttgtcttcttctacattgtcttctccaacctgtgctttctcaattttttctcctttaacttacctctgcattgctacaatttgcttcctgatgcacatatttgatattatcttcttattcaaaatatgatttactctttccatttgtttatagcaaaacccctaaggttcctataaaatttaagaccatttacaacttgaatccagcttactttccagctaccttcttttagctctctcacctacctcaccactatttctccatgtccctttgccctaaaaagcctagagttcccatcgtatcacactgttccctttgcgtcacatttctgtacccatgagaaagaaaatgttactagaatgcatttaatttctcacataaagatgctgtaaattccaagattatcttgcacttctaaatgttttcaaggcattcaattttgagcacatggagtaatataaataagtaccagtgtagctgatgtgttttttactttggagaataaggatacaaagtgaaagttgtatttactgttaccttaagaattagataaacctgtatataatgggaaacatttaaaatcatgccttaaaatgcaattttgggctctacagccagtgacttacaaagaggacatgcttagtgaatattgaattgtgctgaattcaggtcttgcgtctgaagctgtatctgatgtcattactacatagattaagaaaatgtggcaccagctactttagcaagacaagttctaataagtagctcttattttgagtgaatgtgtcaaactgaatgcttattccaagcacttggtacatgaagatttcctctgctttaattggttaactttgtacagttactgataacaaatatgtactacatgtaataaaagaataggtaatgcctcttcaggaaacttcactgttgagttgtaacatctgccacaaaggagtatttaatggcagtggtgaatagcctatgcttttattatagcttagagaaaatacttggaaagcttatcttctacccatgcaaactcatttttttttaacataagaaataagaatagtgtgggtaatgtggataacaatgtccaaagttaaattagacctgctcatcagtctaatcttatcccagtattcctcttaaaacagtagcaagcaacaaaatgatctcagttccttttactgtgtagccaaagcagatgatattgcccagtgttggatcaaaagttagtcatcaccagataaattcaagcacttatttctatcctgtactcccaatgtaggctcaaaagtcagtctgctcccgaaaaatccaagcacttatttctatccctctgtacaatttgaaatggcctactccacaatgcctttcttttcttgtgattgtttatgtgtttcctcattacattgtaaagtcgtcaagggttggagccagatcttgtcacctatatgtccctattacttagcaaactccacatagtggacatgtagtaaatttctgttgaaaggtatcttagaagtttttatcaaagaaaaaaatactgaattacccacatgatcaatttctgcaaattcctattagcataacatttctcattcttttgcttggttattgaataatattatatcctatatttgcatattttatttgtttggttgcaatattgttttaaaagaccttacaatttccatgatttccagtttagtttgatgttgttttataactttaaaaaattatgattattataattaatttatgcctttaaaacactgttattctagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcaggtaacctccttatattgctaatatgtactgagtttgaagtacaatatactatcccactctctcgactgagctaattttgatattttcatggatagctgtttggcattttcaaagcttgaatgcatatgcatcttaattatccctttggttgtatgaaagttgtatagtataaatgattctatactgaattcctacatgatcctgcttttgttttgttttggtttttgcttatttcaggtatattagtatttaatttttgtgatttgtactttcatatatgaaaacaactgttaatactttttgtttcttaaccgctattaagtacttttgacctggatctcagccagtgttaatgctgttgctactacttgataccattgtaaattataagcagtttagttaatgcaacatagtatttgtcttttgataagcaacgtgaaaaatgttaaataaatcagaagtggtcagtggttccaataggctacttgttcttaacaggctactagagagaaacttctccaaaatttgttaatgctgccaacagtcaagcatgtgggctcctcctgaaacattcatttccccaggccaagaccacagctcatagcagctgtctgcttatgtgaccaggtagtgaagtatagtaggagtctgaccatggcattttccagatttttcccaatttgttgaatactaactccacgctgtgttatttagcttcttctgtattgtggtaatttaaatatcactgaatggatcacaaaagctttgtgtagagcagtaaccctatggcagagacttctcaaagtgcagcccctaaccagcaatatcagcatcacctggtgatgtgttcaatatataaattcttaggccccaccccagacctactgaaactgagggcccagcaacctgtgtttttaataagtcctttatatgattctgattcacactaaagtttgagaaccactaatctgtggattattagtacaatgttcacattgttctctggcttaattttgaagcactctactaacatcttttatataaaatgttaaactagttgttggcattaggtataaaaagttataaaaatgaagtatttcttaagtgaataatatttttcagcattgggagtaggcgtttttaaaaactttcttttaaatgaatttcagctcagtttttaatcttccatggatagatgtttaaagccattgatttcttcagaatagtctcattgattaataactaaaattatcttgaacctgatgaatatttttaacagattgacacagaataatgtgtaatatctttgtgaaataacttatattccactttcctcttcaatgtgtcattatttggttctactttataatagtatacttccctttaaccttcattttttttttcacgtattataacaaaatgtaaaacagctgggaggcatgctgtaatatctttgcgttttcagtgaaagagaaattcaggaaaatagctttgtacaggatactctgagaccagagaagagagcaacatctgacatgttagagtgtggtggggaccaagtaaagtttacttgggagttgatgcttaagatgtttaagatgagttattcactggcaaaatttttgaatatcagggcactggacaagtatctgccttataggctgattgggtgatttcataacctgtattataggagttatttactttagatatttgatttgaggggtaacttgcccagtggtatgtccaagtccatattatagtacatttattacaacggttttacctctcttttgcttggacaggctaccatacaatcaggcctatattcactttattgttaggttcctactggttggggtagctttcatgatagtatgaaaaagaatgcttaagagactgtcataaggcccttagagaggtaatctctttaacacaatccttattcagtagtctctttgtggttctgcagaaatgttatctttgagagtgtggtttcacagattctaaactcctggatcaggtagaaatcaaaaccattctcttctttgggagtagtttttcagcaattaaagttttccagaatccagaagtattatttagagccataggaggttatttaccaagagattctgctaggccttggaataaattaatgaatatgtaatttattcccatggaattatttttactgtaagaaatttttacgggcttcctaatacttgtttttaagaattacagcatcaaagctacatgcttctatattttctcaaaaaaaggaatctgaggatgaagcagtagtataagttaagattttgttttgtcattgttgtgtttgaaacataactgcaatcaaaatactgaaacacattttgccttcaagtattgtccccagtatgcttagcattggtctaggctccgtcagggtaatgtttgcaggttataggccctctgtgaaataacttcaagaaatagatgaacaaatcaaagtccaaaagagagcaacaaaagtgttttacagtttgaagaaataatttatgaagaaaggtagttaaatggtttgacattatttgatttaagtaaagctattttgtttaggaaacaactctatgctgcaaattaatagccttcaaatatacattaaaatcttgattatctgaaacctggcgataataagctagtctggataattaaaagtgtgttcttctaagtcattttattataactatttttgattgcaagaagttttatgtgctttctaaaatagagggggaagcaagatagaatataatttgaattattctaattcagtcacctttctgaacatcaattaatatatcatcagttaatattactgttgttacaagggctgtatgccactatcctgaatcatctttatttaatactgctcttttgagtcttttttgccctaattttactttattttctttgtgtaagcttcttaccttgacctgtgttcctaatataactacttacctacagatttttgttttacatggatggaagcaagttttacatgcttccaaaaatgggtgaaacaatagacaataatttcagttattttaattcatggtcatctttctgaacatgaattaatatttaatataatactccatcagttaatatactgttatgagggctgtttgccctattctgaatcatctttatctgttacttttttgagtccatttttctcagtaatttttctctcttatctttgtagttagttcttatcctgaccgaaatgttaactgtttataaagggttgtttcttacttacagattttgtttttgcttcaaataagagaaactagatatcagattatcaaaacaaactgtagtttgcagagggagcagggaaagagtgttttaagaggtatttgataggctaagcatgggtccccacagttcataaagctgagcatctgggatattgacaacttctatctgccaaagccccactaaagtcacatttagctgcagcagtgataagattaggcctctatcttgtataggtgtttattagggtttcttatgcaaccctccagttaatctgtgaacgtgctttgttaagacaccttcacagactaactggagggttgcataagaaaccctaataaacaaaaaatttttattgcctagtccagacttgtaagaggcaactgcccctccacagctacaagccatctccctgtagattctggctttctatagaaaatgtcattttctctgccctaattattagtctacctactgtgaaatggtttgagtactggtttaaacaactttatagtgtgagtagctgtagaatggatttgtgttggtattacctaccttctttagcatgggtttttccatttaaataaaggctttgtggatttaggatatttagttactggaaagaataataccaaaatgagggttttttcctttctttaaaacaactttcattattgaaaatcttttaatattaaaaagtaagttgtttatcttctaaaattctgagtggcttatttattcactattgcccaggtttctggagctacccagaaggctattctatataacttgggcttttaaagtttagtcagggttcataagataccttaagtggtatagttttcaactgttacatacagtgtagctttaaaaagaattttttccttagcatgtactctgtaaacaatatgaaaataggttataactgaaatgtctatagttttagtggctgcttgaaagatgagtaatatttctaaggaaatagcaaaagtaagttttaattttccagaaataactttgattattttatatacttgaataacttattactaatgtggactcaagcataattaatttcacatttttaaattaaagcaattttttaatggaacggaaaaacaccagcttatcttacaaacattataaacttgtctaaatgccctttcaaagccctgacgtggaacttggatcctgtctggcaggcttttttgtgggcatattaattcacattccacctgtcagtgtacctataggtaaagacattaaaccacaccctctgttctgaccttttcctcaggggacactgactagaatcctttggctcagcatgagaggctatttgaatagctcagttcagaagagcttttccttttgaatagagtgaagcagcaagagcaagagaaataatgttacaactgcatttctcaagactgctgctatggagatttcaaacttgaccttccctgccaggttctgctttgaaggcttacttattactacagacatcgctgatattaaaagcagttttattgctcgtctaattagatgtttatatttttattcttctcttcaaggacttaattatgctagtttaaaaggtgtttttgtttgcttgcttttatttttgttttttgattttttttggtttttgttttggtttgggtttttttgagggggcatcaagattgatagagacctaagtttttttagatttgtagtttttttcctggactttccccttccttttattgtgcagttgtatgaattaattttataacatttatttgatagtgctaaaaaagaaactttttatactgctatggtagatcttgataaactaaaaagaactttttaatgtattagaaaattgataaagcaaattaggaatctcggcagctgtatcttctgggatggattcttatagcacctatttggcaactgtcaaagtcagtggctcgtggttagaagagcaagatgaagacatttatgaggttgaatctcgcgtgcctttaccacatccttttcctctttgtgaacatttggatgaaaataactcagtaattgttaatacttctattttccattttattcataaaagaaacgggcatatattaaagcttatttctaaaatttcactgcctacccctccttattcagtaagtataaaaaatattcatttagttaaacactataatgagaaattaaattttgagtgtctatattaaggctaaatgggatagaaccttgtttgatgcgttactactcattcattctagatgtatttaagggctaaatttggtctgagttccaacttggctatgtttacaattacagaaagcagaatgagataatattacatttctccaatgccaggcagtttgtttaaaaagatcccgcttttccttaagattcttgcttttgtatgtttatcatgccaatcctgaataagaatggaataattattatatttgagagactcggtattatgatacttataagacagctaagtgaattgtcattgagcaattaggaaatgtttacaatcatatgttatattggctgttccagtccaggaaaaaaggaagcttgggttctaattttaatattcttaacaacctaagaaacttactttttgtttttaatatgcctcgtaatcttgtggaacaagacccttttctgctttttatatgaaatatattttataaacattgttaaggataagtgtttagcataaagaggcttgaatatttagtatttcaggttcactacaggttattcagtataactaaaagttattcagcgctttttatgactttcatagctttatcctgtactagctaatatttaacaagccagatggttttcagaatagttttgttacctcttctgcaacttttatattaaagtgacagaatattaactgatactttacatgtacttttaatgtaataagtttcttaaatactttggaaatattgaatatgaaatcttacattcttcatattgttatagatattaggaataaacatactctaactgaatggaagaggattctttaaatattaagtatttaatgaacatttatttgaagggtgtctcatctcccgatgaagtgtggatctcatctgctataataaatgacatttttttttgctagatttactgtatttgattgttccaactttttcattttattttagaaaacaagtttttctcttgtggttttatgataaatatttaaatggattataaggctgattaaatcttgtcaggaagtagaacatagaagcaaaggcttatttaatttacttacctaaagcaagcatttattttgttgtaaattctttgttatatccttatagtaaatttaaaaaagacaaaaaaaagcatatcctttttagttacatgtatttactagatagtcattatgtaatgaacagaaaaaaatgacaaacgtgtaaaaacaattgatatgtttttaaaatatggattgtgactgtaaattcccatgtagttgtatataaattagttcatactttattgttatgtttctttgtaataaaaattaatgatattagttatccagactttaaaggaaaaactctttccagttaaaagtaaaaatattccttttgagataacaacatattatcatgggtattttaggaaataatttataatttaaaatgtatgattaattttctattatgagtcttatacgtgtattcatattaattgcaaataagttataagtgatatttgaaatatcctattaaaacaagaataattgcatactggatattttggaaattgatttagagtagccatcaaaagctgtagttactctaaaatccatttgctatgacaaatacctctcagatgtgaaaagtggaagtctttaacaataaagtatcctttagtattatcatgattttgtaatacattttcaatatgtgactataaattagaaaccactacatttgatcatattttaagcttaaaatgcactaatatctttttaatgcacaaagtactttatatgtaaatttacaaattcttatgactttactgtgagcctgttattaatatatgtgatgatttcttcttacaatttttggactaaatactagaaacatttgagttcaattttttcccatgtaattgtttcagtaataacagataagcaggtgctgatagtcaaaagctcagaaaactaaggcagagacagtacttttctgcaatttcacacagctcatttagtagcagtgatcaagagagctttggctttaagccttctatcatcttaaaaaattgtttaagaatgtagtcagtatgtgctattggtaatattttaaggaatctgtgtttatggttaatgtctctgtattctacggttttgaaaataagctgaatattcataggagctttaggtgtttcacaaatggacagaaatataaagcttttagttaagtacatggattataaatataatttcattttgttgtgctactatcattttgttaattgatgccattgtattaatcatgtattattggtcccccacagtatacagcagatactgtaggagtcacaatccgtaaatactaaatgtagaagaaagtttatcatagactgtatagttacataaaattctttggcaaatacaataaacgcctgtgcttcattaactttatatcttcttttatatgataaagtacacagccattgatttaaagtggtttgtatccaaaagaagcatattcttttgttcagtaaagctagaatacatcactttacagaaagtcgtgcacagccaatatacatgtctcctctgatttctcctacctgctaatcttagcatacactggcaatatctaaatgactacaattcagtagtatatctttattttaaaatcctccttttttccagctttaatagggaatgaaactagtatttccacactttattttcttttatgtattgtttccctctttgtttagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggtgagcaatttgccattgacaactaagggtagagaaatttcagtcttaaaatagagatttttgatgcacagccaggtttggaagccgtcaatccaatttagaatgaccattaaaaagtacttgtggtttatcttcagagttcctccaagcaatttttaaaactatatatatatatatatatatatatatatatatataaaattataaaaagaatttatagagttacagaaaataataatttcagaaaataccaaaaaggatagtggtgactcgttactgtaatcacaccatcttaagacaacccttgtaatttaaagatgagcaaactgaagcgaaaagatgttattaaattgttaaagggcacaaataccattacatagtgattccaggctttgaatctctaaagccctatgctctttttaattctcctctgctgttatgggtgttggccttctaaaattacttaaaataccaaccttctaattttcaaaatgtgattcagttcacaagcatctaatttgtattaagcttttcagaaacttactgtttatatctgtttaataaagtgacttacacctacataatgtggtactttggtatagcaaagtattagaaaattcagagaaatttcatgtttatgcacaatggtaaacaaggaaatgtctgcattgaccataccctattaaaggttgatagttgctgtgatgagcagcaaattcattcaagacttttaataggttggaatgatggaaagttttgctaacagtataccttttgttgtttatattaaaacctagtggttgaatttgaaatgaataatagttctattttctgttaattttgtattataggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacgtaagtattttcagaatttgtatgaaacagtcctctgattttatttgtattcttcaaaggcttaaggtggcttttttcctctttcagtgccattattcatatattttatagagagatttaaaaaattataagaaaatctaccttagagataaatgtcttattagccaatcatgtggaatcaggttttttttttctttttccttaggcagatgttaacaggaaaagatagttcttcatttatcctcaaacttctgcttcaagagaaagctgcaaataatgaggcaggatattttaaaaattgtgtaaggtttagttctaatagcagagaggcagcaaaaatgtatacttggattaaatatctaaaagcactgatctggcactagtaatgagcaggtggaggggttttttgacttgcaagcagagtagatttaaaaaggtcagtggctggtaggctgacatctagtttaatgtagtaggaattcaaataatacttaaatgtttaagtaacctttcatttttccttaaataagatattaagtaatatcttgaagtgaaagtttgtttagcagtaaatgtcagtcttggtaatgatggaactttaatcctgtttaccatgtcctctcacttttatattacacgtgcagttggatttttaaatgtgccgtttcactgatttcattttatcggtttagaaatacagcatacatttttgtaatatagtgaagtttcttccagctgctcaaattaattaaacaggtttagtttgggatttttaatatggaaagtatatgtcatatatgcaaaatattcaagaaatactggaacttctcaaaatgttaccagtgataatcagtgtcttcaactcttgtttttgatacgtgtgtgtgcatgtgcattatcccattttaggaagtagaagacatataaattatacttttgttgtgtctttttttttttttttctctattttcctaggactagtagatgctgcagtcgatgcagcaccaggagcaggtgtgtgtataccattgcatggccaatgtttgggtggtagactttaaactccaaaatgtgggtgacctggattttcagccaactaacatctctagttttgcagtgttgctgttgttccatacttacagtttttctctttaacaacaacaaataaacttttcttacaataaaagtacaaattttcatttgaaattaacatctgagattcatactgaccatcatcttatgatgtctatttttgcatagagcttaaaaccattttgatttttgtttgtttgtttgtctgtgtttgttttttgagatggagtcttgctcaatcacccaggctagagtgcagtggtctgatctcggctcactgcaacctccgcctcctgggttcaagcgattcttccacctcagcctcctgagtaactgagactacaggcgggagccaccatgcctggctaattttttgtacttttagtagagatggggtttcaccatgttggccaggctggtctcaatctcctggcctcaggtgatccgcccacctctgcctcccaaagtgctgggattacaggcataagccaccatacccagccattttgagttttttaagaaaccatttaacaaatgtattaaactctttcaatctatgagtttttaaaatgctccttctaaatcaggaagtatgtaagatgatggtagcaaaaggatcagtgaaatttaataagaggctctctggttgatttatttttatgttaacatctaatgttgttttaaaaggaaagctgttttctagagattcctagtcctgagtacaatgttggcatactagttaaagaccctagggatatgttctttccattttcttcattagaagattgttttatttttactatatacactttgttatattaataatattaatagctaacacatagtgcttaccatacctcagacactcttctttacatgtattaactcatttaatgccaaaataactctaagagatcagtaataatattattctcagtttacatataaggaaactaaaggacatcatcataactgtcacatgggagataagtggctgagctaggttgggcctacggtctgttcttaagcactacaccacactacctctcatacatgtcagttttcccttgattcacatacatgtgaccatgcaaaagcaactcaggaatatggatctaataaggagtaagactaacaggaaatttcaattatagctgtatttatatttctgtaactcttagacttgccttggttaaagatttacagtgtttgatcttcatgtttattgtgtatgcaaataaaattgactttatgggtttggaatgaattgctttttgcctgaggtgaagaaaacggtgagtttttttctgtgcttgaatttaattggactttgttctttgcccagtagtaaaaatagattttttttttttggtcatttgctatgttgttttcacaaaaatattattttcagtgacaggacatattttttgttaataattctgtataattttattaataattgcttgtttacttatatagaaatattttaatataattttgatactttcataagagaatatttactttcatgtgtatttaaaataattctcagcctttcatgaacgtaaaatttggacatagttatcagggatttcattatcataagatcattaattgtgatttaattcagtatattttgtattaataaacagaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgtaagtattctcaagttgaatactgatttttctcagtggaatgttctttgctagtatactaggctatgaattttaaattatgaaaagactgttgagttagtttttcagtgttttattaggtgtcgaatctactaatcgatcaaaaagtactattccaatttaagattccaataatttttattgtgcagcactcagaattaaaatcagtacattttattatgtattgaattatacatgataaaaattatgaataagccccactagttttccaaattcagatcaggagcttattctagttttttatttaaccacagactaagataggcaaagagataatgggccaccactgcttcacctgtaaaagatacacatagaacagtgtggccattggaaatgggcccggaacagtggtcatgctgccattactctcttccaaaaagatgttaaatctctaatttcacatttttttttcctttgagatttcacttaagcctgatactctcttcatagatcagagaatcagattcttactcattttataactttagacataaaacctagattaggattcaagaaactgatttaccaaacaatttgttttatggattttgtttaatggctaaactaacatggaattcctcctttgttccagaaaagtaaattcattttaaggtgaatattttttcatcctgtatttaatattacttgaataaaaaaagaaatgtacttgaaataatattttaatattaatacttgaatttttgttgaggaggccaaataggctatatggcatataaaaaataaaatgttatcttttaaaacttttgtgatttgggatgttccatgatcatcagtcctttgtcttcaaacaaaactaacatatctctaaaggagaagtaagaaataatagcttctctaaatactgtttcttcagctactatcattattgtcattaaactttaggagcaagccattgacagagaacatgagagagatgtattccaacaggaaatacagaaactagaacagcaacttaaggttgttcctcgattccagcctatcagtgaacatcaaactagagaggtaagaacttcactgatattgcccaacttacagtaatttgtatcaagtgtaaaataagatgcatatcattaaaaacttaaaagtggattctttcctttgtatgtaaatcttcaaaatcagaaaacttaatattacttaagcatgagaaggtaattaaccctgaaaattgttggtattgaaatttggaatcatttccatctgcatatgtcttctagtatttctcaattaaataaactctgtttatttctttattcccattcctaacaaaagtgatcaagagagttatctgtgttcactgtttactttcccatttccttttctcttactagtccactccagtgaagtatccagcccttgtttctcagtagggttataccttctactccatttaaattgttcttgtgaaggtgacccagagcctcatggctatggctaatatccaactctgtctccatcctcctcaaccattcagaggcatttattgcagccttctcccagaaatacttccttctcttgtttctgtgacacagctactccactggtctctctcctctagtctttgtttctccttttcctacccagcataaatgatggagtgccccaaaacttactcttgggcccctttttatttcctatttatagcctcttcccaggcagtcatatataaatgcctccacatttgtatttctatctgtgacatttctgttaagttccagcattggatatccagtgcctactctgtctctgcttagatgtctcaaaattaacatgtccaaaagaaaggtcttgattcctgattagccactaccagagaaagacaagcataaaacatttttcttcttcatctcagtaaattctgtaccttctaacctgccccattgctgagaactagaatcagccttgattctcctttctctcaacccctgattccaacccactgatgggtcagactgcactacatctttctgttatttgcacttttattcatcttcctaaatcccacttgtcacttgtttgcctggatcactgtggtagcctcttaaccagtctccctgcttctcctttttcaccccaactgcccattttcctcatagaaacatagtcaaaactccacatttaccaaatgaatgctacataaatgagagaggattcactgtatgaatacctaaagatggcttgtcatggtgataaagacattgtgcttagggtaaggcaatcccagtttgtatcatggctctgccatttactaggttatgacaataactaagtcagttaacctctcaaatctctgttaattcatttctaaaatagagattgtaatagcacccacatcataggagtgttgacctggcacatagtgaacactttaactagtattatttctgaaacaatttttatttcgaatgtaatttctaaacagttcagtggatttcatttctcttaaaagaaagccgaagaagtacagagtgccaataaactccttataataaaatgttgtatactagagtagtacaaaagttatcagtctccagggctgggcgtgatggctcaagcctgtaatcccagcactttgggaggccgaggtgggcagatcacgaggtcaggagatcgtgaccatcctggctaacacagtgaaaccccatctctactaaaaatacaaaaaaaaaaaattagccaggcgtggtggcgggcacctgtagtcctagctactcgggaggctgagacaggagaatggcatgaattcaggaggcagagcttgcagtgagctgagatcacgccactgcactccagccttggggacagagcaagactccgtctcaaaaaaaaaaaaaaaaaaaaaagaaaaaagttatccacagtttctagttattgccccatttctgacaaacatatttttggcttttaaaaagtagtcgtttgttgtacttcaaagaatatttaagctctagaacctaggctgtcatctcctattatgtagttttcttttatttgaaaaggttggcctgctttgctcatgaaactttaagaaactaacaaagatgtgcatgtttgattttttttttctactgttgcaccattttattgtacctacattgttgccttttttcttaaccttactccaaatcttagtcaacttattattattaaagtttctcctcagcagctttttttttccttttttttctttttccctttaaaactgactgcacatatcagtgactttattgctatcatccttgaacctgaaattatagttaagcttgcattcttttaatgttctgagaaataactgtcattttttagataatttcctcagaatatttcactgaaaagaaaaggtagaattactttatttcttaccatcacatgtcgctttttttaaagtaagctttccttcctcactttccatacagtacaactaatccttcctgtcacagaaccattcacttgaagggatctccatatcattcttagggaataggtcttggcatgcatcattattttggttaaaggagaaaccaagactagagacatttagggaaaccttcaaggtgcacagatccctctcacaccccttcatccttagctctttcctgggctgatggaatgtatagattgaaaaagctttcccaatgactgttttcaaaatatagtccataaaagatttatttaggtcattttatctcatacaagagtaaatcagtacctgcaaatttgtcatcttcattaggatttagtgtggttgtgccattagataattcagccttatgaaaaatccattttttcccctcttcctaggtggagaaagtcttagtcttaagagaaagattttttaaaggattacgtgaaagcaatattacttgtggtctactagtgttgcttaattttttcaacttgtaaaatgtcacctttgttggagacaacagttgctatctttatacaaagttaaattagcataacatttaaaaatactttttagaaaaaaatttttgaaatgaagatatgttttatatgcattgagtattctttaaaatgcttgagagaagtgtttcagatttcagatattttgaattttgtaatatttgcattatacttacctattcagcatcctaatttgaaatgtgaaatgctccaatgagcatttcctttgagcatgatgtcagtgcttaaaaagtttcagattttgacctgggcttgttggtgtgcatctgtagtcccagctactcaggaggctgatgcaggagaattgcttgagcccaggagtttgaggctgtagtgcatgacgatcgtgcctgtaaatagccactgcattccagcctgggtaacataatgagactccatttcttaaacagacaaacaaaaacgtttcagattttggagcattttggattgtagatatccaaaatgagggataactcaacctatactaactagcttgctgaaattttttttaaattaaattttttgcctcttatatttcaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtgtggcattttatttgggctaacttaataagtgttttaatgaagaatactcttaaattgtcaacttcttgtaggtattattacatattatgtttatatctctgttgacattgtaaccatttctgtttgttcttatttccaaatgttgcttgcatgtcttagtcctgagaagggaagagttttttgttgttgttgttgttttgttttgttttgttttgttttgttttgttttgttttgttttttggagacatagtttcgctcttcttgcccaggctggagtgcaatggtgcgacctcagcttaccacaacctccacctcccgagttcaagcgattcttctgcctcagcctcccaagtagctgggattataggcatgcgccaccacaaccagctgatttttgtatttttagtagaaacggggtttctgcatgttgatcagactggtctcaaaatcccaacctcaggtgatccacctacctcagcctcccaaagtgctgggattacaggcgtgagccatcatgcccggccaacttttttattattcactaattagaagtagactttctacttctaattggagaaacaggattgctgcttctcaaaaaaaaaaaaaaaaaaagcagaccaaaaaacaaaaaaaaactggataatcaggatttaatttatcaaattttgagaaaatttttatatatttaaaggtagaggaccgaaaacactttggagctgtagaagctaaaccagaattgtccctagaagtacaattgcaggctgaacgagatgccatagacagaaaggaaaaagaggtaaggagtttatttttaaatgacacagcgtggtttgaattattttaaatcagttaccttgaaaatattatttgaactgaatgtagtttatgatctaaaaccaaagttgaggctgtttctcagctcaatgccaaaattgaccttgaaggcagtaaacatatgagtaattaagctgacgggaaagaagagtgctccagatagagagaagagccagtgtaaaggccttgaagcaggacgaagttcggaggaacaggaagaaggccagtttagcaggagtgtagagggtggagagatatagtagtgttaggacaaaaggcaatatatcccttttctcctaaccgtagaatacatattgaattattgctgctttgctgtgtggttttttttttttttattgtattgccctgggagattatagtcctgttttacaatatacagaatatgttcttaaaacaaaaagattaatagtaaattgctttaatagtaaagcaattaagcaattatataaagttctcctttgtttctctgccccttcttccaaaaaactaaaaatctactttcagaacaatggtcacctcaacttcctaatttataacttatttaagcctttgtctactaatagtttttaaaaaacatatcctactctatctacattgtctagctatatcttatcatttaaaatgtttaaaatttttaaaattacatttttgtctctaatattctgagaagacttactatattttaacaaatagttatgaacttaagctgctttgaaaaatataagaatgatttagatatcagctaaaactatagttcagaaaacctgtagattagaggagaaaaaaggcatctatgtaagtgactgtagttgaaatcatttccatgagaaggattattttctcactatcacataatactgagtaatgtttacctgagaggctcttatttattttgacttttgattttttttattggaggtggggagcatttttgtttatatgtaactatttctgtgtttcaaagagctaacatttaaagatttcccttaaactgagtaaagtaatttatatgttgcctaaaaagacagaccttctcaactggacccaaagcaatgatagttgactgtggataattgattaaccttactgattttatatttttattatcttctgaatataatatagcactgctatcttgaattaagtatctaataactgtctaccttttactcagaatcatagttgttcaaaactatgagaaactttagagggcatctgtcaactgactgatgttttttatagataaggagagaaacggtaaatgagtaagaggttaaactgacagctgaccctaataacagtaacaagtactttatcaaaacccattcacctaccataactggagactgagaggcaggaacatagaattaaaatgtattttattgaaaataacttcttaagcattttttccccagaaactaggcaaatgctttcagatatctgatggagtataaatataagatgtccctatgtatcatggtatttgagatacttttctctcagagcctaaatttgtataaaacattttttaagcttattagaaatttagaaatgcaggatgaataaaaagagaactctaaaagaaaggagttttagaattataggaggaggtagaaaatggggaaaggaatagaaggattttagaaaaagatacgttccataggttttagctctctgtagagctaatgagatctagcttagagttagcaataataaataataatagttttgttgaggcctatctaattagacagtactaagtatttaaatgcccttttaccgttaacactttcttcccgaggacagactctgttatccccattttacagatgtgtaaactgagccttaagggaagttaaataacttgatcatggtcacaccttaagtggttgaaaaggagttcctctcagatttctgtgagtctgaagcccttgtgatactatactgccaaagcattggggcccattttgtcttgttggtgagaagtgttaaagactgccattcaacatttagtgagctcttaatgcacctgtagcaccagtacccaaatgtaaaactagcggtggacgtcaaggaatctactgtgtaattaaggagacatatgtacatttgaaagagataaaaacactttttaaaaaaggaaacaggccaggcgtggtgactcacgcctgtaatcccaacactttgggaggccgaggtgggtggattactaggtcaggagagcgagaccatcctggctaacatggtgaaaccccatctctactaaaaatacaaaaaaaaaaaaaaaattagccgggtgtggtggcgggcgcctgtagtcccagctactcgggaggctgaggcaggagaatgctgtgaacccgggaggcagagcttgcagtgagccaagatcacgccactgcactctagcgtgggcaacagagtgagactccatctcaaaaaaaaaagaaaacaaaaatagatgcaaattaatccaaacattaatttcaattattagataaattaaacaagattaaaacaaatatttaccagcctttgtttttaaatcttaataatgttcttctggttgtaggtggttacaggctcaataagaagagagcctagtactaaactagagcctgactgaataagaggaaagaatgtcccatagtgtcatttgggggaattgaagtgtctgatatgatgcctgaacttcagctacttagaataggaaagttagtgctttagaccagtgcatttcaaactttaatgcacatgcaaatcacccagggatcttgttaaaacacaagtcttacacaaaaattaactcaagatggattaaagactaagacctaaaaccataaaaaccctagaagaaaacctaggcaataccattcaggacataggcatgggcaaggacttcatgtctaaaacaccaaaagcaatggcaacaaaagccaaaattgacaaatggcatctaattaaatgaaagagcttctgcacagcaaaagaaactatcatcagaatgagcaggcaacctacagaatgggagaaaatttttgcaatctatccatctgacaaagggctaatatccagaatctacaaagaacttaaacaaatttacaagaaaaaacaaccccatcaaaaagtgggcaaaggatacgaacagacacttctcaaaagaagacatttatatggccaaaaaacatacgaagaaaagctcatcatcactggtcatcagagaagtgcaaaccaaaaccacaatgagataccatctcatgccagttagaaaggtaatcattaaagaggaaacaacagatgctggagaggatgtggagaaataggaacacctttacactgttgatgggagtgtaaattagttcaaccattatggaagacagtgtggcgattcctcaaggatctagaaccagaaataccttttgacccagcaatcccattactgggtatatacccaaaggattataaatcattctactataaagatacatgcacacataggtttattgcagcactattcacaatagcaaagacttggaaccaacccaaatgtccattaatgataaactggataaagaaaatgtggcacatatacaccatggaatactatgaagccacaaaaaaggatgagttcatgtcctttgcagggacacggatgaagctggaaaccatcattctcagcaaactatcacaaggatagaaaaccaaacaccacatgttctcactcataagtggaagctgaacaatgagaacacatggacacagggagggaaacatcacaaaccagggccttttagggggtgaggggtacaggagggatagcattgggagaaacacctaatgtagatgacggattgatgggtgcagcaaactacaatggcacgtgtgtacctgtgtaataaacctatgcattctgcacatgtatcccagaaaagtataattttttaaaaaagattaaaaaggaatatataatagagttcatttcctatctgattactgtaaaacaataaaatgagtcaaaaattaaaaaaaaaataaaacacaagtgtggggtgtgacatggcattttgcacacccagcatgctcccacatgatgccaactctactgctctcgagaccacactgaatagcaaggcttcatgtcacaaagttaagaaattgatcataaactgttgtataaaaaaaggaaatttcgtatgagatagggcagcaatttgaacttaaataactatttatgtgttgattttaaaataataccttgtcatcaaagtagttacagaaatgtagggatagttgtaaatactatgttaaatcactttgaagaagatataatcattgcagttttcagcaacctggtaattatttatgttcagtcattaaatgtatttcagtgtctactgagtttaataaccagtgttacagaaaaaattttaagtgtaagtcttagacattagttattagaagcaggataagtgatagtttagagtggaagattcagagataaactcctcaggttcaaaagctggcttctccacatactcgccatgtggcctgaaagcaaattactcctctctgtgacgtccatcctcatctctaaaatggggatactcagaacagatcttataaagttgtaacagggttttaagaaataatacatataaagcactttgtgcagtgcttagcggtaaactgttacaagtgatggctgttactactagtattgatactgtttaggaaatactaagctaactggtttttaaggatttgccagtgttcagatatggttctcagtatgtgatgtgttagtgtgtaatcagcgattccctctttcagtttctaaggcagtaaatgattcataagctgctttctgagccacttgtcactaagtgttgctgaggataggctctgttgccttagataacagagatgctcctgcatcttagtttgctttttgatcagcagttttgatcatgaggtaaatacacatttggaaatcattcattcactttgtattaagtagcaacaaaccagtgagctaaatgaatgttactgtcctcagtcaaaaccaattttcaaatataaaaataattcttaatattcatcattcgtttcagtctctaaccatcaaaaagcagttgctttaccattattcataatccatcctcaaaatgattaaataaatttctgttgtcctacctataggagctctctaattttctcctgaattgtataattcacttactctaaggtttttgtaattcagacctaaggatctcttggtcttagtttctatcttggcttccttctgcttaacaaaccacatggcagccaggccttttagtaagttaattagatatttttggactaaattgagttagtcttatatggtggctaacaaaacaaacagttctacaacttttctaggccttttgatagcaacttaatgtaacataaactaagatttaatatgtggactctttcccttcctcctatgactcttttctgcttcaggagaagagactaaggtaggaaatggctccttttatccttcctcaggaggtttcctctctgctttgtgtaggatagtttaaggatggccagtttgagcatgtctaggaaccacacaggtaacacagattatacctggcttagaaaaaccacattcctttattcttatgactcatgttttaagcatgcatactttgtaaagctaatatagcactcttcattttatcttgataaacgtttgtataaacattttttctcttttgataattttgttattaaagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggtaattagttaagaaaaacttttatctgtaaataagtcatagtttcagtcctatattgctttattattattattattattatttctttctttttttttttttttttgagacttagtctcactctgttgcccaggctggagtgcaatggtgtgatctcggctcattgcaagctccgcctccctggttcaagcaattctgcctcagcctcccgagtagctgggactataggcacgtaccaccacgcctggctaatttttgtatttttagtagagatggggtttcaccgtgttagccaggatgctctcgatctcctgacctcgtgatccgcctgtcttggcctcccaaagtgctgggattacaggcgtgagccaccacacctggcccctatattgctttattaagcattcgataaatccagctgttaaataatactcaacagaggaacattaacaggcagacacatttgcatacagcttattttcagcccaacctgaacatttgaattcatcataaatgaaaattttgggatcatttatcaaaatattttagaattattgatttacagtaaccatatggtgtctctgattttattcatttgtacgttataggctctgatttcttttgtaattatgttctgaaaatgataggtaatgatatatccaactgtgataattatttttgttcctaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggtatactcatttaaaattgattatgaaattaatatgaaccagagttttaaagggcaaaatggttataatgttgctccccattgaatttaaaaaacaaaccaattttattttattttattttattttatttattttttttgagacagaatctcgctctgtcgcccaggctggagtccaatggtgcaacctcggctcactgcaacctccacctcctaggttcaagtgattctcctgcctcagcctcccgagtagctgggattacaggcacccaccatcacacctggctaattttttgtatttttaatagagatggggtttcaccatgttgaccaggctggtctctatctcctgatgtcaggtgatccacccacctcagcctcccaaagtgctggtattactggcatgagccaccacgcctggcccaattctcttttattaattttaatttattaagacacattggtggccaggcacagaggctcacacctgtaatccttatactttaggaagcctaggtgggcggattgcttgggcccaggagttcaagaccagcctgggcaacatggtgaaactttgtctctacaaaaaatataaaaattaactggacatggtggcataccacctgtagtcccagctgcagtgagcctcatcatgccactgcactccagcttgggtgacagagtgagaccctgtctcaaaaagaaaaaaaaaaaaaagcaaagacacattggtttaataatttatatgtatttttctcccctcctaatattgtcataggattctaatgtttttcagaaaggctctgtgacttagattttatcatgttattctaaccaaatctattataaattataatatttaatatgagttaagtaaggtaattacctttggtgccatcggttgtagactttatttccgtacttcatccttttccattaagaagtattgatattgactattttcctaatagggaatcagcaactaaaagcttatattactttatacttaacagaactttctgagccttgtttgatatgatgggggagatattggtctataatgaaattaagtagtatgtctgagaagtagtgtattatttttgtgtgtgatcatctctttgaggtactgccctaaaataaagtaaaattttcaaaatgtaaatacatatatattatgtatgttacctttttcattaattattaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaaggttagttttgtattttattagtttcatttaaataccccaagaaactaagctgattgctaatttactaaatatggtgttctgtttacatctaacaatttatacaagaaggtttttataaaaatataccacttataaaaaataaactcttgttaaaagaaaaactaggacaggcgcggtggcccacgcctgtaatcccagcactttgggaggccgaggcgggtggatcttgaggtcaggagatcgagaccatcctgtctaacacggtgaaaccccgtctctactaaaaatacaaaaaattatccgggcgtggtggtgggtgcctgtagtcccagctactcgggaggctgaggcaggagaatgctgtgaacccgggaggcagagcttgcagtgagccaagatcgcgccactgcacactccaacctgggtgacagagcgagactccatctcaaaaaaaaaaaagaagaagaaaaactagacaaactaaatttacgagagtttatttgaacaaaaaaggattcacgtattgggtagcattcagaaccagaggagtttcacaaatctcttttgtgcaacagtggccagtgaatatttatagacagaactaccaaataaaatacagaaatagcttgattagttacagttaggtgtttgccttatttggacccagtctgctcagttgactgcttgtcattagctaagagttggctgtttattatactcctaagatacgttttcagtttgcttacgtactcctaagttagattgtagttccttacataggaactcaagatacagagacagcctcaggccaaatttaacttaacactgtgtagtcatattattatcactaaaataatggatacagactgtattttatggtctttaaatatgatatttatttcattaacatcatcattaaatggagcagtcagaagaaactaagaaacattaattttagcaaatgttctctaggatttatggggatttttttcttaatttgcttctaatatgcatgttatgttatcattccttttaagtaataataagtatgaaaatatgttaggattgacaaagaatgcagactttacagaaagaaatctattatttaatagcatctactgaattaattaatgtgtgggtgacatattttacaattttttttttttcttgagacagagtctcgctctgtcgcccaggctggagttcagtggtgtgatctcagctcactgcagcctccacctcctgggtttccagcaattctcctgcctcggcctcccaggcggctgggattacagacacgcaccaccacacccggctaatttatatatatatatatatatatatatttttttttttttagtagagacgaggtttctccatgttagccaagctggtctcaaactcctgacctcaagtgatccgcctgccttggcctcccaaagtgctaggattacaggtgttagccactgcgcctggccagcttttacaaattttatacctgataatagatttcatctgttttaagtaaaaatgcgtagttgacctctgtaagtttacttatgagaagatctgaaatcgcagttatttcttagcatatgacagataggacaagagcttttttttcctccaaattctcaccttataaatttataactttgagtagctgaacttcagtcttctccaaacaccagaagattaactgataaatcacaattctataattatatattttgcaaagaataataattccctggctttttcctccttcattggaactaagttacttaagttatagataattaaaatagtaatataactttctttttttcctggacacagagtcttgctttgttgcccaggctgaagtttagtggcgcagtcttggctcattgcaacctctccctcctgagcagctgggactacaggtgtgcaccacaacacctggctaatttttgtattttttgtagagacagggtttcgccacgttgcccagactggcctcaaactcctggcctcaaatgatctacctgtctcagcctctcaaagtgctgggattacaggcgtgagccaccgtgcctggcctaaaatagtaatgtaactttccattttaggatgtatatgaataacattacttaccttttattcccagaaaatcattcttttctcaagaagaaaatcattgtctcaagaatataagatgatggttctgaaaaagcttctctgtttttggaaagagcattgatttgttccaactccttatatctgtaggcagtcattccttggatggttttattagaatgtataagagccttgaatttagctatattttttttaaattatgtgtttcttgtgtttccgctgtcattcagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaagataagtaacatagctcctaattcactcatttctacctatcttaattacgtttcaaagtatatactcttttataacaaatgagctccataacttaaaagctagataaaaagtattttgtggatttgatgaaaactttcattgttataaatttctttaccaacatcttcttgcttggttttcctggaaatctttcttaggaggatactttttatttccattctgttaatgaaggagtagaaagttgttaaagagaactgtatatcccatgagaaccaaaaatagaagctaataaaattatttcatttctatagtaatctatgaccatacgtacatacaaatatatatatgtaaactgtgagcgtttctgaaatgtttttcctactactctgaggaaaatgaacgtataatcatgaattacattcctcccacaccctttaaattctacatttaatatgggaagattttaactgaatgccctactgttctattcattacgttttaggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagaggtatttggtttttataatatgtgtttttcaacattgtgtggttttttaaaaaaaaaaaatcagtttaattcattttgtagatgacaaaccaaaatgcaactcattaaggcacttgatctttctaagtaggtgtattatcaaggcaagttttaaactcctagtacaatattccttttttttcttttgttatactttaagttctgggatacacgtgcaggatgtgcaggtttgttacacaggtatacacgtgccatggtggtttgctgcacccatcaacccgtcatctacattaggtatttctcctaaagctgtccctcccctagcacctcacccccgacaggccccagtgtgtgatgttcccctccctgtgtccatgtgttctcattgtttaactcccacttatgagtgagaacatgcagtgtttggttttctgttcttgtgttagtccgctgagaatgatggtttccagcttcatctatgtccctgcaaatgacatgaacgcatccttttttatggctacatagtattccatggtgtatatgtgccacattttctttatccagtttatcattgatgggcatttgggttggttccaacactgtgtgcttttaagagaaaataaaaaaacgggggcagtctcttccttatgatcgcaattttaatggttttgaacttttttaaatttaaagagtttttagttttaaatttctttaaatctttccattgcatagagttaaataatatatgatgttcctgtatggatttggaacatgttatctttccttaattcatgagtatctcttcttatggtaatattcatgaagaaacagacttgttaaaaaaaaaaaccatgaataatttcatttattatgaaaggtgtgacagatttgattgattacagcacgggaaaccagcaaaataattcattgtattctatttttattaaagcaaaaaatatatgtactttttgttttctctaattagggatcctcaattcctgagctagcacattctgatgcttaccagactagagaaatatgctccagtggtaagttatataaatatttgtaatgtttgtagtagttgtttaagaaataatagttttttggggactggggtttgatttttttttttttaacagcaaattattttctttattttagattctggatcagactggggtcagggaatttatcttacacacagtcagggatttgacatagcatcagaaggccgaggagaagaaagtgaaagtgcaacagattcctttccaaagaaaataaaggtactaaaagatagataccttttattaactcagccagtgttgtttctatgttgaacatagcagttcattagaagttatatggtgggatcatttctgaagagagaattgcttagctagaaggaatctgagagatctattttatttccacatttcacagataataaagtaagagattaatgataatatgtatgaagactttttttcttaataattcttattcctgatgtattcgtttgccagaatttttaaagtagtctcaaagagtagaagttagagcccatgtatttattttggtcaaatcagtagcttatcagtaaacctaggaagagtacattagccaaacagaaggaacttagagatgagagctatggaaagtcataggccatctgctggggttggcttacccctccacaggaagaaggcattcagtaatgttgggctggagttttctctctgcaagctatcttgcttaaaatttatttctgtttgtaagtctaatttttcagtctgtgaagaagttgtcataattctggctcttgggttttggtttccagggattactgagagctgtccataatgaaggcatgcaggtgctttctctcactgagtctccctatagtgatggagaggaccattctattcagcaggtttcagaaccttggctagaagagagaaaagcttacatcaatacaatctcatctctaaaggatttaattacaaagatgcaactgcaaagagaagccgaggtaaccaaagaatactatgcatttaaatcattttatgtattatttgaacaataataatacattataaattaaattatcttttatacatatttttgcatgaataactatatatatatattttcacacttgaaactcagccagaagcagtgcctcatgcctgtaatcccagcactttgggaggccgaggtgggtggatcacctgaagtcaggagttcaagaccagcctggccaacatgttgaaacccgtctctactaaaaatacaaaaattagccaggcgtggtggtgggtgcctgtaatcccagctactcaggagaatcgcttgaacctgggaggtggaggttgcagtgagctgagatcatgccactgcactccagcctgagcaacagagtgagactgtctcaaaaagaaaaaaataaataaataaaagaagtacacatgctcctaggcttttaattatttttctttgtagattaatatttttagaatgtttttaaaacatgcttatttgaaaactaactatcgttatatgtactttgctaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacaggtataatgaaacttcattttaaaaacactttaatagaaataaggaaatgactattgattttagagtcttaatttaagtatgaaggttaagattttaataggagccactatgaatattttaaaaaaattattgtaactattttaacgtattatgttagaaggtaagaaagactgaaagttaatgagcttattttctaacctaggaaattagaaaaagagcaacagaataatcccaaacaaatttgagagagtaaattctcattatttgcactggttatgttccataaagttgctctgaacattgagcggtcattgctcctaagggaaatacaaggttaggttcctgtaagcctttggtcacaacattttcatcagtcagcacataaccttgtctatatgtgattctattttaagacaccttatttactatatattattgattgattaaccttgaacaccaccaacagcactataactcatgcctgaaaaaaacttgtctgacacacatattttctccttaaggcacatcacagccttctcgtacttaggaacaccataaagcacttcagcactacttttgggggccattctaaacagtgaaatcacaaataaaaggcacaaaaatttgaaaagtcactaagtactctgtaaaaaggacatttgacttcagctggggacacccacattggaccatttaaattttttgctgctgtatgcatttctgtgaaagaccatgaaagcaacacaacaatggatttgggagttacaaatacattttagtgagaaggcaaatctgcaaatatggaatcagaataatgaggattccctttaacgaagaagacgacgtcaatagacacactggtacaataggataaaatgttaaaagttggacatttgaacttttctggagaattggttaagcaaaatgataaagcacacatttttaaagttaggaatgaactaaagatatacctgagatataaaaataatagaatattatgaataatttcatgagagtaaacttaaacacttgggtgaaatggacagattttctaaaaagaaattcacttatgaaaactctttcagtaagaaatagaagacctccaaagacctattactagtaacagaatcaaatcaatagttaaaaatctactcataatacttaacacccagatctttttttttaatatattctccactgaaaagaactaggacttcttgtagaactgatgattctagggatggaccagggaaagtataaggtgagcctggaacatcttgttttgctggcaagtaaggaattgttcaaagaatgaagggaacatgtcgaaaggtcatagaagccagcttgaaggagctccaattgaccaaattctagaaaaatttaaacattatattaaatgatagtgacaaattataagccaaagagtgaaataagaactcatgagaccatactgatataaataaataaatatatatataaataaataaatagtattaccatggaatgacagctagtaaatgtagaaggaacaatgaaattaggaaatcaccctttattaaacactgtagtgttaaatcaccctttattaaacactattcaggcaatagttcgcaacagatgctaaaactagtgtgaaaaggtttgttaagaaagtatatttacatagtctcaaagtaaatccccagaaaatcttctttaattaccagggaaaagcagtaactttacagtggagaaaccttgcagataccaccttaaccaagtgatcagaattactattaccagaaatggaatagacatcatacagttcctaatgtgaagggcacgatgccacttttgtagtgtttttgtcaaatgaatattcagagtctactcttggggaaatatcagaccaaaacaaattgagaacactacatctatcaaaataaaaaatagtgacagcaagtactggagaggatgaaaagaaactgtctcatagattgctggtagcaatgtgaaatgggagggcaatagccaaaaactggaatgttctttgacaggggaatggatggacaaaatgtggtacatccatacaatgaaatattactcagcaattaaaaagaaacaaactatttatgcctacaaccacttgtatgctatataatgctcttaaaatgacaaaattatagtaatagaaagcagatcagtggttgacaggggttagggttagggagagagtttgactacagaggagtttcttcgtggtgagaaaacagttggtactctgatggtagtggtggttacgtgaacctatccatacatgtgatcaaattttgtaggactacacaccaagaaaactaatgatcaaattttgtaggactacacaccaagaaaactaatgtgaaaactaatgaaatctgagtaagccctatagtttggtattgtactaataccattttcctggttttgataatatactatggtaatgcaagatggtatcattgggaaaagctggctaacagatacatgggaactttagctttaattaattcaaaataaaaagttttttaaaattgaggaacgtacaacaaaatagcctgtagtcttcaaaaattcaaggtcatgaaagacaaagaaagacttgggaatatcactttttttctttttgctgtgaagtacatttcacaaaatttgaataggctctgtatatcacataatagtattgtagtaatgttaattccacttttgctaattgtagttatgtaaaagaatgttcttgttttaaggaaatacactctggtatttagaggtaaatgagcatttgtctgcagcatatcctcatacattttggaaaggaaaaataagaaaattttttaaaaaagaaaattttagtatgtgtgttccattcattcttctttagatttcttggttgttaattgtattgcctttacattgctcttcacttgttttttaccttcctttgttacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaaggtatgttgtatgacaagctcatatggttacacaaacaggtgaaaagatttcactttgttttctttcttattattattaagttaaaacatattttcttggtcacattttcttctcattctcataatgttaaggatacaatctatattaattactctaggggttagaggattgtctaattggtttaaacagctacgttgactttaaaataaactgccattcccctgataaggttaagcccattggattcattctttttctttattttagagctgtatgttaagaaaacagtctttccaatcataaaacagaaaatactctttagaggaaaatccacaatgcatgtaactaattattttttaatccttttttaaaaaaattgtgagccataacatacagaaaattacaaattgcaaatatgcagtatgacgcatttttaaatgagtatctatggaaacatcacccatgtgaatatagccagtatcccaacagccccttctcccaagcacatgctcctctgagtaacttagaggtaatcattgttctgatttttctttagttttactatctatttatatattcctaaaacatttaagtttcaagtttttttctgtttttgaactttatcaatctgtatgtattttttatcttgtttctttcacctctctgtaacattcttccaacattcttccaagttactgcatttttcaagttactgcattcttccaaattagtagtagaacattcttccaagttactgcatttatctctagttcattcattcttgttactctataactctatgaccctgtgtagggccaggcacggtggcttacacctgtaatcccagcactttgggaggctgacgtgggtggatcacgaggtcagaagttcaagatgagcctagccaaaatggtgaaacccagtctctactaaaaatacaaaaattagccaggcgtggtggcgggtgcctgtaaggccagccactcaggagactgaagcagagaattacttgaacccagaaggtggaggttgcagtgagctgaaatcacaccactgcactctagcctgagcgacagagcaagactccatctcaaaaaaaaaaaaaaaaaaaagaatttcctgtatagatactccaaaattaatatatccattctattaatatgattgagcatttgggttgtttctactttttagctgtttagctatcaatgttattataaacattgttgtatagtgtttctgctacatatgtgcatgcatcttctgagtatatgactaagagcagaattgctgggtcatggaatgcctatcttagataaggtcaaatgattttcctacatagtcatattagtttatacacttagtagcagtatatgagagttacgttgcttcacatctttgccaacagttagtatagtcagacttctgttgccaatctgatgggtgtgcagtggattcttattgtggttttaattggctgttctctagttcctgaagggtttagtcctttttcatatggtaattggctagttggatttttatttttgtgatatgcttgtttaggtactttttgataacagtatctggtcttttaaattgagctacagatggaaatcattagaaagtaaagtgaaatctaattttcatcatgtccactgaggacacatacctgtgtgttcagtaattttgtgtcatgtactggtagaaacatgtatcctttggaaaattttgaaagtcacagcatggtctcacattggtcattataaagctgaagcaggctgggccctgtggttcacgcctgtaatcccagcactttgggaggccgaggtgggaggatcacgaggtcaggagtacgagaccagcctggccaacatggtgaaaccccatctctactaaaaatacaaaaattagcttggcgtgatgctcggtgcctgtaatcccagctactcgggaggctgaggcaggagaatcgtctgaacttaggaggcagaggttgcaatgagttgggatcgtgccattgtactccagcttggacgacagggcaagactctgtctcaaaaaaaaaaaacaaaaaaaaaaaacaaagcagaagcattcttaccactgagtttaagaaggaaaaaaaaaagcaggttaaaattacttcagaaaagagagtcataatgagataaacatatcactttaaacgtaggcgtaattgaagatgtcttttagagatagattaatattgttttacttaggttaaatagaacaccattgaaagcttaatgtcacagattcacatttatgtaaatccttaacctctaaagtttttagaagcctaaattaaacatgattgattatcatctaaagctaatgttatttctgtctcctaacgtcagtaatatgaattgtaatgtgaattgttgaactttgatagtattttttaagttaaaaatgtttttcttattagagtagtatagtattacatatttatggtagaatacagaaaagaatagagtgaaaatcatcccttgaatcacctaaatcctaaaataatgactacctaacacctgggtaaatatgtctccagaccttttcaatgtgcatgtgtacataagcttgtatttttcataaaaaaggaatcctgatacatattttataacatactttttttcatttaacatactgaggcatttaaaattttcagtttgtttttattgtagcaaacatgtagtaagggtttggttggctttcaatggataaaaggacggtatccaaaggggggtttgaatttcccacttctgggaacagactcctattaaagttccaggggactatctgcagtggggtgctgaacaaaagatatcagcagtgctcatcattgtagtaacttgggtaactcctccaaatactttgtgtgactatcagaaatctttggaattttttaatgtacattcttgaaattctgaatgtacaaatatgagttccatttaaagtttttttttttaattttaagtcttgcatccattaatgtattctcttaaacttttatccttatatatttatagctctgaaatcttggccactagcactatgaggaaaacatgcctgaaatttatttttatacgttaccaaccctttttgtttgtttttttgagacagggtctcactgtcactgaggctggagtacagtggcatggtctcaactcattgcaacctccacctcccgggctcaagcaatccccccacctcagcctcctgagtcgatgggactacaggcacatgccagcacgcccagctaatttttgtatttttagtagagacagagtttcaccatgttgcccaggctggtcttgaactcctggccttaagcagtcctccctcccacctcagcctcccaaagtgctgggattacaggtgtgagccaccatgcctggactgcattaccaactcttgggactataatttttcatgtttcctttgaagtaatctccttaactacaaatcagttcttatcaacaaatatttataaaccaaatatgagttgcttgattatgtttcaaatattaatcatgttctgtgtagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggtgtgccaggcttccttattaaaaacatgtaacaaggagtgggagtaattttgtcataaacactgtgcaaatatagagaaatgtaacatgcatgatatttaaatagcatgcaactgttttttttaggaaaaactataatagaaaaaactctaaatgtttccaaatgatgaacttatgatcgtgattatagcatattctctactgtgacttcagttctgtgtgagacttgtatgaaatagaattttgactttgacctttattttaccatcaaccaatttgaagtgatatttatgaacgcagtagaattcatgattgagtgagctaaaatatgcaaaatatttgaagagacaatgcttgttaaaagaatatatttcttggtataaatactgagatattctgttgccaaagacacattacaactagtcatttttatattgaacattagcttcacacacaaatagatatggtgattcccatgttcagtaaaagacaaaaattttatttactttttatttatttatttattttattttatttttatttaattgttttgagatggaatctcgctctgtcgcccagactggagtgcaatggcatgatattggctcactgcaacctccaccacccgggttcaagtgattctcctgcctcagccttctgagtagctgggattataggcacccgccaccatgcctggctaatttttgtattttcaatagagacagagtttcaccatgttgaccatgctggtctcgcactcctgacctcaggtgacccacccaccacggcctcccaaagtgccgggattacaggtgtgagccaccatgcccagccaaaatttttattaatactattttgtaacaataaattgcatagttgtttgcattgataattaataactagtaattgtactactagaaacagttaatttgaagccaggtgtggtgactaatgcctgtaatcccagcactttgggaggccaaggcaggtggatcacctgaggtcaggagttcaagaccagcctggccaacatggtgaaaccccatctctactaaaaatacaaaaaattagccgggcatgctggcattcacctgtaatcccagctacatgggagggtgaggcaggagaatcacttgaacccgggaggcggaggttacagtgagccaggatcgcgctattgcactccatcctgggtgacaagagggaaactccgtctcaaaaaaaaagaaaaaagagggccgggcgcggtggctcatgcctgtaatccgagcactttgggaggccaagacaggcggatcatgaggtcaggagattgaaaccatcctggccaaaatggtgaaactccatctctactgaaaatacaaaaattagctgggcgtggttgcgggcacctgtagtcccagctacccgggaggctgaggcaggagaattgctttaacccgggaggtggaggttgcagtgagccgagatggcgctactgcactccagcctggcgacagagcgagactccgtctcgaaacaaaacaacaaaaaaaagaaagagttaatttgaaatgaaccccagtcaagaatctttaatagtttatattttcctcttagctagtttattatatgcctcaacttatcagtagaagctgtttttctctctctcattatatgcttcgtcaacatagctttatggaaattcatttgtctttctgacttaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggtactgttatctttgtctttaaatgtctggaaaatccagaatgatagaagagggtcttaaggctttcctccatctaaaatgtcaaccttagacttcttaataagatatggtaagttgttcactgtgcattgaatactacataaaccgtattatgaggaaatgctaatggagtggtgattggttttttttgtttgtttgtttgttttgctacatccaaagatgcatatagactgctctgctgcaacatgttttgggcatgtgaattggtacacacagataaatatggcaatcctgtcagtttaatacagaggtagttttggttcctgttttctcctagggaagaggaacagggatacttttctggagccctcactgcttaagaacatttaaagtgaacattggcccctttcagagagacacacccctgctttgcaaggctctcagctcaaggcaggctgctttgagtatctgcttttaatagaggtggagtatacatgaagtatctgcttttaatagaggtgttgttgtctcactggctcagagctcttctagccacgtaatcctaattctcactaactctgtgctgaaaaacaatgtgttgctggcatttttgcccgattttttatttttaatgtccactgtgttagcctccaggcaaagagaactctctgcccggcagggacatgatatctccctaggtaccaattatagttttttaaccattaaaagtttatgtatattttgagttatttgcccctaaccttgctttcgttataagccctattatttttagcatgtgatactgcaaaacacaaggtttttcaggaactcctatcacattatatcaggaacatttattttttaaacaaatttattaatgtgcacaggaatcttatcaaaacgtaagatctccaggaacagttatatttttaaaggttgttattcttataagaaatgtaccctgcttcatattacttagtgagattaagattttttgagaaaagtattatcttacccttcttttatttatatttcatgattatgcactaactactgaacatttaagttaataaactaaataatcagttctattttctaataaagatactaccaacatagtattaataaaggcatggttgtatacttctgaagttttttttgtttttttttttttttttgagtcaaaagtctcactctgttgctcacgctggagggcagtggtgcaatctaggctcactgcaacctccacctcccgggttcaagcaattcgcctgcctcagcctcccaagtagctgggactacaggcacgtgccattgcacccagctaatttttttgtatttttagtagagacagggtttcaccatgttggccaggctgggcttgaactcttgacctcaggtgatctgcccgcctcggcctcccaaagtgctgggattacaggcgtgagccaccacgcccggccaagtatttttaataatattaacaagttcttaaatttgattttctcgtaccaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgaggtaaactgacagtttctttttagatatttttaaggaaagcactgcagccctttgatcattaaattttgatattggattaaattacttaaatagctatatgtaaatcacttaaaaatgaaatctatagaagtttattggatataaacaataattgtgttcccttaagatagactgtgatatgctgttcacttataattattgttttcttattctgtccaaaattgccagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagaggttagacttttctgcctgatctttgggaaagtagtattcttaggctgggtagaccccatgcctctgggacagctagccaagggtggggaattgaaattttaaaggtaatgcgtgtttacattaggaggtgatattctttaacagaactcaaatgtctgaaaacaactatctaacactttgacccagggaagaaagcatgggatataagggagaagtgataggtgaagtagaacgtcgcctgctctgtaatgtttgtggtagtaaacacccccaattgagaaggtatgttttgactttttgtctttttcttgaagactacagtttgaaacagcagatgatgaagatttcatttgggttcaggaaaatattgatgaaattattttacaactacagaaattaactggccagcaaggtgaagaggtaatactttttaaaagttatttctgaagcattgagagcaaagatttaatagaaactggataatttgaaacttgcagcatattctttatactctttatagagttttatttgtatctttttatttattttaaatatgaataataatgcttgctttcccccaagagaagataatgaaagcttagggggggaattagctttcattattgtcattgaataattatgttgaccttttactgtatggagacaagcttcctgaaagagtgatctggcttctatcctgtctactccatgaaacacccttagactcctacagtgtctaaacaattgactagtctggtgaatcttttcagtttatctcttgacttctttgtagcatttgatacttttgacctgttttattttcttaaaaccctctctttccttgcctgtcatgtcagtattctagcatttcttctgcttctttcatcagttgcctttatgattcctcttcctaccctcttccttcttttctctaacctataactatgaaagctcacacagtccgacaccctgagctctcactagacttatttattaaacaaatacttatattgaacacttattctgtgccagataggttctggagatacagtgaacaaatctgactaaaacctcacccttatggagcttatctttagtggactgtggttctagtctagacttctgtcctgtgttccaggtttatattttcaattagttactaaacatttttccctggggaaatgtaccccatagtgaccccttaggaacctcacaggcacattccaaactgaacaccatcttccctttctacttcctgctccagaccctcatttctagtcatgatattgcccagtttagaaagctgaaagtcaccatagaccactttccttcacccttatctgcacatctagacagtcactaaatcctgtccctcttaccttctaaatacctctcccacacaccctttactttctgtcccttagtcgttgcctccattcaggctttcagcatttcttacctggctgttgaaacaacttcctgataggtctacctgactcgaagattatatcttccctaatttcccctgctttgtacattactaccaaaggaattttcccaacacataaattttgtgtcatatttttgcatcaagcctttcgtgactctccattgcctacatttaggtctgttattcataaagtgaagcaatctagacttaccaggcaacctacaacaccccgaaaacaatacacactcgctcaagccttcgtgccttttgcttaatatgcccttccttatcttttctgcctggtaaatatctacctattactgaatactcaactcaagcaccaattcatgaattctgttgttctcggtgcctattcacactttatatgcattattcacatccatttgtgcttaagtgaccttacaccattttatttttccagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataatgtatgtccatttttagcatctccatatatgagaattagtgcatgcttatcatttctgctgtctagttcaagttttaatcctgttaatgtaaaactatcacacacctgattcttaggatctgtagaaaattttatagggatgacaataataatattattactaagttataataattactgttatttattggaaaccatctctgtactcgactctgggttgtatacatacagaatctctaatccacatccaccttatacctgagaaaactgaattgaagtcgtagtcaaaccaagatacttgtatctccaaagccagatactttgctacctagggaccaacaacagatacacgagatgttcaaatgtgaatcctgactgttctcttcatttaattattagttattgtgttgatgactcaattaaaaggttctgttaaattacgtctttcagtctgaaattactctgagaatttacttaaaatttttccatttaaaaacaggtataaaattaattgctagtttccataatcacccagtataaagatagaaaagacctgtaagacaactgtgtggttaaatacatgataacacatttacgtgccttttatagaaatccacttattatgtacatactggcttgtttttttcccacttctccagtacactatttcaggcacaggctcaaaatttgaacccaaatggtctgttaggtctcttgactttttcagttcaaagctctgctaatctgctaaaccttccctgtggccaggctttctcaaggacttttagttgtaaaactaatgtacttagcaaaggaccatgtacttaagagttagtgtatatgcgtaatgtcaattgagattggctttgaactttgtctgggtggggttagaaagttgagactgcatcatcatgcagatatctttttaatatgtttagctcagacttttcttcagagacttgtgtaagtaggctgtggtctttgcagtcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaaggtaggagacatctcccatctaaacatcacagctggttctatgtttttgccttctttcatctctcactgaccttaaataaacagtctaaagaaatttagggcctggcacagtggttcacgcctatagtcccagcactttgggaggccgagatgggcagatcacgaggtcaggagatcaagaccatcctggctaacacggtgaaaccccgtctctactaaaaatacaaaaacaaaaaattagctgggcgtggtggcgggtgcctgtagtcccagctactgtcccaggcaggagaatcgcttgaacccaggaagcggaggttgcagtgagccgagatcgcgccactgcactccagcctgggccacagagtgagactccgtctcaaaaaaaaaaaaaaaatgtagatagtattcaggttttgtctctaggtctttttattcagtctttgtcatgaatgcaggtcacagaggtttctggaaaggcatgcccaggactgggaccagattaacctttattaatggtcacagtggcagcctgggctcatggttccactttccctggtttcatccctaatagaccaaaagaatggtatcttttcaactcctaacaaaagctctactattgtcaatgtaagaacatcatactctgtaaaatggtaagccctctgaaaagcctctccggtgactaataatgaatgttgttaaaactaccttaatcagtcaacataaaattcaaaacaaaaagaaaaacttttggaacatttattccagtttatgactctgaagggatagaaaacattaacatttaaaaagttagattaggccaggcactggtggctcacacctgtaatcccagcacttcgggaggccaaggtgggtggatcactgaggtcaggagttcgagatcagcctggccaacatggtgaaatcccatctctactagaaatacaaaaattagccaggcatggtggtgggcgcctgtaatcccagccacttggaaggctgaggcaggagaattgcttgaatctgggagacggaggttgcagtgagccgagatcacgccactaaactccagtatgggtgacagagtgagactccgtctcataaatttaaaaaaaaaataaataaataaataaataaataaataaatagatagattagtgaccctaataaaaatagctctgtacaattaaaaaaaaaattgggatgacaaaaatatttgcaattaatatgattaatgagggctaaaacctaaaagaaacaagaagcctaactataatattagtattcagactccattgactaatagaggcaaaagtgtaaaggttaatttatctgaaatttcaactttgctgataaagtagaaaacagtgataggaacctgccgttttactattactactactactactactactactactactactactactaccaccaccaccaccactacttgttaaaatctaggttattttcccctagagagcagggtgaatgttttcttaatgtctttacattcttctcttccctaaatatagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccaggtaaagacttgaaggaaaatgcattttactagtagactctctaaaaggattagttatttttaattctccctctattctctgctggttatactctatatttatatagtaggaggtatgtgccatcactgaagcatgtctgctttttttttctaggttttcattcatttagcaggaatactggcagggtatgtgtaaactatgaaaagggccttcctaggtccaggcagctggtgactcagagctggcctatccaatcacggctgccttttagaaaacaatctgggccaggcgtggtgcctcatgcctgtaatcccagcactttgggaggccaaggcaggcgaatcacaaggtcaggagatcgagaccagcctggccaacatggtgaaaccctatctctactaaaaaaacaaaaaattagctgggcgtagtggcaggcacctgtagtcccagctacttgggagtctgaggcaggagaatcacttgaacctgggcggcggaggttgcggtgagccgagatcggcgccactacactccagccatgtgacagagtgagactctgtcaaaaaaaaaaaaaaaaaaaaaaaaaaggccgggcatggtggctcacacctgtaatcccagcactttgggaggctgaggccggcagatcgtgaggtcaggagattgagaccatcctggctatgctgaaaccccatctctgctaaaagtgtacaaaaaaattagccaggcgtggtggcgggtgcctgtagtcccagctacttgggaggctgaggcaggacaatggcatgaacctgggaggtggagcttgcagtgagctgagatcgcgccactgcactccagcctcggtgacagagcaagactctgtctcaaaaaaaaaaaaaaaatctgaataagcccatgaacaagctcacacatgtaaataaataaaagattataaaatttaaaaatgtggttgacaaattacttcttaggctggcgtacattcattttcttcattgctaagataacccacttttggtgcccagttatggaaggtcctttcctaactgcattcaaatcagaggttagcctttaaggcattggatttttgctttttgctagtgcttttattgttctttctctagtaattccaagcaaagaactctggtattcattctgtctgtgattgacatggagccaagactcaaactactttgaggacctggcccactacagtcttctgacctggttatacgcatacaaacaccaaggcttctccatgcatccccctcccttttaggaggcagacagaatcttaaaggaattttgctttttaaagttatttctatcaggtcacatctgatgctgctttatttatttatttattttttttttttttttttgagacagagtcttgctctgtcgcccaggctggagtgcagtggtgctatctcagctcactgcaagctccgcctcccgggttcatgccattctcctgcctcagcctcctgagtagctgggactacaggcgcccaccaccacacccggctaatttttttgtatttttagtagagactgggtttcactgtgttaaccaggatggtctcgatctcctgacctcatgatccgcccgcctcggcctccgaaagtgctgggattacaggcgtgagccactgcaccggcctatttttctctaaaaatatggcacagttttttaattggaagctgtctgagatcacctagtccagaatctcatttcacacttgaggaaactgaggcagggagcggttacaaagccagtagtgatagagctaggacaaccagcccagtctcccaagtctcattcatgctggctctggaaacaggagcacaagttttatcttaactgtgggccttagaccctccttgcttctgatattccatattgtagtctcctggtttcatttactcttcctcacctttcatttccttcatcaccttgtatagagtaaaccagggtaagtgctggtagatgcattgatgaaaaaatatataatcctgcctaaatacctaaaggcagctcactttctagtggggaagactaatatgcacagaacttagaatataataagtaaatgggaggtcacaggagttagctagtaattttgattagagggatctagagaggcttcatgagagcggtgtagaagttgttattgacatacttcactctgccccactttttcttatccaagattatgtttatcatattttgaccctcctaagatggagccttggaactgattcaaagtaaatcaaaactggtgctccaaaagctccttgggccaagatggggaagaaggtcgtaacttgctgcacctgggtcatgaagctaacactcccattccttttgaaaccaacgtttttttgtccctgatcaaagggacaagagcttcacccaccttgcagcattcccagcacattcttattgccaatttaagggtctttttgttctcttcttatctcatctgccctttattctctgttcttttctcttttcattacttctcaccctttctttgcctatctgcttttcccatctacttttgccttccatctccttataccccatttatccctcaagctggaacctgatgctggcaatataagagacctctaatgcctcttgggaaggggatgaggggattttgagtccctattcttccgttccagttgattttgtcacaacaggcattgacatagtttaactgggcaattgtgaaatttgacatttgttctatgttcatatttaaacgtgtgatgtgatttttgtaggaaatgtatatactgtttatagatgggctgtgaaattttatcttggaatcttttttagaatgaaatttttggttcgacggtggcatcgagtcacaggttctgtttccatcaatattaacagagatggctttggactgaatcaaggtgaagtcaaaatagcatattttcttatgtttatgactctctaaatcagaggtcccccacccccagactatggaccatacttgtctgtggcctgttaggaaccaggccgcacagcagcaggtgagcagcgggcattactgcccgagctccacctcctgtcagatcagccgtggcattagattctcataggagcacaaatcctattgtgaactgcacatgtgaggaatctaggttgtgtgctccttatgagaatctaactaatgcctgattatctggggtggaacagtttcatccagaaaccattctggcccctttgggtccatggaaaaattgtcttccatgaaatgtgtccctggtgccaaaaaggttggggactgctgctctgaattactgcatgtgtaatacttaccaagtaatgaattctggaagcaatgttttccaaagacaaagcccttataactgccaaaactaggtaacttcactgttttaaagagggtaataataactgattttcatggagaacttagtctgcacctggccatgctcttttcatgtattctcccaatcctatgatataagtacagttttactactctcacttttagatgaaaaatcgaggcatggaaaacacaagtcatttgccccagaatggccagtagggaagtgatggaaccaggaccaaacactggcagtctgggtccagagcccacactcttcataactgcatttaaggcacggttcaagacaggattgctgttagtcatatggaagaattaggaagttttcataatttaacaatattcaaacaagtttctgagtttaccaacaggttgtataataatggtaacagctaaaattccttctgtctacacctagaagtggaaacaaactagggcttgaacatttctggcaataaagatgaggtccgaatctggggagcacacagaggacacagcatccctgtgctgtgtattcatagtaaaccacctttacatactctaccaggagctgagcatcctacagaggggaaatagatttggtaccctacacaaagtattttgaaatatcattacactgaaacagctgaaatttgtaccataataagttgtgttttattaaaagttagcaaatcttggtttcaagtcagtagattggaatggttacattggtctaatattttttatccacatcatttcccacaagccacacccactcagacacccctcacctctcatctacttagagctaaggtctttaaagaagaaaatatgccaattaaataattttctttgagacataattccagatatcagaaatactcatattcaaaagtaaacaaaataacatttgaaagccgaatttttgtttgtactgttttctcctttatcaagaataatagaaaatgactataaataggagattgtataatatagtataatagtcttttgagcagttacctattttgtagaaattttttaaggtcttgggattttatttttctttacaaggaatattttgggttactttaggtgcagaaaagactgactcattttatcattcttctggtgggctggagttatatggagaaccaagacatactacgtatcgctcaagatcagatctggactatattaggtcccctttaccatttcagaataggtaagaatatgagaaaacctgcctggaattgttaaatgtattaatatttaacagagataaatggacatttttagggctttgacttctttgcattgagatagacatctttgttatatataatttacataatatgaccaagtgcggtggctcacacctataatcccagcactttgggaggctgaggcgggcagatcatgaggtcaggagttcaagaccagctagttggagactagcctggccaacatggtgaaaccctgtctctactaaaaatacaaaaaattagccaggcgtggtggcaggcgcctgtggtcccagctacttgggaggctgaggcaggagaatggtgtgaacccgggaggcggagctggcagtgagctgagattgtgccactgcactctggcctgggcaacggagcgagactctgtctcaaaaaaaaatacaaaaaaattagccaggcatggtggtgggtgcctgtaatcccagctactcaggaggctgaggcaggagaatcgcttgaactcaggaggtggaggttgcagtgagccgaggtcacgccactgcactctagcctgggcaacaaagcaagatttggtctccaaaaaaaaaaaaaaagaaaaaaaatatacataacctaaggcttaatgtaaaaatgtaaaaaccagtgtttaaatttgtaactgatttccaagggtatagcaaacaagctgaccaagtgttatttagtgtatgctatggttagatattgggaaaagtattgactaaaattgatactctgatcattatgaaaagcttaacagtcttcatgacaagatacatttatacatacccaatttattgagacctctgccacaagcattgtattggacattcttatgttgacttagtagcatctttgaattcattggagagttgtctctttctcatcccaagctccaaagctgaagcttggaggagatacattatgtgtgtacaagtgacccacctttttggggaagggagtggaggcaggttggtaacttatatgcatatttctggataacttgattcatgtacatatttttaatcctttaggtacccaggcactccagctgatttcaatcctggttctttagcatgttctcagcttcagaattacgatcctgacagagccctaacagattatatcactcggctagaggcactgcaaagacgacttggaactatacagtcaggtgctctgagtttaaccacatcttggcagcaccacagtgcgagacccacagctcccctttctttgaaattctttcacactcattaggataatcaaagcttccagtttagtgcatgagctaattattaagttagccaaagcttaaactcttgtaaccagcagagaaactgactttaaataatttaagtgaaaatatgatttatcaccccagatcccactcctcccaaaaatgatttcctactatgttcattcagcggactgatgacacaaaatgcacaatgagcaccagtgtgcaaggtactctgagtctacagagcctaactggagaacgtattcctaagtagcgcatggcagaaagtggtaaggccgtgccgcagcactccagcctgggcagcagagcgagaccctgtctcaaagaaaaaaaaaaaaaaaagaaagtggtaaggcatgcaaatcgggtggagttaaggaggaagcacttactttaagcacttaatgtaaccattatccctgctactatattgtgcttttatgtatcatcgaaaaaaactatcccatttaaaatactttgtaaggattattttttctttgttcaaaaacaaaaaacaagtcatactttaaaataaaggtggattccctgttcatggaaggaaaacctcttttccctatctcacttcagttcactcctgattcagagactttgaatcattgagtagtttatctcttccttcaagaaatcatttgtttacacccaagcatcttgtagtaataggaaacttttattatcatagctgagtttgttggtttgcctaggcttgttttgttttgagcatccaaatttcacaagacccagattttgaagaccaaaagatttttcaaaaatgtatgaggtatagaacatccaactttgagagcactttaaaaaaactctaaatattagtctcacctaccttgccatagagccagtcatggtgatttttacatatatattcaaaatctcttaaaagtcagcttaagtatatgggctgggcgcggtggctcatgcctgtaatcccagcactttgggcggccgaggcaggcggatcactaggtcaggagttcaagaccaaccagttcgagactagcctggccaacatggtgaaaccccgtctccactaaaaatacaaaaatttgctggacatggtggcatgtgtggatagtcccagctactcaggaggctgaggcaggagaatcacttgaacccaggaggcgggggttgcagtgagccaagatcacaccactgaattccagcctgggcaacagagtaacactccaccttgggggtagtggggagagactcagtttaagtatgaagaggacattttaaggaaaaaaagggctttaaaaaaatggagaataataataatttcctttgtgtgaactctggtgggtctgatacaggtagcaatgtaatttgaaatcagttgaatttcctgtttttctctcataggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccaca

SEQ ID NO: 522 - DNA, 5283 bp, Homo sapiens
atgactcgggtgaggcccctggagaccggggccggcgacggatgcagggcggccctcctcactgaggatgcgccacaggtccaggcctctcgagcccctgcgcctgcgctagcattctgccgggaaagccgcctcgtctgtcgactcacttccgcctcctccggtttaagcaccgccttttcgggggttgaagccggaagtggcgcacagccctagcagcaacaacagttttccacgtgcgcgtagggcgccgggatcacgtggggaggcagaagccaatggggaagcgtttcgtgtaggtcttctgaggtggtggcgccagcggctacctcctgcctgtgaggagctggctgagaggggactgggcgccggcggggaaggaggagcgctaggtcggtgtacgaccgagattagggtgcgtgccagctccgggaggccgcggtgaggggccgggcccaagctgccgacccgagccgatcgtcagggtcgccagcgcctcagctctgtggaggagcagcagtagtcggagggtgcaggtgagggacgaggccggggtcgtggggaggggagttcggagggtccccgtagcccaggcctgtctttgtgagctgacttggcctcggtgtccgccacggtcgccgcagggacaatgggctgcatgtttttggccgagagaatggaagaacggagacagccgcatcacagaatcgtgttttgggttgtggcgccggctttcacgggcgccggattagagcccgggtctcgggcagcttctgcggcggggcctgggcgggcagggaaagtgccagtcgcctttaggtgaaggttggagggtctagcccagccgcccaccgaggctggggaataaggcacgggctgctggctggcggggccgtcttggggatgagaagtctgtacaatacaaaactagtctgctaaaaaaaaatcattagatgtccaccttgagaccgtggaataacgtctgctgaaccagtgaggcgcctccctgtcagttttagatccgccctttgactagggagcaacctgcagttgacgcagcgtccatgggacacactgttgtgttccttaaaccgagaagtggttcttgattcttggtacccgtgactacgagtaactctctggaaataagtaatctacctgcctgctaattactctcaggaaaggccgctggagaggaagccaggcaatttccacaaaccgtagtgtttttcgtcagccttattatggcattataggttactaaggactctggtggtcccgtattcaaaaaacaggatccatcccttcgttttgaatctcaagtcattgaatacatattgtcaagaattctaagttaacatttctttaatggtttaaaggtaaaagaaatattttaactactgagtttgtgaaagtaagaatctgccttaaccacagtacaaactatcaaagttcatttttctggcagctttagcagaaatcttaaattctgttcatcatgagttttaaacaatatttagccatgcttcctggttaaacatttgggatcttacatttgggaaaaagacaacattctattgtattgtcagtattagtattgtgatattaagattctctatttgcagtccttggctcacctgctgaaatgaaagctgaatttttggagcgagattaataatactaatttagatatactgggctatttaccttggtgcgccaccttttttttttaatgttttttttttctgtgaagttaaatacattattactttcaggatatgaagtcttgaaaggaaagttgggatcttatattatttggttttctttttttttcttacaatgcttgcatatgatgaatcttcaatataaactggttaaaagtcagttattgataattttctatctcctctgtgtatggccagagtattagtagacagacaaagccaagaattatttttgttctcaataaggttaagccagtttgagagttataaaactaaaagtgaaattacatgtggacaggtaatagatactgtatgcttactattttgatactgcattaggtttaccttgtgttggatttcttttaaaagaaaaacgttttaagattagctccatccataacatttttttttcttttctgttttaggatattagaaatggctactccccagtcaattttcatctttgcaatctgcattttaatgataacagaattaattctggcctcaaaaagctactatgatatcttaggtgtgccaaaatcggcatcagagcgccaaatcaagaaggcctttcacaagttggccatgaagtaccaccctgacaaaaataagagcccggatgctgaagcaaaattcagagagattgcagaaggtaaataaatgacaatctctgaagtgtcatgggtattaactagtaaggagaatgatagctaagaagtgtttgtatttgaaggttttgtggagatgggaggtggagtgggatttatgtataaatattgggtgattctctgagattattttcttatcacagatgctttgattcctgaataaatatatgaaagaataatagataattttattggtatacgtatctaaaaatattgaaaatctattctatattatttataagatcactgttgcttctatgacaaaaaagaattttaggtacccaaaattcttatcaactaacttatgaaacagaatattttacattttaaacattaaagacttaaaaattaaactagactctaaagtgctttattcacttgatctgcttttcaaagccatatttgtcttcaaagaaaaaattggaacaaattttgacttcagactagctctaaaacaaattgcacctgctgagcattcagtaattattgttggatggaggtaactgagtagggagttagaattaaacagtttactttagtaaggaggtgcaaaatcttaattcctattaattggttatagttgatggtttaattttttaatacaattaatgatttcacacgaataatatgaagattaaagaactctgattgttgcccacatgtttatttgtagtaatggtaacatttaataactttattgagtattgcagatggcattgtgccaactgctgataactcagcagttaataagacagtttctgctttattttataattttgattaacttgatgcttatatttgtagtgttttgcttttatttctgatgcgaaattcttccctaaaataatagtattcagttcacttgcttgaagagatttgaatatatgtaattttgaatattttaccttcagttactaaaaatatttttgtcactttcagcatatgaaacactctcagatgctaatagacgaaaagagtatgatacacttggacacagtgcttttactagtggtaaaggacaaagaggtagtggaagttcttttgagcagtcatttaacttcaattttgatgacttatttaaagactttggcttttttggtcaaaaccaaaacactggatccaagaagcgttttgaaaatcatttccagacacgccaggatggtggttccagtagacaaaggcatcatttccaagaattttcttttggaggtggattatttgatgacatgtttgaagatatggagaaaatgttttcttttagtggttttgactctaccaatcagcatacagtacagactgaaaatagatttcatggatctagcaagcactgcaggactgtcactcaacgaagaggaaatatggttactacatacactgactgttcaggacagtagttcttattctattctcactaaatccaactggttgactcttcctcattatctttgatgctaaacaattttctgtgaactattttgacaagtgcatgatttcactttaaacaatttgatatagctattaaatatatttaagggttttttttttttgacaaattcaacattcaacgagtagacaaaatgctaattatttccctgattaggaaagtttctttaaaaaacacgtaattttgcctagtgctttttctctacctgcccttgggctcactaatatcaccagtattattaccaagaaaatattgagtttacctgattaaactttaaaagttaattgtagatttaaattgtgtgaacctaatgatttttgcagtgaaacctttactaattcaaagttgcatgttctatgacatctgtgacttgcgttgcagagtgtacatgaaactgtataattgagtcattcagtaaaggagaacagtatcttggttaattgctactgaaaggttgagaaaggaatggtttgatatttaccacagcgctgtgcctttctacagtagaactggggtaaaggaaatggttttattgcccatagtcatttaggctggaaaaaagttgaaaacttaacgaaatattgccaagagattgttatgtgtttggttccagcctaaaaatgattttgtagtgttgaaatcatagctacttacatagctttttcatatttctttcttagttgttggcactcttaggtcttagtatggatttatgtgtttgtgtgtgtgtagtttatcctctctctcatctttatctagagattgactgatacctcattctgtttgtaaaaccagccagtaatttctgtgcaaccttactatgtgcaatatttttaaatcctgagaaatgtgtgcttttgttttcggatagacttatttctttagttctgcacttttccacattatactccatatgagtattaatcctatggatacatattaaaacaagtgtctcatacaacattgtatgtgagagaaatataaatatttacaacctgatattcgttgttgttttattgttaaaagtttattatgcaactctggaggtatagagggcatataagctatgggacatatgctgatcacaggctatattcatgaagttacttttgaccaacctgaaaactgataggattttgtttgtcatttggtaatttctactgcattcttaccatccttctctcacaaattttgatagcttgaagatctttttaattataattttgttgtatttgtttcctaggagcaagtgttcctgctgccagttctttcctctttaggcgtggttgagaaaaagcagaaactttacataaagctgtatttcttaatcatctttaatttgaaacttaagaaaatgaatttattctgttatatttatgtaacttatttcctggaagttatatctactagttttgtttgataataataaaattagctataccttgaa

SEQ ID NO: 523 - DNA, 101451 bp, Homo sapiens
ggcccaccgccgcccaggcaaggccgccctgccttgggcgcagcgctgccatggctgggggccgtggggcccccgggcgcggccgggacgagcctccggagagctacccgcaacgacaggaccacgagctacaggccctggaggccatttacggcgcggacttccaagacctgcggccggacgcttgcggaccggtaggaacgtggcttgtcaggcccgggctggcgtgccctggcctccccgggccctgggccaaagcccggacacttccagattgggccgccgctttaggatcctgcagtcttttcatcccttaggttccacccatgctcactttagtccttgcacctgcagctggtctgcagaatcccacctaggccgaattcttctacagtcctttccccatgatttccccagaggaatccccctggattcctccctcttacctggcactgcttcttattcctgcctacatcccataacataactgcctccttccaaccttgtcctttttcccctctgaaagcccttgcggatgataccacagcaattcatacgcgccccttgctactttgttctgagaacgctttttgggctctcgcacaggccttacgtcctcaatcagaattctcaagtctcatccatgcattcaaatctgcacgccacataattccctctgtactccccaggcatcctcactgtgttttccggtatggaggaactttccatacctctgcaccttcctctaagacatttagctcagaataaagcacacattcatcttagctgtagtagagagagggttctagactgagtctagagaaggagtgtccaatcttttggcttccctgggccacacacaaaatacactaacactaaggatagctgatgacctaaaagaaaaaaaaaattcgcaaaaaaacctcaatgttttaagaaagtttacgaatgcgtgttgggccacattcaaagcggcccatgggcctcgggttagaccagcttgctctagctctagaccttttaaaatggcattttgtttaaaataatattttgcctttttgtctggaaattaaggcacgttataaagtatttatactgacagttttttccccatccttgaagagttgatctaccaaactatttctgaatattatcatattatcatttaaaacatagttctaacttcatctgctttttttttttttctttttgagacagggtcttgctctgtctcccaagctggagtgcagaggcatgaccacggctcactgcagcttattctcaagcaatccttctgcctcagcctgtcaagtacctgggactacaggcacatgccactacacctggttaatttttttaattttttgtagagacagagtcttgctctgttgcccgggctggtatcaagttcctgagctcatgcaatcctctcaccttggcctctgaaagtgctgggattacaggtgtgggccaccgcgcctggcctcttcatctgcttttaactttggcatttcacaacatctgctctatctacacatccaggatttcctcaagaaataccatcttctggagctatcaggacaaaatattctctctcaaactcagggtgcttcttccttcattaaatatttgttttaggcattaggaatacagctgtgggcaaaacagacaaaaatccttgccctcagggagcttacttttctaatgcttaataatatgaagttatttttaacctgaaatggtaaaaatataaattattccccttaacatgacagagaagttggtgactggggaacttctatcttcccaaaccttgagaatcaggaagtaggcccaagaagcagccaaaataggtgtctcaaagtgtacatgggactcaacacaaagctcctaaggcttcattctgaactagtttgtttactttatacaagcttagttgtctgctcctagggctgcagaaaaatggaagagaaaaagcaacttcttttaggtagggatattgataacctcaagaatttatagctggtggctttcataacaagatggaatactagacaaaccaaagcaaaaactatagaaggcaggcagaagaatttaaatagctgtctgtggcctattgtacaccgggcaaatggcctcaacacattcataggactggcaggcaaataattgatggtctcaaggatgaatcagagtttagtcattcaacaagcacttattatcacctgctatttgccagggaaaagtgatgcaggtccaaaatcctttatccaaaactctttattgagagggagtttctctctgtcgcccgggctggagtgcggtggagcaatctcggctcactgcaacctccacctcccaggttcaagcgattcttgtgcctcagcctcctgagcagctgggattacaggtacccgcctccacacctggctaatttttgtatttttagtagagatggagtttcattatgttggccaggctggtctcgaattcctgacctcaagtcctcccgcctcgcctcccaaagtcctgggattacaggtgtgagccaccgtgcccagccttttatccaaaactcttgagacttgatgggtttcagaattcagaagtgcttctgttcacgtttatgtgtgcacattccacacattacctaataccttcctcagtgtctggggcagcatcgaaaatcaaacacaatgaaacatagaaatactcaaatttcacactgaacaaataaacactataactaacctcatgtcagttcaggctaaatttgctgccaataaattcaggttagatttttttttcaacttcttttagtggggatgtgttgtaatataaatttcagtttagtagcatatgtatatcatttataaataacattttgaggtgcatgctaaaaacttttgcatttgtaaaaagtttagacactgctagtttaaagtatctataatttatagatagttacaaattactaacttattttggctagctttccacagcagcaaaaggtctgctcatttataatttgatagcttttggaaacatccctccaaaaaacttgcttcaatccctggatcccccagtagtgtatggtggtgtttgttttcctttatcttcaacaatactatatatgttagactttttcatctttgccacataaatgaaacatatctcattttaatttttatttatttataaattatctagaacacctttgtttacaaaccattgatttttctttttctgtgaactgctcatactctggtttatttttctactctgtggtccattttcttgtttatttgtaagagctaaatatcttaagaaaactagcattttgggtcatataatgcatatatttttctcctaattatatgcatttatttacgtaatttatgtgatttaaaaaatgttgatagagtcaaaatgaccttttttttcttttatggtccctgtgggttttttttccccctctgttccaatgttactaaaaaccaaattcgtcaaagtttacttttaacttgttcatgacttcgtttttaaattttcatcaaataaagatataagtaggtttttttttttaagttcttcgttccatcaaagtacgggcctaggccacctccccgtgtgcatccctcctcctccagctaggcagctagacaaatataggcaattgaatttttcagtgtcttccactcatttgaaatgccattcctacaagcccagtgcctggtaaaacaaacaaaaaactttcaaaaattgttactgaatgaaataattctcaaatgtatttcaagtctctttttttccttgcctggaatgcttggtctcttggcttgtctcagcttcaatgctacatcctcagatagttcttctttgataaccacatttaagtatataccctcacaccccaagtcgtttgttaaggagagcaccacgtcatctcttcaacggcactctctaagcttgtacttatgtgtttattatgtttgttttcccccaccagactgaagttccatgagagctggaaccatatctgtgttctcacctccgtggactaagcacagtgcctgacacagagtcagtgcttagcaaatatgggtgatggatgtgtgatgggtgaatgagtggatgaaagacctgtggaccaaagagtgcttaacccttccccagaccacattcgcagaattatgctttatggaaggacccacacatttatcaaggattattataaagccatataagaactgatcttacaaattttgtacacatagtagaagagtacagtgtttattatatggtactccttgtaaggttcacgttataaatttctgttagaatttagtattataagtactttgcttccctaaaataatttttaggctttctcttttctgatgataccacgtttctctttttgccctgcctgccaggacattcagagaaaaaaatcaaggctcaatcccagcaacttaggatggcataataaaagagtggcttatgggaggagacagggtttggagttaaggctgggtttgaatcccagctctgtccctgtgtatctgtaggcaagaatgtaaaactccctgagcctgagcttctgtatctgtaaaatggagatgacacctgccttgcaaagttggtaaggtgcctggaccatgggagcgctcagccattgttttttctctcagactccccttgttcattatatacatataatatgaactacttcaaatccactttggaaaaagtgtatctaaattgaagaacaagggtattttgcgatttggtgaaaagtagttgattgaaaacatatgcaattctctccttgtcaagggttttcatttgttaatatctcagtattcagatctcaattcaaatctcccctgctcgcagagtccttcactgacctacctgtccagataccttctcctcgcccaccactatgtccctctactctgctttgttttctttacagcactcatcactatttgaaatcactcgtcttctagtttgtatcagctggttgggactgtgtctgtctaaatttacccctgcactcccagcttccaggagagcacccaggcataataactcagtaacatctgaacgaatggaagctgagtggaacattttggttcattccttagataacttaaaaaaggaaagtgcattttcactggcttaggttttgtttttaaatcatgcttttggaaagtatgccagattatctatttaaaatataattacaaatatttttaaagtagaacttttgatctaaaatgatcattatcttaatcattaatgattggctctacagctttgaaaaaaattttttttgtttttcctcttttaggtcaaagagccccctgaaatcaatttagttttgtaccctcaaggcctaactggtgaagaagtatatgtaaaagtggatttgagggttaaatgcccacctacctatccagatgtgtgagtacatttataaatagctttgacgtggtttcagttttctgttttgacaacatagaaacagattgaaattcgtagtattttctccttcctgctcccattccacataaaatttcatttcctctatttcaacaaaactacatcagcaatagatgttttcatgaaacctgtctcattttaagcctgttcatagttatagaattgtcactacagatacttatatttgcctagtgactattttgcttcctctgatgtgttaacttttgtttatttatttcttcataagttaggaagaggaaaatttggaagaaaacaataaaggcatggtgactgttgaaagcccttgcatagttagagtgtggctggtattagaaattcagcaagtctgtgcctcagatgacctttcactgcctagagtgagggagagtatttggatctgtcctgcctctcaatggggcactctggcgagtgtccattgtgcagggctgtgctgtgcactgcagtacgtttagcatccctggcccccacctaccaatgccacgagtgtcctccaggcattgaaacaaccaaataacctacatatttccagactccctctgaaggtgatgtcacctctggttgagaaaaactagttagagccaaagtgttagccatcagcacttaagcatgtctatttggtgtaatctttccccacccatcccacatggaaaggcaggttggcctggatggcgttaagtagtttgaaattattgtatggggaaccagtgaaggtttttgagatggaaagggacaagtaaaaggaaactctgctttacacagtgggtggtaaatttatggaatttattatcctaagaagtgatagggaggatatgaaaagacagataagtcaaaattgagctccttgaagtcagtaaccattcttggcccccaaaactgtcctgagagtattatagtaggtatactatacatactataaaaatattaattaacgaaacgttaattataaaacattaatgaaaaagataattaaaaatttatgaaaggaaattaaaagagtgcctctctaggttgtttttttttcctgacaccaaatacatgatgccttttctgataccatgtgggtgtccagtagttcagttcaattctgacactatctgtagttagcaaagaccccacagattaaggacccagttccacaagattgcctccatttctgatgctagtggcaagtcccagtacttctgaccatttatagccagtatttataactggctataaatttaggggtttccaccaccccctcctaagttgcgataattgctagaatgcatcacagaactcagtttctgtgagttacatttaccagtttgttgtaaaggatatggctctggaatagccacatggaagtattatgaagggtaaggtgtgtgggaagaggcacagagctcccataccctctccaggcctggcaccctcccagcacctccctgtgttcttcaaccaagaatctccctgaaccctgtcgtttaggggtttttatggaggtttcattatgtagagatgattgattaattaaatctttggccactggtgattgaacttgatcttcagccccctactcctccctaaagatctgggatggggctgaaatttctcaccctgtaatcaaggcttggtttttctggtgaccagtcctgatcctgaagctatccaggtactgaccagagttccctcatgagtactaactccggtatggttggaaggggtttgttatgaaaaacataagatgctcctctcacccctgttgctcaggaaattccaagggtgataggatctctgtgccaggaacaggggtcaaatatcaaatatatatttttttattataccatagcctcaagaattcaaagtgtttattcttgaaaaatcaaaataaagaaaaaggtataagtgctataatgttatataagtgctaaaatattaattatagcattatttgtgaaagcaaagatattggaagcaatctaaatgtcaaatactagagtgaggtttctccaccttggcactactgacatgtgggcagataactctttgttgtggggtccttcctgggcattgtgggatatttagtagcatccctgacctctgtctgctagatgtcgggagtacatttctccccaggttgtggcaaccaaaaaaagtctccagatgttggcagatatcccctggggccaaaatcacccctggttaagaatcatggcactagataactattcaggtaaatcttaatgtgtccacttgataaaaatattatgggatgattgcttttaacatggaaatgcttataaaagttaaaaagcaaacattataatatcagctacataaactatgaattatatagcaaggaaataaagagaacattagaattttttttgaagtttaattagcatcattgatgattttttctccattctgttaatattgctatattatgattacttattttttaaattataacaaaaatcttaatttggggtaatattcttatccttttgaatgtggtacaggaaaacattgcttttctgcagaatagtcctgggtgccactgtgagagagagactcccgggttagattctggaattctggaaatttcagccccatcccagacctttggggaggaattctagaaatttcagccccatcccagctctttggggaggaatctaacccaggattccatacatagagtcaggactgtatggtttgtttttctgttctttccctcatatagactactttctctcagatttctatctatagaaatagataatgatcatagcaccctttcatactgaagcattgagagaacgcatagataagtgcatactcaagacttcactggttaaatgccatgaattactcagaaatgcttggtaaaaagtgatgagtcatcatctcttcagtaaaattaaataactcctatttaatctgagagagttgttattggatatttattggttgggaataaaatgaaacccgagggctggttgtgtaatgtccttgagttgaaagtgttgacttagatgagctctaggcagaggtgcagagagtgtgcatgactagatgtatttatacacaagaagtgagcatttccacctggtttcgatcagaatgagtgattgggatgcagcagtgtgttgtgggaatactagagggatcaccagggctccactcatctatttattcttgttctgctttatgctagagcacacctgaatgcagagcgcttggccttgccagtgagctgtcagagctaggttaattctcattggctgcaagctagggtagagaattaccatacaaaggagcacatggttaagttactgggctagagtcagctgcagaactggaatgatttttttttttttttaaggtgaagaactcagagttagggatccaggtcaaatcgtaggaaataaatagtaattgatgttgggaaattttaatcagattgtaaagctgaaattagatacaggggtcaagcccagtaagtctaacagcccagacagaaggctttggccagcccacttcttccctgtaggacgcaggtgactccactgtcaactggagttgcagggatatggttgaagtccctttgagattaagggccttgggcccagagtgctttcagtttagcaaatattaatgcaaacaggctatactttctggagtaactcttttttttttttttttttttgccttttccagagttcctgaaatagagttaaaaaatgccaaaggtctatcaaatgaaagtgtcaatttgttaaaatctcgcctagaagaactggccaagaaacactgtggggaggtaagatttgttaaactggaattaaaagaagacagtaaacttccccattacacctcaaatccaattttgagtagcatgttttgtgttttattggttctacaaaagggaacattgtgatttttatttatttaataggattaatgaaatttgtagtctatagatggtactattgatgctgaagaatgtttctgaaaattgctaggcatggtggctcacacttgtaattccagcacttggggaggctgaggtgggaggatcacttgagcccagaagtttgagaccagcctgagcaaaatggcgagcacctatctctaaaaaaattaactgggtgtggtggtgtatgcctatagtgcaagctgctcaggaggctgaggtgggagaattgcgtgagcccaggagtttgaggttacagtgagctatgatcacaccccttcactccagcctgggccatagagcaagaccctctctcttaaaaaaaaagaaaaaaagaagaagaatttttctgaaaacagttgatgtgaacccagccatactttttgtatactttggatcttgcatcatgacttgaacctttttgttggaaaatgtgggcagacaaacaatttcggaccacctctcccctttgcatatcagaggaatttgttgttttctttctcaataattagtgacacactctactccttcagtgtctgtcatatacctgagcatttacactgagtgcagtactcattcttttttaatcttctgaacattaggatctacatatgagttctctcctgggtggcacaactctctgtggaaggcaagactaagtgtcttctggaggcagagtatgactgtgctttccttaggccagaccaattccctcgaagtataacgcttctttgccccacttttgtgtaaaatcactcagtgtttttgcctggcagcttatgtttaacgatctctttttttttttttttttgaggcggagtcttgctctgtcacccaggctagagtgcaatggcgcaatctcggctcactgcaagctccgcctcccgggttcgcgccattctcctgcctcagcctcccgagtagctgggactacaggcacccaccaccatgcccggctaattttttttgtatttttagtagagacggggtttcaccgtgttagccaggatggtctcaatctcctgacctcgtggtccacccgcctcggcctcccaaagtgctgggattacaggcgtgagccaccgcacccggccaacgatctctttatgtgaaaactaagaagaggtgccctcggcttccatgtctgtttcagacttttattagacataaccaaagataaccattcatctcatggaaagtaactggacagatttttacttgcttttcataacacaatgagtcatagtacagtccatggaatgccttttagttgtaaaaattgtgtccatttaagttgctgcttccaagaacttcagtgattgatgagatttagaaagtgagtgtagaacggcctggataaaaaactaggccttggaaatgattccaaagttctttctagtacaaggggattccagtgtctaactgaaaagtaatgtgaagttatttggaaaattcagctccagagaaacctctggtttcttggatttttgatttgtgatttaaattttttttttttttctttttgagagacgaagtctcaccatcttgcccaggctggtcccaaactcctggctcaagcaatcttccttcctcagcctcccaaagtgctaggattacaggcccgagccaccacacccagcctgatttaaatttttattttgagataattatatatttatatatacctcttacccagtttgccccgacagtaacagtttgctggaaagaagatcaaattagccaccacattcctttacgccaaagcataatctggatcaaggccctaactctcttcaattctgtgaatgctgagaagagatgagggagctgcagaagaaaagttaaaaggtagcagagattggttcatgaggtttaaggaaagaagccatcttcataacataaaagtgcaaggtgaagcagcatgtgctcatgaggaagcttcagcaagttacccggaaaaacctaagataattgatgaaggtagctacagattttcagtgtagatgaaacagtcttatatggaagaaggtgccatctagaattttcacagctagagaggagaagtcagtgtgtggcttcaaagccttatgaaaggacagactgactcgcttgttaggagctaatacagctgctgacttttcaaaagttgaggccagtgttcacttaccatgcccaaagttccaggaccgttaagaattatgctaaatctcctttgcctgtgctctataaatggaaaggcaaatcctgtatgatggcacatctgttacagcagggtttactgagtattttaagatcattgttgagacctgctgctctgaaaaaaaagattccctttaaaatattattgctcattgacagcgcacctagtcacccaagaattctgaaggagatgtacaaggagattaatgttgttttcatgcctcttaacacaacatccattctgtagcccatggatgaaggagtaattttgactttcaagtgttattatttaagaaatacattttacaagcttattgctgccatagatagtgattcatttgatctgatgtgtcttagcaaagtaaatggaaaaccttctggaaaggattcaccattccagatgccattaaatacatgattcatggaagggggtcaaaacatcaacatgaacaggagtttggaatatgattctgaccctcatggatgactttgaggggttcaagacttcactggaagaagtaactgcagaagtgatggaaatatcaagaagtctattactagaattagaagtggagcttgaagatgtgactgaattgctgcaacctcatgataaaactttaacagatgattagttgcctcttatagattaggagagaaagtggtttcttgagtggttcctgaagatgctgtgaacattgttgaaatgacaatcgagcatttaggatatttcataaactttgttttgaagcagcagcagggttggagaggattgaccccaactttgaaagaagttcaagtgtgactcaaaggctatcaaacagcattgaatgctacagagaaatcttccatgaaaggaagagtcaatcgatgcagcaacttcattgttgtcttcttttaagaaattgccgcaaccaccccagccttcaccagccaccaccttgatcagtcagcagccatcatcaagacaaaaccctctgtctgcaaaaagattatgacgtcctgaaggttcagatgatcattagcattttttagcaataaagtattttaaaattaaggtatatacattgatttctacagacataatgctatttcacacttaatagactaccatatagtgtaaacataacttttatatgcactgggaaaccaaaaactttgtgtgactcgctttattgtgacatttgctttactgaagtggtctggaactgaacctgccatgtctcagagggccgcctgtgctagcattcatctgagtcatcgtcatataatgagatttgaatgggtgttaaacatgggaaggcactgtgcaaatcactcttcttgtttatctaaaattcatttccattaagtctggagtactggaaagtctaaaatagacataattctaaagaaatttttttattttcaagtaaaatagagtataattaggtactaaagcatggcatagggattcatcttggtatggcattcactgatacttgccttttaaaactaggagtcatttaattatttgaatggaaataagtactcaaaaacagcttgttcttaagcacttccaattgcttatgaatgatttttaatctatacacagctctttgtcatgtaaaaataaacttaagtatactctattttttcaaatttgtaaagccaaagtttatttttttattaatttactcaacagatatttattgtctgtgtaccatgtgtcaagtgctattccagcactgggaaaaccacagtgagcaaaccacaccatgggctacactgggaagggaacagacagaaagcaatcaaataactgcacaaccaatcaggcagttataagtgccatgaagaaaatcagggtgagcggtctagagagtgtgacagtggagtggctgttctttacaaggcattcaggagaggcctccaagacttaagcagaggtctgagggaggccagtgagccctgtagcaccaggggagtaggaggcaagagtcagtttggaaagtagttcttttcatccagtcttagaaggtttatcaggttgatttgtacagaaaactctagtaaagtaaatagaacagcaaaagaaaaaccctccacagcttggctcctgcctcctttttggtttagaagtggtttctctttgacatgatagaaattgcctactttccccagctttcattagaagagcttttcttagaataacctgcctcttagactgtagactagtgtttctgactgtaaagtgaaatatatccagtaaatgccacagcttctggtgtaagaaaaaatgcattaacatcacccagcaagagctgtgctttctttgcatttgctccctgagagaaaggcaggataccaaatgaactaactttatatttttgggtacaatgacttctattattatttaccaccctgttaagtccctttagaaacggtttcaaacatataatgaaaataagaattttaaaattgcttcactgtaactgagaaaaaaaatctcaatgttatgttcctcatccaccaaaggatcagcactctttacctctttggggttgggtaaccagtcagggagggtctcagaaatctttgttctattgatttatcaacctaagtatgatttatgtctcctgcgggtaagggaaaggggcttcctgtgttcacataaagaatgtgtgaaagggagacctttttcttccacattctatctgtgactgcttctctaagtggaaataaaatactttctaagtatttatcagctttttattgaccagttactaacaaggagataataaggcctttaaatatttgcctctgtactcccaacaatattttcagtatgctgggtagacagaaaaagctctgatcttagcaatgagtattctctgcccaactctcattatgtggacaggttttctagttgggaagatagcttttactttcatgcagtcttaaatgttttgtcagatttatttctaaagaaatatattttattggatttactatagagaaaatgccaataagttgaataggtctataaaagaaaagtgaagctttttatttacctaggtaatgatctgtcttgataataacacaatgcaatgggccctttaaaagctttttcctgctgtgattatatcatataccgaattcagagtatgtcatatcaaaatgaataatggcattctaagtgggcctctgaccgccagtttgctttcctgttctgtagcctctcctgtttgggccttcccattatttgatcatttgtggttgatttttgtttacatgtttaggtgatgatctttgaactggcttaccacgtgcagtcatttctcagcgagcataacaagccccctcccaagtcttttcatgaagaaatgctggaaaggcgggctcaggaggagcagcagaggctgttggaggccaagcggaaagaagagcaggaggtgagatgcccttgtcgatgtctgtgtgcatggccagcctggaggattgcaaactactgtaggttttatctgtctctgcctacaaacttatctttaagttttgctcagcctttgattcaagaaaggtagacacatgtgagagtatgaaaaatatgagtgattccctcctgacacatatcagtactgtcccttagagccctcagtccaggtcttaaagaaatagaagagaaaagaagctgtttaaccaaaccacctgtggtcttttggagcttgttagggtgtacaggagttcactgcattttagaagctattttcttcttccctgtgcaagactagtatctcatgcccaaatgagtagcaaaagccagagaataatttttttattcaaacatttagatgtatatattatctttgatttaaaggattttaaaaataagacagttaatatctacgcaaacagattaaagaaaaaatacaaagattaaataccatttgtatttaaatcaaagataatatatgcatctaaatggttaccatttgtattttataaactcctgtttatatcctatgctgagattctaaagatttgtttaaattcaagtttgtttaaatacaaatagttaccatttgtatttttctttaatctgtttgcataaagatataaactcttgtcttatttttaaaatcttttaaatcaaagataatatatgcaactaaattcccttttttattttaatttatttttctaaagttttaaattttttatttgttttttctatttagcactttaatcaacttatctagaacttactttgattcaggttataaaaaaagcctaagtatatttttcttagacattttcctaacacatttattaaataataattcttgaagtgattcataatactttctttaaactatatgtttaaaaatagtttaatgtattttaatattaacagcaaacgtgcaagaagtgcacagaagacagataacattaaaaacatgtacttgcatgtaggacaactcagttagaaaagtatactgaggccagttgtggtgtcttgtgcctgcaatcccaggactttgggatgaggcaggtggatcacttgaggccaggagttcgagaccagcctggccaacatggcgaaactctgtctactaaaaatacaaaaattagccgggtgtggtggcaggcacctgtaatcccagccactcaggagtctgaggcacgagaattgctcgaacccgggaggaggaggttgcagtgagccaagatcgtgccattgcactccagcctgggcgacaactagactctgtcttcaaaaaaaaaaaaaaaaagaaaagaaaagaaaaatatagtgaatgggtgtaatctactgtatgataagaatgctacaaaccgtttagttgccatcaataaaaaatgtacttattttgatccttctatatagttcataagcttgatgatcggtgttcacacacatgtgagatacgccacctgtgaaccttgttaggacatcagcacattacccatctgacatgaaagcagaagaaagaaagagaagaatttacttgtttttaaaaaaatccaaatactggcattatccagaaaaatgtaacaggtttatctataattattagaaagttaaactgccgaaacttgttcactgaaacattttgatttgcattaatgctttacatcccccccatttatattaaaaattcacacatgaatgaaaatagaaaaacggccaatacgtgatttctgtcccctctttttccactcacagtcatatatgtaggtaccttttgaccccataggaaaaaaatatttaacattcagaagtatcaggaataataagagaattttttgcggggggagtgaaatttcccatcatagtggattctttttgtttctttgtttgtttgtttgtttttgagacagactttcgctgttgttgccccaggctggagtgcaatgatgtgacctcagctcactgcaacctctgcctcccgggttcaattgattctcctgtctcagcctcccaagtagctgggattacaggcttgagccaccacgcccgacccacagtggattcttaagcacgctctccatgtatgtgtcatgctagctggatatctttcagcacaattgttacatgtttggcatggatagatagcatacaggttggtgttttcaaaaaggccaaccagataggcctcacttgccttctgcaaagcaccaatagctgcactctggaagcacagatctgttttaaaatcctgagcaatttctctcaccagatgctggaggggagtttgcaaatcagttcagtggacttgtggtaacgtctaatttcacagaatgccacagtaccaggcctgaaatgatcggtttcttcactcctccagtagaaggtgcagtcttgcaagcggctttctgtagccagtggcttcaacccaggaggcagaggttgcagtgagccaagagctttaccacctgtggatttgtgggcagtctcctttgtattatacaagccatggtatagagacctccttacttacccccttctccttctgctggagttataggtggtgcagcggcggctgcaaacgcaattctcaagtgcatcttaactgcttacctatactacgttctatttgtcaatgatctgttcaactcatctgttttttcttgaatctctaccacactctttgaattattgtatctttataatgctttaatatctgacaagtcaatcctacccctccccatcccttcatcttccattgtttttgtttctcagccattctcacccatttattcttacagaagatgtacagaattactttcccatagtcaaaacaaaacaaacatcctgggatttttattgattttaaaaaatcttacatatttatttaggaagaattgatatcttcacagtatttagacttcccattcaggattgtttctttttccatccagggctgtttgtttttgttttctgttttttggattttttttcttttttttttttttgagacagcatcgtgctctgtcgcccaggctggagtgcagtggcgcaatcttagctcaccgcagctcaagggatcctcccgcctaagctgcctgagtagctgggactatagccgtacaccactgcacctgcctaattttaaaatttttttgtagagacaagatctccctatgttgccaggctggtcttcaactcctgggctcaaccaatcctctggcctcaacctctcaaagtgttaggattacaggcatgagccaccgtgcccagcaccatttgtatatctatttttattttttgttgaggctttctaattttcttcctacagatattactatttcttaaagttacttttagtgttttgttcttaggttcttatgcttgtctcttttttcattttattttgtttctgcttcattttgtttatcctgtgcttacattaacactgtctttttgtaggtgccattgattttgttacttattttctatttaagtgtgtagcctagttattgttgggagtttgtagttcttttttattatttttattttattttaatttcttgagacagagtcttgctctgttgcccagactggagtacagtggtatgatactggcttactacaacctccatttctcaggttcaagcaattctcctgcctcagcctcccgagtagctgggattacaggcacccaccaccatgcctggctaatttttggacttttagtagagacgggcttttgccacattggccaggctggtctcaaactcctgaccttgtgatccatccaccttggcctcccaaagtgctgggattacaggcatgagctaccgcaccctgccgggagtctgtagtttattattgtccttgttgttaggaaggctaatttttattagaagatagtgactatttagctaacaattttgttttgacatactgctatagctacctataagtttggggtgtgtttttacacattgtattattgctgttatggtttttggtgaatctcttaatagttttgataattataatctggaattttagaggaataatgcaaaatagagatcaaaataccacttttaacattgagaaagctgattagaaaatacaggtgattgaagaatggcaggtaggtatggtacttgggccatggctacctcaggtgcaggcactgaggcttgctcagcccaccttcaccaagctgaccgggacccccatggcagagagcaggcacaagtgcttgttctctgcagataggcagatatcaaacaggaggagctaagacaagtgtcggaagaagtgagaagccaacagtgttgctgtagtggaaatctcctgcacatagaaacatgaagaatggggagtaaatgcccctccccacacacgctcaaacctgtttaaatgggaatgcctattgcgtaagaactctgataaaactgatagaactgcagtttgtactaagatgctgtgttttcagatctcttaggaagagagggtttgaattattgaaagttaaaagatttttctgtagttccataatttatatgttgtatgggtttcagagattggcatttgatgatggtttgatttatttcagcaacgtgaaatcctgcatgagattcagagaaggaaagaagagataaaagaagagaaaaaaaggaaagaaatggctaagcaggtaccctatcaactccaccataataatttacattttgcaaaacaaagtgtttttatttccactgatgacatctgtgttactatcagtaatacagcttaaaataaagcactaaaaataaataaatattcactgtgtatttcagactccctaaataggtggcaaaatttagagttttatgttgtcagtagatgatttagacttacataattactgtaatttatcaaatgagggagggaagagattgcgtctttaataattaacctggactaaaattgttcttttttttgagacagagtctcattctgtcgcccaggctggagtgcagtggtatgatctcagcccactgtaacctccacctcccaggttcaagcaattctcatgcctcagcctcccgagtatctgggattacaggcgtatgccactacgcctggctaatttttgtattttttagtagagatggggttttgccatgttggccaggctggtcctcaacttctggcctcaagtgatccacccaccttggcctcccaaagtgttgggattacaggcgtgagccactgcacctggcctagaattcttaatacttggaaaataaaatgatttgttgatactgaagagggaatagaaaccatatggatctgcctgaaatttcatccagtgatgaaaaagagtaattcaacagagcagatttaaaaggcagtggtgaaaaaggatagagtgctttttcctttatttttcctgagtctagctcaagcaaaaaaccagtcagacgtgtttggagaaattcagagaaaattttactcattctcttttacataaattagagcattaaacttaagggacatgatgtggtagcaggaagaggcactgaagcacaagcaagcttctcctggtttaaagcttcagctttcctgctgcctcactttgtgaccttggcaaggtgacattctctgtgactctctttacttgtcccttaaaatgggactgataatgcctttctttctgtcttgtataattacctccacagataagtgtactgccctatgtgaaactaaacctgcgtaaaaatgtaagatgagatccctgtttccaccagtgctcctgtcttgctcctgacctgccttcctgtcagccactctctgccctctctttgattctcccttcttctgttcatctcctgttactcttctccctaactttttacactattgcaagattctaagcattttcatttataaaatttacattttcttgaaaccataacctggacttcagttcttgagccagtacatatttaggcattaacatttttttaattttattttttaattgaccaataatagttgtatatattcatggagtatatagtgaagttttgatacatataatgtatagtgatcggatcagggtaattagcacatccgtcactgcaaatatttagcatttctttgtgttggaaacattcaatatcctccttctagctattttaaacgattaaaagttaagttcaattttatttcacttgtaaacattcagcttaaaatttgcattctatactgaattaataattatgtaccatgattttcttccatgtatgacttacatctaaagtaagttttacttttcttgttctaggaacgtttggaaattgctagtttgtcaaaccaagatcatacctctaagaaggacccaggaggacacagaacggctgccattctacatggaggctctcctgactttgtaggaaatggtaaacatcgggcaaactcctcaggaaggtctaggtaagtccctgggatttctgatctgggagaatgacagatgtagaaggattttactacattgaagatgtagtgaaatttgatggaaatttcaggcgatagtcttaataacttttttcaaaccttatatatcttaatatattagcaatatattaggtgtatttttagcaatatgaaactaaattgcgtttaacactttccaagtatctatcatgaatctagttttgttgctcattccctttttttttttttttttttgagacggtgtctcgctctgtcacccaggctgcagtgcaatggcacgggctcagctcactgcaacctctgccttctgggttcaagcgattctcctgcctcagcctcccaagtagctgggactacaggcatgtgccaccacacctggctaatttttgtatgtttagtagagttggggtttcactgtgttggccaggctggtctcgaactcctgacctcgtgatccacccgcctcggcctcccaaaatgctgggattacaggcatgagccaccacacccagcctcattcccctttataacagcctataacacatcacaaacttgccttagtacgatttaacatttataaacttaaattcagtaagtgattttaaaatttttcttccatttgaatcatcatcatccagtgtttcagtctacaatgccttaggtcccaccacagttgtaaggagtgcctgaaaatgagcacaggtgagacatctgttacatgagagtaggaaccccagttggctgccaggggtcccctccctaatactgaggtgggctcctgggctgttccctgtcaccactggtcacttaaaagatactacttgttcttctatatctttttcactgaagaattccaactttgctctctatttgctgtggccccctgtacaccagaaaggaattttggtgaagaaaccatttatgagtggggtgggttattaaatagtgtagggacttcaaccttcattgtatgtttaaattatctcttgtgagactctaagcacaacttaaaaccaccactttgcttccatgaaaagaaacattttaggcaccaaactgaagatttatataaacttctgtatagtttgtttattagaaggagccattttagttctttccctaattatctactactaaaaaaacagttcagaaatcattttgacactaatgtttacctactattaggtttaactaaatttttaaaaaaatactgtttctggtaaccattcctttttaagattataactccttcccaatttaaattatttttgaatctgggcttctaataagcaacagagtttgaagttgtcagagaatttcactaggaaatatctaacaaatttttgttgtattagaacctttgaattaaatcaatgatataaataagtcttttcagatatatggaagatgattgttttaagtttaaacatttctatttttgtggctaactataaacagtgaatccaaggttaggcttgtttttgagatcagagatagcacgctgggcacggtggctcatgtgtgtgaccccaacactttgggatgccaaggctgaaggatcacttgagcccaggagttcaagaccagcctgggcaacaaactccttcccatctcagagcctctgccgacccctctgcctggactactcaacctctggcattttgcttgctgagcccctccttctcattcagttctcccctcaaatgcaaccttctcagggatgccttcctgagcccccctctaccctatttccctgctttgtcccttgctctccaattctctgctttattttttacataacacttagcactagctgaaattgttattcacttgtttactttggaatgtgaggtctgtgagagcaaagccctcatctgtgttttcctcaaagcctgaaatcgtgcctggaagacacatggtaggtgcctggtcaacatctgatgcagggagggagccagggagggaagatgacacagggaaagtgggacactgtgtttctggtgtttgtagggtctacagcctctttaaccagggcagttttgcttctcttgatctgtggggtatgtaaaaaaccagtgaggttttatttaacaaaagatgttcacgctgaaaagaagagaaagagagaaaagagaaccactcactattctagtggaaagaacgtaaaggcctgatactcaaaggcttttcactgatgagtcttggcttttgttgaagaactttattttctgtgcttcaagtcttcttttcccaccttgaaggattcactttttagaatattaaggtaaaaatcaaaaaacataaaattagctattttaatgtgtacagttcagcgtgaggctgtatttgtgaagtgcagacatagtccccccaacccactgccttgtttctgggatgttgctcctcataagtgggcaatatgaattttgtagaagaagcaaaactaaaaaaccaaaaaacctctataaaatagctcatggtagaaaattaccttcacatattcagacttgctgtctttgcagattaccgtagtgtagcccagaatctagaatatatcacctatttatatctaccatcaacaagattaggttatctagtttgttttccctattctaaagccaggtatggtaactgctggctcctcacccttacagagaagagatcattaagggtataagacatgggattctctctgctctcctcaaaaaacttggggaaccattaaagtataaaggtgtaggggagagaggatccttgatacgtctctccagacatggtcctctgttgttcagtttctgtggttggttccatggaggcatagactggtttacctcaaattaaacaatatcaggaattcttactaatgttgtctctacaaagtggctctgtgtttcaaattaagggacctagaactagcattttctgtggcatcttggtgagttagacaggaaggtgagactatccctgcccctgtgtctcagataagatcctctttctccctcctgccccaacatctacacattgatcataatggtagagcaatcttttggatggtagcccaattctctagtccccacttgaaaaattgtcatctctcttcttgccacttggctttttaaaaaaaaaaagattatccttttttcttttttcaggtatcaagctcctagctgcctaatttagtcatctaaaattgtattatgtttctctgttctttttaaagacctagattaatactatttggtaattttatttgaaacacccttcatataggttgggaactgccacagatacttggcaaaactgataacatgggtgatatttttaatattatgataatattgcaaacctcatgaacatccatactctagaatagatcatgatgatgagaccagagtcatagcttctgaacaccatttgtttgcactgtttctgctggagtacagaagtcgttttacttatgaatggattcaaatccaaaaggttgttccaagcccagttcttgatgggtcccaggtagacagtataagcatccaatatatatgaatctttttggcgaaaacaatagatatggatgacattgcatttgtctctttattccttcttttcaaactctgtgatttactttttatccttcagaattgtttctgctacaacctgtgccatgcagcatgtaccacatttgtcgttttcttactttcacttttatctctacttttctttcaatcctagttattccttaatcttacagccatcaacactcattgtgtttgtacttatcagtcataatagggtgattcacattctaaaactccttaaaaccaagcatttacacattgtaaacttaagaacagaaagatggcctagactaaaatgaccattagcaccatctgctgaggaggccagagctgatgtagagatgcttctgcatagtttatgttactaagtctagcatgtaattttaaatctttgcttttatccttttctccataaatctcagtgtgtccctagttgcacacataactttagaagtagaaatttgaacagaactacaatgtatttgctgttttctgatgtttagaatatgtggacatgggccaggtgtggtggctcatgcctgtaatcccagcactttgggaggccaaggcgggcagatcacgaggtcaggagatcgagaccagcctggctaacacggtgaaaccctgtctctactaaaaatacaaaaaaattagctaggcatggtggcgggggcctatagtcccagctactcaggaggctgaggcaggagaatggtgtgaacccgggaggcggagcttgcagtgagccaagatcgcgccactgcactccagcctgggcgacagagcgagactccatctcaaaaaaaaaaaaaaaaaaaagaatatgtggacatatgtgtggtgtaagatatgagtatcataatacataatcttgtcaccagtgtaggaggggtttgaggaaagagaggatgtgtaggattggaagcagaaagaccagataataacagagtattgcatatgtccaggagaaagttggagatgaactaaacagggcaggggagatagagaggagaaggtggtacttgaagaccaattagatgcagatgtaggagcccaaggagactcacaggtttctcacctgtgagacagaatggatgactatgcccctaaccaaaattaaagagtcaaggggaaaaatcaggtttagagcgagtggagggagtggcagttttattgacgttgcaatggtgtgagggataaatagtgcagaagtggagacaggaagtgcagtaatgtgactatgaggaacaggatggggcgggtggtgcagggttgagggaggggaatgtatggatcagagagatttataggctggtgggagggaacccagagagaggggctgactgaacatctgggagaaagggactaactaatagactaagatcccagaggagacctttgtaggggatgggactgaggacaggggtagccatccttcctcaaagtcacccacaaagaaagaatagtgccaatgccaagtaactttataggaggaacaatagaaattgtggactgtattcctcttgcctcgtgttctcagtgaaagtaaaagtcaaaatcatgctgagaatgagagggtgatctctctagagatctgtccatgcacgtcatcgaagtgtttctgataagtgttcaatcctgaccatcaagagctctctcccttgcctcttccctgcaaccctctcccctaatttattgtttttgcattatgatctagtttcttagctcttgctcccaccagaaaaaaagtagaaaaaaagaaagagaggagaggctgggttttaagtgttttggagaagtcatggaagggaatgatgggaatatctaccaaagacaagcaagagaaggaatgtgcactcaatggctggaggcccagttggaaaccaggaatttgtggcagctccaaccccctctgttttgcagctttctccagatgtgcatgtgcgtgggaatgaagcaatatgggatacctgtggaattgatctaaatcactgctgaccagtagaactttttatgataatggaaatgatctgtatctgtgctgtccaatatagtagccactagccatgtatggctattgagtacttaaatgtggctactgcacatgagctgaattttcagttttattttaatagccacagcattgggcagcacagacctcgagttaggggtttgtggttttcatgtggagaagatgacaatgggaagtgggggaagtgaatggctttcccattagcaccgcctactcaattcccagtagaaacagatgttagactgcgagtgggctaataaacagtaataaacgggagaaaatggaggggcattcttgcctatgttaatctataacattcctatgttaatcttaaagaaaaaaatgaaaaatgattgttcaaatgtattgttcaaatttatttttaaggcgagaacgtcagtattctgtatgtaatagtgaagattctcctggctcttgtgaaattctgtatttcaatatggggagtcctgatcagctcatggtgcacaaagggaaatgtattggtgagtaaactagcaaaatctattcatattattgtaatggcaaaagttaatcacaaaggaatgggatggattagacactgtgtcattcagaccagtgcagtccaaggaagaccatcaagctggtagtcattctggctcccatccttaatgactggaatgagaaatcactcaggtttcctctaatgtaagatggaaataaaaacctgtgtttttgtctgggcaccgtggctatgcctataatcccaatactttggggggccgaggtggaaggattgcttgagtccaggagttcaaagctgcagtgagctgtgatcatgccactgcactccagtgtgagtgacagaatgagaccctgtctcaataaaataaaataaaatttaaaaacctgtgctcttggaatattattaacataacgatcattttaaatctgtcatcattataattatccaagcttattgaaacaaaaaaatgattaaaatattatcagtcagtagaattttacatcatatacagctaatgctgatcaaatgtatgtaacaaagtgaattctaatgcctatgatcttttttgttgttgagacagggtgttgctccatcactaggctggagtggtacagtggcacaatcatagctcactgtaacctcaaactcctgggctcactcaatattctcccctcagcctcctgaatagctaggactacagtaatgtctgtggtctttattgaccagatctcattttcttaagtggatatccatccatttggcattttcctgcttgacatattatacctgaccaagaagaccaccttattttctatatgccttatttagaagttttgtctactcgtggctgtttggcgtgaagctggttcagcaaatcagaatttgaattgctcatactaaagtcaagtttttggtatttcttcctttaccctaaatgtatgtcatctttacccagccttacagataaaaccagtaattggtatagaaaccatttgtacatagtgaatttggcaattaactttcattttcaatcccatgcatatttttgccagaagtaacaggtagccaaattatgtgaaatgagtttgctttcttttgggatcttttccccttcctctttaaggagatacaaataagcaaaagagttgccaggaagcagccagcaggtggagggagaagaaaccaaacttctcaataatctatgagctaaatacttaaccttggcagacacacagcagcctggacagtaaaggatcctgcacatagacagagctgccatatttagacaaaggaatcattgggcaggttcaagacattggtagtggtggttggctttagacctgagactgtccttgactcagacatttcagattcatgaagtgacaacataaaactacttctaataacctggggaaatcaagaaggcaaattaattcaattcttattaccttaacttagtctcttattctcactggtactcattagacagattcaccatagttaatacccttattaggaggcacattttcagttggagaatttttaataaaattaccaagtaaattattcattttgttttctcacagtgggtctgattttttaaaatatgccctaattgtctatgaaatgtttttataaaagattaactactaatttttttattttcaatgaagtatttttataaaaaacaatatttgtttttcattttaaagttgttagaactagacagaggagagaacttacttatagatatgactatagcactatagagactgtctgcataaatgatcattgtgggcatatagggtttcagttagagttcttttgataatgtattttctcttagcctcgtctcagtatattcttttgtcccttttattattcccatcatgaaaaactgacaagaagagtctggcaatactaaaattataattttttaaaccccagcaactatgaaatgcctgcctagtcccaattagggaaacaaatattgcaaaacactgtactgcataacacacaaatttaattaggctttatgtaaataacgtcttactccatcccataaacatttaatgccatgtgtttctagtagactgcttagatcccacatttctcaggttgcttcgtttggttgacaaatttttaaacagcaggattttttccccttaggcaaagactgtcaggagttatttatgactaacagatcattttaattaaaatctctaaattatcagcattcccatgaaataaaaactgcttgtcagataaaaagtcaaagtgagctagttcagccatatttttccaaagtatttttgctgagacatctttatcatgtatatgcaggttacttcacctttgattattcaaatagaaaagataattagcaatgtctctttaaaaatttgttttcattatgaagatagtatagcatcatggaaaactattatttatataagagaaaaaggcagattactatatatcggggttatcagctgggggccattttgtagcctgcaggacatttgatgatgtctgcacacatttttgatggctaacattggggtcggggtgctattggcatctagtgggtagataccaggattgctgctaaaatcctacagtgcacaaaacagctgcctacaacaaagattacctggtccaaaatgtcatagtgtcaaggtgttatatatatgctatgatatggtaaattatggggtaaaggagaatagagggaactaaaagaaaaataaaacaagtggtgatttttttctccttttccaattttttagaattttctattatggttttaatgaaaatagagatttttataagaaaatttttggtgttacagaaatttagctctccctgtgtaagtgagaaccatatgactatcactaaataaatgtgtctcattttctagcttcaaatctaaactgtcatctcttgttctttccttccaaagcattgaccagtttgtatttactgagcatattcaaattttgcacttagaaagtcattgatgtattcagattttcaaattactgttttactgtgcacactaatctataatgatctcgatggcttgttctctattttcatattctttctgtcattttagttggtatttagctgtatgagtgtacaccagtagacacagtcagcaaaggtagactcgttatgaaaataacattgtgcataatggctagtagcataaaacactggcctcttttgttttttgagacagagtcttgctcttgtcgcccaggctggagtgcaatggtgcgttgtaggctcactgcaacctccgcctcccaggttcaagcgattctcctgcctcagcctcccaagtagctgagactccaagtgcccgccaccaaacctggctaatttttttgtatttttagtagcgacggggtttcaccatgttgtccaggctggtctcgaactcctgacctcaggtgatccatctgccttggccttccaaaatgctgggattacaggcgtgagccaccacgcctggccaaacattggtctctttatttgcctgatactaagatctcattgtagattcttgccccttataaaaaattattttaggactcaggtatattgctaaatatcaaaaattgtttacaaaaggacattattacataaagtcctattttccatagttagcgcatggtatccattgttgaactaaagaatgtgtattaccccctcccttccttcccccaagagaaaacataccagtgggatttaattacactttctgtttaatgtgcaggcagtgatgaacaacttggaaaattagtctacaatgctttggaaacagccactggtggctttgtcttgttgtatgagtgggtccttcagtggcagaaaaaaatgggtccattccttaccagtcaagaaaaagagaagattgataagtgcaaaaagcaggtaagcatccaaggtggctgactgagcaaaaggcctaatctcaggctttaggagatgacagaacaaaatagccctgcatttgtttgccctgcagagatggtccagagcagtatgagaactgtttgaccagggaggacagtgaaggaccagtacctctttgccccttgcctctggtttcagaactttcacaacatgatcaaagcacttccagctgccttcttaacctcctttcttagcccttagtatggcattaacagtcatctttccaactgggactaaatactagttcataattgggtttttttgcaattcttcttttccctactcttgaaatattgcttcagggctgggtgtagtgactcatacctgtaatcccagcactttgggaggccaaggtaggaggactacttgagcccaggaggttgagaccagtctgggcaacatggtgaaaccctgtctctacaaaaaatttaaaaatctgtgggcatggtggcacatacttgtggtcccagctgcttgggaggctgaggtgggataattgcttgagcccgggaggctgaggtgggataattgcttgagcccaggaggttgaggctgcagtgagctgtgttcatgccactgaactgcaacctgggtgatagagcaagaccctgtctccaaaaaaaaaaaaagaaaagaaaaatactgcttcaaaactgaattttgggggaccggaggatttttaagttaatttataaattatgatttataaccaagcataaggagaacattcagtattgcatattgcagtgttacataataacaaggtttacaaaaacgtagataaagcatggtgttcagaaatgtgtgtgtatttaagtatagaaagaaaactgaaagtaaatgtgccaaaatcttgagttatcactgggtggtgaccacatagataacatgtgggtattttctatcaaactaattttttaaatgttgacaatgatctttattaaatcagaaaagattttttttttctgtcttcaaccttaactcctctttgccatgtgaggttctgaggattaggatgtggccattattctgctgctcaaatcatatactatatttttaaaaacccaaatacaaagctaatcagaaaaggttatttttaaattaaagtttgttttttctagtggctatacctcaaaagaattttattttaaaaactgttcactaattttgtagtatatgcatagtaggttttgagattagagaagttgagaattagctaaattttttccatctttatgaactattagattgaccatatggtttggggaggattcagtttagggcatatttgttctcctctcatttgaaagtatattttctatcaaatacttcacttttggttttggttttgtttttttatgcccccatcttgtatgatcaaatacttcacttttgaaatgaaacccaagttaatgttgactggcccaatattctttttttttttttttaacttatcagattcaaggaacagaaacagaattcaactcactggtaaaattgagccatccaaatgtagtacgctaccttgcaatgaatctcaaagagcaagacgactccatcgtggtggacattttagtggagcacattagtggggtctctcttgctgcacacctgagccactcaggccccatccctgtgcatcagcttcgcaggtacacagctcagctcctgtcaggccttgattatctgcacagcaattctgtggtgcataaggtcctgagtgcatctaatgtcttggtggatgcagaaggcaccgtcaagattacggactatagcatttctaagcgcctcgcagacatttgcaaggaggatgtgtttgagcaaacccgagttcgttttagtgacaatgctctgccttataaaacggggaagaaaggagatgtttggcgtcttggccttctgctgctgtccctcagccaaggacaggaatgtggagagtaccctgtgaccatccctagtgacttaccagctgactttcaagattttctaaagaagtgagtatcactgagattctctctaatagcactttactcctgtacttttgattgtgctggagtgtgccagacatctaagtgatgtggaagctgagaagtgaggaacaggacttcattctttgctctcccaatcctgtcctagtctcatatgttctgttttctcatgtaggttggtgattctcttaactaccacattctctgaaattcacttggaattcacacttgattttcaaactccttttgggggactgatgggatactcttggaagtcaatagagatggttatggtgagaaatgccctaggtattccaaatactgacctttgctctggttcctaaagggtcaaagacgaggctccttattcaaaaacagctttgggagtgagattctgccccttgtgcttcttaaccattcttcattggctgtctcattcatttaagttgtagaatgcaaataacttccttagtctagccagaggagtttcaatacctgtaaatcacaggtgcatgtttaattacaaagccaagttttatccaatttgggagaacccttcttgagatgtttcctcaggcctaagatgtttgtccaggtccttcacttaagtgttttctaatttcgtcctgcctctgttttcagtccaagccagagctaagttctgtcagtttctgttaaatgggagataagatcccttcagtctggatttttccagatgctcctctggtccagctatcctgcaggagttgacctgggctggtttcttccctttctgacactctttgttttttaccttctttttcccaatcatttgcttttattcacttcttccatttgcaacatttcttttacccttcacatttctttccctattccacctatcgcagtagccagttggcctggtttacattgttatgctctgtcactgatggtcttaccattacagatgtgaaagtagctgcacctgtgtttgagattgtttttgtgtaaagtgaatatgatatatatatatatatatacacacacatacatacagttgtggaaaggggccaagtttgattctttatgttggtttctcgccttgaagtatatgaaaatattaagatttctaaagaaatcttttatggtatctttttaatgcaatggagctttaaacatatttatttaaatgcaccctaacaatgaggttggccaaaatgacaaatatgatgatagaatcacagatggaaagtttcatttccatcttcaaaatgtcacctttagtgttctgccttcttcattgatgaagagtaatttagtcaaggttagcaatagcatcatgtgttgttaaaaacagtactgggaggtttaagtagaagtacctttcctttcccgtttagtagcaaaatgaatgggctcggtaggtaaaactttcctagttctcttcttaaatagctgtatgctctgtcagttttaaacttgagatcagcacaatttcttattcttttttttttttttttttttttgagatggagtctggctgtgtcgcccaggctggagtgcagtggtacgatctcagcttcctgcaagctccgcctcccaggttcacgccattctcctgcctcagcctcctgagtagctgggtctacaggcgcccgctactacacccggctaatgttttgtatttttagtagagacagggtttcaccatgttagccaggatggtctcaatctcctgacctcgtgatccgcccacctcggcctcccaaagtgctgggattacaggcgtgagccatagcgcatggccttcttattcttttaacaagatttttctttagactattttgtatacttctctccctggagtggtttgatagactgtgcttggttaaggagctgccaagaactgtttttatgaactttgctgtccagccctggttaacaaaagaaaaatgccattcacaaagaatgaaaacagcaaccttccatttgtagttatatttttacatattagtgaacaccctttggagcaagattttgtttcaaatcagcctctgtgatgggtaagactctggagtcaaaacatctgggttcaggtctcacctctatgtcctactggctgagtgaattaaccccctgccctgcgtttcctcctctgtgaaactgggataatagcactgcctacctcatgaggtggttgtgaggattaaattagttaacagccataaagtgcctggcacttggcccagactgagtcagtgctggttttcatcaccatcctcagtagtgagaactatgaagaaatgtgggtgttgccaggcattttatccctttttgttcaaagctgaaccttttctatatacggctaccctgttgccaaaattattgattcagagaagttcatttttaaagtgagatcttggtggctataaatctcttaaaaatactgtgcattctaggtaggctgtaacatttttctgatccagatttactttcaagtcaataacatttatgtcacagttgagttacagttgataacgcaattcagaaacccaacagggcatatatagggatgctcattgcagcattttgtgaaaatgtgaaaaattggaaataatctcaacagtaggagaatgtgtaaataaattctggtaggtccacgcctatacagaagtttaaaaaaaatctttaagtactggcttagaaagagctccaagacacatggtggaatgaaaaaagcaagctgaagaataatgtatataagatgatattgcttaaaaaaatcaaaaaacaatactattttgtttggatggttgtatgtttatgtgtataaatgcatagaaaaatctctacaatgagacaccctaagtggaagaaagaattggaaggggaggttggtcaaaggctttatcattatcagtaatgttttaatatttgcaaggagaaggtatatatgttttaatgatataattaaaaagtaattttaaatttaaaggaaaatacggtatcttatacaaatggttttattagaatttttttgcctgttcaagctatgaaattaggagtaccttgctttttactgctgcaacataaaaaaaagttaccatttatgatagttgctgtcaccactttgtatgtatagatttttaagtccagaactcacaacgacagttgattcttttaagtatattgttttaattataggtcaagtgctaccaagtcgtactacttgggccgttgtaatgaaagtagcttggcatggtggttcatgcctgtaatcccagcattgcaggaggcctaggtgagagtatctcttgagtccaggagttcaagacctgcctgggcaacatagtaagacctcatctctacttttttaagtattccagcacagcagggcgtgatacctcacacctgtaatcccagcactttgggaggctgaggcaggcagatcacttgaggtcaggagttcaagaccagcctggccaacatggcaaaaccccatatctactaaaaagacaaaaattagccatgcatggtgacactcacctgtaatcccagctacttgagagcctgaagcaggagaatcgcttgaacctgggaggtagaggttgcaggttgcagtgagccaagatagtgccactgcactccagcctgggcaagagagcaagacttcgtctcataataaaataaaataaaatgaaaataaataaacaaaacattccagcatggtggtacacgcctgtagtcccagttactcaggaggctgaggcaagaggatgctttgagtctaggagttcgaggctgccatgagtgatgatcgcaacactgctttccagcttgggtgacagagcaaaaccttatctcaaaaaaaaaaattaaaattaaaaaaaaaggccagcttaaatcagttacagtttaactacttagactttaacttagactttagcttgcattgaaatcatttggagctcttgttaaagcacagatcactgtccaaacctccagagatgctgatttactaggtcaggggtatagtagaatttgtatttctaacattttttaggggatactgatgctactggccagggaccccactttgagaagccctgggttaaaggtatggcttgtttttcttcattaaaaaacaaaacaagaattgtctattacaccattaaacagtaagttaatgggttcaaggaatgaagattaaaagaaagtatatgaggccgggcacggtggctcacgcctgtaatcccagcactttgggaggccgagacaggcagattgtttgagctcaggagttggagaccagcctgggcagtgtggtgaaaccctatctctacaaaaaatataaaaattagccaggcctggtggtgcctgcctgtagtcccagctactgagatgggaggattgcttgagcccgggaggcagaagttggaatgagctgagatcacaccactgcactgcagcctgggcgatacggcaagaccctatttcaaaaaaaaaaaaaaagcataaaccaatttttaaaaaaagtatgcaatagaatatgggactttaaaaaagccttccctaaatgtttccaacttgcttcatcctgtaatgagcaggcttcatctaaagctcgtcatactgagccactctgctgcaccaactctctgatttgctttgtctttcgaaagctttatttataaccggttcctgcaaaggcttagtttggcatgacaaggcattaaactgttcatcgaggtgaaaatttatagcctacttgtgctaccttagacttttaaaaaattgttccatgagggtaagtcttctcatctagagatgcctttttttgattcgcctcttgtacccagcctgtcgcatagcatgtaaatcctgcaggaatgtttattaatttaaattcacctatgagagtacattctggtctttgagtaacatgaattctataatgtgtatctttaaaaaataaacccatagttaatgccttggattaactagtttagcactgattgtttgtgatgctaagattcttccttccctctcaccgagatgtgtgtgcttggatgacaaggaaagatggagtccccagcagttgttgaaacacagctttataaatccccagccaaaaatgcctctagtggaacaaagtcctgaaggtgagtctgttacctttctttatttggtaacctgtttgacattaaattattttgaaagtatacataaaccaaaaactggaaggggctgcatgtgttattttatgtcttttattctgaactaaatccattagtttgatgtgtgccatgtgcatgggactgttttgccaccctgatttttctagtctctattgatggaatgaatgtccattgctgtagtctcttgtagtgtttagtcacccatagtgccatgtaactagatttttcctgctgcacctgagattaaggaacctcggtagagattgggatggatcatgagacctgagttttggttctagctctatagttaagtcacttattctatataatcccccacctgtaaacttgggctaattatatatttctgcctactttaaggagggcaaggtgaggaaaagttttaaaaggccactcaggtaagaggtaatttttcaaactactggttggagctcttcttccagggcttccatcattgttggctatgtagctcttcctaaatttccaatgcctcatgtgcctcttactccctgttttatctcagattctgaaggacaagattatgttgagactgttattcctagcaaccggctacccagtgctgccttctttagtgagacacagagacagttttcccgatacttcattgagtttgaagaattacaacttcttggtaaaggagcttttggagctgtcatcaaggtgtggtacagagtcattcccagtcccctttagagctccttctctgttccatttccacaaagactcatggactttacttttattttgggagtggggagggaagtgaatatggctgttggatactatgctcatcctcaccttcctggagttaaaggttttatttaagttacgctggacacagttgagaattgtcccactcctctttccttgcttcatgtggagcattaacatgaaacacacatggttataacagcacttcaagtggaatcaagacctccacagaaagaacatttttgtgtgctttggttcagaaagaacattgttctttttttctcctgtttgctgttagagttgctgtagataaaaaggttctaaggttagaagagagatggacttcaaactgggagatggccccagcaggtctcgatggcttttattttccagctattattgggacaggaaagtagcgatgtattattaaggtacactgttgttgggtcttcctttcttcgttctagtctatttgggtgacttttattattatctgccccttgtagaaagaggtttcagctgtttttatataatagaagtatttctttgtaaattaggagacccagattattgtattaagtccatatacagtacatgtcatctttcacatatgaaggtaacccaccatcaactgagtatattgtctgttaaggattctgagagtatcattaggaagcattactgttactgtagaaaaacttttacactaaaaaaggaattaaattagttttcctgtggtaaaagacagacaagcaagacagatgtcctgatcagaaagatcataattatgtctaagaggaggggatgattgaagcgtatactgtccctttaacacaatatcattttgatcaaatcctttaacttcattctattttaaattcttgaacgtagaatagtaacaaatttcatctctttacaagtacttaataatgataggcaagctcatataacaaaaacatctgagtaacttaagcccccacggtttccagtagtttctccctgtgagaatccacagccctcacctcctacctctgtgcttctgtgtcagagtagggcagcctgcccagtgatctggcattcattagcagttggacccattactgtttctgcaccttttcacttcagtaaatgaattcctaggggtttccagtatagcaagctttactcccaacccagttcgtatatgatgtgtactgagacaggagatcgaaaggcaatgccaagatccccacctcccgccctacactgtcctcttccctattaatgtggcagtaaaagaacacagggctatcattttttggagcacctgccatatttcagattgtgtgccaggtgatttacaaaccttgtctttaaatctcaggacattcttacgagatgggtatgatcctcattccctagatgagggaactgaagctcagagaaggttatgtcctttgcctgagataagggagataaaaccagcattcagacccacctctgttgtactacaaagtgtgtgttcttgtcactatttccatacaaaaaaagataatctgaaactcaattttgtagtacttccttcttattcccaggacttcacttagacttttattagtttaattgaaacttgtgagccaaacaagagaatgatattctgttttgtgttttgtaatcaactaatttctcctgccacccatggccacatggcatttgcttttctagagtatatcatcacctcagttgacctgcacggatgtgactacaaggtttcagtgaataagactctgtaaaagttacttcagtcaccccaattacatagtgaaactgcctggcataaggatgcctctatgtaggatgggaggacttgcctttgcaacgttttcttgctttcttattattttactgtgttgttaattgtattgttctggtttcagtatacatcatcttaggtatataacaaaatcaatgggcagtgattgtgttaatagcaattgctgttattgactaagctaagcacctttctctgtgaggccttgatacaagtgctttacagtcaccatttggggtagtggaaatggtataaatgccattttaaagataagaaaattgagtctcaaggaaattaagtaattttcccaagttcacacggctttagaaatcaaggaattaacctttgtgttcaggtctgttaatatttttggtgtttaatttgtttttagtgactttaagtgtaaaaaaaaatcagagagaaactaaaatcatctgaaactttacactgactttagaaaataatttttaatcttaaaatcaagacacttagaaatttagatagcagatacattggaaaagcagggaggtaactgtcagtaaaattaattattaaaatggagattatgttttccccagggtctcccagcaagctaaatatatctagagtcgggtgggctgttttctgaattttgtggcagtcaaagctttcttcagtttaagaatttcaggcatgtggttcttgactgtagctgtgggactcatttagaacttcacgctttccttgggaggggatggggtgcggtgcaaatgcctgtttgtgcaaggctccgagcggctgaccttcccctggctgtgccgcaggtgcagaacaagttggacggctgctgctacgcagtgaagcgcatccccatcaacccggccagccggcagttccgcaggatcaagggcgaagtgacactgctgtcacggctgcaccatgagaacattgtgcgctactacaacgcctggatcgagcggcacgagcggccggcgggaccggggacgccgcccccggactccgggcccctggccaaggatgaccgagctgcacgcgggcagccggcgagcgacacagacggcctggacagcgtagaggccgccgcgccgccacccatcctcagcagctcggtggagtggagcacttcgggcgagcgctcggccagtgcccgtttccccgccaccggcccgggctccagcgatgacgaggacgacgacgaggacgagcacggtggcgtcttctcccagtccttcctgtaagcgcacggcgcggaccagctgcctctgatgcgccccctagtttcctttctttatttttttttcctttttcctttcatttccttccttccttctttccttcttttctttctttccttttttgagatagggtcttgctctgtcacccaggctggaggtcagtggcgcgtccttggctgcaacatccgcctcccgggccagcgaatgccccccaacattaatccccaccaagtccaagccagggaaaaggggattcatttagaaatccagacgtgttgaccatgtttaaaaacaaaaacaaaaacaaaacaaaaccaccacttttagagagtaaccaaatgcaatctaaaggagcggtccccagcgtttttaggcaccagggactggtttcatagaagacaatttttccacagacgggtgttagggaaatagtttcgggatgaaactgttccaccttacatcatcaggcattagagtctcataatgactgctgaaaaagcgcacaacctggatccctcgtgtgcacagttcacaatagtgtttgcgctcctatgagaatctaatgcggctgctgatctgacaggaggtggagctcaggccttaatgcttgctcacctccggctgtgcggccctaacaggcagtggacctgtacctgtccatggcctggaggtttgggacccctaatctaaaggattttttttcccgctattttcaaaagatctccaaaatccaagccatggaaaaaggaaaattcaatacctcatcttatacattgaatagaatttctcataggacattcctttggataagggcttgcaaccctgtgaaacatttaagaactaatttggagtcttgatacagtgccaactgcagcccccaaaggtaccaaaccaataattatgatcctaaattttatgcttctcagaatccaccctggatgtttactttcatgattttgttttattttatccaagtggatacagtttatgattactcttcactattaaattttttgaggaaacttaatctggctaatttttattaaatcaagggttctgtgttttgcataatagcaagtacaaatcagcacagtgtagagtatacattgatgcctgtgggctcatggtgtgatgtctgtagcctcttgtgctttctagtatttaaaaatgtccatgtttataatgataatagggatttctgttcctttagtatttctgtttccctttttcaggcctgcttcagattctgaaagtgatattatctttgacaatgaagatgagaacagtaaaagtcagaatcaggtatatatatgaatagaaattatatcattttattcgtgatataattgacgtctgatgtcataaaccttaggtaaagtattaaggctttaatctgatattcagatatagaaaccataaattttaaaagatgattattcatttaaaatatattctacctgtgtttatttatagaccttctttatttatccacatagtaaaacatacctccttttagaagagaggagtcagttgagacactgcatttttgtatgtgatgaaaacagttttctaagggtttgggaaactttatatggttggggataagaattgaatgcaaattaatgaactagatttgcatttatggagttacctcatcatggagttaccttggtctgtcccacgtcaattaatcttgattccttattttcatagaccatcctctagaacagtgttttcacactgtgtatcgtgatcctataatgcaggggtgtccaagcttttgtcttcccttggctacactggtagaagaattgtcttgggccacacataaaatatactaacactaatgatagctgataagctaaacaaacaaaaaaatcacaaaaaatctcataatttttttttgagattgtgctgtttttttagttgtgttttcaatggagaaatacatcatctgttgacaaaatagcttttgaaaaatacgagtacagatactataaaacaaagcaaacttcagtcgtgagacactacatacatcatgtgaaagcaacagtctgatctccaggttgtgaaaactataattaaaaagtcactacacagaaaagatccaagtttccaggttggcaaaacttcggtgcagttacatgaaacgtttaacaaactgatttgttttccccaatgtgtaaacaaaatgacaagactaagtctgtgcctggtaatttcaatgtaactctgaagctacacaaaacacacagacaccttatacacttcacctgttagtatgaccatcttttttgttaggtggtgggaggaagggcaaggtgactgtgtaaagcaaagatgtgggaagtagaaatattatgtactagacgttataaaatcatggtgaaaagaaagctttgattaatgcgtagcctaagggggaaaagactacactccaacttcagaaaattaatttagaaggataggggaagagattaagtaattgcagtttaacatgaaaaatgcacatgtgatagaatggagcacaatggaagattcataaaacatgctcatcagaaaaatctgttaagtttactttgtccagattaagaaagagtaagtttatcaacatctggcatccctcatactttgtaaagatagatcttctgctgcttaattatgagaaattattttattcaaagaggggagcttgtcaagtgcttgctagaaattatttttaaaatgcttctacatgtaaaatgtactgacaaattttggtaaaccatttaaaaataagaattagttttgaaatcttggagaaaatgtctttttgcccacatttaaaactgaaaatcaattttactatagacaggagttctgtggagtatacaaaattcctcttagaaatcaaatggccatcccagatagatatcaagtttcacaggcattacttttagtcagtctcaagtttcagccacgggaccaaaatttagtgttctgtaccatgttggtttcacatcacggcttaagaaaatactgacattttgtttcttatgaaataagtcctatcttgtgcatacaagcaaaaagaaaaaggaagaaaagaggggaggggaaggcgcaagaagctcttttttgtttgttttgaagacaacagattgaaggcaaaagaatacagagctttcataagctcaaagaaaaatatttgctggctagtcgctgatttgtatgcactataaaacattccataaataaaactgatatatcatttcttaatcatgaccccatcaaaacgaagttatttcctaactattctttcaacgtcaatgtaccctagagttgacatttcatttttaagggttgcagctacctcataggaactgaaatagacgtacgcttaccctttctctgaagtataacagtgcacaatggtatccaatttgaagactaatggtaaagaaaattcttcagaaaaaactgaaaatccatcaagctgaaaatctataattagttctactttctaataaaaagtacataaaagtacatcatcagaataaataattcttatgccagtttgtattgcaaattttccaaacaatgcatcaaacataaacccaatccagatgtcaattgtgaatacaaatagagcttgaggttgtttttattaaaggcagtaatttttgaaatagttaatgcaactgttgctaacacaataataggactcctggcctcacatactaacctggacttctgatcaagtgctaattagcccagtaagggaggtcaccaaaaactactagggcagtcagttgtggctgtggggaattattctactattggggactgaatgcaacaactttattactattattattttaagaggcagggtctccatctgtcacccatgctggagtgcagtggtgcaatcctagctcactgcagcctagaactcctgggctcaaatgatcctcctgcctcagcctcccaaagtgctgccattataggtgtgagccaccatgcctagcctgcaatgactttattaccaggaataaaaatataattaccagcagttacaagggttcattcatagtaaagaaaagtctaagtgtagactcttaaataagcagttcaatgtatttgaaggagatctgagtattagccagtgtgtttttctataagtactttccttgtcaatgaaatcactactaataaacatttattagttataaatttaaaccaggaataatagcataaataaactatgttggctgcagtggctcacacctgtaatcccagcactttgggatgccaaggcaggtggatcacctgaggtcaagagtgagaccagcctggccaacatggtgaaaccccatctctactaaaaatacaaaaattagccaggcatggtggcgggcacctgtaatcccagctactcaggaggctgaggcaggagaattgcttgaactcaggaggcagaggttacagtgagcccagatcacgtcattgcactccagcctgggtgacaagagcgaaactctgtctcaaaaaaaaaaaaagtctgaactactgctaaagccaaagttaatgtttggtgttagcatttgttatgcacataattattacaggggcaccaaatcctggttttgctcagttaagggcagcatccatgggcatcctaattgatgggtagaaacctccaagagattaacagtgtaatacagataatccccagcatccataaatgattcaggagtagaacctgattgttaccagagcagagcttttttttttttctttgataaaggaaaaagttcaaaaaaattcttcctcagaaaaaaattataaatcagaaatggtcaaatactaactaatactttttctgcacttggtgttataagtattcaaatacatctattgagggaaaaagacttttttaagaaaagtatcatgtatgagaaagaaaattagctgttggggacaaacagagtaatggtatgggaagtgtcctagagggtcattcactgtaagtggcagctgagggcatgttcttcaagcatgtacctctgagggcagtgtgccctttgataatgtggtcactttttttttttttttttttgagacagagtctcactcatcgcccaggctggagtgcagtggcacgatctcggctcactgcaagctccgcctcctgggttcacgccattctcctgcctcagcctcccgagtagctgggactacaggtgcccaccaccatgcccggctaattttttgtatttttagtagagacagggtttcaccgtgttagccaggatggtctcgatctcctgacctcgtgatccgcccgcctcggcctcccaaagtgctgggattacaggcgtgagccatcgtgcccagccatcacttttaaattgttttacctaaaggtggatttctagtcttctgtttctgaactaagcctaccaccaaaaaatatggaattccagtaaaactgaacccttcaaatattagcctgtatgcattctgaccttcttagccatagatggttatcagcggtaagaaagaattgacttgacaaggagtttttctgtttaatacctgcctattttctgtttactgtatcattgttctgtgtagcaacagacctgtaaaccacacagaggatactggaaatagcacattttcaataattctgtgagcttcttttttttcctttttcttttcttttctttttttaattacacttaagttctgggatacatgtgcagaacatgcagttttgttacatagtacacatgtgccatggtggttgctgcacccattaacttgtcatctacattaggtatttctcctaaagctatccctcccctagctccccaccccctaacaggcaagccccaatgtgtgatgttcccctccttgtgcccatatgttctcattgttcaactcccacttacaagtgaaaacatgcagtgtttggttttctgttcctgtgttagtgagaataatagtttctagcttcatccatgtccctgcaaaggacatgaacttgttctttttttatggctgcatagtattctatagtgtatatgtgccacattttctttatccagtctatcattgatggacatttgggttgattccaagtcttcactattgtgaatagtgccgcaataaacatacgtgtgcatgtgtctttatagcagaatgatttataatcctttgggtatatacccagtaatgggatggctgggtcaaatggtatttctagttctagatccttgaggaattgccacactgtcttccacaatggttgaactaatttacactcccaccagtagtgtgaaagcattcctatttctccacatcctccccagcatctgttgtttcctgactttttaatgatcaccattctaactggagtgagatagtatctcattgtggttttgatttgcatttctctaatgaagaccagtgacgatgagctttttttcatgtgtttgttggctgcataaatgtcttcttttgaaaagtgtctgttcatatcttttgcccactttttgatggagttgtttttttcttgtaaatttgtttaagttccttatagattctggatattagccttttttttttttgagactgagttttgctcttgttgcccagggtagagtgcaatagcacgatctcagctcaccacaacctgcacctcctgggttcaagtgattctcctgcctcagcctcccaagtagctgggatcacaggcatgcgccaccatgcccagctaattttgtatttttggtagagaaggggtttctccttgttggtcaggctcgtctcatacgcccgacctcaggtgaaccgactgcctcggccttccacattgctgggattacaggcatgagccaccgcgcccggcctggatattagccctttgtcagatggacagattgcaaaaattttctcccattctgtaggttgcctgttcactctaatgatagtttcttttgctgtgcagaggctctttagtttaattagatcccatttgtcaattttggcttttattgccattgcttttggtgttttagtcatgaagtcttttcccatgcctgtgtcctgaatggtattgcctaggttttcttctaggattttcatggttttaggtcttacatttaagtctttaatccatcttgagttaatttttgtataaggtgtaaggaagggatttggtttcagctttctgcatatggctagccagttttcccaacaccatttattaaatagggaatcctttccccattgcttgtttttgtcaggtttgtcaaagatcagatggttgcagatgtgtggcattatttctgaggcctctgttctgttccattggtctatatttctgttttagtaccagtaccaagctgttttggttactgtagccttgtagtatagtttgaagtcaggtagcatgatgcctccagttttattctttttgcttaggattgtcttggctatacgggctcttttttggtcccatataaaatttaaagtagcttttcctaattctgtgaagaaagtcaatggtagtttgatgggagtagcattgaatctataaattactttgggcagtgtggccattttcacagtattgtttcttcctatccatgagcatggaatgtttttccatttgtttgtgtcctcttttatttcattgagcagtggtttgtagttctccttgaagaggtccttcacatcccttgtaagttgtattcctagatattttattctctttacagcaattgtgaatgggaattcactcatgatttggctctctgtttgtctattattggtgtataggaatgtttgtgatttttgcacattgattttgtatcctgagactttgctgaagttgcttatcagcttaaggagtttggggctgagacaatggggttttctaaatatacaattaagtcatctgcaagcagagataatttgacttcctctctttctattttaataccctttatttctttctcttgcctgattgccctggccagaacttccaacactatgttgaataggagtggtgagagagggcatccttgtcttgtgccgattttcaaagggaatgcttccagcttttgcccattccatatgatactggctgtaggtttgtcataaatagctcttattattttgagatacgttccatcaatacctagtttattgagtgtttttagcatgaaggggtgttgaattttatcaaaggccttttctgcatctattgagataatcatatggtttttgtcattggttctgtttatgtgatggattatgtttattcatttctgtatattgaaccagccttgcatcccagggatgaagctgacttggtcgtggtggataagctttttaatgtgctgctggattcagtttgccagtattttattgaggatttttgcatcgatgttcatcagggacattggcctgaaattttctttttttgttgtgtctctgacaggttttggtatcaggatgatgctggactcataaaaaagggaggagtccctctttttctattgcttggaatagttttaaaaggaatggtaccagcttttctaactaccatcagagaataccataaacacctctacacaaataaactagaaaatctagaagaaatgtgtaaattcctggacacatataccctcccaagactaaaccaggaagaagttgaatccctgaatagaccaataacaagttctgaaattgaggcagtaattaatagcctaccaacccaaaaaagaccaggattcacagccaaatgctgtgagcttctaaggatagtggttatgttctgctcactgacttctccctaaggcaactgggtggccctgtgttgggggtgggcacaaatacttaatgatggtgatgattttgcttaattttggcctccattttgagttattgtgtgttcgtcttgggttaggatgaagattgcaatgaaaagaatggctgccatgaaagtgagccatcagtgacgactgaggctgtgcactacctatacatccaggtgaggtcgtggtgtgtagttaggtgacacagcaacacccagtagtggcgggtgggcctgtttcagggtattagaacaagataatggacagaggagggcttattgccactaccaaagattaattggccgagaggattaccatatggaggcccttttccccagccttgaactcatgctttcctgccacatatcaggagcagccacagggcagctctgggctcaggctgtgtaagttcacatcctggatccacctgttaggactgcatgaactcgggcaaggttcttcagcatcttgtgcctcagtttccccatctataaattacataatagtagttcttatagacttgtaaagaataaataacatgtgaagtacttagaaccatatctgagttccataagtgctagactgcatgagcacagaaactctactttgcctaaccacctgaatctggacaagtaagatatgatgtgcacacatgcctgtacatgcaaaagtaacaccaaggtgactttaggcaaagtggcttgaccaggaacctctggagaccagtgcacaggcaagccagttccaatggggcatgactgagaagtctgagctttggcctgcctacctgccagagcaacaacatcctaaacaggggtgagtgggctcttccagtagaggagtggccataaaacaagttggccgggcacggtggcttacgcctgcaatcccagcactttgggaggccgaggcgggtggatcacctgaggtcaggagtttgagaccagtctggctaacacagtgaaaccccgttactactaaaaatacaaaaaattagccaggcatggtggtgtgctcctgtaatcccagctactcaggaggctgaggcaggagaatcacttgaacccaggaagcggaggttgcagtgagccgagattgcatcattgcactccagcttgggcaacaagagtgaaactctatctaaaaaacaaacaacaacaacaacaacaaaaacaaagaagtctttcctctgccccaagggaacaggactgtgggtcactgttagtatttcagtcataactgcaagcaggcagatctttaaatgtgagatacagaactgggcagaaaaaggaaccctcgacaagttacagcattttgaatgagatgaattaggtatttgctttcctggagttggagctggttttaggtattccgtaacataaatatctttgaggtaccacttacacagataataaagcattggtcccccaaaccactgtttatcctctattatattccattaccttctacacaattagaatgagatagaagtacacaaaggaggtgcatccgacatgcatcaggatcacggtgtgggcatcagagggggccttgtgaggcccggagggtgaaccagagtttactgacaattattccgaaggtgatagaacaaagtctggtcttcctctctttaaaaacaataaaacctttcttcgtgagaaatctcaactctggcactagttgaagcatataggctagtttcataaatcaaatggtgcatgttgatttaagatttaagtcatgttgcactgttttctgatatgtgaatacactcaagaaggggtgagacagagcccctgtgtcactgtcccaagaagacttgaatgttttaatatttataatatttttctctaaacttgaaggtcatttgtgtttaatgtaagaaaagctaatgatataattaggttaactaaccctccttgtaaatttgggtttggaagcgatcttgtaaaacaataaataaaattttacaacattctcagttttttatgttaattgtgataagtattttaaacaagtcatatttttaaatgagcaataatataaaaaattaaaaatggttatgttggagtgccaagagtatgcatatttacccccaaggtattttttaatactgttggtttctttttcgtgtagaaaaccaagtctttcccctaaccgtttaaaacccatggtacacgttttaaaatggaggattatgtaaattgcagttatactccttcacttaaaactgttgtgtaatcaaattctcctggtttgtctgtatatagatggagtactgtgagaagagcactttacgagacaccattgaccagggactgtatcgagacaccgtcagactctggaggctttttcgagagattctggatggattagcttatatccatgagaaagtaaactttacaacatttcatatctgaagacttatgtttacataaatttatgactgcataaaaatatcaaatgtaagattggagaaaaactgaaatagagggaaagctatgggtatattgacataatctatttttgtaggaaatagaacaaagtgtcaaagacaataaagtattacaaagtatcagagtataacattaaaaaatgttaagaaaactttaaaggttaggacagggatcagcaaactgtggcccacaggtcaaatctaacccactgcctgttcttgtatggcctgtgagctaataatgactcctatatttttaaatggttgtaaaaaattagaagaacatttcgtgacacataaaaattacatgaaattcaaatgtcagtgctcccaaggttattggaacatagctatgctcattggtttacatattgcctatggctgttttttttccataccagcagatttgagtagttgcaacagggactgtaaagcctaaagtattcactctctggccctttacagaaaaaatttgttaacctctgggagaggagaaagtatttgaacatgtagggaatatgaggatgattccttgagtgctttagaattagggccaggtgcggtggctcatgcctgtaatcccagcactttgggaggtcaagatgggcggatcacttgaggtcaggagttcaagaccagactggtcaacatggtgaaaccccatctctactaaaaatacaaacattagctgagtgtcgtggtgcacacttgtaatcccagctacttgggaggctgaggcaggagaatcacttgaacctgggaggtggaggttgcagtgagctgagattgtaccactgcgctccagcctaggtgacagtaagagacttcatctgaaaaaagagaaaaaaagaattaagcaaggatgtgattaatacctgccaagttacttgattctaactgaattagtgccacccttcctaggaacacggggaaaccagaaggtcatctagcaagaagagaaatgagactttctgagtaacttagcttgtcgcatgtctaaaatgtcattttaaagctagaaattgccattataatataaatgctaatgggcctagcttcaggatgaaacactgcttacatttttaaaatgagattgtctaatgcattaaccaatataaattcattatttttttcctttgcctcaaatttctttaaccttaaaatgtttgtactgtaccgtatttatactgagaagcaagggctgtaatttacacatgtgtagtttgtaaatgatttggtagaagcagaatttgcaaggttagaaatgaaaatgaattctaatgagggccatttaagctgtattactgtgattttatcctgggatgctagaacaatgccccctgtgctctattccactccatccaatttgctcagtattggctaaccatttgctggcatctaacactgtgccatacctggaaatacaaggaggcacaagtgtgtgtcccgtgcttgagagggacttcttgctcttagagggacccagaatttaccttcatgtaatggtaaaagagatcattattttctctattataatgcatgaaacaatacagattatgagccattaggaaaatgagaaagcagtctcatgtaacaagtaattgttgcacacctactgtgtgtgctggggatgccaagttgaactgttagaattactgtggaaggctcatgaatgagttggcaattgcaaatgttggtatagtgcaaatgcatggaaaaaagcgagtatcctacgaaggggagagggtacaaagaaaggaatagaagaaggaataaaaatggtgtgtctccctgaccagaggagaggttttgtaatgcagcagaggtaagggtaacttggtgaacccagtggaaggggccttggatgccacagggaactatttagaattcacctggtcaggataccaccaggtagaactaggaaacagtaaagaggtcataggacagtcaggacatattgcagaggccagacagcctggaccagggtggtctgtgggagaagacctcatacgattttcatcgctaggttggccttttaaattaggaagtaggtataactttatgcatggaaaaccattgtttgtttcttcactctctttcaacagggaatgattcaccgggatttgaagcctgtcaacatttttttggattctgatgaccatgtgaaaataggtgattttggtttggcgacagaccatctagccttttctgtaagtattttaaaaattagactgtacctaaaaacagactcagatgtcttgataatcctggaagtgttagcggatagaatagtgcgttcacagaactatgccgtctaatcctcaggagattatacaaacctgaaggggtatgctgcaaatgatcttgtaggctttgcaattgtgagtatatttttttgagtgcattccacttgagggacacaaaattattggcttgggaacaatattgtggtcaaaggtgtacagtactttatgaaatcatttggtattttggtctaccatgcctggcactgggctagatgctttatacctcagaggcttttgttggtttggggaaatgaggctcaaaaacgtaaaacaccaggagaccatacagttgtaaggctcaagaaaggctggataacgacagtggcatttcagatgtccttaaatggtggttgggagtccaacaggtggaggttgagggcagggcctggtggccccagggtgggaattccagagagagcacagcataagcagaggccccggggtaagcagacttggctgtcggaagaccagcatactgtctgactggtcgaaactgtgaggtgcaggggagagtaagaggatgcggggcagttgaggagtcactggaaggttgggcagtcttgtaggtggtaggctttgaatgccagaggaggaattttgcttcacattataaacccaagttattaagcaccaagatctgtgggaaatgcagttaattccaagggtgatcaggaaaggaaaataggatttgagttaatggtgagaataaccactggggccaagttagaaggtgagactaggagtggaaagggaggagagggaaggcagacagtacggacagggtcccgatcatgctccccatggagtatatgggagagtgctgagaccaaggacgggccagatggtggggatcttgatccccaaactaaagaatttaacttgatatctggaaggctgtagcatagtgagatagataagagctcaggctctggaatctcactgacctggactagaatcctatctctgccactgctttgtagcatgatattggacaattaattaacttctcaatacctcatttgtaaagtgtgcctaatactagtgcctagctgaaaaagttatcaggaagataaataagaatgcaggtaaagcacctagaacagtgcccagcactaagaatgttgaagccggtgttactgatggtgatgcttgtaatgggaagcacctattacaagtgcagacataacaatagtgacttagggtattgacaacactgttgcacatagtggagcaaggtgaggctacctggggggcattagccatgagcgagggtggaacatatttgctgagcagcctctaggaaagaagaataaaaattgatgcagagaaagtaacagcagtgggtaagttgaaagatgaatttgttgtttttaatataatcttactcttcttagaaaacagattctgtttttggcatttgcaacatgaaaataaattggtttctctaagtgtttgcatatttctgtcctaaagaaagagttgtacagtgattgcccccctccctcttgatttcattgggttttctgagagccttgcattagtgggttaactaaactagaaaaaaaattaaaactcaaagcgttattatattattttgatttccatgtaatatttcctcagtcttcatttagaaacagacaagccattctcatggaataatatcatgttttaattggatatttggcttacttatatttttaggctgacagcaaacaagacgatcagacaggagacttgattaagtcagacccttcaggtaaacccagaagactatatatttcatccatgtgttaaagaccccagaatttcttaacctgaaacctgttttttacttgtaaaggttttattctacggcagattttaattgctccttaagttaacaaaattatggaaacgttttaatctttttttccttttcaatttatgaattattctttgaactttaagaaattagagcttcagtgagtagaataattggctcccaggggtagacagttttattttgtctaacctccattggtaatgtgaggttacctcatgacctgatccatctggggtcttatctggcactgtccctcctcttcaatagcaaagacatccttgtgtagaaccgaatgtgtggccatacgtgacttatggttattcatttggtacaatgcatgctctgcttcctgtgagtggcatagacagttaacagatcatgcctcacttttaagaaacctttttttgtttttagtttgtgtcttctgtaagtgctattattgggacgttttccctctgttttcctccacacaggtcacttaactgggatggttggcactgctctctatgtaagcccagaggtccaaggaagcaccaaatctgcatacaaccaggtaagaggttttgtggggaaaaggaatctcaaaattaaggtaataggacatctagatcacagcatttgggatttagtcccggctaaaatagtcaagacatccactcattcacactccaggaaggactcatggtcctaaggatagtgactgaaactggcactgctgctgccaggagcttacagtccatccatccatccatccatccatccatccatccatccatccattcatccatccatccatccatccatccatccacccacccatccacccatccatccacccacccatccatccacctgtccatccacccgtccatccacccatccatccactcgtccatccgtccgtccgtccatccatccatccatccagccatccatccatccatccatccaaagaatgtgcaaaccaacccctatcttgggcaaggtgccaggaacagatgtggctccagccctcagggagcttgtccactggtggatgaaacagacaacaaataagtaaaaaataaaagatatagccacaaattgtggtgagggctaggaagaaaagaaatggaactgagtgacaaagagaacagattgaccagggaagatctcttgagaggatggcatttaggataaaggatgagaaaggacaagccacacagatttgggggctgacacatgccagggagggagatggtaaggagcagaggaaactgcacacataaagagaaagccctgagtgagagagacagcttggcacatttaagacagccaaaaggaaggctagtgtggccacagtgtggcaagcaacaggggacagaggcatgaagttaagctggaaaagaaggcagggaaagatcacacagagccaggttggcctggataaggagtgtgcatttaatttgaagtacacagggagccagtgaagaatcttgagcaagagagttcactctggctgctgcgaggaggctctgcaggaagtcctggtaaggcggttggcagctggaactggactgcaagcagtagaaatggagagaagtgtgctgaattaggaagggaattgagagattttcccaatggaagggatgttggatgagaattaggaagggatttgagagattttcccaacggaaggaatgttggatgagaatgaggaagggaaagagtccagggctcaggtttctttctggaacacctgggtgaagagtatttgactgaagtgaggaaacctaaggacagacataagaggaaggaggagaagatgacagaaaaattcagtttgaggcatgttagtttgaaatatctgatgagaaatccaattagagatttcgagtagattgttagagacccaacacttgagttcagaggaaaggtgagaatcagaaggataaatttgaaatcagcacacagataggatttaaagctatgagactggatgagatcacttagggcaagagtgtaaagctaaactttaaaaacacattaggtgccaggcatggtggttcatgcctataatcccaggactttgggaggctgaagcaggaggattgcctgagctcaggagttcaaaaccagcctgggtaacatagcgagacctcatccctactaaacatcaaaaaaattagccagtcctggtggcacacgtctgtagtcccagctcctcaggaggctgaggtgggaggactgcttgaggccaggagattggggctgcagtgagctgtgatcatgccagtgcactccagcctgggcaacggagcaagaccctgtctgaatcaattatatatgtgtaaaataaaatacattaggaaagcaatttgcatcaaagcaaatgctcaggcttgcagtggagattcaagcctgggttttggttctgacagggagcattggacaacaacataaagttgaaacagacatctaagtacctggtgagggtgagggttagggtatcaggagatggactgcacacactgtgagtgtgggcagacacctttagtgtcattattattattattattattttgagatggagtcttgctcttttcgcccaggctggagcacagcggtgggccatcagctcactgcaacctccgcctcccaggttcaagcaattctcctgcctcagactcccgagtagctgggattacagacgcctgccaccatgcctggctaatttttgtatttttagtagagacagggtttcaccatgttggccaggctggtctcaaactcctgacctcagatgatccacttgcctcagcctcccaaagtgctgggattacaggcatgagccactgcacctggccgtatatacatatttttttaaaaaaccaaagtgggggcatcttagacatcagtaataaatatccctgagtggtgggatcatgagattgctattttattcttggtgcttttgttctatgttttctatagccaacacgtataggaaatgccacagtgaatgtttttaagatgtcggaggtcaccagtgacaatccaagagtctcgccgccccctctttgagtccaaatgtattcaagagtattgcttgaaaatgttttccattgtcctgaaagcggctctacaccctgcacctctgtgcccctgaccatgtgcagtcttttcctcggcagctgtgtcatgctcggtttcctcagatgcactcccttcccaacgccatcttctccttcgtggcaccctacttagattttctctgcactgacttgcctttttgcttcttttttctttttattgtagatactttttttgtttttgtcaattatttaatagttatcttgattatttatatccttctagttttttgactttagtgtttttttctgtagctttttatttttatttattttttatttttttcctagcttatggaggtatgattgatgaaacttgtctatatttagggtgtacaatgtgatgttttgatatatgtttacattgtgaaatgattaccacagcgaagctgaccgacatacccatcacctcacctggtttccattttttgtgtatggtaagaacgcttgagagctactttcttagcaaacctcaagaatacaatgcgttattattaattatagtcaccatgccgtgctttagatctccagaatgtattcattttataactgaaaatgcgtgccctttgaccagcacctccccttgacccccagtccccagcccctggtagccatcattctgttctctgttactgtgggtttgacttttatttagattctacataccagtgagatcatgtagtatttgcctttctgtgtctagcttatttcacctaacataatgtcctgcaggttcatctatgttgtcacaaatggcaagattctcttctttttgaaggccatatgaccctgtagtcaggagctggccttttctatcagccgcagattttggtctgtgtttcacttttaagatggttagctaagatgtgaaacaaagcaaattcttatgatcaatctcagttgtccttgctcttcagccattatttccagttttcagccagtggttttctatgtctgtggatacaactaaaccagttaccattaattttctaggaaggccaggcgtgttggctcatgcctgtaatcccagcactttaggaggccaaggtgggtgaatcacttgagtccaggagttggagaccagcctgggcaacatggcaaaacccactctgtacaaaaaatacacacaaaaaaattagctgggcatggtggtgcacacctgtagtcccagctacttgggaggctgaggtggaaggattgcttgagcccaggaggcagaggttgcagtgagccgagactgcaccactgcacttcagcctgggtgacagagtgagactctgcctcaaaaaagaaaaaaaatttctaggaaaatgtttaaagacatcatgccaaatattttatcatcatctgaatacaaaatatatcatttagcctttataaccataatttttaagaacaaatcttcgcatttttccagtgtgacctgttttgtactcctacaaactttatttcagctaacaatgcttatcctataattccctggtaaattatactttcatatcaaggctctctaaatgcaattattcttccccctcagaaagtggatctcttcagcctgggaattatcttctttgagatgtcctatcaccccatggtcacggcttcagaaaggatctttgttctcaaccaactcagagatgtatgtatcaggtgttttagtgcctacattttcagtaaccggaatcttagcacagagatcagaattcaaagcaggatatttttctggtatttataatatagaagaggctgccctactgtaattttaatgactcatttattcagatatgcaagactaaccagttttcccatttttagtgaaacatttttctgagcaaaggaagtcacctcagttaaattcttaaaatagcagttttgggagccaaagatcatcagcatgtaggagggatcttactggtctctccactatgtttccacagtgaggtaaatggaaccctacctctgatgatgggaaacttgccccagttttgtttgtttttggaaatcttacctggagaaattgctaggttatagttgctttttaaaaaattattctgagatttactcttgattttaaagcaaaggaagaagccacaaaattgggcttgatatgaatatggttataacaagggagtagattgtaaagaaatgggtatttagttctagaagttaaagatgcctgttgaatgggccagttgtagtaacgtctaaagaaaactaccaagaccagaagttaaaacgggtccgaaaaaaatatctgccccttgaaatgtttttcccaatgaaatttccatttgtgttcttgggattaatccttgcctcatttactgcctgagctaaaaagggaccagtgttacatgtgcgaggtcagagatgcccatgagcaaaccgcattaagatgaaagtgaagagtgaggtttgggtgagagtgatttaaattcacatatttatgagcgagacatctggagagccaccttctttcttactgagcagagtgaagcaggaatatttattaagttaattcataaacacgataactagaatgcagtaagaatactcctgtattccactataagaacacttctctggataattttgaaaacaaattattttactgtgagtacagtgtggacagctgtgttcgtaaagtataggactaagtgaagtgatttctattgcctcgccttgactgcaatgctcttagatgattatgtccttaatgaagtgcctttctttagtctaaaattcatgtttatttaccagaaaggtgagaacttttggggaagtagagattttttttctcttactctatctgtgttggtatatgggtgtggttttttttttttgttttgtttttttttgccttttttcatctgcatgtttaattaaactactttgttgttctctgaagccattaggtttttactttgtacccagatgtgctttctgccccttgaaatttttttctcagtgaaatttccatttatgtttttggggttagtccttgcctctgttactgcctgagctaaaagggaccaatgttatagtatgtgaggtcaaaggtgcagacagcattaggacgaaagtgaagagtgaggtttgggtgaggctgtcatttgggtaaagtttatattaaaataatatgtatgtaattggaagaataagcgtcaggtttcaagaaggtatcacctatcttttcttgctagcaaatttttatttctgtatttgattttcttacttatggtgaataaatgctttcactgtggcagtctgccaaaaccttgctgatttgaatatatttttttagcccacttcgcctaagtttccagaagactttgacgatggagagcatgcaaagcaggtaattttctgatgcgtcaattactatgtcttcagtcttgcattttaattattatttttcttctttttcaattagtaatcttctgccactcattctcttgtgtcctgggaacaacgtggggaaaaaatatgaaaagatgaagcacttaaaatgtcattagacttgaactacaccataaaaatgccaagggctggcacagaaaattaacaaactgcagggttcttttgtgcaattcgttgtgcttttgaagtgctatttggacccttggcttagctgttgaaaaaaaaaaagaatccttttacaactcattgtttttgataaagcttggggctttaagaaaaaaatataatttaaaactgtaattttgttctgttttgtggttgcagtagctcagattatgggggaagggttgcattttctggacagtctattgtcacagtattttaaagcaaaataaattctcctatataccataaatatctgagtatatgtgtgtgtgactcatgacataggctaatattggcatccagcaaatattaaaaaaaatattattggtgaatgtgtgtattgggcttctggtatgcctttcttctgagtgccagttgtttgtcttggtacagtggttaatactcttgtcatatggaagtttctcaaactgacttactgacaattataatcaaggcaaactccttatttaaatcattaatgttgagaacaaaagcatagatggaatattgtattaatttggtccttcttgcttgctggttatgtatctgaatggacatgccacttttctagactttaatttccctcacctataaaataaaaagattaagtactctttatttatattagcactaacattgtgtcatttggtaagtttaacatgatggttatttatggctgtagggacctattctgcctcatctgtttaattagtgaaggccattagaaatacattgagtcatgtttctgcttcttttggtagctattattgtttctgggtgtcataagtaaacattcatttcatagcctttccttatgacaaggtcagtcttatttggtgtttccccttgttgacagctaagatggcccaggaactatacaaaccatttttcaccatgaggactgcactcctaccatcagatatatattagatacccttgagcatttgagtctgggctgtacaaattggcaccaaaacaaaaacaacaaaaccacaaccacctcccatgtcatagtcattgctttttagctgaaaggaggaaacttagaagatgcttatagaatgagcatagcataattttttgccatgcacatttaccagtacagcagggtctattatgctcaatagggtattcttgtttttgtcagtttaatatacctttcataaaagttgtatcatgtcattttctttctatataatactcctatatcccatacaaactaattgcctgtgtttttattttaccctaatactggaaggagagtggtaggggggcatattttaaagatttataactagaaaatgcttaataaagtccatctaataattgaggttttcttatctcaaatatttctctaactccttataaatctttattataaacaagaggattaaacatcattaaggaacctctcaaaggtttagattgccttcatatggttcactgctttaatgaggtggctgtgaagatataacaaatcagtaacataaatcaagagaattcaagggaatggtatcaatgcaaataacataaatggagaagaaaccattaaaacaagatgttttacattgcttttaggattccagcagttattatgcattacaatttctactaaaattaggcatgtaaagctatttgttttatctttttacatctttttatacgatattttctgtgtttataaggcctaatttctgcttctatgtagttgttgatttgattttttttggttgtgacaataaggtataaaaacaaggggcctccttttaagaaatgttcatactacattgttgcacaactctgtggtcataataaagcagaaaaaataatgacctattcagaaatttcagaatgtcagttaagtgcaagaatagtggcaccttttctttgacctgaactgactactgacttgtccggagaatagctgagcattatccattgcatcccattagcagtgtgcctgggttttattgtagaaatcagtcatctcctggctgttgaaccacgatccagcaaaacggcccacagccacagaactgctcaagagtgagctgctgcccccaccccagatggaggagtcagagctgcatgaagtgctgcaccacacgctgaccaacgtggatgggaaggcctaccgcaccatgatggcccagatcttctcgcagcgcatctcccctgccatcgattacacctatgacagcgacatactgaaggtgggcttaagccacgctgcacaaagggagcttcaccttgtccacaaaaggatcaagccagtttctcacagattcttttaatgcctctaacataagttcttatgtgaggtattggaagcccctaaaagtacatgcaaaatgtgtgtatatgcattcagggaagaggacccatactttcagtcacctacttgaaggagtccttgacctttcctcctccctacccacccaagagattaagaagcagtgcctacaaaaattagccgtgcgtggtggcatgcacctgtaatcccagctacccgggaggctgaggcaggagaatcgcttgagcctgggaggcaggcggaggttgcagagagccgagatcgtgccactgcactccagcctgggagacagagcaagaccccaactcaaaaaaaaaaaaaaaaaagaaacagtgcatttagagactgatccctagcccaaacgcccagagccataagcatcaaccagctcatatctagatgaagtataaagtagttcccagtgctggttgcacatctacttcatctcagaaactctctgacaatgcagatgcccaggtcccgtagcccatctagtggctcagaatctccaggtgtgaggcatttcagaatctcattaaaagctcccaagcagtttctgaagtgtagccaggttgccagtttgggaagactttaacatttaatttcttttaaaaagaaaaaaaatctgaagcatattagtgaaatgttaaaatgtgttaaagttgggtgagtaggtaacaggtatttgttatattctctattatgtttctgtttgcttaatatatatgatataatttaaaaagatagagtagtggaggaagtcatagtaaaatttatgaaagatcagtatagattttagagaccaaacacaatttttactggctggcaatattattatagaaagatatttgcaggattataggtgacttttttatagatgtcttttttcatatgtgttgtttctaaattttctatagtgaaatggtactacttttataatacaaaaacaaatgaaaaagaaagctattggcaaaatatgtaaatgccatgtagctttcaacaggcctgccatgaatcaccttggtatgtgggaggggcctgatgctgttaggtggtcatcgcgccacagtatccctgagagtcagagagaatgtgtttatttgattatctccctctgaaaggcaaatatcaatgtggccaagaatttggactttgaacccaggcatccttcccattggttgaaaggttagctcttgctttccaaagcaggccatgaaagatatgtgtcctcttccctgatgtgttcaaagagggatggacttgtcaagacttgttttttgaacctggaaataagcagtgtagtgcctactgcaagccacagattaatattttaaaggatccctttgataaggcttcaatgatgatgttttaatcggtcctgttttagggcaacttctcaatccgtacagccaagatgcagcagcatgtgtgtgaaaccatcatccgcatctttaaaagacatggtatgtacgccctttttaaaaatgatatttcttctcataagacttttttcatcattagaaagtactgttagtgttcgggcatatcatattttactttcaaattcagttataaataattgacatcatatggaatttaagcttatttttgaaactgatttgaatattacagccttactattaatactaaaatgcaattggtttgtggagtcagaaatatgaccaaactgtcaaacttaactctagatgagctctctatttataaatttagagaactcaagaaaaattgatatgacttcaatggtcccagtagcaattacttaactgtcaggtttgtgttaattttaggttgccttctaaggagaatgtgaacctgatgatgagctattttttctcatttggtgtaggagctgttcagttgtgtactccactactgcttccccgaaacagacaaatatatgagcacaacgaagctgccctattcatggaccacagcgggatgctggtgatgcttccttttgacctgcgggtgaggctgggaacacactgctgacaatcagaatgctgtatctagtcacagggatggcatctctgttaaaggatttttcccccaggcttatattataaatgtcacctttgggaaatgtattcttgaggaagttgtcagagtgagagtgttactggggtggaggaaatgtttggtcctgaatgcctccaccttcctaatagctcaggtgtttatggctctaggaactggaggaaccctgcattgcaggtgccacatgtgcaccccccagtgttgagtgaccacagcaggttaaccccacccacttagacaaataaatgtagtttgtttgtctttttaacttcctggctagatcttcagtaaacatcctaacatgttaatgcctagaacagttaaattcttctaacagcaagtgtctctcctaattgggtatgctgagttttgcccgtgcctgctttcttccgacccccagggatcctgtcgacagcagcagtcttaactagtctttcactcacacagtgttggctactaacaagctatctgtggtgctgtatgatagagcaaggaaaacatgcaatgcatgtgacagacaaggtttaatacctctcacatacagaaagcactgacaagtggagacatgagcaaaggatataaccaggcagctctcagaagagaatatgtgcatggctgataaacttctgaaaagctgtactgcctcaccaataataaagaagtgcaaagctgtctcaacttcacccatcagacaggaaacatttttaaattaatgttatccagagatgacaggagtgtaggaaagtaggtattttcatatgttgctgatgggaatgtggactgctaaacctttagaaaagtaatctaaaagtttataataaaactttaaaaattttgttgcacattctttatccttagaaccagcaatcccactttgagcaatttactcaaagaaagaaaaacacatcagtgtatgaatgttaaaaggatgttaattgccatattattgtggtagtcaaaaactgtctgtctgtttatcagtaggaaaatggttgaataatttgtcaccaatattatggaatattaaggagctattgaaaagaacattgagctaggcacagtggctcatgcctgtaattccagaactaggctaggtaggaggagtgcttgagcccagtagttcaagaccagcctgggcaacataggaagaccccatctttacaaaaaatttaaaaattagcccagtgtggtggctcgtgcctgtggtctcagctacttgggaggttaaggcaggaggattggttgagcccaggaagtcaaggcttcagtgagccatgattctgccactgcactccagcctaggaaacagggcaagactctgtctcaaaaagaaaatttaaaaatttttttttgtagaaacgggctctcgctgtgttgcccaggctggtctcaaactgctggactcaagcagatccttctgcctcagcctcccaaaatactggaattacaggcatgagccgccatgcccagccaatctatatttttatatagatcaaatatgtattttttatatatgtataagatgaaaatacagtcagctcttcgtacatatccttggattccacatccacgtatccagccaactgtggatggaaaatactcagaaaaaaaaattccaacaagcaaaatttgaatttaccatgtgctaaacactgcattgaatccacacaaaagaagggatgtataggcatagtagtagatattataagtaatctaaagatgatttaaagtgtacaggaggatgcgcataggctataggcaaatgctctgtcattttatatcaggaacttaaccatccactgattttggtatccttgggggagtcccggaaccaatttctgagggacaactatacatatttagatatagccatatttatacttgatttgtaggaatgtgcatggcacattgttagctttttttaaaaagtaaatttcaaaggaactctattatcccatttttattatagagaaagaaaagtttttttaaaaaaattgtgtgtgtacaggaggctgaggcaggagaatcacttgaacccgggaggcggaggttgcagtgagctgagattgcaccactgcactccagcctggacaacagagcaagaccctgtctgaaaaacaacaacaacaaaacaaaaaaacaaaaaactgtacataaggtatactgtgtgtgtctgcatgtacttttttgttttatttttttttttgagatggagtctcactctgtctctcaggctggagggcagtggcgtgatttcagctcactgcaagctccgcctcccgggttcacgccattctcctgcctcaccctcccgagtagctgggactgtaggtgcccgctaccatgcccggctaattttttgtatttttagtagagacagtgtttcactgtattagcaaggatggtcttgatctcctgacctcgtgatccgcccacctgggcctcccagagtgctgggattacaggcgtgagccaccgcacccggcctgcatacacttgatatatgtgtagatatatatatttggccctctacatccttgggtggtttctgtatccatggatccaaccgaggatggaagatactcagaaaaaaaaaaaaaattcacaaagctccaaaaagcaaaacttgaacttgtcacattcacgtgtctgaatgaccgtgcacatcaggttgtttgtatcaccaaagagtaaggtgtcaaagaatacactcattttgaccatactttttggaggggggagtggaatctttttttaaatgtatgtcatatggcttattgtgaaacaggttttgtgtttatagtctaagaagaaattccttccacattcctcacttctgtttttcttttatagtgagtaaagtgatgtgggattattctgaggtagaggtaaataaacagcaaatcagatgagacatttgcgttttgttgaaaaaaaaagaatagaagtacaaatatttacatagctatacttaaagctggcttcttattctctaaatattaggagactaaagtgcagatttttaaatatcagctcccattctataagctgatattgaaatgcaaaaaattaaaaagtgaatgtatgttgagaatttggcccatcagtggtaatgataccatgttggatctgttggggcaatctaacaatggttttactagttgtggttactatttgaaggtgtttattaagaatttattctaagagattgataggaaaatcaggaaattcaccataagagataatacccattttgactgcattactataaaagtgacattttttttaaattcataaataaataacttgcactaattttagttggacataataaaagctccacagagaatatttaactaaaagtgaattttaaaaaaaacctaagaaatgccacagtgaataaggttgatggtatgtctagcagcggagtccaccactgaccaaaacactgaagaacatttcagggagtgtgagtggtgagcagtgcataacttagtgaatacactaaaagccactgaagtacatactttaaaggggtgaactttatgggacaggagttatgtttcaataaagccgctattaacaaaaggcacattttgacattgacctttcatattttgtttatttttcagatcccttttgcaagatatgtggcaagaaataatatattgaatttaaaacggtaagaaacaataggagattccatttggtagacataggaaaatagttgaataatttgtcaaccaggaaagaatattttatttcctgtgatccttacacagttaagaattctgggttcagaatattgagcttagaatatgaaccagaagcccagccacagtaccccttcctgtaaggtaactaggactgttagaaggaatgtagcaggtaggtaccgtcatgttcccacagtctattctgtaccttctaaatgtccccaagcaacattactaattattttcacaaacggttgcttgataaaaacatctggctgttcatgatcacagatggccccttttaaaacttaattggtgggacaaatggccagtggtctctatgtgaaaactgcctacacaggtaaccgaacaaaagctgcttgtagagaagtggagtaaacccagcaggaacgctgagcgctgaggacctccaggcacttagccctggaaaaaggctttctgtacattcaaataccacaggggtccaacactgagatcttcataatttggagcagtattgttgtcaatgaggcaccctactttaaagctcctttcttcaactgaaagcaaagctctttacatgcttttattctagctacaagtgaataattaataatcgtagtcctatggtgtgggtatccctgtgtagaaagcaatcactaaggtaaaattttttggtgtaatttcatctctatttcagacatttaaaaaaccttaagccccatagcttaatagtggcaaaactgggaattggaacctagatcacaaggcaaggctgttccaggtcaaatttgtctttcagtcctcttgatcataccaccgattaattttttttcatatttgtttcttatatcttgttcaacaatttcttatacatatttctttctagtaagcaatgaccttagaaatctgggtttctctctccagatactgcatagaacgtgtgttcaggccgcgcaagttagatcgatttcatcccaaagaacttctggagtgtgcatttgatattgtcacttctaccaccaacagctttctgcccactgctgaaattatctacactatctatgaaatcatccaagagtttccagcacttcaggttcctttccatattttaacattccaagattccccactatatttcttcaccaagtgtggtggggaaaaccacagctacagacctgcttctcagtctgtcctgcagatgaatcacatctttactaaagtaactgagaagagcttgctggtgttgcttttgaggttcagctcaggctcttaccttcacaggaactggttttgttttgggggatgggtattctctgcccattcttctaaaatgcaagatatcaggctaagattcctaagatgctcttagcctgttcataccctgtttggaaccctcagtggctctatcctacacccgatctcttcactccccaacttcccttttcaccaagtctgcatgctgcctagctggtggggactgctgccagcacttctcaggcttccctccccaccccacacacacaccctgtcattcctgccaccgtcagtcaaatgttcccttgtctagaaagtctttgcccagccatggtttgggccctttctccccaggaagcctcactgcaccctcattaattagttggccaccttttcttctcaactctcacaggtcttgatctgagacacccatgtactaccttgagttatgttcattgttttctccaagcagaacatgtgtttttagggcagagcctacgagtccgctttgccatatacccccattgcagccagctcggcacatggctcaccactcggtgaatactcattaatcgatttgtgtggacaaaagttaacaataactattccactggcctgtgcttatgagtcgattactactggaccagatccttctgtctttgaaatcaactctctcgggctttttaacatagctgaagaccagtcagagttgtttttgttttgttttgttttgttttgttttgttttgttttggagacagtgtctcgctctgtctcccaggatggtgtgcagtgatactatcacagctcactagcccctaccttccaggctcaagcagtcctcctgccttgctgcttgaatagctgggtctacaagcatgtgccactgaccccagctaattttttatttttttgtagagatggggtttccctatgttccccaggctggtcttgaactcttgagctcaagggatcctccaaccttggcctcccaaaatgcttgaattacacaggcatgagccaccaccccagccagtctgagtactttggatatatataatatagtattaaattagagtatactctgactataacagtgcaaaaagaatgtatgaaaaaaaaataaactaggaagccatatgctaaattcaatccttccattgtgttaggatgacaaattggtggtaagtttccagatttggtcatgtaccagtaattgcttttataatgaaaatagtaatttttctccatatcccaggaaagaaattacagtatttatttgaaccataccatgttattgaaagcaatactcttacactgtgggatcccagaagataaactcagtcaagtctacattattctgtatgatgctgtggtaagcatttaattacttatgatgttgaaagataataccttgatgttgaaagataataataatagttcctgatgattttcttacccatgcagccatgaaactgaattgggagccttatctccttccttcattgctctaaattgaaagaaccaattgattttaattatatcaacagttaacaagtattggttgagcttttgttccatcctcagccctgtactactaataacctccggggtgttttttaaaaggctaacttctaattttaaaagatcaaattatttaatttgtcagatagtaaagttattcaccaacctacttattaaggcaaatcactaagtaattggtcctgatacttgccaataataatttcaaagatagttaacattgactgagccccgctctgtgagctaggcattgttctgagctcctctgatggatgaactcacttcattctcacaccagtgctgctattacctttcctttagagaccgagagcaactgttcatgttgagaataaacagtgtgccttgcccttgattcttccagtctgcctgtgcttatcagtaaagtcatgtatagatttgcattgattgaattaaggcagaatggcttcgaactctggtggggcctcatttaccacctccttcctgtgggactgaggctatggcacctccagttactcttccctaatttagtcacatcatagtattcattactttatagtatatgtgcgggtacagagactggaaggggacgcattgaaaaaatgaattagtgttatattatgatgctaagatggaagtgaatgcttatgttttctaatatcttttcatgttaagttttgttttcataatgaataagaggcatccaggagatgtaagaactaacagcaccagaagtctatggttaagacagagtagtggaagtcctcacataatggcttattgtttttatacaccaaaaggattaactagcttttctttcatctggcaggtacacatcaatggcccaaactttactgcttgtttcttagtggttctttactccccctaaagctctgctgctgtttgtcagtgacagatacaatatgatgtcaatcggacactggcagaaaccccagggattgtgcaaggggcttcagctcttactgattcatgtcctgcggctacggcacatctgccagcgtgggatgaaatgcccagagcctggcctttgttaggggagcccagagcaaaatgactccctccctgcccaaacaaatgccctcattaagcctgtccagatttgggtcacctcaccattcagcaagtacaactttccccttttaattcttttgtcagggtttttcagattttaaaataagttaattacggttttgtgtgaattgggagaaaaaattttttaatcacagaattcaatctatcctgtaccattaggagcagtttgttcaaaatgaaggctatacttgttagaattcgcctggaaattgtgtcttgttcagtgccagatttcgcgactctcattgttacctttttcttccacgttagacagagaagctgacgaggagagaagtggaagctaaattttgtaatctgtctttgtcttctaatagtgtaagtaccttctaatggtattattacagctttctctgtaattttgtgataccagaaaatgtcatcaaattctcgttgcagtagggtagcagccagcgcttcctaccacctcgcagatgcagtttttcccttgagtgttaggtaccatggcaacctctgggattaggagaagggagaaactaatgctgtgatcaaagaatgtctctccatgcttcttcttgatacgctgtaatcatcctgctctttcttgatcagcagatacttttctttgtcaccccttatagagctgtgcctggtagagcctcctgctgaacatacctaataccagttgtcctcttttgaattagattatacaggactagaaggaggcacagaattctgcaaattcatctggggagctacccttcccctacctccatgtcttctaactcctcagagttgaattaaagctctagcttttctggtatatctcttaatcttaaaatcttacatttgatcccatcatcaataagggaaatcttatggaataaacagtttggtcatattctctctgtaggcatcagattgatcccagatctttggtacagtaacccacacttaattgagtagctgaacaacagaatacaacagggattttgtacattttcctgaatatttaaataaggaaagtttttttttaatttcccggaacctgtctaggcccttgtctgacactcaattatatgatcttgcattgatcagcaaaattcacatatgggatagattaaaatatgattgtacacagggcaggaagagtcactcaatctttcggacacctacagtgtggcaggcacaatggcagggatataaagaagagtccatagactgcattcagcttcttggttcatattggcctttaaaaagccataaggggatatgcacagcatgtatctgccctcaactctgtaaaacagctttcagagggcacacggaaaccagagttcaaagaaatcacccctttgcgggtagggaaagtaaaccagatgcatagcactaggagttctgaaaattgagccaggttaaatcttaaatatttaatattgggggagatagtaatgatatgcaaagtaacacaacagctaaatatccaaatatgaaggacaatatacagtatttacatataatctaaacatgtacacagcacacacctatgtgcagaaatagtcccatgtgtaaatagcacagagaatctgcacaagactgctcagttcaatgattctatacccaagtttccaacccaaaaggttatttggactaaagtcacatttcagaacatctttttttttttttaagaaagtcttataaatatacattcggacgtaatagccacattggttgttcacatgtcaacttcttttctttctgttaaatctctaaccactggttattcgatgatgctaagtgttaattagacgtgtctgattcagttaaaaacagaaaaatagtatctaataaaggcatttggtactttgattattttaaaatggactctaagggtattaggaaggggagtagaaatattgccaaagagtttcacatatctgacccagtcctcttatttcacaaatgagacacctgaggcccaaagagatgttgtgatttgtcctgagtcacatggagttagttgatgatagggtgaggaccaaaatctggagatattgacttcagtgcttctggtagtttattattggggtaatttaatgttcaaatttatagagaagaaatcatttttattttcttaaaaaaatattttaaatcgaatacatgattttaaatttaaatttttttctttttatttttttgagacagggtcttgcactgtcacgcaggctagattacagtggcacaatcatagttcactgtaacctcaagctcttgggctcaagagatctttctgcctcagcctcccacttaatttttttttcttttttatagcgggatagcaggcgtgagccattgcatccagccaaaatttttatctttaatccctctattagtctgctgtcacactgctaataaagatatatccgagagtgggtaatttataaaggaaagaggtttaatggattcacagttccacatggctggggaggcctcacaatcatggcagaaggcacggaggagcaagtcacgtcttatatggatggcagaaggcaaggaggagcaagtcacatcttatatggatggcagaaggcaaagagagagaacttgtgcagaggaactcctctttataaaaccatcagatctcgtgagacttattcattatcacaagaccagcatgggaaggacccgcccccacgattcaattacctcccactgggtccctcccatgacacaggggaattgtgggagctacagttcaagatgaaatttgcatggggacacagctaaaccatatcattctacccatggcccctcccaaatttcatgtcctcacatctcaaaaccaatcatgccttcctgacagtcccccacagtcttaactcatttcagcattaactcaaaagtccacagtccaaagtctcatctgaaacaaggcaagtcccttccgcctatgagcctgtaaaatcaaaaacaagtgagttacttcctggatacaatgagagtacaggcattggataaatacacccattccaaatgggagaaattggccaaaacaaaggggctaaaggccccatgcaagtctagaatccagcagggcagtcaaatctgaaagctccaaaatgatctcctttgactccatgtctcacacccaggtgatgctgatgccaggggtaggctcccatggccttgggcagctccccacctgtggctttgcagggtacagcctccctcctggatgcttccatggactagcatttagtagggactctgtatgggggctgcaaacccacatttcccttctgcactgccctagcagaggttctccataagagccccacccctgcagcaaacttctgcctgggcatccaggcgtttccatacatcctctgtaatctaggcggaggttcccaaacctcaattcttgttttccgtgcatctgcaggctcaacagcacatggaagctgccaaagcttggggcttgaaccctctgaagcaacagcctgagctgtacataccttggccccctttagccatgggtggagcagcttagacacagggcaccaagtccctaagctacatagaggaggggggccctggggccagcccacgaaaccattttttcctcctaggcctccaggcctgtgatgggagggcctgccatgaagacctctgacatgccctggagacattttccccattgttttggtgattaacacttggctccttgttacttatgcaaatttctgccgctggcttgaatttttcctcagagaatggggttttctttcctgtctcattgtcaggctgcaaattttctgaatttttatgctctgttttccttttaaaactgaatggtcttaacagcacccaagtcacctcttgatgctttgttgcttagaaatttattctgccaggtacccaaaatcatctccctcaagttcaaagtttcacaaatctctagggcaggggcaaaattctgccagtctctttgctaaaacatagcaagaatcacctttacttcagttcccaacaagttcctcatctccatctgagaccacctcagcctggatttcattgaccacatcattatcagcattttggtcaaagccattcaacaagtctctaggaagttccaaactttcccccattttcctgtcttcttctgagccctccaaactgttccaacctctgcctgttacccagttccaaagtcacttccacatttttgggtatctttacagcccaactctaccggtaccaatttactgtattagtttgttctcgtgctgctaataaagacatacacgaaactgcgtaatttataaaggaaagaggtttaatgaactcacagttctctgtggctgaggaggcctcacaatcatggtggaaagcaaagaggaacaagtcatgtcttacatggttggcagcaggcaaagagagagaacttgtgcagggaaactcctctttataaaaccatcagatcttgtgagacttattcactatcatgagactatcatgggaaggacccgcccacatgattcagttacctcccactggatccctcccatgacacatgggaattgtaggagctacaattcaagatgagatttgagtagggacacagccaaaccatatcaagattataggaggttttaacattttttgggttttttaaaaatttaagtgatttatgattaactctaagattaagctatgtcaatctgagccttcatttagcccttaggtttcatgtgccaatttatggatgaactaggttgtacttgcctacagtcttaaaatggctataattttgtttcttaataatttctactttagctcctgggagttttctttctggctttatgactatggttgtttcctcttactccagctgagtaccagggactgtgagatcaatcatctctagccactgacctcttctggggcagtctatgagtacagctggtgacagccaggatctggcatccaggtgggaggagagggaagggaggatcaggaggctgcccacaggagaagacatctcaaggttgcaaataggaatgattcaagccaaggaagggaatttctagctaattctgtattaaaacaagtcagactttgccttattgtccccccatgtctatgcctgcagtaacaggaattcatgagaataagaaaggtaaagaggaaaaatactggcctgaaaatagataatggaagctctgctagtgccagggtctgctttgctggggtcagcattaagtgtgagtaaatgtatctgaataaaagtgaaccatgagtatgtgtctaaagcattcctgcaaggtgctttcaagttgttggaaaaggataatccttagtcaggattgtggcaaagcctaaaataatctttgaccacaaagataatcgtagcatcccatgtgctcctgctcctgcaggtgcacacagtcggtgcaaagggagtcttcccctgctgtggatgggcagctgactgtgcccctttgctttccagctgtgtcgactctacaagtttattgaacagaagggagatttgcaagatcttatgccaacaataaattcattaataaaacagaaaacaggtattgcacagttggtgaagtatggcttaaaagacctagaggaggttgttggactgttgaagaaactcggcatcaagttacaggtttggcaacagtttgatactggcagtacaaatgtgtagcattactaatagcacagggaggaaatgtgtttcatttcactaatgctagttagtgttttatttttccagaaaaactgctttctgtgttttggagcatttgatatttagtaataattttggcttaaatcaggatttctttgcaagtgccactgttcctatcatgaagcagttcttactatgttagcctcagagaggtggttattcttaaagagaagagaatttattttacttgtcaggctatggttaaacagactttgagctagatcttactgaatattttgtttatgctaaatagattgttctgatgctattgatgggaaacaccattttcagcattatattccacattctaaatttcaaacccttgacacatttgtgtggcatctctctttataggtcttgatcaatttgggcttggtttacaaggtgcagcagcacaatggaatcatcttccagtttgtggctttcatcaaacgaaggcaaagggctgtacctgaaatcctcgcagctggaggcagatatgacctgctggtgagggcttgccctttatttatttgctctgacttaattttatttcttctaaacttgttattttgaaattttcaaactaacaccaaaaatttgaaccagtaatatcattggatacttctattaatatatgtttcatctaggaatagaaatataatgtgaaccacatttgtagttgtttaagcttaaaacaattatattattttgcaagatagttgcaaagatagtactgagagggctcatgtaccctttactctgtttctatatatatatatatatatatatatatatatatatatatatatatatatatatgtattttggagacagggccttgctctgtcacccaggctggagtgcaatggcgcaatcttggctcacagcagcctcgacctccctgggctcaaatgattctctcaccttagcctcccgagtagctgagactacaggcatgcaccaccacacccagctaattttttgtattttcagtagagacagggttttgccatgttgcccaggctggtctcaaactcctgagctcaagcaatccacccacctcagcctctcagagtgctgggattataggtgtgagccaccacaccaccccttgcataagtacagtaaaatatcaaaaccagaaaattgacatttgtataatgtatgtgcatcattcttctccattttatcacgtgtactttccctcaacaaccaccataatcaaggtacagaactattccatcaccacagagatttatgggtatcaacatcttatcaattcaaatgaaatgtagaaactttatctccctgtatgtctctttacctcatgccccatttataatataattgtcttaaatatttcttctaatacattgagatccacatcaaacagtgttaaattttttactttactgttaaatataattataaaactcaaggggagaagaaggtctattgtatttaccccaaatttctggtttgtgatgagaaatttgctgttatttgagttacttttcccctataggaaagttatttctgacttgatgctttaaagattattttctttgtctttagtttcaaattaaatcatgatgtgtcttggcatgagtttctttggatttatcctgtttagggtttgcttagcttcttaaatctataggtttatgtcttttgcgaatttggaggattttttcaggcattctttgattttttttttcagtctcacactcttttttctctccttctatgaccccagtgacacaaatgtccttgaggttatgggacatttttgtccaggctgatctcacactcctggctgcaagcaatcctcctgccttggcctttcaaagcactgggattgcgggtgtgagccaccacacctgacctgtaattttaaattatttagtaacattaagtaaaaggagacaagtggtattaattttataatatatcttatttaacttagtatatccaaaatattatttcaacatgtactcaaacttctaaaaattattaacaaggattttacatttttttcaaagtctttgcagccagtatgtgttttacatgtacagcatgtgtcaatttggattagccatatttcaaatactcagtagtcacttgtgactagtggctgccatattgaacagtgcagagttagatgaaacatttgttaatattttttctaaatttgcatgtgtgcttgcttctctattttactacacacacacatttctttttgttgaactctttgatgatgagctgctgacagagtgctcactctttaatcattgttttccccgtaatcacagtttctttcctatttcataaccataactgtttgtgtctctccacagattccccagtttagagggccacaagctctggggccagttcccactgccattggggtcagcatagctatagacaagatatctgctgctgtcctcaacatggaggaatctgtaagttctggcttggcttcccagcatacttcgaggtgtctttcatttctaaaagtatgatttgccttttgcagtcatttacatggggcttctgatgtgaaagctatagacgtagggttttgaaacttacctttaatatgatagacaagcctaagacttgatgtcaatccctgcatttcagtccttatcatctgttctctagctggacgaccttagaccaggggtccctaacccccaggcagtggactggtacccatccagggcctgttacgaaccgggccgcacagcaggaggtgagcagtgggcaagcaagcattaccacctgagctccacctcctgtcagatcagcggtggcattagattctataggagcatgaaccttgttgtggactgcacatggaagggatctagactgcacgctccttaggagaatctaactaatgcctgatgatccgagatggaatagtttcattccaaaagcatcccctcccaacccccgcaccatccatgaaaaattttcttccatgaaaccagtccctggtgccaaaaaggttgaagacttctgccttagacaattaattcatccttccctagactcattttccttatctgtaacgtaccatataaatgtgagatgttatagttgttaacaggctcttaacaaaacttcttgttcaggccaggcatggtggctcatgcctataatcccagcactttggaaggtcgaggcaggcagatcgttgagcccaggagttcaagactagcctgggcaacatagcaaaaccccatctctaccaaaaaaatacaaaaattagctgggtgtggttaattagccatgcacctgtagttccagctactcaggaggctgaggtgggagaatcgtttgaacccaggagggggaggttgcagtgaggtgaaatcatgccacttccactccagcttgggcaacagagccagaccctgtcaaaaaaaaaaaaagaaaaaagaaaagaaaagaaatcctgctgtggtctacaaagctagaaatagctttttttcccccttgtatttcaggcaagattagttttcctagagaaaaatggtattttccagatggctcagggtagttgaaataatttctgtcttgaaagactaacataacattttttttttttttactgtggccgagcatggtggctcatgcctgtaattccagctatatcccaataaggccaaggcaggtggatcacttgaggccagaagttcgagaccagcctggccaacaagcagaacaacatccctactaaaaagaccaaatatatatatgtatatatatttatttatttatttatttatttattttagccgggcatggtggtgcacgcctgtaatccagctactctggaggctgaggcaggagaatggcttaaacacaggaggcggaggttacagtgagcggagatcgtgccactgtactccagcctgggtgacagagtgagactctgtctcagaaaaaaaaagaaaaagttgtttgagtgtgtcttttttttttttttttacaatgtgttttgaagcaaagtctttggcacgctgtgtttctatgcaggatttcaagaatgcccatcttcccaagagtgctgcctcccctcctgatgctggtttcacttccatgcctgcagtcttgctcctctaactgtaaccggtctgtttctgatccaggttacaataagctcttgtgacctcctggttgtaagtgttggccagatgtctatgtccagggccatcaacctaacccagaaactctggacagcaggcatcacagcagaaatcatgtacgactggtcacaggtaatgggacaaaaagcacctgtgagtgaagtgcaaattgctatggctttcatggcaaatatcctctgcacctatagactgtcaaactctgtttatctctgtaattcgagttgcctcctgtgttagtttctgattgctgcagtaaccaattaccacaaacttactggcttaaacacatatttattatcttacatttctggaagtcagaaatccaaaagcactttcactgggttaaattcaacagggctggctcctctgggaagctctaggggagaatctgtgtccttcccttttctggctcctagaggcctcctgcattccttggctcatggcctcttcctccatcatcacactcagcaatgaagcgcctccttccttgctgacctgtgcttctgttcttacatctgtctctaactcttgtctgtccagctccctcatacatgcaccctgtgattacgtggggcccacccagataatcctggttgatcactcacaggttctaggaatgaggatatggacatctttgcggggctgtactccagcctgccacacttctgaaggcactcagtgcttagtgtgttttgggctctgtatcctgagacctcccacagcatgcaggcctgacacttgccgtgggtgtggaggtgtggaaagtggcacccaggacacatgcctgccctttggaatgggggcgtaagcagaccatagaaggggtgcactcccaggagatcatccaggttgtacccacattcgcccacactaaaggtgccccagagcatggcgatgaccagggacacagacccaccaccctcccacctgctctgtttacatcacctgccaggaggcttctgaagctgctgctgtttactcgtgtgtgtgtgttgtatcaaaattcacatcagaagtgtgctgagcaacaatttttaatcatttgacagaacagtgtcctcttctacttgttcacatgtttcataaatcattagagaagtgttctgtcctgcagtaaaatccaagcctcgtggccagtgacctcagtcctgcacagtgacaccccacaggcttctctgccccctcctggtttgcttcttcagttctgcttttcaccttcccttatttcctttgtttccttcattttcctcagaggctttttcagcgtgtgtgtgtgtgtgtgtgtgtgtgtgtgtgtgtatgttgtgttgtataattttgggcatcttttattaagtcttgaagcttttgaaaacctcttactattgattgattattcatggccctttaaacaatcatgaagggaagggaggcaagagaggccttgttcctcccttgaattctatgcggcttcttgcttaatatttatatccccctgaagtcagcattttagtaattcacattgagaatataattggaaacagtattttcattctccttaattacttgaagctgttccaggtgctctgtgtttattttctttactatgtttgtttgtttcagtcccaagaggaattacaagagtactgcagacatcatgaaatcacctatgtggcccttgtctcggataaagaaggaagccatgtcaaggtaaagacgtcagagattttttacaattcaatagttaggtgttacctgtggagcacctgccttcacactgaggcccgggccgtgtaggtgactggaaatccgttccctctactctccctttccattgttgggtttcttttttttttttgagacggagtctcgctgtctcccaggctggagtgcaatgacgcaatctcggctcactgcaagctccgcctcccgggttctcgccattttcctgcctcagcctccccggtagctgggactgcaggtgcccgccaccacgctcggctaattttttgtatttttagtggagacggggtttcaccatgttggccaggatggtctcctgacctcgtgatctgcccgcctcggcctcccaaagtgctgggattacaggggtcagccaccgcgcccggccgttgttgggtttcttgctgaagaaaatgtgtataaaataaggaagagagtccaccttcattaaagctttaaaaagcaaaacaaacaaaaaaactggctgtggttttttcctacttttctcctcttgttctctttttccagctaagaaaataagaataagtaaagttgtatctgctgataggcatatcctctcattgctttgtaaccaattttacttttttgtattcaactaaaagtgttcataaatataccacctcataacctttatttctaattatttttaaagggaaaaaaactttcttaaaaatatttttctcttctaatttttttttggtttcgatatcagggtaatgttggcctgatgaaatgagttggagagtgttctctcctcttctgttttctgtaagatactgtatacaattagtattagaagtccaatctcaaatatttctatatatagagctattctggttacctctttcttctagaggcagctttggtagtttatatctttcccggaacttttccatttcgtctgagttttcagatattcccctgttattgtttcactgtctctaggatctgcagtgatgctccctccttcagacctgatatgggtaatttgtgtcctccctcttttttgtctaatcagcctggctagagattgatcagttttgtctttccaaggaccagcttttggtgtcattgatttttctcagtttttatttgttcatgtgttttctattttattcatctccactcttatccattactattttcttccttctgcttattttggatttagtttattctttttttagtttcttcaggtagaactttagatgaggtattgacaaactacaccttggaccaaattcagcccatagcctgcttttatatgtctgtgaactagaaatttttacattctttgttaaaaaacaacaacaaacaaaggagagtgtgtgactccaactatgtatggccctcaaagcttaaaacatttcctatctggccctttacagaaaaaaatttgaagctttgttattatacatgtttaggattttatatcttcttgatgaattgtcttcatcattataaaatattccttatccctggtaatatttcttgttctgaaatcttttggttagtgtttacgtcactacctttctccatccttttatttttaacctgtcttttttttttaagagatgggggtctcatcatgttgcccaggctggccttgaacgcctgggctcaagcaatcttctcacctcagcctccagctgggatacaggcgtgtgccactgcacctggctaacttatctatctttatatttaaagtgagtttcttatacacagtcactaggttgagttttcctttttttttttttttttttttttgagatggattcttgctctgtcacgcaggctggagtgcagtggtgcaatctccacttgctgcaacctccacctcccaagttctcctacctcagcctcctgagtagctgggtttataggcacacaccaccacacccagctaatttttgtatttttagtagagacagggtttcaccatgttggtcaggctggtctcgagctcctgacctcatgatccacccacctcggctccccaaagtgctgggattagaggcgtgagccactgcgcccagcctcctttttttttttttactctgagaatcctggcttttttttgtttttttttttgagacagggtctcactcacctatgttggagtgcagtggcgcgatctcagcttactggaacctgtctcccaggatcaagtgatcctcccacctcagcctcccgagtagctgggactacaggcacgcaccaccatgactggctaatttttgtatttttagtagagacgaggtctctactaaatgccaaatgccatgagatttgctaaatgccatgagagtcctacagataaagttctccaagggtccctcaggctgggagatttacataagaggcagcagtgaagtcttcaggaaggtgctgggatttatcctaccctcaagaattcgtggtcctggaagggccttttaggaagagggaactgcaaaggtgatggtagttcttttagtagttgtcccaaagatagaggcaggccagcagagaaccattctggtacaaccctgaatagtctattttgggtgagacagatggatcagaagcagaaaatggttatagctacatcatggagagcccaaatgccaaccaaggaatctggtttttttatttagcagttattggggaggccccgaatgttttgaacagaaggagacatcaaagttgtgtttgagaaaaattaatctgcagggatgtgtagcatggaatagagtgagggagaaaccgaggacagtgatagcagtataaagaatatcaaactagcctaggccaaggttgggtgctggccaggggagtgaagatgaagggacagatgccataaaagtgggatgacaggacttgggtttagaaaggagagggaggagtggtagatgaagctgagatctgagaaaccttggtggctgaccagatttaaaggggaagatgttaaagaatcacatgaaatgagagcccattcatcttggccttaaaaaaaaaaaattctatcatctgtgataaactagtccagaccagggtttctcaacagcagcgctgttcacattttgggccaaataattctctgttgtagggggctgtcctgtgcattaacagcatctctgaccgctacctactacatgccagttgcaccatccaaaaatgtcaccagacattgctaaatgtcccctggggagcaaaattgaccctggttaagaaccactgacccaaactattgatttagtagtcttactgtggtgctctgagctagtcttctgggttcagaaacctccaaatgatagatccgtttcattctttttaaggttaagtctttcgagaaggaaaggcagacagagaagcgtgtgctggagactgaacttgtggaccatgtactgcagaaactgaggactaaagtcactgatgaaaggaatggcaggtaacttaggaaacaaaagccgagaaaagtgacttcagttacctatatggaaactacgtaaatttattttaaaagtcaatttgagccaggtgctgtggctcacacctgtaatcccagcactttgggaggccaagtttggggaatcacttgaggccaggaatgcaagaccagcctgggcaacataccaagaccccatttctaaaaaaaaaatttttttgattagctgggcatggtggtgcattcctatggtcccagctactcaggagctgaggtgggaggattgcttgagcccaggaggtcaaggctgcagtgagccatgttcataccactgcactccagcctgggtgaagagaaagaccctgtctaagaaaaacaaaaagaaagaaatcaatttgatccttttgagaaacaaagataggtcaggattacttttaatgaaccattctgttgcttctgaataactcaatcaggagtttaattgtatgaccatcttgtatgagactaatcatagcttacattcaacatttgttcttcataccatttccaagaatactttatcattttgaaaagcctcaggagccaaaatctatctgtcattatcttattcagtctgctaatcagtgaatttcaataatattttgtccgtgtactttgaaagatgtaacgttctgggaaaagatctcacttcctcatgatgggagtatcaaccatatgggtaggaatttgacaaagtaaattaaaagccttaaaactaaacattttttttaaattgacccagcaattccactttcaggaatttataataaaaattattttaaagatgtctatcaaggctcatttataacagcagttctcaaactttttggtcttagaacccctttacacccttaaaaattatttcaggatcccaaagaacttttgtttatgtgagttatatctataaatattaaaacataaacattttaaatatgtttattcatttaaaaataacaataaccccattacatgctaacgtaacatatttctattgaaaaacaactgttttccaaaagaaaattaacttagtaaggaaaatggcattgtttaaaatatttgcacatcttttagtacactgttttacatttttgtaatctattttaacactttagtagaagaaatgattctcctgtctgtttatgtattcaatctgttgtgataccacaaatcatatagtctctggaaaactcggttgcacatttatgagaggatgagagtgaaaaggcaattaatattttaagattattatgaaaatagttttgaccttgcaagaccccttgaaaggatatgagggaccttcaagattctctagaccacacttggagaacctcatttcaaaatatacattggtagaagattgtttgaattatgataatttggtgaaatattgtgcagcctttaaaaatgatgattctactaaagctgagttcattgacatggaaagatgtccataaataggatgtttaatataatcccattttgtggccgggcgtggtggctcacgcctgtaatcccagcactttgggaggccgagaaggggggatcatgaggtcaggagatcgagatcatcctggctaacacggtgaaaccccgtctctactaaagatacaaaaaaattagcggggcatggtggcgggcacctgtagtcccagctactcgggaggctgaggcaggagaatggcgtgaacccgggaggtggagcttgcagtgagtggagatcgtggactgcactccagcctgggtgacagagcgagactctgtctcaaaaaaaaaaacaaaaagaacaacaacaacaacgaatatataatcccattttgttttaaacaaaatatacaacctatacataaaaaaatgtctagaagaacgtaccaaatttttaattgtagttttggttagtgggattacaagggatcttaaattactttgttaagcttttctatatatttgcaactcctttttttttttttgagatagagtctcacttttgccgaggctgaagtgcagtggtgtatacatgactcactatagccttaacctcccaggctcaggtgatccttccttcttggcctcctgagtagctgggaccgtagtcatgtaccaccttgtccagctaatttttttaaattatttgtagagacaggatctccctatgttgcccaggctggtctccaactcctggactcaagcaactctcccgcctcaagaaattcttatatgtatgctcattatcagaaaataccacacggtaatttttctggcttacatcagcaattctcaaccaacaatgattttgcttcccagggcacatctggcaatgtatggagacatttttggttgtcacaactggggagttttactggtatctaggagaggccagggatactgtgaaaacatcctaaagggtacaggactactaccccccaacagagaattttctggcctaaaatttcagtagtaccaagattgggaaatcctggcttacagaaaacaaaccttgctctgttcttctcatgcccccaccccttcttatttgcacctagccttaataaattcaccattaggtgtttctgagggaacataatgttctggaaatcaccagtattggaattatagatctaaatcaaagacagaggtttagaagagaaaccaagaaatagccaagtagtgagtatgggggaacattaccaagacacttaaaaggctacatgggatttagttttagcagggaaaggttcaaagtttttcctccagcaaatgattatttccctgttttcccaagatagagtgctgttgtctctctcaaaggctataaattaattcacagcatttgaaagaacatccattcacggctttttaaagaatatctttatttaccaaatgttctcctgtgggtggttgccaaggctactgccataatgaaggtggggctgctgttattcatgtttccttgtattatgaggggggcggaaagaacacccattatatttcattgaaatcagcttattgtgtggatccaggatttcacgcccagctgaataaatcagaatgttttccttaggcatttgttaacttaaaaagacatcctttataatttttacttgctcttgaccaaagcataactaaatgcaaattttttgtttttgtttttccaccaataaccaagaagatgtttttatatttaatggaaaagtggctcactatacatgtagttcactgtaagttatgtgttgcttgtgccttattgactgttctttaattgtttttgtttgcttgtttttagagaagcttccgataatcttgcagtgcaaaatctgaaggggtcattttctaatgcttcaggtataattactaattataatctgaacataatgatgcttatatgtttgctctaagcacttattactgtagctaactgcttgtgacactggaaatctatttttaaaataacatatacgcaataaattgtaccacatgggatgcatccctatgctttgaaatccacatcctagaaaaggataaaacaactggaatttagctgactcttctactctatctcttatttttacaagtgatttaatcttccttttactcaatttattgtacaagtgaaatgtgtataattttcctggagattttcctcatacagaggattgaaggaagtattttgaaatcccttgaagaaggacactatacacattttgttttcgtgaaagccaagagggcacagtggtgatagttatgcctttgctttcatcacctctagcaaccttacttcttttttaaagaagtgttccaattaaggccatgagaagacatatttggcttttaacagaattgagtctttcccattctcttctgttagcactaactttgtgttgccatcagatttccaattcttgcaggaatttaaagaagtatgcaggtttggtgatattcagcttgattttcttaggcccctgaggttttgatgactcctgttgcctccctgccccttccaccaccccccaacccctgcctgaggagagaagcatcaaaactgctgggtgttggggttctgggctcctcacctatccggtgcagatggttgtagggatagaaaacacagcccagtcgtgatctagcccttagaatcacgacaggatgtctactaataaactctgccatctctctgtagtatgttgtagaaagtgggaccagataaggccataaattctgaaactctcttggtctcaggtttgtttgaaatccatggagcaacagtggttcccattgtgagtgtgctagccccggagaagctgtcagccagcactaggaggcgctatgaaactcaggtacactgggtcagggtttctttggctttctaatatgagttacagaagagaaaaacaacaacaggaaaggaaaataagataaacatggaatttcttggaaatattttttccaagaaaaaaatttttcttccaacttgcctaactgggtggcttctggctccaggattcccatctgtccttcagagaggggccattgtgcactgtgggcacctcaaggcagctgttgtcagagtgactgcatctaaatgaaaactatctaatctggctctaaaggtagttgaggtttgtttgtgctctaaatagcaaagtagaagaggccgatgacaagacttaaggcaggcttctcattccatacatggtttcggcatttgctatatgcctactggtgtgctaagggctgtgtaaaatgtagaaaacattaacatggccccagtcctcaaaagagtttataacttagaagcatatgcattatatagagaataataaaagcaaataaatataggccaggtgcggtggcttatgcctgtaatcccagcactttgggaggccgaggagggcggatcacttgaggtcaggagttcgagaccaccctggccaacatggtgaaaccctgtctctactaaaaatacaaaaattagccaagcgtggtggcaaacgcctgtaatcccagccactcgggaggctgagacaggagaattgcttgaactggggaggcagagattgcagtgagccaagatcatggcactacactacagcctgggcaacagagcaagactttgtctcaaaataaaataactacagtagaacactgagttaaatttatagaatatgaatgttagagtatgctgtggacatatgcaaaagagtgagtgttaaaagagagcagtcaattttagaaatgtaatcagactgaaatacaaaaatcaggtactttatttttgtaagctcttctagctgtttctcaggatttgggtggaaacctatttttcccgtcttcctactgccttcatcacctaccaagtttcagttctcacaccatgtcctcattgctgccacctctccctttttcccaatttagcttcatactatcatctctctgtctctgtgtgcactgtttcactgcgctacgcctttataaggaatcatttcaaaattatgaagagataattgacaaggattattaaacaaatggtcaagataagttataaaaacctcatttcccctgagatcatattgctagacacccctttctgagtggattaagagcaaatcttcttttttttttttgagacagagtctcactctgtcacccaggctggagtgcagtggtgcaacatcagctcaccacaacctctgcctcccatgttcaagcgattctcctgcctcagcctcccgaatagctagtattataagcgccggccaccatgccctgctaatttttctattttcagtagagacggggtttcaccatgttggccaagctggtctcaaactcctgacctcaggtgatcccccagccttggcctcccaaagtgctgggattacgggcatgagccatcgtacccagccaagggcaaacctttagacaccatttggaatcctttctaggctttggtatgtaaccctgtgattgtatcctgggataggaaataagatggcaagaaagatggcttggtttaacatgttctgaattccattttcttactatttaggtacaaactcgacttcagacctcccttgccaacttacatcagaaaagcagtgaaattgaaattctggctgtaagtggctttctttagtattttgaaggtggcttctgtccatactgtcaaagtagttgcctcagggttcagagcttttttgctcagtgtcagcagaatttggatgcaggccttattgtgatgtgaactacacgcaatttaaaactattaagaactagggggagaatttaaggttttttgtttctcctctttgttcctctttaagatagaggaaaatgaaaacaaaagtcattttcctacatatatcaggcctttgccttgctaagcttacaccgaatacatgtagcagcgtcagacctttcgggtgtggtgtagagggacagggagtacagtttccactgcttattaattctccagggctaagatcttatcactgcacagttcattaagcccttttacagcacaatagcatctcagactctgcaaaccctattcatactgctgcatttcacgtgacactatggtcacaaggcagtattgtgctgctgagagttgatgtacatttgtgtgtattcacaggtggatctacccaaagaaacaatattacagtttttatcattagaggtaagcaatatgaactcttctgcactgtggcctttaagatcccaaatctttgctattagtttgccaaaatactgaagacggcattcattagtgatagtatttttctggcagctgcaggaatttagtaacatttttccttttatgtaacatatatgttcctaaatcctatgttgaaggactcatacttttctagtgactttatttttcagatacttattttattaaaaacaaaaaacaaaaacaaaaaaacacatatactgcttttactatgtgtcagggtctggcaggccttgttgtaagcattttacaagtagtaactcatttaatcattaccaccccaaaatgtagatactgttattatccctttacagagtacggaagtagagaggttaaatatcttacccacagtcacccagctagtaagtagtagaaccaggatttgaacctaagcagactagcagaatcggtgttcttaaccactatactatactatctctcaaacctccattccagctagggaagctcatttgcagattagtactatacaaaacaaaatccttttgtaaaaattaattaggtcctttataaatatatatatatttttacaggtacatccctttatcatcaaatagcctaaataagaactttaaaaatttgaatagttatctttgctattaagaacactcaactatagtcatagctacaggtgacttttgcaacatgtcatatcaaagaatacttttttgtctatccagagtgtttagtcacaaattaaattagattaatagtgaacttagccctagaactagtattttatatatcattttttgttctcttacaaataagcatataccactatctcactggcagtgtactgatttatgatccagtcaaatggatatacttaagagctgctatcaccgttgtacaaaaagtaaacagaggccgggtgcagtggctcacgcctgtaatcccagcactttgggaggccgacgtgggtggatcacctgaggtctggggtttgagaccagcctggccaacatggtgaaaccccatctctactaaaaatacaaaaaattagccgggcgtagtggcaggcgcctgtaatcccagctacttgggaggctgaggcagaagaattacttgaacccaggaggtggaggttgcagtgagccgagattgtgccactgcactccagcctgggcaacaagaccgaaactccatctcaaaaaaaaaaaaaaaaaaagtaaacggtaggcagaaataactgctctaaagtcacatcagcacactagggctgcagcattgttaatcaggctctaattagggagtcttgttttaaggaaaactggtgcttcagaggaaccccagcagtctcctaactggttctgctatctccctattactgattctcctggtatacttgaagagggaaatgacactggaatttcattagtgacccagaaaaaaccagctagtaaaccctagagacctgttgttaagtcttatctatttttttcctagtgggatgctgatgaacaggcatttaacacaactgtgaagcagctgctgtcacgcctgccaaagcaaagatacctcaaattagtctgtgatgaaatttataacatcaaagtagaaaaaaagtaagttatcacttgggcatagcagggttcacatggttaaaattcagggcggggggtttcagagtgacattattttgttgtcttgttgaggtttgacgcctggtaagctgttcttagaattgcagctgacaaccaataaatcttgcttggactgtgaatcacagtcatgatctcatcaataacaaaacacaggggtcctaggagtagctgtcccaattacaattttgttcacccaggtaattcactttctaagtatgtttaaatcaaagaaaataaccatgactactttgctgtatgtccttatgtcataatgccaatcaatcaatcaatcattcatgttatcatacacttaaaaggcaacaaggaagcctatgaggtgaatggttatctccttactaggaccttatactgcagacccctgtcagtcacaccttgtataaaacctatataattttttaatgactagccttccatcttgtttttgcttaaataaagctcctacaggtgttataaaaatttattagctctgttcttcactcattaaactgagtctgtccttatatcttttcttttcttttgcagggtgtctgtgctatttctgtacagctatagagatgactactacagaatcttattttaaccctaaagaactgtcgttaacctcattcaaacagacagaggcttatactggaataatggaatgttgtacattcatcataatttaaaattaaattctaagaagaggctgggtgcagtggctcacacctttaatcccagcactttgggaagccaaggcaggaagactgcttgaaaccaggagtttgagaccagcctgagcaacaaagcaagaccccatctctataaaaactaaaaaaattagttgggcatggtggcacatgcctgtagtcccagctactccagaggctgagatggatcatctgagcctcaggaggttgaggctgcagtgagctgtgactgcgccactgcactccagtctgggacaacagagcaagaccctgtcttaaaaaaaaaaagaaaaaaaaaatttttttctaagaagctgtcctacaaagttgagctttgttagtttttcatgtgtaatatattataaatttatcttttgggatataataaatgctttcatatacctgc

SEQ ID NO: 524 - DNA, 64808 bp, Homo sapiens
gcgcgccccggcgccgcgcccggccgggagccgcctgttgatcgccgcgctcgccccggccacggcgccgcccctgttctcccggccccgctccaccggggctgacggactgacggccagcacagccggctccgggatgagcgcacggacgggtgagcgccccggggggcgggtggggcctgttctggacagccggtgtctgcagcccccgggcccgcagcgcggtggccgccgtgccctccctgcccgcgggaggatgctccgcgacatgggcggtcggccgggcgggcgtgcagagccgggccgcctctcgcctctcgcctcccggcccggtcggctgcgccgggagaccaggcgctgcgcccgggcgggaggcgcccgccggggtgtgagtcccgcgccccgcactgcggtgccgcagcctctgcagcccgctgggccgcagcggggagggcgcggtctcctgtcctcccgggctgcggggctgtgttcttccactccgggctttgttcccccacttttccccttcctgtgcatgtttggtgagctcctggagcggtatgcatctccctgcctcgttcagcaggcgatggggaggggtggactggccggcgtctttcctgagatcgctggagctgtcactcgcagggcgtttcagcctcccagtaagcggcctcgtgcggatcctcgagaaccttattattattgttattacttttctggttaaagtaattgtagtatgtgctcccttgaggcttcctaaatgttccctgttgacctgcggaaatgaaggtggatttttaaaacagtaataaaaggcttctaatgggaatttttagagtattcagaggtaggaaggtgatgccgtcacaatgcaaattagcagtgaaggaggccgtgcttactgcagcttcgtctgtgcccattacatatctgaatcacgaggcatttaggacgggaatgaaaagaagatcgggggaggtgttttaaaaaccaggttctcctcttagcttgaccattcaggagctgagggacctgggcaagtccctccacctctctgggcctctgcatgtaaaggggcgtttgggctaaatgatttgtaaacctctgttcttccaagattctcccctctcagggaactgaaaagatgagagtgtttctgtttaacagcactacaaaaagcctaattgtgacaacaagcgcctctaccctagtgaggaggaaagatttttcagagcttcagcaatctgatttttttttaaagataaaactgattttctcgatcgactctcttcagtctaacccaataaatacgcattgcaatcattttaatttttgtaaggtactgtacattggtgggcaacaaaatgatggggtttgtttttgtctttaatttgctgaaggtgaagtgatgggatcagcagataaaggattagtggctccctagggctgggcacgagtggtcaaatgtggtcagcatggaggtcggggaggaagccccagcaagaagtaaccagaatgtgtatacacagaaaagagaagttgcgtactgatggatcattgtttgaaaaagaaatatgcaatagaaggaatgagagaatcaggaactcggcgctctgcaaacctaacataacagttgaataaggcaaggacttaccaactggtccaaaacctttgagtgaaaggtggttggggaataggattttcatattatttcaaagtatctcaccacagtttactctgggaaaatttgtccttacaatggagaaattaggaggtcaccactggaaccaaatgaccaagtttagcagcatctactgcgagtctcccgttgtgaagcaataaggaggcataatttcacctctgtagtgttcctgcaaaaagacttggcgatggggcagagcaaatgggagcaactattgtaggttaaaatactcaagtgatacaatagtgaattgggatgtgtgaactttgaatcctagatgcaaaaaaaaaagctataaaagacaatttggagatagttggggatgtttgaatatggattgcatgttagatgatattatggaattggtgttaattttcttaggtgcaataatagttcattcttgtggttacctagaccagacaatccttattctttggagatgtggatattggaggtgaagtgtcatgacatctgcaactttcagctgtgtcagaaaaaaaaaaaaaaggataggggtagcagaacaagttcaggaacgtagcaaatgtggcagaatgatgacggttggtgaatcaagaagaaaacaaatgtttattgtactattcttttaacttttctatagatttgaactttaagaaatggggaagtcaataaaataaataagcgaataaagagaaagtgttgtagaagacgggggtggttcgtgacaaacagctgcagtgaatctgtggggaatttcttggcttcaccttcccaaaattgaaatcacctattggaggtgtgagtgggggggacggggggttggtgttcccatttttggtttatcttggctactctcaatcatttatgcttaagtaccccatcctctagcttcaacttcaaagtattagtaattctccatacctaagaaattctagccctacccaagaaccatcccgaaagtgctgtccctttcctctctgtgtccgagatctgtgtcagtgtgtaaggaagtttgagaacataggcagtggttcattttattttgggttagggtagtgttgggggaaaaatgatttagctttgtgataggatagaagttttggggtttcctctcattcccttgtgtgtaaatcatatacaaccaaatgttttccttatagactttaagtggttcaaagaggttcatagaaggcatgtgcagaagagacttcctgttaccagaccacgaaaacagaatcaactcttacaacacttaatctcttacacggaatcccttgctgcaaagatatttttgctttacctggattatatgtgtttatgtatacatgaaaatactaatttaaagtatacatatttacttgcatgaatgtctgtgtgtacttgtgaatctctcagtcagtattccccaaaatacatagaatgttaatgggttacaagaaaaagaaattgcctagccagatgtggaaaacactaaacaaagctggacaagttggtttattcttgacttttcagagcctttcatgggttaatgatcattgtatatggggatgtaaatggggtgggaatgtccataggatgtgatatgtaatgtttcccaaactgtgtgcaaaaataaaaaatgaaaaatatcttgaggggctatcgttacatggaaccacctttgagaaactgcctttaatgcatttttgagtgaaaggtcaggacatatgattaaatgtgtaagttgtaagtatttgtgcttcacattacttacagattagaattcaaatttcagtttctggttttaatggatcataacagtttgaccccagtctactttttcatcctaaatttcctaactttcttcctataaattctcctgcttagtcctttgttgtatactatgaaccatttttattttcagcacaccaaaaagtcaattctacgtaactttaaggcttcgtggttgtgtaaaatgagatgcgctcttctgctatggctcttccatggactgaaatagccacctttcctcccaaagccattttgagttccttggccttggtcccatgtttcagcacaaccttccttaaagctgtgatttcttgctatttctgcttttatgatttgccatcctgttttggcatcaaggctgccccactaattacctctttcacatgtgtcatcactattcctaggttcccctggtgagagctaggtagggtggggatgagaaagtcaactccaggactgtgagtggcaggagctcacaaaatagggcacaaggccagccatgccaagcctggacatgaggagaaaggagacaagctggggcacaagccctaagaaaggaccaggaggtccctcatcagagtggttagaggagtgtggagtccagtgagctgggctgctattcaagcggtgtgcatggggacaactgtcctcattgttgataaacaaccattctgactgggcagtgtcccttctataccagttgctaaatgttttgcacatcatctaggtaagcactcacaagtcagggtgcatacagcatccataagtcattacaaaacctggatcaaaacctagctggtataaaatgccaaagaaagagacaagatgagtgagtcaaagaccacataagcaagcagaagaaaggagggcacatgaatcaaaggacaaaaagcaggaaacccggtgccaatcaggaagttagaagaagcccataagttcccaaaggcaagaggaaggacatggttaaaagcaacaggcagttaaaacccagaaaggcgcagatctccaagtggaaggcaaggagataaatagaggtcaagcaagaggaactcctctaaaaacagaaaagaaggccaaacacagggacaagacaacagcgggaaataggacccgccatgagaattagaaaccaagaggcaggctgggcagacagcaagactttttggctttttgactgcttcctacccaggtggaaatctatctcatagcttggctagcttacactatggtggctttctacacctggcaatgctgacccgcagctcttacaggttttgcctctttatattcagcagatcttgatggggaaaacagagggaaagaacacctaaaacacgagattattccacaaccaaggacgaaagagaaatagctttgactgagggcttgcgcttgctagacactgcgcctaatatgtacatggtcaccttaagtgtcacctcagccttctgagataagtactgttctttgcatgttttactgaggaaggaccagaagtttggagaggttgtcactgcacacatatctgcaccatcagaccttgggttggttaactccaaggcccgtgcttttagtcttctgtgttcttctaaccttggacaggagcagtcactagtgggcaccttgtttttcaagtatgatttaatctttggcaagtttgtgttgtaagattgggaaatacgagctctgcattctagtaagatctgttcctctttcctctttcagcttgttccttcccattgccgtaccatatttcagactgagacttctccttatcccgcctcattctgtccttcatcctctgcaagtatttcccagaatatatagaagtcttttagttgtttaaaataaaacaaacttaattggcccatcttcaaatagctacattacaaaacaggcggttgctgtgttatatttgcccagcagccagaaatgaattaaatatctaagatcaattcatgttttgttggaggatacattgatatgcagattctgttctaatttactagttttagaaaatgtggatttggttctggtgcaaatcggtgcactaattgtttaaaattatgaaatattgaagacatattaaaaagaataaagagggctgagcgtggtggctcacgcctgtaatcccagcactttgggatgccaaggcaggtggatcacctgtgatcaggagctcgagaccagcctggccaacatggtgaaaccccgtctctactaaaaatacaaaaattagctgggcgtggtggcgggcacctgtagtcccagcttctcgggaggctgaggcaggagaatggcgtgaacccgggaggcagagcttgcagtgaacggagatcgcaccactgcactccagcctgggcgacacagccagactccgtctcaaaaaaaaaaaaaaaaaaaaaaagccatactccttattttccttcccaaggcttgtatatttggataataggaagagttatttaagggcccaagtcatgcttccatcagctcaagtctttaatcctattttctgttttcctaactggctcctgtacttgcccaccaggactcctggaagccttgttaggcatttgcttcactccagcatgtacattagcatcatattgcatgttaaatgcttgccatgggacagacacaccactggaggggaggctgtagcagtgcttgctaacttcccacggcagcattgctaacaggacggaagacaaatgggagcccttgggcagccttggtgggggcaaaagcagaccagccatgagctggaaaagctttgatttgactttaaaagctatgagaatactgcattcttctccacagtatttctatatttgctttttaaaaatacagcctgggcaatgtagcgagaccctgtctctacaaaaaatttaaaaactagctgagtatagtgggacatacctgtagtctcagctggggtcaaaggaggtggggggaatactgaggcaagaggttcacttaagctcaggagtacaaggctgcagtgagctatgatcacatcattgcactccagcctggggaacagagtgagaccctatttctaataataataataataataataataactagcttttccccaaatcttcagatcaaagttgtgctccaggaggatgcaagttttttttttctcctctgactttgagatcccctggtacattgacacaacataggcaatttgttttaacagctactgttacatagtatgaacatgttattttaattaattaatgtattttcctactgaagtatgacatggcacttattttctgggagtttgtagtgtagctggagagagaaccatacatgcaacatacatgaaaagatagcaagatatgtcaaattggtgatgtaggcatacaaatttagaggaaggggcaacttctgtgggcttagatgatctcagaaagctccatcacagggagaggaagcagtggatagagtggaatgagctctggacctgcgggttcatttgaactcatttctttcacatgacatttgttacacaatatttattggatacctacttcagatcaagaactgtgctgggagtcaggattttatcagtgaataaaactcatacagtccccctccctcacagagattagcaaggaaaatagagataaagcaagtagttgtaataaagccaagaacagatgtgattaaaggggtagcatggagatggggagtgacccagaccttgtctccaggtccaaacaaggcttccctgaagaagtgaagcttgcatgagaccaggggatgagtaggatagcagtcagccagaggggagtggggtgagagtgttctgagcagagagaacaacataaggcatgatccaggcattggaattgggccaggaggctggagccaggaggagatggggagtgcagcacaggatgaggctgacgaagatgacagaagacagactgaatttgaaccttatcctcaaggcagcagaagccactggaggattttaagtaactagagaagagttgtttaactctgtgctcactttggccatttgtatggcgaatggatcaggaagggatagggttgaatgtggacaatgcagatgagtgaagtgggtggattctcaacacgtttaggtaaggacaggatttggtgattgatggctggaaaagagacgagagagagaagatgttaaggatggctccctggtttttcggccaatttcctgaaatgggagattctggaggaggaaagatgatgagagcacttctgacatatttgaggtgtctgaggcagccaaggagagatgtgaattaggcagatggaaatataggggcctaaccctcaggaaaaaagtctaggatgaagatacagattttggaatctcctggatatatattataattaaaattttggaggcagatgagttcctccagagagaatatgtagtatggaaatagaagaatttataagatgagaccttgaagaatgccagtatttaaggtggaggaagaagaattgctaaaagagaccaaaaagaaatggtcagagaaatagaagaaaaaccatctatgttgctggattgagcaatctttaaggactctttcagctctgacattctgtggtcctgcagaactgggatctgagccaggtctcaagagcagagcgcatagataggccatgagaatagagaacagcattccaagtaatattaatgtatcagccagcatcccaacaagaaacgggatacactcgagtaacttgagaaaaatttaataaagaggctatttacaaagatggggggaggatttagggaatccaacaaggcagaactctggcaccagctgcacaaggaacccttaccacccaaggcctgaggccagccaggggcaggcagctgtatggagagggctgcctcttgggagatgtgaccttctggacccaatctccccctcccctgctctccagtttcctgctagtgccccctgtgggccaaacagaagccagacagaaagggaacccattgatacagtctaaatagatcatcttcctggagcacagagcagcaggggagtggatgtggaggtgcaaacagaagacagccagaacaatcatcctggaaaatggaagtatttgggtaagagggtgtgttcattccctattgctgctgtaacaaattagcataaatccagtggcttaaaacaatacaaacttattcttacttttgtggaagttagaagtctgaaacacatgtcactgggctaaaatcaaggtgtcacaggactgtattcctttctgaaggccctaggggagaatccatgtccttgcccttcccagcctccagaggctgcccacatcccttggctcatggccccttccaccatcttcaaagcaaaaaaattgcatgacactgactcttctgccttcctcttccatcttttaagagtcctttggattacattggcacacccagatcatccaaaatggtctttctatttttaaatccttaatctgggctgggcgtggtggctcacgcctataatctcagcactttgggaggccgaagtgagtggatcacttgagatcaggtgctcaagaccagcctgggcaacatggtgaaaccccatctctactaaaaatacaaaaaattagctgggtatggtggtgcatgcctgtaatcgcagctactctggaggctgaggcaggagaattgcttgaacccgggaggtagaggttgcagtgagccgaggtcgtgccattgcactccagcctgggcaacaacagcaaaactctgtctcaaaaaaagaaaaaaaaatccttaatccttaatctaatcacaactcatttgttttgccatgtaaagtaacatatagatgtgaggaataggaggaggacgtatttaggtggccatgattctgcctaccacagagagcaaataagccattttagccgaagtgggctccccaggaaagtaacgagagagaaaacaggaagtgcaggttaaagccaaatcatgggagctttggagctagattgtctggatttcattctgtggacaagagggagccattgtaagttcttaaccagggaagtggcttgttagcagtgttgagaaaaatgatccaattatagtgttctgggtagcttacagggaaaaacagaaatctttcaagatgcaatcagagtagtgcaggtatgaaggaacaaaaggctgaaacaagagtgaaaagaaggggtggtgtgaaaaatgttgtgcaataaggacctgcaggaggtgctgaccggctggactcagaaaaaaaagtgggagagtctgaagctggtctgagtgttgggagtgtctgactggtagattaatctagacggcaactctgtttagagaaaaattgggagtttaggtttagttagagaatccagcaatagaaatccaaatagaggctgggcactgtggctcatgcctgtaattccagcactttgggaggctgaggcaggaggattgcttgagcccaggaattcaagaccagcctgggcaatatagtaagacctcatctctgcaaaaaagaaaaaaaaatttaattagctgggcatggtgatacacacctgtagacccagctactcgagggactgaagcaggaagatcatttgagcccaggaattggaggctgcagttagctatgatcaagccagcctgggcaacagaatgagaccctgtctttaaaaaaaaaaaaaaattcaaatagaatcttataaactctaagataccattgattgtaaaactctccagtattttatgtatcactaagaaaaaaaggctggcaatcaaaatataacatgttttcttaaaaatacaaatttttggccgggcacggtggctcatgcctgtaatcccagcactttgggaggccgaaacaggcagatcacgaggtcaggagatcgagaccatcctggctaacactgtgaaaccctgtctctactaaaaatacaaaaaaaattatccgggcgtggtggcgggcacctgtagtcccagctactcaggaggctgaggcaggagaatggcatgaacccgggaggtggagcttgcagtgagccgagattgcgccactgcactccagcctgggtgtgagtgtgagactctgcctcaaaaaaaaaaaaaaatacaaatttttggctgggcacagtggctcatacctgtaattccagcactgtggtaggccaggctgggaggattgtttgaagactggagttggagaccagcctggacaacatagtgagatcctgtatcttcaaaaaataaaaaaaaaatagcccggcatggtggtgcacacctgtagtcctagctacttaggagactgatgtgggagaatcgcttgagcccaagaggtcaaggctgcagtgagttgtactgacatacaactgaactcaagcctggcaacagactgagaccgtgtctcaaaaaataataataatttttactttattgaaagagctgttttcgacttccacataggttttttgaaatcttttttactgaagtgtaaatgacatacaataaagtgcacatatttcaagtgtacagtttgataagttttgatatatgcatgtatgtgtgaaaccatcaccacaatcaaggtagtaaacatatgcaacatccccaaaaggttccccatgcccctatgtcattcctctcatcagcccctcccacctctctcccatgcctaagcaactgtgatttctttctgtcatataaattagtttatgtgttctaaaattttagataaatggaatcctgcagtatacattctttttggtcttctttctctcattataattattttgaggttcatccatgtttttgtgtacatcaatagttcattcccttttattgctgagaagtattccattatgtggatatacgacaatttgtttatttttatttatttatttagggacagggtcttattctgttgcccaggctggagtgcagtggtgcaatcatagctcactgcatcctcgacctcctggctgaagcaattctcccaccccaacctcccgaataactgggactacaggcatgtgccaccatgcccagctaatttttaaaaaaaaaaattgtagaaacggggtctcactgtgttgcccaggctggtctcaaattcctgggctcaagaaatcctcctgcctcagcctcccaaaacattgggactacaggcgtgagccactgcacctggtcacaatttgttttttattcatttactatcattcacattgttttcaatttttggcaattacaaataaatgtgctatgaatatacatggatttttaaaatcatatatctctcctgtgcatacattaaaaggggaaatgtaagtgaaatgcattcattagttgatattcttaaaacttcttcacactcagagtccaacattttagatcactattttacttatccatatctggttcttttccacataataatttcctctgtgccatcgagtggtaatttaaaaaatctgtaaaaaaacaaaactaaaactaaaagccattgaactgggcacttaaactcactctgtaattatgtggaactgtcctaatctgggcctctcttcaggagtgctgctaaacatacctgcattgtcacctccccacgattgtctgctttctaaattttaaaagagtattccacagttgtccctgggatttccttccaagacctttacatccactctgctagttttgaagttggtgcttttgatatttaggtatatacaagcaatgacaagtacatttttactgctgctgggacaacagtaattgtaggacaccatgaattctaagacacatctcaatttcagaatgttaaatgtggcaaagtatgcattttagaatccattaagtagggtgcttcaaccaattcatttgatggataagggcctggaagatgccatccttgtcctgtgtgatgcagtaagttagtggtagctggcaccagaacaaagtgtataggatccaattggtttctctgactttagtagaatttttgtttgtttatttactagaatatagtcattaaagatttaaaaaaaaaaaaggagggctgggagacctcatctctacaaaaaaaaattaaaaattagctaggcatcgtggcacatgcctgtagtcccgggcttcgtgttgcacacttgtaatcccagctactccagaggttgaggtgggaggatcacttgagcccaggagctggaggttgcagtgagccgagatggtaccactgcattccagcctgggcaacagagggagaccctatctctaaattaataaataagaagctgagctaatggaaaagagcgttgcattgcatgtgaaaggggtatcgacacagaaaccacaaacctgaacattgtgagccgttgaattcacaaaggaaagggaacactattccaatagcccttaagaggcccacctgcagccagtctcgttccatgccaactcattcttcattcttatgatttgaactcataaaaaaagattggcgtgctcagatcactcccctactttaagaagctgtggtggcttgccattcccaacagaataaagttcaggtcccttagcaaggcgcagaaggaaggcccttcacagatgtcccaccctcgtctttagttctttcctctcccttcctccatgaatccccctctgtagccatgccgcctgctctaccagcatatcatttactgtcttatcctgtacccctttgtgctgttcccttttcctagaatgacacttgcccattcatgtccaccttatgacctcctccttcaatgttcaaacacagcctctttttcacagtttcccctcaaacttcccccacttactcagtgattatttccccatgtgttttcaaacctactttttacattatgtctaatacttacggcattattgctgtttgtgtgagagtctcactaagctgtgatcttggggagagggggcattttgataaatataattttttttttgagagagtctcactctgtcacccaggctggagtgcagtgatgccatctcagcactgcaacctctgcctcccgggttcaagcaattctcctgcctcagcctcccgactagctgggactacaggcacatgccaccacacccagctaatttttgtatttttagtagagatggggtttcaccatattggtcaggctggtctcaaactcctgacctcaggtgatccacctgccttggccttccaaagtgctgggattacaggcgtgagccaacgttcctggcctcctcatgtgtttttaaacctactttatacgttacgtctaatacttatgacattattgctatttgtgtgcctgtctcactaagctgtgatcttcttggggaaaggtggcatatcttgtttatctttgtatttctgtttgctagaactatgcctggcaaatagtaggtatataacaaatatttattggcctgaaagatgtgattggtggtaatacctcctaaggagaaacacagtcagtgaagtacattactgtttcctgaatgagtattatctttctaaggaagatctgtagaatcctctgcaaggagaaagggattgagtaaaaattgcattttgggtgaatatttagaagtgaggtggtataaaaaataagggtcgagagaagaacggtctgagggtataaagaatgaatacgtagaacaaaaaggaaatgggactagaaatagaatggaaaacaaagcaaggagaaaaatagagagagtgatcatgtggccaggattttagaatcgcacttagtttaattgcaggggagttactggacaatgctttctcacatagacgttccaaactctcgttcctgaatgaatcccattttgtattcttcacatcactctctccctgaaaagacacaagtatgcttcttacaactgccttacaattagtgcattgttctcccctgtttttctatggagagccagggaaggcagagtagtataagggaaaagcacccactatgctgggaatcagaaggcggggctcacgcatcccagctctgtgacctcgagcaaggcactaggccactttcacctcagaattgtcatctataaaatgggaatgataatatcgtcacgggcttcctcacaggattgttgtaaagatcaaaataagtgaaatatgtgaaaacactttgtaagctgtcaggttgctctgcaaatgaagggaatattacctttttgttgaattattcattcaatacagtaggctccattggaggcatacttctgtctcctgttaataagtcctgtttacagaacggagattcttttttattgtgtttcttttttattaacagtattctgaagtctcaggaaactggaccatttaaatgtgcatggcccatgagaaaggcttataagaagccatggcactcccctttcaaaaagagctggagaaatacaagaacattgatgaagatgagcttcttggcaaactctcagaagaggaactgaaacagttggaaaatgttctagatgacctagatcctgaggttagtgacatggaactgaagcagagtggttaatgatagtatggataaatggcatggcttggtccttaaacaatggtagaaatcccttagctcggaatgcacattttcttttcttcctctgattggttctgggtcacctgtgtttacaaattcatagagaacctcatagccactacagtgtgatacagcaaatgtatttctcaaaaaccagcccaatgtaaatggggggaaatattttccgttggttgagaaaggactagtcttgtttaggggaaaaagaaggaaagaggaaaagagagcaaatcttactgagttttttctgagtcatatatttctctgggcacagaagcccttgaggtaaactttattaacccctagacatggagaggtaatttatataagattccacactggtaagtgtcagagatggtatttaaaccaggtttttaggcccaaatgcagaattttttttttttttgagacagtctcactctgtcacccaggctggagtgccgtggcaagatctcggctcactgcaacctctgcctcccagattcaagcgattctcctacctcagcctcccaggtagctgaaattatagacacatgccaccatgcctggctgatttttatatttttagtagagacggggtttcgccaggttggccatgttggtctcgaattcctgacctcaggtgatctgcccacctcagcctcccaaagtactgggattataggcctaagccaccacacccggccccaaacgcagatttttaaaaatatctcatttctttcaaatgcacaaataatgtgaactctttgatgaacttataacaaagaatagattagactgactataatcatgataccaagttcatttcaatggagtttctaatgtttttataagttcttgaaaagctaagtcgcttgttatattgtttgattagcaagcactttcttcagacctgctggtatgatcttaaacttagaattagcagtacttttataaaaaaagatatgctggaaattgctccgtgtaattttttaaataaaaagtcaattacggttaaaaaaaaaaaatcggagccatccaaaatagtgattttaccataaataaaaatataactaaaacaaaattatgtatatggtattctgatatgtcagatactttggatatggtatttacttttaaaaatacagatattctgttgttgtttttttaaattaaggaaggaatctgaaagctttatcaagcaggcattaacatcatcatagtgtttacttatcagctttactgcttctgcaggagaggggttccccatgtcagctccttgttagagtctcatgtttctgcctgggagcaccttgggtgcagccctagccaaacctaagcatgatctacaaggaaagaggtcttttgcctccatgttttaggaggcagcttcagaaactcagaggctgctctagccatctatgcgctgcttgagctcattgggagccccctctcagcactgaacattataacaaatagggcctcagaggcgtcccagagcccccagccctcagctcacacgcacattctgcgtaggtatccttcctgcttccccagcacatagtgagtgggggtggaagaggaagtagcaaagtacaggccggcagacatcttccttcctgctcacacctctttcttgtcagagtgccatgctgccagctggatttcgacagaaagaccagacacagaaggcagccaccggcccctttgaccgcgagcacctcctcatgtacctggagaaggaggctttggaacagaaagacagagaggactttgtgcccttcactggagaaaagaaaggtaaggaccacaggcagagcatcttggaacagaggttctctcttttttttttttggaacggaggcactcttaattaagattacctctttttattttattgtcgtggaggatcaagcaagggaactgtcccagacatgggaaataagcccatgaattggattcagtatttattttattgtcgtggagggtcaagcaagggaactgtccgggaaatgggaaataagcccatgaactggattcagtatttattttattgtcgtggagggtcaagcaagggaactgtctgggaaatgggaaataagcccatgaactagattcagtatttattttattgtcgtggagggtcaagcaagggaactgtcccggaaatgggaaataagcccatgaactggattcagtatttattttattgtcgtggagggtcaagcaagggaactgtcccggaaatgggaaataagcccatgaactggagtcggtgttaaaaagaatcatggctgctagctagacatatgtcattctacattgggccaaacccataagatgtgtaacaccaagagtgaaccctaatggaaactgtggacattgggtgataatgatgtgtccatgatggttcatcagttgtagtataagtatcgctatggtataggatgccattagtcaggggaggatgagttggggagagtacattgaaagaaaaaagaaacacgatcaaatatgtaggctaactgcttatggtgtgatggttctcaaattagtttagtgaaaacatctcgaaccccaaagaaagttttgaaaatgtgaggtggtgtcatgcctgagagtttcctaggcactggtgtatttctcttagcctggtgctttaccaacttcagaagtccctcaaggccttctgctccatgtccaggatggctctagcactgcatccctaaccttagaggctaccattaaagtctagtgcagtcattcatgcatccatcatctactgagtgcctcctctgtgcagaggcttgtggccagatgctagaaccacaggcaaataagaccctgccctgccctcaaggagcttgtagtgagagaaacaggatgacagagctaggaaggctgtgagaagcaaggagttgtttttccatgccaggattgagctctgagccaagaataggaaaccctcctccttagctcccgaccctgtgctccccttgggaggaagagtgactatcaatagcctgtccagcttccccagctatagacagtgacttgagctcaaagattctaatggaattattgataacctcacagcaactacaatctttttataatacaaatcagatcatgtcggctgggcgcagtggctcacacctgtaatttctgcactttgggaggctgaggcaggaggatcacttgagccaaggagttcaagaccagcctgggaaacatggcaaaaccccatctctaaaaaaatacaaaaattagccaagcatgatggtgcacccgtgttcccagttacttaggagctgatatgggaggattgcttgaacccaggaggtcaaagctgcagtgagccgtgatcatgccactgcactacagcttgggcaacagagtggaaccctgtctcaaaataaataaacaaacaaaccaaatcttggcatttcccttcttaaagtctcaaatccttactgtggtctttaaagtagatatagcctccatccagctctctacctgcatctggccttcccttgctaatcctcagcccccactgtcttcattcactcccctgaacctgctgagttcttttcctctctcaggctggtcttctcatgtactcttccttctgacgcatgtccccatttttcacatcctaagggtctcagcttaaatttcagggcctcgggctttctctgacctctcttctctctatcatgacagctgcttattgctttcacagcactgtaacaatgttcatcactttacttactttggtttttgcatgttttcatgtgatagggtcttttttttatcctggcacagcaactggcatgggaggcacttgataaacatgggttccagtgaatggcatctcagaaatctgtactgcagcagtaggagcaggagcatccagctcctagttggcatgaggcagagtgctactgccttgtctcacataatgccgaggctgccctctgtattgtgcacattcagtggatcacacatcattgagaatgtcattaagaaagtaaaattgggccacatgcaatggctcacacctgtaatcccagcactttgggaggctgaggtggaaggatcccatgaacccaggagttcaggattgccatgagctatgatcctgccactgcactccagcctgggtgataaagtggatcctgtctccaaaaaaataataaataaataaataatagtgaacagtgacaaaccaggcaaataatcaaggattgctgtgaaaatatggatctgtttctatagcaacatagttgctgttggactaatttaattgtgaaaaaaattataatgtcaaatcttcaatgaagtcccaattaacatcaagtagtgacagcataataagttgaaagctgttatcttttgttcttagtgtagaggtctgaggagtggctatggtaaattatctcatgatcaagattaatctccagatggttggtgggggagttaggaacgtaggagctgtctgagtaatagtgatataaaaggggtatacagttgcatagtgtagcttaggagaaggttgagaagtagcacaactgaataaagtgagcagggagcaagttttctaatcagagcagcagagcagagcgaagagtatgcaggggccccagaaggaccagtgaaccatccaggagcagcgggaggctactatgaggtcctcaagagaggctgcacaaccacagttctgaacactatgtgctggcacacctcaggttcctgggctacattttactctggtgcagagttttgcttagaacttgttatttggttggacctccaggaatggatctgcatcagcagttctcctgaataccaatagttgtgtacttcgtgtttagtaccaggaaagaggaacttagaaaatcctatattaggttgggcatgcctctaatcccagcactttgggaggccaaggcaggaggattacttgagcccagaaggtcaaggttacagtgagttatgattgcaccactgcactccagcctgggtgacggagtgagaccctgtctttaaaaacaaagaaagaaagaaagaaatcttattttgactctagacctaagatcatcttggccagaaagaaaatgtttcaggccatagacgctaggaatgttaagtctgagatgagccccagtatttgagatgttattgattagttgatttctttttccattttctatcttctggccatcctcctaatttgtttcccagtgtattttccttctttctgagaaatgtggcagctaaagtgattccaaggcaggaagtaggatgcatgtcagtgataatgaccttgttgccaggatgccccagactgacgacaagcagtgcctttctttcctgtgtttggagtgcccagctctgacacactcctgtttgcttatccagccatttaacaatatggtaaaacaggaaatacacagaccttgtaatcagggaagtctcctggagagttctcatgcaggagggttattgactttgggttggaccctttcctttcccataggagtgggataaaccaggctagcgaaggagacctggagagaacttgggtcccaatgggcggaaactggagtgagatgagcctttagggaactctacagatcaaaatggaagagaacaatttcaaagactgtgccccaaaagtcagagcagcttcaaaaaagagagaaacaaagagtcaaaagctgggaataattagaaaggaatatgaatgctctggggtgttttgatcatggctctagaatgtccctggtgcacgtgtgggatgtggatgtgttggcctggctcgaagttaggagcaggaactgtgccatcctcctgggtatggcaatgttatttcatcagtccagaagtttgagctgggagttagggaatagatatcagcattttcagaagtgagcaggggacaaaataaatggaatcttgctgataggatgaaatgggagatggtggcagaggatgcatctgtgggaagcacagaatgccttgctgctcacagaaccccactagctccgagtatagtgaccctgatttttccttacaatcatgcctgctttggagactctagagaggtggctatgtccccaggtcactacactagcccacctggccccagatatggcatgctagttgtctgcattcccaatttagagggagcgctccaggggatcaccagtttgttactcaggaacccctagtgctgtttagatgaacctgctcctaatatttgcagggtccaaggcaagtatacaaatagaagcccacatgccacattttccaaatatttaaaagctaacaaatcattaaaatatgttgtatcctcctttagatatacctaggaggccagtattcttggacttccaagagttccatgcagggatattgatctgtcccacactgccagggcctcaaacacacatgttggacacccaagcccacatatccaagcttcatccaggctcccccacaaatagcctccccttgacctgagggtacacacccagcagcatgacctgccttctggaggatagacatgggaaggggcttgtggaggctctagaggcaggctcagggctctttgggcaaggcattccagggtcctaggtacctgaagtgtggtatagaaagtggcctatatgctggatgggcatatccctttggcctcatggttcctcccctggaggggagaggtacagccacaggaagactagtatggggttctctaaagtgcacgactcagggcagggcctctcctgcccagacccaagggcagtactgccaataagaggggtagaagccaccatttccctctgtgtttaaggactgtagtctcagatctctgtgtggcagaatgcaggattcctcctccagtgttccttccctctgacagtgacttattgatgttggtaccatcctggcaatccaggaatctcggttggatatgaactggcttaattatatgggtctcaatggccagaactgcattctctgctcagtctacttaccctaccaataaggcagtagtactcaatatttttgtttttcttctgatttaaagggagagtctttatccctaaagaaaagcctatagaaactcgtaaagaagaaaaagtgacccttgacccagaactggaagaagctttggccagtgcctctgacaccgaactctatgatcttgcaggttagtcctgaactctgggaactttcctgtctggctctatgacctccgagcatgcactggcacccatggcagcaggctttgagcttctcttaggtaggagaatgacaggttgacacaaggcattatggagctgtaagtcttgatgcaggtgacttaaactctctgagcaaatgttattttgctctatttcagcagcaaataatacccatctcacaaaactcaagagttactgtgagaaattaaagcaaacaagtatgaaggagtgttgagaatttagagaataaaacaacagctcttttgctttctaaggagctttcacatttggcattttatcatcacaacatttctataaagttcttgttcttcccacagtcattgttccattttgattcagaaaacgctaagaagtccattagccttctagtcttaacaatagcaacatgataataattattattatttaaaatgcagatagaaaaaggtcaaagagtacaaaagaatgtgtaatgaaaagtaagtctctcgacctgaattacctaggcccactcccatgtcttgtacagccttcaagaaagattttctgcatctaccagtagatttatatattagatcttccttctacatacacagggttattagatgaccacaggatagaggtgctttaaaaaccagtccacagctttagcaagaatttttattccattggaagacatagaataataacctctttcctcccaggagaaccagccttattctaaaatgtaccagccaccccaactgcattttcattccttctgtgatgatgtcaggaagttcccatgtttgtgaacttaatattgaccatattgaccactgcaggagttgaggcgatggcgtcacctggtaaagaaggtgttttgcacccactggtcttagccctggggttgctgtggagggatcctgttatggctactgctcctcccaggggttgcctcatggtctctaccagaattgcccagagggagaatgcagggctgaacttgaattcccaggtaatgccttgagaaaggaaaaagagaaaaacaccaattatttggaagatactagatcctgaaattcatacagtaaaaccagagagagaatccaaatagaaaactgtcctcgttcatccttactcagcttccctccctcgtcctgtgttccctaggaattcagaaggaagcctggctggggctgttggcagcatctttagggtgggcccttctggaagattgaaggcagccccatgggcagatgagctggcagccattgagttttagataagaaagagtgtcggcatattgcccatgttattgtggcagatagagagcagacagaaagttcttcaagggagtggtagttgacctgcaaaacagcacctcttacactggctgggtgtcagtgtggtcaccatccagagtctagttcccagccctaaactgtgggagctctggactggaaatttgatcttatcagtatatatagaagcagtcagattggagcaaagtggtgggaactgatccattagcccatttcacagataacagataaaaatgaaaacctggcaatgggagccaaattataattagaagttacttggtgagcatagggccagagcaagaagatatgtttgttgtatggcctcagtgtttatcaaatgggacaccttctccttctcctgtccccttcacagagacacagtgacaaattctttttcctttttttttttttttttttttttttgagacggagtctcactctgtcacccaggctggagtacagtggcacaatctcggctcactgcaacctccacctccggagttcaagcgattcttctgcctcagcctcccaagtagctgggattacaggtgcccgccaccacgcccagctaatttttctattttttgtagagacggggcttcgccatgttggccaggatggtctcgatttcttgacctcgtgatccgcccacctctgcctcccaaagtgctgaaattacaggcatgagccatcgcacccggcccacagtggcaaattcttatttatttaacaagaatttgtaaagcatttagaatagtgcctgacacatagaaagtcatttaatcttggtaataaagtataattattatccctgttttacagatgaggaaacggagactcgggcatttaacaacttcccaagtcacacagtttaacgtggtcagagtcaggattcttgactgctcccaagtccccctcttcaccgggtccttgctagctctgaccatttgccctttcttgtgctgtgccagctgcctccctccttcaatatgtagcttacagtagagctgataagcatctcagaggcactcctctgccacctgtcaacagattattatcccttctgggatccttcttcaggtggccagtatcacctggaatttcattagcaaagggaaatctgcgtagcagttgcaggttcagtcagccccgcattcattcttccccagtgttgtttcctgcattctgtgctgcctcctggtgcaagttctgtgtaatacaggaagccgaaaatcagtacgcttagctgaccttttctttgctgatgttgcttttttttccccaccctggcatgctctagagacaattatatttggtactaagagatgaggaggctgacattgaaagaggcctctggaaaaatatatgcagtaatctatataatgttagatcttaaaaacccttagtctcagtcccaccttctcattttacagatgagaaaactgaaaggttttcctatttaactaggaggtctaggcagattttcggtaaattgtggccataattagccactgttcctcagatcctaaatgattctacatgtggagacgtagaaagacaggaagatttctggtggtcttgaaaggaggtttttgtaagtgtatttaacgctatacatgtaccacacactgtgcaaggaaagaggactcagggacttatctttatgatgtaaagaattgttcttcaagggacaaattaacaatgtggacatcctaatgtgcttctccaaacttaatgctcatttgttgactgtttttagctgtccttggagtacacaatttgctcaacaatccaaagttcgatgaagaaacagccaacaataaaggtggcaaaggacctgtcagaagtaagttgatgtgcaatctgtggttttgtaaagctttggagcctccagagttgctggtaggagagaggcctgttgagtcttgcaggctttacactctgtcattttgctaggatcacttgggctttgagcaatcaaaccagaacagagcagctgacaatgagagctccatctggcggtgaaactagtacaaatcagtgtgtgttgcccagaacactttcttggtaggtctgtttagtcagaagatgaaattgttgatatatgggtctgcattaaatggtataatccatattcatgaaaaaaaattgctgatataagactgcttggtcatcacaaaatgcagcgtttcatgttcctgaggatgttttaatcaactatagtagcttaaataagttcccttctctatttgagtgtctttttgtctcaataatagatgcttgtcattagaatttgaatgtccacttccctcagagggcatgaaagacacgctggcatggacttacgtgcacaggacattccacaccactatcttctatgtcaacgtttcctatagacgtgtacaattaattagacttttttattcattcattcatcagtcatccactaaatacctactatgtgtcaggaatgttctaggcttaggtacaaagatgaaaatggtccctgccccacaaccaaaaaagagaattttagaccaatatccttgatgaacattgatgcaaaaatcctcaataaaatactggcaaaccgaatccagcagcacatcaaaaagcttatccaccatgatcaagtgggcttcatcccttggatgcaaggaaacaacaggtgctggagaggatgtggagaaataggaacacttttacactgttggtgggactataaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagccataaaaaatgatgagttaatgtcctttgtagggacatggatgaaactggaaatcatcattctcagtaaactatctcaaggacaaaaaaccaacaccgcatcttctcactcatagatgggaattgaacaatgagaacacatggacacaggaaggggaacatcacactctggggactgttgtggggtggggggaggggggagggatagcattaggcgatatacctaatgctaaatgacgagttaatgggtgcagcacaccagcatgacacatgtatacatatgtaactaacttgcacaatgtgcacatgtaccctaaaacttaaagtataataataataaaaaattaaaaattaaaaaaaaaaaaagaaagaaagaaaatggtccctgcccaagggaatttatctgtccagggtaaggaaggaccaataaccagatcatgtcagtacagtgtgatccatgtgctttgaaaactcatagaaaattacagcttttttttttttttttttttttttttcttgagacagagtcttgctctgtcacccaggctggagtgcagtggcacaatctcggctcactgcaacctccacctcctgggttcaagcgattctcctgcctcagcctcttgagtagctgggactacaggcatgtgccaccacacccaactaatttttaggattacagcttttcttaggttaattttattttattcactttaatagagacttgggagatgctttctaatctcagtagcatatatatgaaatattatttatagtggtaatttagacacacaatgagcaatattccttttatttttttgagatagaggcttgctctgttgcccaggctggagtgcaatggtgcaatcataacttattgcagcctccagctcctggactcaagcaatccttccactcagccttctgagtagctgggactacaggtgcatgccaccacactcagttaattatttttatttttattttgtagagacaggatcttgctatgttgcttagtctggcctttcttgttatgcatatggataaaaaatgctcatcctttttagcttcagcatcaaagggtaacgttctgacaatgtttcctattaacaatctggtgcataaccttctggacgtttatacgtacacatacaaatattaacttgtcttctaattgtggcctcttatcagtacttacaggtttccttcattcttttaatgagtagataactttttttttttttgagacagagtctcgctctgttgcccaggctggagtgcagtggcacgatctcagctcactgcaagctctgcctcccgggttcatgccattcttctgcctcagcctccccagcagctgggactacaggcacccaccaccacgcccggctaatttttttgtgtgtttttagtagagacgggatttcatcctgttagccaggatggtctcgatctcctgaccttgtgatctgcccacctcggcctcccaaaatgagtagataacttttttaatggatagataatgaagatacttttttttttttgagacagggtctcattctgttgcccaggctgaaatccagtgtcactaccaaggctcactgcagcctcaaactcctgggatcaagggattctcccacctcagtcccctgagcagctaggactacaggcatgaaccattacacctggctaatttttaaaatttattgtagaggctgggtctcactgtgttgcccagcctggtctcaaactccctgcctcaagaaactctcttgcttcagtcccccaaagtgctgggattataggtgtgagccaccatgcctggctcctgaatagattcttttaacgaatagacaataagttgttacgtgatgatgctatactttatttacccattttcatattggtggacattttgtttatcatgttttgctgtcacaagtaatatttcagggaacagggaacacccttgaatatatatctttatgtatctgtgctatttttgtaggtaagacttctagatatagaattgctgggtcatagaacatgcacatcttaaattgcaatagataatgccaaattactctcccaaaacatttgcatcagatcacattcccacttatagaggagtacgaagatgcttttttctccacattgttgccaactccaaatgttacctcgtttcacacttgtttgctaatgaaatggtatctcatttctttattttggagcttagttactttttatattttttggttgagtgacagattcttctgagcgtattattggttcatttttaattgggtcaccttattgatttgtaggagctctgtgtatattgggatattaatcctttgtatctctgttaactatttttgagaattcttccattcttcttttttatccctttctctccccataccttccttaaaactaaagctccagaatagaactcagaggagggtagggtataatcaagaggccagaggggtattaaagtttgggaaatgaagacttattgtggtgtctgatttgtatctcagatcctgtagtctagttagtatagtctgacagatgtccatatggagcagcaataacggcccatggatattttgaaagttggagtttgctgcagggtctcctgaactttgggtccatgcagtgttagccccagggaattctcattgcagttgagaaacaccagccttccaagctgtgactcatagctataccactcccatgcttgcttagctgagaatacacctactgtcattgctattaaagtgttattggaatcagcatatgaaagaaatgtcattttttgggaagtcaccactgattttgataggagagactttgcattttttaaaatgaaaacttgtgttttagatgttgtcaaaggtgaaaaagtaaagccagtatttgaggaaccaccaaatcccacaaatgtggaaataagcctgcagcagatgaaagccaatgatcctagcttgcaagaagtcaacctcaacaacattaaggtatttcattgtgattatcatcagtcagttaatttatcatgaggtcagaaaacttaccagagatgacctattgcttgttttcacacctgtttgcagttctttgtagtcactgagttggagtcaaggtatcctattcaaaagaagtgggttttggaaaacagtgatttctataattatttgaaaagaatcaccatacctgagttaagcatagtacattagttatatctattgctgagtaacaaattactccaaaacttagaggcttcaaacaacagacatttattatttcacacacaatttttcagtgtcaggaatctggtagtggctagctggatagtgtggctcagggtctcaaatgagatggtagtgaagttgtcatccagggctgcagtaccaggcttgcctggggcaggaggatccagttccaagatggcagattcatgcggctgttggcaggaggcctccatttctcaccatgtggctccccagagcgagtgatccaagacagagagatgagaaagcaggaagccacaatacctgttatgacctggtttctgaagtcacatgttgtcacttccactttattcaatttgataataagtcatgccactctcaaagggaaagagtaggagagagagagagagagagagtgtgtgtgtgtgtgtgtgtaaacattacctgaagtctcttttgtttattcttttggggccaattcttagcatttaataataaccaacttttattgagtacttactatgtgccatgtcctttactaaatacttggaatttattatctcatttaattattagttggacttaaagagttgttaacgtcatagagttagtctgtagtgcagccaggactcttctccacttctaactgcaccccacattgtctccttccccagtggtcattactgtgctaaatgatctagaaaaaggactacaaagataaataagatttattcagtctttactctgaaaacaattatattaggagaaaaacactaaacagataattataacatgatgtggtgagccaccaaatatcattgaattgcaagaaagaaaaattttaatgctacctaggagatccagtaaacaaaggagatgatattacatctgagtcttgaaagagaaaaggacaaaaggaatttccaggctaaggggaaagcatatataaaggtctgaaaaagagaacgactttggtatattaaaacagtggcaaatacgtcagtctggctagaatacagagtgaaaaataaaaagagggaagtatagtatctgcatactttcttggttagggaaaacagaaagacgacactcagaggtaccatagtggtagtttagattcccctattggacactaagtggtgctgttagctcaggatagcttggttgctgaaggctaggtaatgaccctcatttagaagggatatcgtgtatttatctacacatacctggtatttaaaggttgtgggttcttaccttggcaagagtgtgccatacaatggttcatcaactagccatgtcctctctgtcttagaacattccaattccaaccctgagggaatttgcaaaggctctggagaccaacactcacgtgaagaagttcagcctggccgcaactcgcagcaatgaccctgtggccattgtgagtaaaattcttagaaatataacatgaagttatttaattcactggaaactctatttactttgtttcattagctaacaattttttagatctggaaaacttaccttctacacagttagtgagcaaaattatagttacaatgcaatagttaaacttcagaactgaactgtcagatgctttaagttatctggaattttgtcagcattacagttttcagagaaagaaacaagataagtttggcatttaactaactgaatatttagagtttgctctgtgcttaggatacattttctaaaactttcacatctacagtcattggatatcatgaccctaaagcccttcaggaattaggcatctatagaaatattgaagtagctgggcgcggtagctcatgcctgtaatcccagcactttgagaggctgaggtgggtggatcatgaggtcgggagttcgagaccagcctggccaatatggtgaaaccccatctctactaaaaatacaagaactagctgggcatggtggcacgcgcctgtagtcccagctacttaggagactgaggcagaagaatcacttgaacccgggaggcggaggttgcagtgagccgagatcatgccactgcactgtagcctgggcgacagggagactctgtctcaaaaaaaaaaaagaaaaattaaagtatattttaatctttgaaatggattaatatgtgtctaaaatatcttagacaacaaaatcaggaaacattctgtgtttgacaccagaatgtgaaaaaaatagccagccaggtgtggtaacgtacacctctggtcccagcgacttaggaggctgaggtgagacaattgcatgagcccaggagttctaggctgcagtgagctatgattgcacctctgcactccagtctgggcaatagaacgagatgatagatagatagatagatagatagatagatagatagatagatagataaaagaaaaatagccaactaaaagttctattcttcctatgcattttagataatttagccaaataaggaagccccttgtcccaggtaaatacttataccatcactatcatgatttttattcttcctatcaatagccaattagtaactcctcctatttatagctactttattgaggaattagtaaatgccagcactgatcttcgtgctttccatgcagcatctcatccatttgtcactgtaatactatgaggtatatactattattagttccaactttaacaaatgagaaaacagcttcagagaggttaagtaagctatccaaggtaatacaaccagtaaatggcaaagccagaattcactaccaagtctttctggttctacagccaggaagcttaaccatcaagctatgctagatttacacacaatgcctggctgtcatacatttgctaaaatatgtcacttatcaaaagcctgggcatcagcctgttgttctatggcatttaatgctcagcccttgaatcgagttagaaaaacgcaagttgtctggacttgatggtttgatttaaagtaacatgtcttttggaagatctaaaatagcatttaaaacagatgacatgaaagtaatgactacctatcatggtcctggcacagaatagatgtttgacaagtacttgttaaataaatgaatgatcataacctccaacctctagcaatagagaatatttctatggtgatcacagcaaacttgaaataagcactcatgtaaaagaggaaccaggctacaaaaatcaatgtttttaccagcagttattacatttctaaattcgtagcttgaaagcagttttgaatttgaaacctatcattaaaatagaaagatggcagaactagataattggtaaggtgaaatgagcagtttaaggattcttatctctgtatgattttgtactatttctgccttttagtagatttttttcagtaaagcaaaaatattcacaatatactttgtatgtaaatgaataaagggataaagaaatgatttgtcacttctgtttcatatattatttcgagtaaaattgcagggctggggttagttcacaatcaactctcaacactactggtaaataatctaactcctattctagaccaaataaataacttactaagtggattaaataaattccaaatataataatcactttgatgctgtttttaatgcaacaactatgtgttgaatgcttgtcatgtgaaaagcactacactaggagctggattttttgggtaacacttttcaggcaaatttgaccttttgtaacttgctttttaaagaatactttatttgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggagactgaggcaggagaatggcgtgaacccaggaggtggagcttgcagtgagcagagatggcgccactgcactccagcctgggcaacagagtgagactctgtctcaaaaaaaaaaaaaaaaaaaaaagatgaatggatgaagaaaatgtggtatatatatgcacactgaaatattattcagccataaaaaagaatgaaatcctgtcattttcagcaccatggatgggactggaggtcattgtgttaagtgaaacaagccaagcaaaaaaaaataaatatagcatgttctcacttacatgtaggagctaaaaaaaaagtggttctcatggaggtaaagagtagaatggtggttactaaagcctgggaagggaagggagtagggacaaagagaagttggttaagaggtacaaaaatacagttagttagaaggaataagttcttgtattcaataatttattataaatttcaaaatagctagaagagaagaattgtaatgttcccaacacaaagataagcctttgaggtgatggctattccaattactccaatttgatcactgcaaacacattgtataaaggtatcaaaatattacatacacccccaaaaatatgtacaactattatttatcactaaaacattttaaatttaacatttaatttaaacatttttaatttatttggtatagtcatagtatagtctataaaaaatagagggaccacaggaagatatacgtatatatacatatatatattcatttatatggatagagttttcaaaatatgattttgctactgttttctgaagagcatcactcctaatagaaatttttcccttgtccttcattccaattctaagatgtggtacaccaccctcctcccctcctcactccccgaatccccccttctcaagggtaagctgagaagagagaggcagaaccaagggaaagaagtgatgattttaggaaaggttttcttcgttgtcactgtgcctgggtgatgttttattgggagtcctggcagaaagtctccatttttagcattcaaacatgagatgaaaaggcgtttcttggtggatgacatttgtggacctcaaaccttattctgctttcatgttataaattattattctgatatatttttagaatcagtgaagccctgtgcaattggcatccgtttagacatgtccccatttaaggctgtttggcattcaatcagaaaacatattttggggtttgtggtgaacacaagccattttacagatgaggcaactgagactcaaagaagttgaatgctgaactaagattacaccgcatgtggccaagccaggatgcaaatgtaagtcacctgtgattgagtttagtttactgtgccccaagcactttcatataaccacatctatagcaactgagcattcaaatggaatttgtccccactgaatgccaatgagagggcccaaatatatttaaaatgctactgttatttacaatgatgccacataaaaatcaagagtttaggacagcactgtttattggaaataaaacgtgagaggtcacttccaagatggccaaataggaacagctctagtctacagctcccagtgagatcgacgcagaagatgggtgtttctgcatttccaactgaggtatctggttcatctcactgggactggttggacagtgggtgcagcccatggagggtgagctgaagcagggcggggcatcacctcacccgggaaggggttggggttgggggatttccctttcctagccaagagaagccatgagtgactgtatctggaggagcagtaaactcctgcccaaataccgcgctttttccacagtcttcacaaccagcggaccaggagattccctcctgtgcctggcttggcaggtcccacgcccacagagccttccttgctcactgctagcacagcagtctgagatccacctgggatgctagagcttggcggggggaggggcatctgccattgctgaggcttgagttggcatttctatgctcacagtgtaaacaaagcggcatggaagctcgaactgggcggggcccaccacagctcaggaaggcctactgcctctctagattccacctctgggggcagggcatatctgaacaaaaggcagcagacagcttctccagacttaaatgtccctgcctgacagctctgaagagagcagtgcttctcccagcatggcgttcgagctccgataacggacagactgcctctgcaagtgggtccctgacccccgtgtagcctgactgggagacacctcccagtaggggccgacagacacctcatacaggtgggtgtccctctgggacaaagcttccagaggagggatcagacagcaatatttgctcttctgcagcctctgctggtgatacccaggaaaacagggtctggagtggacctccagcaaactccagcagacgtgcagctgagaggcctgtctgttagaaggaaaactaacagaacggaatagcatcaacatcaacagtaagcacatccacaccaaaaccccatccataggtcaccaacatcaaagaccaaaggtagctaaaaccacaaagacggggagaaaccagagcagaaaggcggaaaattcccaaaaccagaacgcctcttctccaaaggaacacaactgctcaccagcaagggaacaaaactggacagagaatgagtttgacgagttgacagaagtaagcttcagaaggtcggtaataacaaacttctctgagcaaaaggagcatgttctaatccattgcaaggaagctaaaaaggttagacgaatggctaaatagaataaccagtgtagagaagagcttaaataacctgatggagctgaaaaccacagtacaagaactttgtaactgaaaaccacagtacaagaacttcgtaaagcatacacaagcttcaatagccgatttgatcaagtggaagaaaggatatcagtgattgaagttcaaattaatggagtacagtcagaggacaagattagagaaagaaaagtgaaaagaaacgaacaaagcctccaagaaatatgggagtatgtgaaaagaccaaatctacgtttgattggtgtacctgaaagtgacaggaagaatggaaccaagttagaaaatactcttcaggatattatccaagagaacttctgtaacctagcaaggcaggccaattttcaaattcaggaaatacagagaacaccacaaagatactcctcgagaagagcaaccccaagacacataattgtcagattcaccaaggttgaaatgaaggaaaaaatgttaagggcagccagagagaaaggttgggttaagcacaaagggaagtccatcagactaacagcggatctctcaagccagaagagtgggggccaatattcaacattcttaaagaaaagaattttcaacccagaatttcatatccagccaaactaagcttcataagtggaggagaaataaaatcctttacagacaagcaaatgctaagatattttgtcaccaccagacctgccttacaagagctcctgaaggaagcactaaacatggataggaacaaccagtaccagccactgcaaaaacatgccaaattgtaaagaccgtcaacgctatgaagaaactacatcaattaatggcagcaaaataaccagctagcatcataatgacaggatcaaattcacatataacaatattagccttaaatgtaaatgggctaaatgccccagttaaaagacacagactggcaaattggataaagagtcaagacccatcagtgtgctgtacccaggagacccatctcatgtacaaagacacacataggctcaaaataaagggatggaggaagatctaccaagcaaatggaaagtaaaaaaaagcaggggttgcaatcctggtctctgataaaacagactttaaactaacaaagatcaaaagagacaaagaagggcattacataatggtaaagggatcaattcaacaagaagagctaactatgctaaatatatatgcacccaatacaggagcacccagattcataaagcaagttcttagagacctacaaagagacttagactcccacacgataataatgggagactttaacaccccactgtcaatattagacagatcaatgagacagaaaattaacaaggatatccaggacttgaactcagctctggaccaagtggacctaatagacatctgcagaactctccacccgaaatcaacagaatgtacgttcttctcagcaccacatcgcacttactctaaaactgaccacataattggaagtgaaacactcctcagcaaatgtaaaagaacagaaatcacaacaaactgtctctcagaccacagtgcaaccaaattagaactcaggattaagaactcactcaaaactgcacaactacgtggaaactgaacaacctgctcctaaatgactactgggtaaataacgaaatgaaggcagaaataaagatgtcctttgaaaccaatgagaacaaagacacagcgtaccagaatctctgggacacatttaaagcagtgtttagagggaaatttatagcactaaatgctcacaagagaaagcaggagaaatctaaaatcgacaccctaacatcacaattaaaagaactagagaagcaagagcaaacatattcaaaagctagcagaaaacaagaaataactaagatcagagaagaactgaaggagatagagacacaaaaaactcttcaaaaaatcaatgaatccaggagctggttttttgaaaagatcaacaaaatagaccactagcaagactaacaaagaagaaaagagagaagaatcaaatagatgcaataaaaaatgataaaggggatatcaccactgatcccacagaaatacaaactatcatcagagaatattataaacacctctacgcaaattaactagaaaatctagacaaaatggataaattcctggacacatacaccctcccaagactaaaccaggaagaagttgaatctctgaatagaccaataacaggtcctgaaattgaggtaataattaatagcctaccaatcaaaaagagtccaggaccagaccgatttacagccgaattctaccagaggtacaaaaaggagctggtatcattccttctgaaactattccaagcaatagaaaaagatggaattctccctaactcattttatgaggctagcatcatcctgataccaaaacctggcagagacacaacaaaaaaagaggatgtttaagccagtaatgatgaacattgatgtgaaaatcctcaataaaatactggcaaaccgaatccagcagcacatcaaaaagcttatccactatgatcaagtcgccttcatccctgggatgcaagggtggttcaacatacgcaaatcaataaacataatccatcacataaacaaaaccaactacaaaaaccacatgattatctcaatagatgcagaaaaggctttcaacaaaattcaacagcctttcatgctaaaaactctcaatcaactaggtattgacggaacgtatctcaacataataagagctgttcatgacaaacccacagccaatattatactgaatgggcaaaaactggaagcattccctttgaaaaccggcacaagacaaggatgccctctctcaccactcctattcaacatagtattagaagttctggccaggacaatcaggcaacagaaagcaataaagggtattcaaataggaatagaggaagtcaaattgtctctgtttgcagataacatgattgtatatttagaaaaccccatagtctcagcccaaaatctccttaagctgataagcaacttcagcaaagtctcaggatataaaatcaatgtgcaaaaatcacaaacatttctatacaccaagaacaaacagagagccaaatcatgagtgaactctcattcacaattgctacaaagagaataaaatacctaggaatagaacttacaagggatgtgaaggacctctttaaggagagctacaaaacactgctcaaggaaataagagagagagtacacaaacaaatgaaaaaacattccatgctcatggataggaagaatcaatatcatgaaaatggccacactgcccaaagtaatttgtagattcaacactatccccatccagctactgctgactttcttcacagaattggaaaaaactactttaaacttcatatggaaccaaaaaagagcctgcatagccaagacaatcctgggcaagaagaacaaagctggaggcatcacgctacctgacttcaaactttactataaggctacagtaaccaaaacagcatggtactggtaccaaaacagatacatagaccaatggaacagaacggatgcctcagaaataacaccacacatctacaaccatctgatctttgacaaacctgacacacacaagcaatggggaaaagattccctatttaataaatgctcttgggaaaactggctagccatatgcagaaaactgaaactggaccctttccttacagcttatacaaaaataaactcaagatggatcagagacttaaatgtaagacctaggaccacaaaaatcctagaagaaaacctgggcaataccattcaggacataggcatgggcaaagacttcatatctaaaacaccaaaagcaatggcaacgcaacaaaagccaaaattgacaagtgggatctaattaaactgaagaggttctgcacagcaaaagaaattatcatcagagtgaacaggcaacctacagaatgggagaaaaaaatttgcaatctatccatctgacaaagggctaatatccagaattgacaaggaacttaaacaaatttacaagaaaaaagcaaacaatcccatcaaaaaatgggcaaaggatatgaatagacacttctcaaaagaagacatttatgcagccaacagacatatgaaaaaatgctcatcatcactggtcatcagagaaatgcaaatcaaaaccacaatgagataccatctcatgccggttagaatggcaatcattaaaaagtcaggaaacaacagatgctggagaggttgtggaaaaataggaatgcttttacactgttggtgggagtataaattagttcaaccattgtggaagacagtgtggcaattcctgaaggatctagaactagaaataccatttgacctagcaatcttaataactggacatatacccaaaggattataaatcattctactataaagacacatgcacacatatgtttatcgcggcactattcacaatagtaaagacttggaaccaagccaaatgcccatcaatgatagactggataaagaaaatgtagcacatatacaccatggaatactatgcagccataaaaaaggattagttcatatcctttgcagggacatgaatgaagctggaaactatcattctcagcaaaccatcacaagatcagaaaaccaaacaccgcatgttctcactcataagtgggagttgaacaatgagaacacatggacacagggaggggaatatcacacaccggggcctgtggagggtggggtgctaggggagggataacattaggagaaatacctaatgtaggtgacaggttgatgggtgcagcaaaccaccatggcacgtgtatacctatgtaacacaactgcgcattctgcacatgtaacccagaacttaaagtataaaaaataaaaagaaataaaacatgagccacaaatggaagccccatgtataaatttaaattatttagtagccacattaaaaaaaatacatagtagacaaaattaattttagtagtaaatagatgctccttgacttacaatggggttatgtccagataaaactactgtaaattgaaaatctttatctgaacatagcctcatcataagtcaaggagcatactgaataagtatcactttcacatcatggtaaattccaaaaatggaaagtggaaccatcgtaagtcagggactctctgtattgtatttaaaccaatatatccaaaatgtaatttgaaaatataatgaggtattttgcattctttttttcatactacatctttgaaatccagtgtgttttatgtttgcagcacatttcaaatcagactaaccagttttcaagggctcagtagccacatttctcatggctaccatttggccagtgcagaaatttgcatttccatacaatcctataaagtacagacagcaaacccttctctttaaagatgtatttctactctacttcaattacatttaaaacatctagtctttgttttactaatgttattattcccagcacatgtaatatgctcaaatatttgctgaactgaagtgaacctgggcctacagcccagtattgtgtttggctggctcgcccctgttttgttcagcacaagaaagtgttttctcaagtttaaaagaaattggcaagatcctggcaactcgccaggaggtcctgcaactttctgtaaaggcctaattgctctgacattttgttattctaataatgatagtaaatcccaaagcttgtagagtccaaaaggaaagtcctgatgcatccctctctgatgatcagattaaaatgtatagatttaattttaatcaaggacctagcacagaataaatgcactttaatttacatggtatgcgatagtgtaaatccaaattgttgagctttctttgcagtgcaagcaactgcctgaccaagatacaggattattcttctagtccagtggttctcaacctagggcaattttgccctccaggggacaataggcagcatctggagatatttctggttgtcatgatggggaggagtgctattgacatctagtgagtctcagaggccagagatactactaaatatccttcaatacacaggacagcctcccacaacaaagaattctttggccccaagtgtcagtcatgctgaggttaaataaccctgttctcatccaatattgggacttctcgtcttccttcttcctgtcttttccactgtaaaaacaattaaaatagttcagaacttttttgttctactccccagaagcaatcactattagcagtttgtttttcattcttctggttgttgtctttatgactttaattaaagtggttactggctcatgcctgtaatcccagcactttgggaggccgaggcaggaggatcacttaaagccaggagttcgagaccagcctgggcaacatagagagacctgtttctacaccaaaaaagaaaaaagtggttgtcaatcctaactgcacattattcacctggagagctcttcagaaatgcagatggccattccacagcctcagagattccgatttaattcatctggggtaaattttttaaagctcccagaccattctaatgtgtggtcaatgtagaaaaccagtaatatacagaaatttatatttttcatttatcatcttagaaaattttttattctctattataaaagatgagggtagttctatacttaattttccattcctcctttctcttccacttccaaattgtagatattccattattttcacacatttgagctttatacattttctgtaattatattctgtgtttgtatatagattgattccaaaaattaacctattagcagcatttacaattatatgacttatataaatataaatctccattctcatgggccttacaatgtagtgactagtgctgacctgatttttgatcctttgcaggtaacttgtttttccttgctagaaatttttagtactctctttcctcttggaattctgaaatttcacttgtctgttcacttaagagtcattttggtccgggtgcggtggctcacacctgtaatcccagcactttgggaggccagggctagtggatcacctgaggtcaggagttcgagaccagcctggccaacatggtgaaaccccgtctctactacaagtatataaaaaaaattagccaggcgtggtggcccatgcctgtagtcccagcaacttgggaggctggggcaggagaattgcttgaaccaggagatggaggttacagtgagccgacacagtgccactgcactccagcctgggcaacatgtcaagtgagactttgtctcaaaaaaaaaaaaaaaagttttttttattcattctgctgagtgtctagttatttccttcagataaagatccgtaactttcttcatctctgggaaatttattttttctccttaattatttgataacttcttctcttctgcttgcttgcttgctttctttctttctttctttctttctttctttctttctttctttctttctttctttctttctccttctggaactcttcttagatgaatgttgaatctctgcatctttcatccacatctcttaaggttttctcataatttctatcttcatctttttgctgtatatccttggaaatatcctcagtgttatcttctagatcaccaacttggtcttcagccatgcttattttgtaattctagatgtctattattttcttttatttcaatgtagtttttttaaatgttcaaaatgtttttcttttctctgtctctctccgccgccccccaccccccacccgactttttctctctttctttctttttctttttcttgtggggcagggaggaaaataatacataatcagaatttttaaatttgtgtctgtttcttctatggcatattgacctgcttggtcaactttattctttcatgatgttggttttcttaaaatgtctggcaattattggttccctgtttataatggagagcaaggttggtttgtataatccaggatcatttctcctgcagttgtatctatctgttttaccaacagacctctcccttaaaaaggaggcccctttatttttctccatttgtcaccatctgataagctatatattttatttattaatttattgactctgccctcttgctcaaatataagcctctctgaggacaaggatttttgttttctcttactgctagagcacagtagaagcctgacaaatagtcttttttgaatgtatgagtgagagctttttttcagcagcaggtgtgctgacctgccaccttctctgcagtgtgtgtataaggagctcacaggcagcctgagagtcccctgcaatcgctacagttaggaggacttcattctgggaggggcacctttcaatgtatagtagtccccttatctgcagaggtttcagtggatacctgaaaccacagatagtaccaaacccgatatgtgctatgtcttttcctatactacacacctataataatgtttaatttttaaactaggcacagtaagagattaacagcaataactaataatagaacaattataataacaatatgctgttatagaagttgtgtgaatatggtctctctcaaatatcttactgtactatcctcctccctcttgtgatgatgacatgagatggtaaaatgcctgtatgatgagatgaagtgaggtgaatgacataggcaaggggactgcgttaggctactgttgcccttctgaccatttgtcagaaggaggatcatctacctccggtgatcctggctcatccagccatgacgatgtcaatggttggatgtcaaaagcagacagtgtcattggttcataggcagggacagcacggagatgctggacaaacagatgattcacctcctgggcgacatagaccataagatttcatcataccactcagaacagcatgcaatttaaaacttatgaattgtttatttctggggttgtccatttaacgttttcccactgaggttgacagcaggtaactgaaaccgcagattgcagggaatactgtacttcattcctggcagagctgcctttcccattttccccccacactgtactggtgtgaaggtctggaggcgcctctgtttccgcactgcttctgtcacaggtcgcagcaccttcaccagaggctcttcctgggagacttcattgattgtgctggcagctgctctttttcctggaaggtgctgggagggatagtgtactctccatctgccctagctgttccatctgttcctaaggcggttctttaaggaattgccccaaatgggacctatctctagcagctcaggcaacaacttgcttgtgctaatttatctgtgaatctttctattttctgtatttcagcaattcctcaagataatggccttttgttttgttttgttttcttgcactgtgagaattccagtctcttaaaaattatattatttcttcctggtggtgggaaactctgggagtaaagagagccggcaggtgcccgtgtgcagtccgctgtctcaaactggagtctcccatgggtttgccaccctcagtggtgattttgttccaaaagttattttttaaaaattctgatttatacatgatctgaaataatataactaaatcactagtttccaagtgctagtcaatggtaaagtttttttttaattaattcatagtaaaggaaaaaaactgggttttctgggattatgtcctttctaccttttttctaatgttaaaatgtgttttctcaaaaaaaaaaaaacagtagtggtttttttttaatgtctctacttaacaaaaaaaatctgtaatcctatgtcagtatcttttttaaaaatagtttttgcaagtatgtgaaatttatgtctagactgctggactgaaatattttaattgtggttttaaattgtatctttgttacttggaggtgaaagtatgatttgatgaaggttttctttaagtgctagaaaacatctgtatttaatttgggagtgaggggtttagtaaattaatctttagaaattctaacttaattctaagttttttttctttttgcatcataaggcttttgcagacatgctgaaagtaaacaagaccttgacaagtctaaacatagaatccaattttatcactggaactgggatcctggccctggtagaggcactgaaagaaaatgacaccttgacagaaatcaagattgacaaccaggtaaggaaggccagagaataggcaaagtcaactcacagggtgtgcagtgagcgggggaaatgccacaaggaatgagttaaaagacacagttctgtgtgtgactcaatttgatgtactggatttcctgtaagttttagaaccatttctggcccatggaggatgtgcagaagagcatgttactaatcaaacaatgtacagtggggcagcctgggacataaagagccatctatcccacaaccctaggctagtcaggctccagaagagaaagcaaggaggtggtggcagaggtgttgatagctgctttattcagtctcatcattgttgccttttggcatgtatctcttccctgtactatcccagccttacttttgcttctcactgggactgttgctaacagagaaagcagggtagccgtgtccaaagattcagatttcttttccttggctgaagacttctagaaccaaaagagcagatgcaggctcctgcagtctgatgctggctgcagagagcctatttaaaggaatcagggttctagaagatggtctggcttagagtagcaggccacacccatgagattgtggtctgatcacagtctcattgatcatgaccacagcatttctcaggttcccgtctgcagccaaagcaaggtgcttttccctagagccacctcttcctgcctggcgacctctttttcccagcgtcagcctgcagtgccttccgagttgctctgctggcttcagctgactcctgcccacagacagcaactctcagtgatcagccatgatgtagagccctgctcctctggccatggggaagggtctgtgatggggttccagacactatatcttgaaaagaaagggccttggaaaggagagaccaaggagacttgtggtatgagcattcgttcccctgtgggatggtgggagagacagttggggaagtgactgctcagagcatcctttgcatgtctgggggccatctctgggaaagttcctggtgcagaccctccaagatctgataaagccgcagagtgccatccaggactgttgcctaaccctggaaaccctcaacagttcctatggaggctctattctctgtctttgctaaccaggacaagcagactgttttcagtgcaggccctctggccctggactaatgatgtttgttgccaggggaacacagaaagcccactaggagagaggaacttttacattcgcatcctgccagaaggaatgtgccaccaaaacggctttcctagacacagagatgtggaggcagcaccccaggggatgtgccacacagggccccgcacactcaggaagttcgatgctgtgtatcctagcatatgtccagctgctagtaaattagaaagtggcatcagggtgtgggggagtaaggaaacaagccagagagaaatatgaagggagagaacagaagtgatcactcagggatatttgttgaatagactcatatcaggaagaagctaagtgggcacttagtaaatatttccagggaaactaacacagaagtggataccctgttccaaagtatatttaactttgtttacggatttaggccattgtgaaaccccatatctgaaataatatcacacactctgtccctagttccttacaagataccacctagctaaggttgccacataaaatacagttaaatttggctttcagataaatgatgtataaattttagcatgtgtcatcaaatatatgggataccttatactatactaaaaaaattatttgttgtttatcagaaagtcaaacttaactgggtgtcctgtatttttatttgctaaacctggcaactctatgcctagtattgagttagaattagcctagaatgagctagaattgtgaaaatttagaacagagcagcttttgacaatgcatataaagaagaccctgaagtacagcctgtaatcccagcactttgggaggccgaggcgagcagatcacctgaggtcaggaatttgagaccagcctggccaacatgatgaaatcccatatctgccaaaaaatccagaaattacccaggtgtggtggcacatgcctataatcccagctactggggaggctgaggcgtgagaatcacttgaacccaggaggcagagattgcagtcagccaagatcatgccactgcactccagcctgggtgacagagcaagaccgtgtctcaaaaaaaaaacaaaaccctgaagtacaaagaatttgctccctaaaatcccctctaaatcaacctcatcacccctcctcagccatctaggaatggatttgtgtagtttttcaactttagtatttcattttgcttctgaaatggcttctctttatttcttttttttgtttgttttttgtttgtttgttttgagacaaggtctcactctatggcccaggctagagtacaatgatgcagtgtggcctcactgcaatctccacctctctggctcaagtgatcctcccacttcagccttctgagtaactgggactacaggcacacactaccatgcccagctaatttttaaatttttgtagagacagggtctcactatatttcccaggttgttctcaaactcctgggttcaagccatcctcctgcctcagcctctcaaagtgctgggattacagacatgagccccaccgcgcctagcctggcgtctctttatttgtatacgacaaggaggattaagattttctagagaggctgggtgtggtggctcacacctgtaatcccaatgcattgcaagaatgagacaggaggatcacctgagcccaggaattccaggttgcagtcagttatggatgtgtcactgcattccaccttggacaacagacctagaccctgtatattcattctctctccctctctctctctctctctctcacacacacacacacacacacacacacacacacacacacacacacaccctgtctctctctctctctctctctctctctaagaaaagattttctagaggaattggaaaaaattgtttgctttacttgagaaatgagggaattcggggtcaaaacttgtcttgcatccaaattgtgttcattgactcatagactgttagaagtaacctcagtttccttatctatctaatgaggggtttgaaataaaataatctgtaagacagtttcctcaggcagaaccagaagccaagaccaatttaacagcacagcaatgggcagctgcaccaaagcgaaggcctgctgagaatccaccactgggggcaggctgctgtggctaggctccaggtcaatgtgcagtgatttaatcaggtgcccccatgggaagaacaatcggtgatgcatattaaagaaacagatggggaactgctaaataaatttgagtagataaaagaggtcacttagaaaaacacagaaggcgatttgaagatatgcttaaacatttgtttctatttttccccctttgtgtttggtgacttaaaatataaaaagagcctgggcctctagtcccagctacttaggaggctgaggcaggagaatcccttgagcccaggagttcgagtccagcctgggcaacatagcaagacctcatctttaaaatatatatataatataatataacataataaaagttatataatttaatacactacatacttagataatttaagtatatataaagactgtatatccaaattataagaaattttgatgcccatctattgtcctgggtttatgtaagacctcaaatccaaaaaaagatgcaggctgaggaagaaacatagtgtatgttacattaattcctccccttttttatatgccccccaatttaattttcttcagcttctaagtcttttatatagctattagcatctccttcctccccctcaaaaaaaaataaagctattattctattattaatatttcctatttttgattccagattatattaatggtttaagttaacataaaagcagagttggtgtttctgtttcactactttgccagaatgtcatccaaggttcattacaaaatagagaaaaccctaaagaaattacagttgacgtctatataaatagaacattcaaatcaaggatgaataagtgtggatttgtcttttattgcaaaacaaagcagctgtaaggatgctgagcagaatttaaactactaggaaaatagccagctacttggagaggagggactcagatacttgggaatataggtgatttggggtaactttggaccactgcattaacactgcaagttatccaagtccaggactcaaatgctccaggggcacaagccgtagtagtggcagccctaaccttagctcagggctcatcccttgatacggtcccactcttctaaactatgtcatttgctaaagttgctcatgaaactctgaggtcagcatctcttacttttttgctgccactccctcccatttactcaaaatgcttagagcgttaatctctaccataattattattgtctaactggaaataccacattgtgttaagttcttgaggagagactcgtttgaggggttgctggatgacaagaaagagagaagcaaagagataagccttaaacttgcttgggacgcaagagttcctccataaacttttcttcttcatccactccatacttaaattttccaaatttaaaaggtatatatttttaacttattacaaagtaatcaagattgtatggtactggcacaaaaatatactagcagagcaataaagcagattcaaatcagggaagaatgaaataaaagatggtgggataatttgctagcattttggaacaaaattaaattgggtctctatatcttctttttttttttttttttttttttctttttgaggtggagtttcactcctgtcacccaggctggagtgcagtggcgccatctcggctcactgcaacctccgcctcccaggttcaagcgattctcctgcctcagcctcctgagcagctgggattacaggcgcatgccaccatcccctgctaatttgtgtatttttagtagagacagaatttcaccatgttcaccaggttggtctcgaactcctgacctcaagtgatctgcctgcctctgcctcccaaagtgctgggattataggtgtgagccaccatgcctggccctatcttcattcttatgttaaaattcattccagatgaaatgaagatttaaacattaaaatatattaaatcataaaccaaatggaagaaatcaggaagagtagagaggcttcctaaacatgatatctagaagattgataaatttgaccatatgaaaatgaagaaaagtcctgatagtgataaaaagaaagtcaaaagacaaacatagcaaaatgttttcagcacatttgacaaagggctaatttcctaacataccagaaacctacaaatcaagttaaaaaactcaaaatacaggaactgtaagctaatagaaaaatgggcaaatggcatggattggtagttcctgagaaaaaagaaatataaacctgtaagaaaattcattgttcttattcatcatttgacaaatgcaaattaaggcagtaaataaatatgaaagaaatataaattttcaccaactgtatagacaaagattaaaaaggttagtagtatcttatttggctagggtagggaaagaagtaacactcgtacagttagcaagaataaaagctgtcataacctttgacaataagtcaataatatatcagaattcgaaacatgcttgccatctgacccagctataatttgtcctacaggcatacttgcagaaatgccccaagatgcactgggggagggaagctcactgcagttttgtttgggatagtggaaatagaatgtgatgtaacagtaagtcactaaggcctggctaaatacactatgatccatcactgcaatgggatttggcatagttctttatatggatgaggtaaatgtatatttaccaacatgaaaagatatccttaatgttagatgaaaaataaaaacacacttcaaaacaatatgctagtataatccattaatgtgaaaaaaagcatagatatacaagtgattgtgtagatacgtgaatgcatagaaaatgtttagaacactacatactgcatgccaatctggctttctctgtggggaatggggatgttggagtaaggagacttgcatattttatatacattttaatttgtgttttctaaacaagcctgtacgttttgttttgttttgttttgttttgtttttttttttgagatggagcctactctgtcacccaggctggagtgcagtggcacaatctcagctcactgcaacctccgcctcccgggttcaagcaattctcctgcctcagcctcctgagtagctgggactacaggtgcctgccaccgcacccagctagtttttgtacttttagtagagacagagttttgccatattggccaggctggtttcgaacacctgacctcatgatccgcccgtctcagccttccaaagtgctgggattacaggcatgtgagccactgcgcctagccttattttttaaaatgtgatgactgtgttatgaaaaaatatactttgtcccttaaattaaattgtaaattcccatatttacatgccccatttgtttttgttttttgagacagggtctcactctgtcacccaggctggagtgcagtggcgcgatcttggcccactgcaacctccgcctcctagattctagtgattctcctgcctcagcctcccaagtagctgggactacatttgcatgccaccatgcccagcaaattttttgtatttttagtagaaacggcgtttcaccatgttgcccgggctggtctcaaactcctgacctcaagtgatccatctgcctcggcctcccaaagtgctgggattacaggcaggagccacggtgcccggcctccgtcttaaaaaaaaagaaaaaaaaaccctctattttttattttttcattagtttatgtctcaaacaaaaaaacctcttcccaccaacttaaacaagttggagatttttttgtagtccaggaacccccttcagagtttgctgatttcatccaaacgtgtacatggttcaaaccacaataaagctgctcagaatcacctagcaagattctgctgagagacaacagcccataggttgagatgtttaattatcattggatatggatcccagaattaaaaaattatatttgatagcacaaatataacatgtgcacaacacagtgacaatagagttactatagtcaacaataacattgtgcattttaaaataaaaaagtagaatttgattgattgtaacacaaagaaaggataaatgcttgaagtgatggataccccatttaccctgatgtgattattatgcattgtatgcctgggtcataatatctcatgtaccccataaatattatatacctatgtatccacaaaagtcaaaattaaaaacattttataaaaaagaagaaaaagtattggaaatgaataaaggtaatggttgtacaatattgtgattgtactatatgccactgaattgtgcactttaaaatggcaaaattttatgtgtattttaccacaataagtaagtaagaattcccaaagtaaaaagtaaaaaataaaataaaaatttagtaattggattggctgctacaaaatagtttcattatttttaaaacaccctttgtttaaaccacagatactgggatgaattcaaaacaccaaatattagttttgctttcattttaattctggaattatcctttccttcataaacaatttgcttagtttttttcagctgcaggacaccagcaaactcagctatctgtctgttggattttgcttctagacaaggagcaggactcaaatgactgtgagagaaaacttctcaagtgacgctgtccctttcagtttgagacctttgcctctttgcctttttgtccagcaagtagccttgtctttttcctgtgcaagtaactgtttcctcttccttcttggtcatcctgtgcatgtgtctgcacctgcaaccagaggcagcagttgggaacagctgtagagatggaaattgcccagatgctggaggagaattcaaggatcctcaagtttggataccagtttaccaagcaagggccacgaacaagggtggcagctgccatcacaaagaataatgacctgggtaattcagccataatatttgctgttaacaattagaagagcatgagcattcacttctccacttcagacgcagcatctcacagataccattccactggcctctgatgtcactcacttcttcatataagacgcattattataatacatggtcataggagtctttgtggtcctcgcagtgttaagtttcatcatagcattttctcaaaaaagaagtttgttctattttccaggcagtctttgatttttgcttgatttcttttgtgtatttgtttctcttttacttacatgtaatctccttctgtttttatctgcaccagaaaatgggcacaaggacactgagattccaaattatgtttgacttctgactgctttggtacttagttctaaatatggatatgtctgatactttggcactttacatgtgatataaacatggagctacattatgaagtttaaactcacaggtcgccttttcagttagccccttcagtttttcgtgtggccacttgttgctgaggatccctggcatttcttctgttaggatgaggtggggcatgtcctgatcaaccatagcaaagaagaaaggaactgggaaagcttggtctgaggatatcccagccacctggagcagcctggcaaaaggacacccaggagcagacatccatttggcaagtggtcagtcagtcaatagcaggcttcaatccccagtttgaggttcagggacagaatgccagatcttggatggaggaactgggcaaggcgttccaccaggtacagtgctggcctcaaggaggactcagatagtgggcaagatagaagctaaaggttagaacgggaaggggcaaataaaggttagcctccaattccttgtccagacaggctttgccaagaccctgaggcgtaggaaaggtgcagtgtgtggcatcaggaagctggctggacacgtgacagtgcttacctggggggtgcacagggtgaggccaagggacagacaggcaaatagggatttggggaagagtggaagcagcaatcagaaggcacctaggaaaagcacattgggtccacaaccaaacaatatagagaccaaaggaaaacaggcaaaatgagaggtctgaagaaaatggacagggcagcctacgtccaagaagcagcaactgtgggcaagagcctaggtaggagctaggctatttaaagtggagagttagagcaagaccacagccagggcacctttttgccaaatccaagaaagttcaaatagccctcttcccagtgaccaggagagcctgcagttgggagagtgaaaggtggaagaagagggttgcaggaactgggaaacggcagtctcggcaacttcttcggttctaaacatcaggttaaaagaacattaatctctgagtttgcttgccaagtgaatcacaccttcctgtaggttgatacttagaagtttttatttagaagagtttcagaaactttgaactatttgcagctccttccagacttcatcccataatcagaattaaaagattgtgattgtgttaacctgaagagttagttaaagccagttggtgacagaattgcaagtgccgtggataaacggccatgaaaatagtcaaagtgcactgtttcacgggtctcttctggaatttctatcccatagaaattcgaaggttctaacactcgagtacccaactatcagacatatatgtatttaaatgtaaattccaccagacactggatgaatttatcatttccattgattgtcatggttaagtattaaaatttaagataactgtatcctcaagtgtgtgagattgtcatcttatgtgattaatgttgtttatctggaatttaaggaatatcccttcaatttgtctttttgttcctttctttcttacctagttcgtaagaagagagttgaagcagaccgaaggtaaacttccttgaggagaagtgaagtttcactgtggtatggccattgaaaaacaaaaactcttcttcttccccatcaggaccattttatcaaagttcgttcatttccgttaaccacataactaataatttaattgttattcttttttagcactacttatttatcttggattttgtaatatatgcaattgttttatttgctcatgggcacttctggcaacttgacaaatggaccgatgcagattttagagagtgacgacatggaaaatgaatttaaccactttcttattgggttgtcttgctttcttacatgaacttgtttttttaatcactgaaaggaatttagtgtataatatgtgtttgtaactgtgattatgatagaggcctatctctgtttacatgcatagctttgagttaggctaaatacatcagaagtgttctactgaccacataagaagttagtattgccaatctttcactgcatgtgaaaatgtgaccaatttagcacaaattctctcttagttccagaaaaatcagtaaatgcacatgccctgttgattggagatcagtagtgtcatcttcataaagcaagacaacattatgacactttaaaacagtagcaaagaagtctatttattaacccacaaatgtagcatcaagccagactcacaggtagcaaaatgaattacacacctacttttactgactattcaacataaattgaatctttaacatgactttaaaggctatttacaaagctgttttaaagtttttcaaacatgatagaaattttctaaattttagtaagagagaagcttttaaaacagtacattcctgaataaaacaacaatattgtatcttaatcaaggctgtctgatgcagatgattgcattttttggcaaattttagaagcatttattgctttgtctttagtgtaacaagatcactggattaaatataaacattcaggttaattatctagatttttgtccacagtatatgatccatccagacatttgcaaacgtcaggagaaaaatgtgaattatttatccagatgcatgtcatctcaaggacaaagcctgtgaaagtacaagtgagatggttgcattgtagtatgcattaatctttcaatgtagtggtgtaaaaatgcagtgctaaactaatgaagcaggtgactgcagcctttggctcaagctcacaactctgataactgtcagtgcctgaggttgtgattggtgacattctgacactgcccaaggcaactcaccctctattcctcctttctcccctccctttcttccaattcattgtcttttttttcctcttttctctgtaatttgttactaaacaaattccagaatttgtttagtagctgagtgttcctgagttgcctagtagcaataaaacaagtgaataggaaaataattaatatattattctatttagcttgtaaaacacatggaatctgtttaagatagcccttgtaaaattgaacatttacctgtattgtaagtacccacatctgtgtctctgaagtcctttgaaacatctcattatcttgaaatttttttaatgtttgagaacaccataagcagaatattctaacacctttggcccctgaaaatcctttaattagtttatggcttcatctccttatctatttaaaaaacatagtaaataatgtttatggttttcagtctgatttttccttccctttcacccatttaggtgtgatgtgttggagtcaacttgtacaggcttgccaactgttatattttcaagaattttgcaaactggttgttcaatacagccattatttaaaattaaatgatgtgcacttacaactgaatgaattatattaaggacagaagtaacaaatactgtactcaaaaatcttacattttactattttctaacctcttagattatttacatctagtaggtatgtatgtagaaatattaccaaacagtatgctactgaacgtatcctctcaactccatgttcactaccttcttgttactacagtggcttgaaattggccatggtagaaatatttacaccacagaaattagcaatatgtaagaaattggggttttctccctctccagattgctggttgataaacattcatcagcacaccactgggtgaaattatacatttttttatacatatgtttcgcttatcatgttgccgaagggaagaacatttctcttagatgtcttttctcctctttggatttgttacaaacctgtttaagtgctgagtccctgacctgcctctccaagtaagcctttttcctttttttttttttttttcttactctcattcttgccttgactcttaaaatcctggaccctatagagcattccttgcagccccacagtgctgtgggctgggggctaaagcagttcttggcaaactctggcagaaagcaagaaaaaaagaatcagaattcaatcatggctgtttcttttgtacaagcagttgttgatagtattaaagcaagataatgggacattatcaaaaatatagcactgtttttaccttatgaaatagttgggttgcatgcaacagagtctatgaaatcaaatgttttttactaatcagtttgttttcttattacctgtgtttttaaagtggcttgaaaggtggcatttccatgagtgtgcacatattgatgataacccttagaaaaacatacacttgaggagcctatccatcatttaattagcctaggacttcatctccctctctgcccaaagtgtggaagtggtagctctttcatgatcatgggcacagttaatcctttgctatccattgtgatggggcataatgtatataaaatatttttctatgtatttgttctgccagatactgtgttgagatatttggcaatatctggataactgactgaagggagataacttctccccaggcctatctccctcccccttttagagttgtgcaggtccactttaagtgtaaaatcactcacctggacttgtgggcttgtatcaccaacatctattatggcacatgtagatgacatttaggagaaaaaccttagaagtctagaaatcatatgattagttcagcactgcagctccccatctgcttatagtgtataactggaagctctttcatcctcatcagcatgattaaatgacttcgtttctttcatctttggagggtataatgtaaataagtgtcgtgtgtgtatgtgtgtgtgtactgtcagatatctaactaggtatttggctacatctggacaactgattgaagggagatgctctctccccagtcctcttcccttgtcctttttagaattgctgcaggcccaggttaaatatgaaattactccctaggctttgcagtttatgttaccaaccaccacattttatagctatgtagaggatgactcttaggaaataaatattagaagcctagaaatcatttagttgttctagcaccaaatctatccatttgcctaatgtatttaacattccatcctcatcaacatgatgaagcccctttcttccatctttgtagggcacattgtatataaatattttgtacataaagatcatcaaataccataatggggtatttggcttcatctggaaaattgactggagggagatgctgtctcccagccctgcttccctcgtccctgtccaagttgctgcaggcccaggttagaagattaccaacctggaggggcatgcagttcatcttacaataaaagcccattcatttaaaaactcagaaatcatcccagtgcctgtactcctcaaaccaatttccctaagggaagactggcacaccagcccaaagagcaggtgcttctcttccaacagaaacatggcccctgacagggcaccagcattagggaaaccaatgtcctccgaatagctgccatgagaacatttcagatgctcaaactgaaaattcttaaaaccaatattaagcatcagcatgctttaagtgtaagatagccctttggaatttacaaacacatgtgcagctatttccttcttcacagatatgatgtactcagccccctcctaggcactacgaagaagacagaggaagcataaaaattctggactaatataattttatatgtgtttctgagattggggagtagactgagtgccttttttacaaagaagatcccatatttaattcaagtatttatagcatcagcaaaaatgggcagagggcgggaagttgagaacactaggttctgtgctatgttacctgtattcagtagaagtgtttctggagtcaggttttaagtcatgatcctgaagcttccttcccctcttccactaatgatgcaataatagctgttttcattttaacgagcagagaactaagaggaaaggtcctagctctgccttccacttgcagcttccctttacctcctcttattgctttcatctcaaatatccctgctactcaaccaatcctaaagctaaagtactgagatgcacacaaaggaaaggtgtgagagtgcttggaagcatccagctgagcccactggatgaaaatcagacgatagggcctcctgttgtaatatactagccagagaaaagcgccaagaacttcagggatattattcactgctttattgctccctaaccctagatcagattggattttactttgtagttcaggagttaagaagtcaaattgctgaccgaggtggggaaggatgatggaaattaaaggtttacatttgtttaatggcagaactgagatttgctcagcttatctctttcccatctgtctgtaatagcaatgactgaataatcagtagaccaatggaagaggagttgcaagtttaaatttgtaacctgactctgggttctgttctaggaatagtgcatgttttagaggctttgccagttgggatacattgttgacttgggggaggatgaaggagagaactgatgacctagacatagaaaagagtagttaactaactagatgttcttctgatctcttccatggtagacattctgagcacattggcccagttagttggtatggtgaaggggcaccgtactaacagatttggagactgaaacctaatcccatcaccaacacttagcaggtatatgatcatgggcaattcattcaattgcctgccaattatagactatatagggggaagagcactggatttggagtcaagaaacctggacacttggctccacacttccttagctgggtaactttgggcaaaccgcttggtctctcaagcctaaggttcttcagctataaaatgggaataatacttcactaactacctcacagagttgtggtaagaatataatcagataactggataaaaacactatataaactggaaagcgccgtacaaatgtgagagatcagttttattatcaaatcactgttttccactgcctcttgaatcggctttattctaaccaaccattacatctttctcatcttttggagtatgggtaattgaggcttgggtgtgtcatcagggactggagttatttcagctcccatgtagaggtgggagaggtggttgatggggcagtggaagttagataccagcgatgtatatggtaggacattttcctgggtcactttgacagtaccttgggaaattgtcagtccttgcagagggcctaggctgggcacaagggagaaagcgaacagttgactaagaattgaggggagggtctggagcgctactgccctcctgtcattgctgtgggtgggagaggctaagacttcaggtttgactggaggcctaggagagaagagtgtccttagggtttcaagaattttaatgcctagcagctgagtaacaggcattagttctgatagatagtgaaggggagaaagtgccacctgttgtgagatcacctctccagggcagcagctgccttgttatcaccagcaaccttagccctggtcagtaatatttctgctaagaaaggttttgaagcatggcctccaatgactttcataagcccttggaggcaggactgtgtctcatccatctttgtatcttcagtaccatcttgtaaggtgccttgtacatagtaggtgcttaatgaacaaatgttgcttgaatttagctgtcgtccagccccacagagttatgctccatttgccaccatgtgatatttttgagaaacaatagtgatttggatgccagctctatgtgactttgggcaagactctccatctatcttgtcttcatttcatctgtaaaatgaagtgagtagattcaatgctccctaaggtcccttccagctccaatacttgacaagcttgtgattctaaatcgtttccgttgcctctgaacatgggtgagtaatgcctccactgcagctgtttctctccaggaggctttgttcagaggaggtctgactattgcacagccagttttttcttcctcttcagcagttctttactgtcttcagaatggttctggataagcggccttttctgaaaggatatttaaaaatatatactatttaggctgggcccagtggctcatgcctgtaatcccagcactttgggaggtgaaggtgggtggatcacctgaggtcaggagttcaagaccagcctggccaacatggtgaaaccccgtctctactaaaaatacagaaattagctgggccctgtggcaagagcctgttatcccagctactggggaggctgaggcaggaaaatcgcttgaacccaggaggtggaggttgtagtgagccgagatcacaccactgcactccagcctgggtgacaagaacgaaactccatctcaaaaaataaaataaaatatatactatcttgctcctcagaaccagtggggaagaagagggaaggcaaagaaagaaactgagcatagtaaacacagcatttttttgtaggctcttatttaaaatgtgtgtgtgtgtgtgtatgtgtgtgtttctgagtaagtattgactgggaaaaagagagaagtcaatcaaaagtatactgtgcaattgagagaggctggcccaagatttaaaacttcctgtgggtaatctaactgtgagtagataggaatcggccatatgacgaaatgagatcaataggaaatgtgctttttgaggaaattttattttagtaccaaatgttgccagtgacaatcttcagttaagaagtaagttattctgacctaaaattcttatctctgccactttggtttaaaaacaaaaacccttatatacatggaatagttatattttaattaagcatttattttagttgttttcatccattcaagcaaaatgaataagcagcatttttcattgcacttaaaaatgtaaaatacctgcatgccactaatctgtaacattttaccagttcagatgcctgtaatgtgtgactttatgtgtgtctgtgttgttttgaagagaataaaggaaataatactttgcaaactgtttaaacaagtgtttaaacttctattggcaacatttattgggctaagcagttattgaaaactccgcatagttttattttccatttgaaacttcaatcaaatcaagactattatattcattagggaattaaagactaatttgctttttaaatgtgaagttgaacactgtgtggaaagtaaatgtgtgatgaagcaaaatgtataaagtatgaaatattatacttttaccctggataattattcaggaccccagttggcccaaataggtgcaatttttaatcctttgaaattagccagccagacctaatgctaaggtaaatgtaaactgttttaattaattaagatctttctgctttcgaaggtataatgtatctatttctgtcaggaatgatatttccaaatgaaaatgtaaagaacattgggaaataataaactttcctttcaaagtaaaagtaaa

SEQ ID NO: 525 - DNA, 9092 bp, Homo sapiens
ggatttgattggtggagcgtggaaatggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccggtaagttactgtccccttttgggcctcagtttcaccacctgtaaaatggtatcgggagagtggacagtgtgtgggcctttctaacctttgacagagggtcggcagaaacctcgaagcccacgggtttagttactagggtctggagcccaggtgctcttcctgtgcgatcagccctggggtgcgctcgacttcctcatctaagatgactagggagactgggggggagccgggaggttttgtgaaagaggtccccttggggttggaggatcctaggaagtcattagactacgtgtgtgataggaggttaagatttacctacttttttcaaaatttaatactaagaactactttgaaagaggcatcaccttctttttacagagtcttttaccgagactttgagatgttaagtaacttgctgctaaacttacagctggtagagctggaatttgagccccagtctcttaagagtttgtgctgattccaccaggcttcagtatttttatctctaaaattgtaaacaatatcatttcataagatccatccagctcctcaaaattattttaccccaaattacatcagaaaaccttgattctaattctagttcttgcagtttccctatttgtagaaaagaacttgggttaaatgatctctctagacccatccaccttttacaatctgtggtttagtgattaggatacactttactgaaattttttttttaattttaaaagtatgttttcatcatagaagacacattggaactttaatgaagttttagtttagtgggtttttttttgagatgaggtctcgctctgtcacccaggctggagtgcagtggcacaatcatagctccctgaagccttgacctgccggacttaagcagtcctcctaccccggcctccttagtagctgggaccacaggtatgctccaccacgcccggttgcttgtttttttttgtttttttgggttttttttttcattttttgcaaagacgaggatctcactgtgctctccaggctggtctcaaactcttgggatcaggtgatcttcccacttcctcctcccaaagtgctagcattacaggaatgagccaccttgccttgccagcttttttcaataacagtatgggggagaagtattagaccaagatttggtagacttgggttctcgtgtctgttctgcaagtaatttaacctgtcactcaattttatcaataaattgagagtaaaccttattgtacctacaaggttaccatgaggatcaagaatgaagaagattcaaaaattctgtatcaaattatttaccttctggaggattacatctgatgaaagtgatacacactctctcccagaaattttacattatgtaaaacttttacctcatttatttgcagagaagacagtgtaactcactgatttatttaagcattttctggtgcttaagagcttagctattggttcatattctcaaatttatggtaagtgcccccagaaatctttataatagccctactcagtgattaatccgaaaagtttctagcttgacttttttgttgtgcagagatttccaacaccttttaacctgtgctagaggatatgggaagcttttggaagacaggaaaatactcccatagcacaagactggtccacactgactttaatctccctcattttaatatggataatctatgtggttcctgcattgtcatggattaaaactgagtaggcagtggaagataaattttaaataagttaatcacttagactttgtttttccagcaaagaagatgttgctatggaattggaaagagtgggagaagatgaggaacaaatgatgataaaaagaagcagtgaatgtaatcccttgctacaagaacccatcgcttctgctcagtttggtgctactgcaggaacagaatgccgtaagtctgtcccatgtggatgggaaagagttgtgaagcaaaggttatttgggaagacagcaggaagatttgatgtgtactttatcaggtaagcatataagatggtaaagatagtacagccaaatgattttgtctgggcaggtagtgggagcatagcaggaatcttagcttctttatatttttaccataaaaccattgcagattctattctttcaatgttgctattaattacatcaagtgatttggggaaaattacatacattttgtccctccttctgtgaatggttaacgggtaggttgcattttagttatatttataaatttatattgtcatagaggaaaccatttaaaagtgccatttatcactctttttcatttttaaatgacagatacctatggcaacatttggaaattaattagaaatctgaaatgtggtccagttcttttaaaagtcccttctatttactagcagtaagtttcctttaatatcattttctagcccacaaggactgaagttcagatccaaaagttcacttgctaattatcttcacaaaaatggagagacttctcttaagccagaagattttgattttactgtactttctaaaaggggtatcaagtcaagatataaagactgcagcatggcagccctgacatcccatctacaaaaccaaagtaacaattcaaactggaacctcaggacccgaagcaagtgcaaaaaggatgtgtttatgccgccaagtagtagttcagagttgcaggagagcagaggactctctaactttacttccactcatttgcttttgaaagaagatgagggtgttgatgatgttaacttcagaaaggttagaaagcccaaaggaaaggtgactattttgaaaggaatcccaattaagaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggtgagaaaatatttcaaggtatccagtgctttcaagcactattaaacattatgtgatgagaaatttataatgctgcatcttgtattcgtgcccatacatggttaagatgtgaaaatagagccaagaaatagggccaaatatgagataccagttgatcctaatactttatcttaaactgatattcaagcagtttcctatggcagagagaaaatcggctgactgctgtcgtgatgccatggcaaaggagagtattactattaacagctgccatcgtctctccctggtgcagcagctgggactctcctcctcagcagtgctttcccttcttcccatcctctttccagccagtaatcttaaaacttgaaggaaaattaaaagccttcacttgtgaaaaatttagggaaggcttcttatatacataaatgagtggagaatagttggtgtcttcacacccctcctgatacttactactaagtgtgacttccaatttaattttgtatatatcatagtcatttttatcttctattttaatgtaatgcttctctaaaatgctttagagctctaaataattcaaaagtataatcacatagttcatctattatttgtaatatgctcttaatacagaattcagaacttagcagttttgtctttataatacctcagtgaataagagataaaagggagaccttttgagcagccctgtattagttattcattatgccattatggtataatgaataactcctttaaagaataataattttacttaaactcctgtggggaaacagcctggagaaatttgtgaagcaggagattaggtttgattcttgttcccagttctacccatgattttatgtcttttctgtgcctggagtttctctgcctttaacacaagatggccatatatacctaggaactgcataagaattcttcaagtctgtgtcctagacactgagcttcttgaagaaagctttgaggtttatgtagatttattgctagcaaaatgggcaaatattaaaaacttttttttgtggtaagagtctagttctcaacatgagatgaagtactcttagtacgaggtgtccatgaaatagtgaagacacccattggcttagctagaaattgccaagtaaacctggcataaaggagactagtaattattcataggagcccacagaaaaagttgtcaaatcagagcagtcagagcagtttcctttgttcttttttttttttactctctactgggctttacctactcaaactaaaatagcgaaaaaacagtagtctaattatctggagacctggatacttgttccagtttatagtcaatcccagtatcattttgggatgattgcttcatttagaagcttcactttcttcatctgtaaaatagaggtaaccatcctgactagtcctgtttttcacatcaaaaatattgtaaaatgagaagtgaaaaagatgctatacaaatgcaaggtattattaactgatattcaaattgcgagggtatggttaaggagtattacatgtgattttagaaatttgagaagtctgataacactggttcccaatagatagaggttctcaataggtagttgtctcaggtgttctagggttcaaattgtaggtttttctgcagattctgttttgtctgtatccctttttttggtaagcgtaaaagtaagtgttcactgcagaaattttggaaaatacagaaaagtaaagaaggaaagaaaaattagcacttggcaacaaccattatatcattttggcttatttcattcttaacttctgtattgttatttatatatgtttccccttttttataaaattgggatcatatgtagactcttgctttttcatttagaagttaataggaaaatattcacaatagtctaaaaaatactttaatgaccacattatacaaatgcatcgtaatttaaaatattccatactgcctttaatttttcaatactataaactctgaacataagtcataaagaactagtgtcacagagtggttaaaggtgaggactcaggagccagactgtctggatttgaattttagctgggacacttagtatctgtgtgatcttgagcaagttacttagcttctctgtgcctcaatgtccttatctgtaaagtggagataaaaatagtaccaagttcatgggtcattagttagattaattgggtatttatgtaaagggcttagaatagtgcctggcatgctttgtaatagtgttgatattattatttgcatccctcaatattgctttaagctaaaccatagactccataaagtgtttacttttccttttcagaagataccatcccacgaacacagatagaaagaaggaaaacaagcctgtatttttccagcaaatataacaaagaaggtatccctttcccaatcagaacagcaaattctaattccattttgggttttcaattctgatgcactatgtttgtttagctcttagccccccacgacgtaaagcctttaagaaatggacacctcctcggtcaccttttaatctcgttcaagaaacactttttcatgatccatggaagcttctcatcgctactatatttctcaatcggacctcaggtttggggattattatcatctttgtcttagtagagacagtgtggtagggagaaagcactgaattgaggcctgggttcaaagtccattttgagtgtgtcacctgggatagggcattcccccttcacccttaaactcttcacctatgaggaaatgagactggatgacatccaacagaccttttagaataaagaggtagattttatttattttatacttccaaattctttttgatcatcagtgaaaatcagttaacgtttctccaccctctttcatgtgtgtttaaaagtatctttttcactgaatgtaccttgtgttctatatgcttctactctcattatctgctgatctgatcatttaaaagctaatcatgcaaggccagttttcagcataatttggactattagcccaatatattagcagttttggcatttgattctgaaagtggttgctggttcagataatggcttctcaccagtgtttttttgttttttgttttctttaaaaaaaaaaaccctctggatgagatttctatgagaaactacttgaacatgaaatcagcccacctggagtcttgtaatcattcagttacttttacttcccaggcaaaatggcaatacctgtgctttggaagtttctggagaagtatccttcagctgaggtagcaagaaccgcagactggagagatgtgtcagaacttcttaaacctcttggtctctacgatcttcgggcaaaaaccattgtcaagttctcaggtattttcctatacacccaaaggaaaaacataatacattgtgcttatttaagagagccacaccttaaactttaatgttctcagatactatattaatggaggtttttcagctcaagcacccaaggcatttaaaaaagtccactttccccaaaccacagtctcccactgacctaaacaataaatctttgcccagcactgggtcaggcatgtgggcagaattaggggaagaagtcagtgaagcagaaagcccagttcttgacctcaaggacatgacttctgtcttgttagcacagcacaaaagagtggttaggaattggcaaatgatatgggtgctgcaggaattcagaaggaagagtaatcacaactggggttgctgggaaagagcctttcctgtccctttctgctgttctctccatcctgccccatcaccacacattttgggagggtgtctttagaagctgacctgataatgtgggatgttgtattcttcagatgaatacctgacaaagcagtggaagtatccaattgagcttcatgggattggtaaatatggcaacgactcttaccgaattttttgtgtcaatgagtggaagcaggtgaggctcactcccatccataattcagcacatttggtctctgaggcaaaataagtccaccattatggttaagactatttattggatacaaatgctattacagtcacaaacaattgtgttcctggctgcggggaagcgggtggcatgtgggttttggggtttttgatcagtaggcgctcccaagtccacaaagaccagtccagcggcgtggcctctgactcatctccagtggtttgtcacctctggccctgttcctgtcattccctatttgtgtgctatctctaagcctgacgtggttttcctcctgtcaaaagtacaccactacaggaaagcaggaaggtttgggcctgcaatgtatgcatattgggtttctcttagtggtctcagactacgtttgtggtgactgggtcctgcttcagccctgttgaatatgcccagcctgtggcatgctggtggtcatcctggcagctggtgggtggcctggtatgctgcccactcagcttgagactcaccctcatgcattcagccagtaggtctggccaagcctgaactgaaggaccatggtcctatcccagcttcatcagagcaatccattgtgacctgagaatccatttaacctctcggtctagaacctccttctggaaagtgaggtattaatacttgactcatgttatcgccaccccacattctaagtcatggttgagtagtaatttggacagtaccttgtaaattgtgtgagattaccttaatataaggtataacttaaaatattcatgaatcccaggaggttaaaggttataacttttaggtatggtatcgtaatgtactgtcccccagcaaacatttaaaaagccaattttaaaaaatgtatttctgactaagttacattaaggtctctgcctctgtatcttatgtttcttccaggtgcaccctgaagaccacaaattaaataaatatcatgactggctttgggaaaatcatgaaaaattaagtctatcttaaactctgcagctttcaagctcatctgttatgcatagctttgcacttcaaaaaagcttaattaagtacaaccaaccacctttccagccatagagattttaattagcccaactagaagcctagtgtgtgtgctttcttaatgtgtgtgccaatggtggatctttgctactgaatgtgtttgaacatgttttgagatttttttaaaataaattattatttgacaacaatccaaaaaaaatacggcttttccaatgatgaaatataatcagaagatgaaaaatagttctaaactatcaataatacaaagcaaatttctatcagccttgctaaagctaggggcccactaaatatttttatcggctaggcgtggtggtgcatgcctgtaatctcggaaggctgaggcaggaggatcatttgagctcatgagggcccaggaggtcaaggcttcagtgagccatgatcatgccactgcactccagtctggatgacagagagagaccctgtctcaaaaaatatatatttaaaaaataaaaataaaagctgaccccaaagacaaataa

SEQ ID NO: 526 - DNA, 17558 bp, Homo sapiens
aaatcgggggcttggctgctcctggacggtcacgctccctctgcccgccagccggcccgccagtcccggtcccggcgtctctctccggcacccacctcggcgctgcggaaagactgactgccaggtacgcgggctcccgggcctgagaggggcagcggtgctgacgagtcccggctcagcccccgccggctcccgccgtgaggtggactgacaggtcagcgggacgcagaggggcgcggcgcccgggcgacacggcaccgggagagggctcgggagggtggcggcggcggcggcggcggccgtttcccgcctcccgcttcgccgggggccgtgagggaggagctgagctcccgcgcagaggggcgggggcgaacgagggggaggggcggggttgccgtggttccgggcgcgggtttgcccgcgctcaggccccgcgcagctaaggggaggcgccggccacggtccgactttccgcgccaaatttttaaatcgaaggcggaaggtccggccccgcccctggcgccgtcggccaatcgcaggcccgcttccggccctctgattggtcgggaattgttgtcctggaaaccacgatgatgctgtccgggaactgtcgggactgcggcgggcggacagggcctgggggaggggcctttggccgaaagttgggggaagtgcactgagcgagtggcggccgggggacagtacctgcttgccttattgggcaaatacagccttccaaggtggagtctaacgccgtggtgtgaactggccacccgaacagggagtaaatagtgctttgtatctttaaggaagcccttttttaaatttaaaaaaaaagtcttaattataagactctttaaatgcccaactgcatacttggagctttgggactgaatttggaactttcctgtcaagcgacctcccacgactttactgctgagcctgtgcacgtgtgtgtaaggggagaaatccaggcatctagatgcagacttgtacccagttacttggggtcgcgtgcgctcagctgggacctgggctcgtgcgcttagtccggagccctgatctgcgaacaggtgggtgcttcctaaagtattcgctggggtccggagaatggctcgccttttctacagatgggagagggctgtcactagaaattccgtgggttgcttgaagtcttaggaccgccgatccgtttgctgaaggaatttactggcatttgttggcgttctccgctcagtggggcgatctctggtcgagaataaaatgtaaatctagtttgtcatttttcgttaggctttgtttccgtagcctcttgtccgtgaaggaattttcaacagatcttttggttcttgtttttctctaactttttctatttccttttttctttaaggatattaaaacttttagtacaattgattggactacttgaaccatcgggatttggggaggaactccagatttttcatttttaaactctaaatgtatgaggaatttacagaatggagaacgaaaaggtactttataacttcagtattcatcattgcaattttaaattcagtatcatcctgatttaactccataatttttccctatccaatgtgttttcttaatgccacaaccttggttagcctctgtaaagacctggaaaaaatgaaccttatcttatagtttcaaaaatatatagtttaaaatatatactaatttaattaatatagtttaaaaaatgaaaattatcttaaaaagaaattcagtctccaatcatgtcaaatgccctttctgaattccagttgttcaagaatcctcagaaatgttgtaatgaaactaacaaattttattattcttaaaaataccttttctctctttatgtctgagacagctaccaaatcattaaaaactagaaagagtgtaaaggggcaaacctacccctcttcaaaaattcgttagtttcattacaacatttctgaggattcttgaacaacttggaattcagaaagggcatttgacatgtttggagactgaatttctttttaagataattttttaccaaattggcagcttatttatggggtctgcaaaatgctctgtttagggggcaaacattttgtaaaattacaaaagaattgtctgtggggggtgtccaactactaataggtttaaaaaagtgaacttacatgcatatttcctaatagttttagatgttagtcaaataagagaattactattgcttctgataatctgaggcaaagaaaaagcctattgtcagatcagtacatctcagatgcacacactggcaaggagctcctgttgggtccaccatactgacttccatgtaagaagagcaccatacttggagtgaaaatatctgtgttccactcctacgtgacctctctcagcctgcatcttctcttctgcgagctaagaatgcaggattccatgaacatacaaacggaaatgcacttgataaacccaagatgtcacaacatgtcccatttgtccatgttcttaaagttatttggtctgcctattattttacttattgctgttccaagcattttctttaaaatagataaagatgggagtagtgtgtgaagtccctggtgtccaaaactggaaggaacatagtctccattagccttatttatgaactgctgttaatttacccttttgtctcagtggctatcctgcttctgccaggatctagctttgtggtcttaggtagctgttaggttgatgcaaacataattgctgtttttgccattactttcagtagcaaaagccacaattacttttgcaccaacctaatcattttacttctctgggccccattttctctatctgtaaaatgagggagtggatgttcaaagagcagacttttctggtcagaaatcctgctgttggacactctagatttccctgataaatctgaccatatgctatccctcactcttgtctccttgtctctctgactcttcagtggtattttatttagcacccactgcatgcagccattatgctaggtggataagaatttctgccctgtaggcctttacttattacagtgccatgagtaaacaaaagtcatttctagaagtttgatcatttaacattgtcagtccaattaggggaagctgagtgaagggcatttgggaactctatactgtctttgcttctcttctctaaatctaaaactatttcaaaatacaattaaaattataagtcctaactaaagttgttttttcagtggttgaaacataaggtgaaaacatttatggcttattgcaaaattaaaaatgggaaatgtaattattagaattgacaatacacatcacatgaccattagaatacagttattaatttcctcaactctacaatctcattagacattttttccttggcatgattctattcgttatgcaatttctagaatccaagctgtctgataaatcctgttttaccatggatttaattatttacattttttaaaccaggaaaatctcttttgtgagccacataaaaggggactaatgaaaacacctctgaaagaatccaccacagcaaatatcgtgttggcagagatccagcctgactttggccctttaaccacacctaccaagcccaaggaaggctctcagggagagccgtggacaccgacagccaacctgaaaatgctcatcagtgctgtgagccctgagatccgcaacagagatcagaaaaggggtttgtttgacaacagaagtggattacctgaggccaaagactgtatacacgtaggttttcagaggactggttggaggctggggaatttgttggggggaggggggaggttgtagctattagagaagtgccagcaatttaaagcatcaccacccgaaggctgttattaacttccttcggagcaccagaaaggtttggaccccaagaaatatagctctgggaattctgaacctttgcgttattttcgtttcaggctttcctttcaggtttgccaagcattttgtactggcccccctaaccttttctcccatccagactttgcagctgttgaagctaagcgtgtgtaagttggtgtcagtcatcgagcacagatgcccctaataaatctgtcagactttattttagaataagacattgtttaccttttcctttgtaggaacacttatctggagatgaatttgagaaatcccaaccaagtcgaaaagagaaaagtttaggattattgtgtcataagttcttagcacgatatcctaattatcccaaccctgctgtgaataatgacatctgccttgacgaagtggcagaggaacttagtaagtatgcaaagaactcactgaaagaattaataattaaagtggctttatggacttaactccttcagacccccgctcatctagccagtgtttgtaaatgacacaaataagccggcatggaaattttctatctctaaagccctcttctaatataagaatgaaggtaagtagttgcaaatttcagcaaatcttggaggcagaaaagtcacaatggaggttgcttctgactacagttgtctctgaagctttaaagaaaggcaatattgtctcatgacttgtttcacaaagttacaactgtgaacttttgcttcattgctctcccttgctgttcttgaagaatcaggctgataaatggttatcttcctagttgacgctgaggatcagcttctgtgagtgggaacaggacctgtgcactcctggaccttcagcactattctgaggactagttttctgaatgttttgtgttgggcacaagttattcctcctgcccctttttactctgttcaaagacctgaatctatttggagctaaaaaggggcccgtggtgaatttggggtacctttggagtcatgtgggtatcttaatttaaacctgtgaagtgatgtgctgtgcaagataatacattttaatacaaagcaatcaccccgtgaagaaaagttgcccttctaatacatgtttgtaaatatcaactttatttcacattttaagaatataccgtttagattcatctacttttcatatatgcttaatggtagctgggtaggatattcagcaaatatctattaatcttctactactatgtgtcaggcaatgttgtaggagcctgggatacatccgtaaacaaaaagggcaaaatctcttctctcttagaacctatattctagtggggcaatagatactgagtaaaggatataggaagtaagtaaggataatacatgctagaaggtaacatgcatagtggaaaaaataaattgtagatcaggatcaagggatcaggagtgctggggaggtgctttgccataagtggtcagatcaggcttcgttgagaaggtgacatctgggcaaggacttgaaagaagcaaggtagggagctgtaaggacatcagggagaagggttccaggcagaaggaacagccggtacaaagcaagtgcatatctggcaggttccagggacagcaagaggtcggtaggatgcacccttattaaaatagtgttttattgatcacttttccagaaaggctgatctcatcaaatatttaaattgaaattaagtttcttgaacgaagagaattctaacattacagaatattgaaaacccaatttaaatagatagagtcacagaattactaatatcatattgttaatgatagctagaaagtaagcaaaattagacccaaaaaggcatattttatttttatgtaagtttttaaaaactacatcatggtttttgtacttttctgaaatctcagcattttgtttctatcttatgatcattacagatgggcgtgtgtgtacgtgtttgtattggaagcggttggaaggtgtgagatgtagagttttaaagacttggtttgctacttgctagctcttttggggtgagctacttagctggtctgagcctctgttttctcatcgttttttttttttgtttgtttgtttgtttttgagacggagtctcgctctttcgcccaggctggagtgctgtggcgcgatctaggctcactgcaagctccgcctcccgggttcacaccattctcctgcctcagcctcctgagtagctgggactacaggcacccgccaccacacccggctaatttttttgtatttttagtagagactgggtttcaccatgttagccaggatggtctccatctcctgacctcgtgatccgccctcctcggcctcccaaggtgctgggattacaggtgtgagccaccgcacccggcctttctcatcctttttaaagtgcagatcataatacctacttcacaagtttagggtgaaaacttcctaaagctgtgtagcacaacttaggccctcattaaatgttgcctttctaattcatatgatttgtgcccttggaaagcaagcacatgtctttctcaccttcacagtatttgttgagtatgttcacttacagttaggaaagtgatattatccaagacctactgactaataaaccaatggaagaaaaagctattcaattctaaacacgttacaaaaatctgtaacacacaattgcacattctttgtagatgttgaacgtcgacgcatttacgatatcgtgaacgtcctagagagtttacatatggtgagccgcctcgccaaaaacaggtacacttggcacgggcgacacaatctcaacaaaacccttggcaccttgaagagcatcggggaggagaataagtacgccgagcagattatgatgatcaaaaagaaagaatatgagcaagagtttgactttattaagagttacagtatagaggatcatatcatcaaatcaaacactggcccaaatggacacccagacatgtgttttgtggaactccctggagtggaatttcgggcaggtgagagatggtagtgaaaactccaggcggcatggcatttgtcctctgtctaaggaaaaggttctgtggagaacacagctctaaagctactgctgcctttaatgttcagatgccacagttgtcagctgtatgatcaggtggtagtatttttagccttgttactttagaagtcacttgtccctttatgaattttaattctctaatcctcatccttctctaaagcttctgtaaacagccgcaaagacaagtctttaagggtaatgagccagaaatttgtgatgctgtttttggtgtcaacgcctcagatagtaagcctagaagttgctgccaagattttaattggggaggaccatgtggaagatttggataaaagcaagtttaaaagtaagtgtcatgactgccatggatttttgaacctattcttaaacaataaaatctcagtcgtaaactcatttccaaattaggaaacataggtgcataaacagatcttctctaattatgtttttatatcttctccccagaagccatgataatattgatttagctaacttgttatgatacataagtatcactactctttttttttttttttttttttagacggagtctagctcttttgctaggctggagtgcagtggcgagatctaggctcactgcaacatctgcctcccgggttccagcaattctcctgcctcagtctccggagtagctgggattacagttgcgcgccaccacacccggctaatttttatatttttagtggagacggggtttcaccatgttggccaggaggatctcgatctcttgacctcgtgatccacccacctcggcctcccaaattttgggaggcctcccaaaattacaggcctgagccactgcgcctggccaagtatcactactcttatttgacacattgcttcatttgatattgtaacattgttctcaaaagtaaacacggccaggcgcggtggctgaagcctgtaatctcagcactttgggaggccgaggagggcggatcatgaggtcaggagatccagaccaacctggctaacacagtgaaaccccgtctctactaaaaatacaaaaaaattagccgggcgtggtggcgtgcacctgtagtcccagttactcaggaggctgaggcaggagaatggcgtgaacctgggaggcggcgcttgcagtgagccgagatcgcgccactgcactccagcctgggggacagagcaagactctgtctcaaaaaaaaggaaacactagaagaatctgttctgtgtgagctctaaatgagagtaaattgtaaagtgggtctgcaccctggtctccttccactgatgctgattacagagggtttataaatgactcataaaattgtccccagaagtgacctgcagcacaggtagtctgccattttgaaagaatggttttagctagattacctgctcaaaattgggaagggactgtagattggattcctaacaaaagagctatgccctcaccattacaccagactttgcaggaagggtgtggaaagaagtgctcagcggatggggaggagcacttggctcgggagatcgggagatctgcaatttcagaaaacacgtcctgatactactgaggggttacttgccttttgtgagtcaccggatagttttcatctttgtttcactggttagtcatagccttgaaaactattccaggaactgcagaggtgtaagttactgaatccccagggaattcagaaccttctgatatggctaggaaggagactcgatttgtaatttgtactatcaagatggcagtaaaaaacagactttttgtaacaaaactctttaagatatgtgaggtttgtcaagttcacagatctatgttttgcatgttacatagacagtattaaaaaattacacatgttgatggagtacagaattttccatgctgccatagtaaataaattttgttataagctattacaagcagaaaagcaagacatttatcacagatacttttacttctctgctcataaaattcttctgaatcctcattagaagatacccaggaatggtgactttatttttgaaacagtctgtaacatagtttcagatagggtgatctcatcaagtcgtttttcctttgtcaacgtatgctattgtcatttcaacattgagtactagcagtaattgagtcttttaaatatttaaaacttttttatcttaattaaagttgtatcaccagaagaacttaaaaggaggcagatgtttctctgtctgacattgatggttaagacagctcttagaatatacatgaagtccttctgaaggaaaattctttgatcttttcattattccattaagtggtatatatactttttttcccagcaaaaattaggaggttgtatgatatagctaatgttctgagtagcctggatcttatcaagaaagttcatgttacagaggaaagaggccgaaaaccagctttcaaatggaccggcccagaaatcagtccaaataccagtggtatgtatttttttctttcaccctctgctttattatttgtgtgtgtgtttttctaatttttaatttccagtgtgtgttgttcccctccctgtgtccatgtgttctcattgttcaactcccacttacgagtgagaacatgcagtgtttgattttctattcctatgttagtttgctgaggatgatggcttccagctccatccgtgtcccacagaggacatgatctcatttctttttatggctgcatagtattccatggtgtatatgtaccacattttctttatcctgctttattattttgaattaatgcacattgggagatattttcccttccccttcctactcaccgccccacatggaaaagatatatatgattgaaaagatgattcaagatgaatggcaatatagaaagtttggctactggctccatcagctaaccaagatccataacaacctcccaccctgtgttcaagaagtacaatctgtatgtgaaagcattcggaaagttgaaagcaccacaaagcataaaacactattgctgctatgcggcacagtgaccacaacagaacctgtgcccattgagaatatgaaatgagttcactctggtatcaaagtagatatttctagccttcatcttaactctgcgatgctgacattttgcattctaccaaagatccccacccagaatcattgaaaatgacaagaacgtgggccatgaagacagagggaaacttaggttccattccaagccctgccactctggctttgcggcctgagacaagctacttcttcgaggattagttttctccttggtgaaatgggaagaacaatggcacctcagtggagttactgtgattttggtataatctcagagagaggtcctttcgtgcaggaatttggagtgaaaattccggggccatattgaccaggttcatatcccaggcccacatgctcccagttgagagaccttgagccagtaggttaatgtctgtgtgggtcagagctctcatctccgacacagggctgcatttcttgaggaacagttacctcatggagctgtgaggatcacccatatttcatcagatctaagacttcactgattgtaagatgcacaattctttctatatcactaagaaagaaaaatcactaataactacactctagcacaccactggttataagatatagtgcagtttcagaaatgctaatgtaggaaatattgtgtctcagaatccatttaataagataaacaaggctttctctgtaaagcccttagaacagtgacaggcacatggtcggtgctctgtaacttgccacttttattcctaaaattgttttatttcatatcccaaaagccaactgagccatccaggttttaatacacagacgttttctgtttcaggctccagcccagtcattcattttactccctctgatttggaggtgagacggtcttcaaaagagaactgtgccaaaaacctcttttccacacgtgggaaaccaaactttactcgacacccatctcttatcaaattggtaaagagtatagaaagtgatcggagaaagataaattctgcgcccagtagccctatcaagaccaacaaaggtatgttttcaggaatgtcagggatctgctaggaagaattcccttttatctcattttttcagcttacttgatccttgcaatagttgtcagagaattatttcaatatctatatacccaaaccctcttgaagcctaactaatgtataaatttaaaaagtcatttgtggggtttattgtttaatcgctatgcaactttgaggggaggtgcacactttctgttcctctgacttcagtgaggtttcatctgtgtgaacatttgttctttagctttgaccggtgctctcttcctttctattttaccagctgagagttctcagaattctgcacccttcccaagtaaaatggctcagctcgcagctatttgtaaaatgcagttagaagagcaatcaaggtaggttggcaatcctctttaataacaggatgaattacttttacattacattgttaggattacttattttatgtgagaagaagccctagccttgaactggagagctaatcttttctgtatctcatactcactcattacagaaattatctgcatgttccataaaagcgtggcttcaatatgaggcttaaagcggtagaacagttcagaaaaaatgtatatccatcatgtcgtgtattaaatcttgtctttcagtgaatccagacagaaagtgaaagtacagctggcaagatctggaccctgcaaaccagtagcccctctggaccccccagtgaatgctgagatggagctgacagcaccgtccctcatccagcccctgggaatggttcccctgatccccagccccttgtcatcagcagtgcccctgatcctacctcaggccccttcaggcccatcctatgccatctacctgcagcccactcaagcccaccaaagtgtgacgccaccccaaggcctgagcccaacggtgtgcaccacccactcttctaaagctactggctcaaaagactccacagatgccaccactgagaaggcagccaatgatacctcaaaggccagtgcctctaccaggcctggaagcttgctgccagcaccagagaggcaaggggcaaagagccgaaccagggagccagctggagaaagaggctcaaagagggcaagcatgctcgaggacagtggttccaaaaagaaatttaaagaggacctaaaaggacttgaaaatgtctccgcagtaagtacagccttgaactgcacaaagctttaggaattccctagtctattacaggaagattggtggcttgtgaaatttaccgaagagcattctctcagaagacaaggaactgttccttagcatcccataatccaagtgaggccctcaacagctaatcccctggctgggatgaaggcagggacatttttaacctttggaggaagggattatttgctgtctttttaaagtaccatgggtggttgtccttaagtccatttctccatcacacactggaatgcaaacagctgtcatgaaagtcttaaataatttacaagcagacgtaaccccaaatgaacgtgtggatgcatagggttcctgtaactcctgctttctgagtcattacctaatgtttgtttgttgtcatgtaactggcatctgttgcctagaagataaattgctccccgtttttactttctacctaaaatttaaatcaaaatttctatttcatgtaaatagaaaaatcaaactgatcttggcaaattgtagatatagttcatgtattggtttctagagattttgacatgctagacaaatttttttcctaagtggagattagttccggagggaattaatatttattggatgcctacccacatatagcagacataatagatattagtcacttttacatacagtatctcattttcctcccttaggacaattatatatgagagacattactgtatcatccgataaataccactaaatgtgcaagtaaaagttaatctctcattttgcccctgctcttaatacaagctattttacttctctctgtcttatttttccgcatcggtaaagaatttattccaccagtttttcctcatcacctactggatataaagcactgtgctctggatcaaatctaacccagcacctgcctttggtggcaattgcttttgggtacttgcctgtgggcatatgatagtttttgtggggttaagtgaatttattccatgatgatacacataaaagggtttgatccttttaagacgtgttataagctgaaaggtattatctgttacgttgttattaaagaggaagcttagagtttgtcaaatcttccctgaggatggcctcatggtaaccattcaaaacatctattatcttacatagtatccttttgtatttaatgtatatgccaagtgggaaatcataaggtttcaatattctggaaggtccataacttcttttggccaatgggtatgatttaataatggtctcctgttgcttacatagttattcaggattaggattttcagtggatagattttccatatactcctgcttcttttttatatctctgcaactctaaccatttcttttttcttttgagacagggtcttactctgtcacccagaatggagtgcagtggcatgattttagctcactgcagcctcgacctccaaggcttaagtgatcctcccacctcagtctcccaagtaacttagactacaggtgtgctgccatgcccggctaattttttattttttgtggagacggggtttcaccatgttgctcagcctggtctcgaactcctgagctcaagcagtctgcctgccttggcttcccaaagtgctgagatcacaggcatttgccgtcatgcccagcccactttaaccatttcgttttagtatggcctgagcaaaacaaagacaatgagagagtcatgtgttaattcattcaacaaatttttactgagaatttatacttctaggggtggaaagaagataagtatgcaagtaaacacaaacatatcaggtagtgaatgataggaatgaagatgacatgataggaggaaggggtggaagggctactgtaggctagaagagttcaagttcaaatatgtcagattcattcggcaatttaatagttctaattattttataaaaaagggaattggcataggttaaaagattctataatgaatatagtttgttggaaatttaaaaattattattctattattgtgggttttactgaagacttgaaagagttaaaccagcagtcagaataatttgtaccatgagagaatataactaaagctaatagagcgcaggtcttcataaagcacctaaatttgccccttaaaaattctctcttcctgcagttttcaaggcacctactagtagagattttgagtgggaccaagtacttaagaaacaaaattaaaagcttgtagtatacttttagctttgtggattctgaatttcctggttcccaaggaaaagacctattaacaactagattaaacttgttttgacaatggagagaagaaaggtctgaaggaagaaaaaaggaggtccctagtttataagagcggtttttagcttttgccagtcccgctcatggtaaggctaaagcagacttttcatgcagttcaggcacccgtgtaaactttttctgtttgggaaagtacagtgatctaataggcatgttgggaggtacatgcaaccctacccttgggccttttctagttgcaatataactttattgcctaaagcttttgctcaatggcatgtgcgtctctaatatgaattaatcagttctcttatttgtaatttttttaactctggtgtactttgcgtattttaagactgcttgttatcattagagcaagcagtactagaaagaaatctttacttatataatttctgttttaaatcaggggccagcaaacgttctttaaagggccagatagtagacattttttgggttttaaggccatatgggctctgttgcacctagtcaactctgccattgtagcaggaaagttgctataggcagtacataaatgaatgagtatgattgtgttccaatgaaactttatttataaaaacaggcagggagtgggaattggcacatggccaatagtttagccccctttctctaaatcaatgtcatttaaagtgtttccttagaatactagtcctccttaattgcctactgaaaatatagttgccaaatagtttgggaaatgctacctgctgtgtgccccacttggagaattttaaggcatgccaccattaaaatctcttggaaattctctaataaagacaccatttgactttgtttaattcagtattttccaattatatttgaccaagaatcaggtaatgcctgtttgcaacccatggacctcaggtccctcagaatgccctttgggaaataccgttctacataattcaagaacaatcaattactactacatcataccaaggagtccagtagcaagagttaagttatcagtttaagagtggtgtgctggatgaatccttacccctaagcagggtcagtgccatcatccaaaggtgtcctaagaccacaggtggcatttaagaaacatgttctgcattattcggggcaagcattgggaagggtgggagggtattctcctctaggagccaggtgaccagcctgcctgcagcccactccgctggaggctttggtccaatgaggcaaccaccaagggatattagtcctgaaagaggcacgtggccatttttcttcctgtatttgtgtgtaaaataaacccttcctccttgttttctagaccttgttcccatcaggatacctaatccctctcacgcagtgctcatccctgggggcagagtccattttgtctggtaaagaaaactcaagtgctctttccccaaaccacaggatttacagctccccaattgcaggtgagtgcacataaaacactaaccagatgtgggccggtctcaagttcacttaagccttgtcaacttcttggataaatgcctgtgcttttaagatatcttcccccttttccttccaggtgttattccagtgacatcatctgaactcactgctgttaattttccctcttttcatgtaacaccgttgaagctaatggtctcaccaacttccgtggcagccgtacctgtcgggaacagcccggctctcgcttcaagccaccctgttcccatccagaacccaagctcagccattgtaaacttcaccctgcagcacctgggactcatctcacccaatgtgcagttgtctgccagccctgggtctggaatcgttcctgtgtctccaagaatagagtctgttaatgtcgcaccagaaaatgcaggcactcagcaaggaagggccaccaactatgactcaccagtcccaggccagagccagccaaatggacaatcagttgctgtgacaggggcacaacaggtgagaggctttctacttaatttaatttttcctggaattactaagccccaagtatctgtgtcataagagattggcttttgcttttcctctttggagagggaaaggatgggaaagtcaggagattgaaggcctatgtttcttccagaacccaggaagagtgtccaaggcatccatattgttgggttatcatgagatttttgtctctcccctaacaaaaataattgagaatgtaaaactcaccaaagcttccctcgccaatttcaagatacgccagtttcccaatgtgcaatacattcatccagcccaatcttccaagtctggtaagactatgtacctgtgtgtggttgacttcttttgtccattcttctctttccaatcagcctgttcctgtgacacccaaagggtcacaattagtggccgaaagtttcttccgtaccccaggtggacccaccaagccaaccagctcatcctgcatggattttgagggtgctaataaaacctccttaggaactctctttgtcccacagcgaaaactggaagtctcaacagaggatgtccattaatcaacagatgttggcttagtttaattttctaaagagttgtttaatagagaaaatgtacacagactgatttggagaacacattctctgaaaatactgtaaatacgttggggatttgttcaatgtgaaatcagatagttgttttcatacatatatatatatacacacacacacacacacacacacacacatatatttgtataaagctaagtttagctttcaatcctacaaaataaaagtaaaatgttgaactctaagatatattaacttctagggggaaaaatccattattttagctatgcctatactattatgcaaagtaactgtattaaagtttacttccctctaagcaaatatgcttgacatgcctaacacagcattcccttaaacattttgcacaaagaaaatgctgtgtgatgtataatgttgtatttttaaataggggtatagctatattttttgtaatttctttaatctgttgttgcagtgtatctttttgtaaagtttgcaacaatcctcaatcaagtctatggaaaaattatttataaaatgtatttttaatcataagttgttcaaattaaaacttttctaaaatata

SEQ ID NO: 527 - DNA, 7055 bp, Homo sapiens
cgcagagtttcaaatcggctgcggtgggcgaggagcagctgtgctgcggctgtgctcggccttagtggtgtcgggtgagtgcgggctgggcacaagtttcgcccttgttgcccaggctggagtgcaatggcgcgatctggactcaaaacaatttttttgttcggaggggagggcatcaggttctgttcacaggggagggcatcaggttcggacacgcacggcctgtggggtcgtctgggtaccacaagaagtcggatcgaaatcggggcgtctggtgggaaggccggggtctgggcgggtgcgcgtttggtctgggcgagctggtgaagaagatggtgatcgtgtcctgggcccagcgctgaagctcggctacggcgtgtcttgaccctgcctcccctcctcgcctgagccagagagaggaaggaggttgggatgaaaagacagctgttttggaaacttgaagggcgggacatcagaaatgctgctgacccgaggcccctcttccaggaagcatcctccttcctgcacccacacttaccaactcgcccgcccccgccaccccgctgcatcccgtctcttcccctgtgtccagggtctctgtggggcctgggaatgggtatggggaatgccttgctgatctgcctttcgccctcctccccagggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagagccgtcaacctcaacctccgcgcagggccctcctggaaacgcctggaaaccccagagccaggtcagcagggcctccaggctgcagctcgctcagctaagagtgctttgggtgccgtgtcccaggtaatactgacaacactaatcatcttttttatggagtgtttccttggtgccaggcagttcctgccctcaaagagcctcaagaatatagacttcatgaaaacagggacgttggttagttcactgctgtttccccaccaccccagatagttcctggcacatataggtgctcaacaaatagttgaatgagtgaatgaaagcatgtcttggaggaaacagatgctcacaataccaggtgataagagctgtacgtgataggaaattgcaaagcaagtgaccaatagtgaggctcaccaaatgcaagcttagtcggtgaaggcttcccagaggaggtgattccagagttcacccagggaagcaaaggtcaaggggtatttagggtaggggaaatagtgcaagtccaggcctagagctgagggaaagcaaggtgtactgcccactcagctgtgtatccctgaggagagccagaattgtagtctgggtatgaacagatgacagagagcaaggtagagcagggggaaaggatatgaaggagcttagaactctcccaggaatgatcaggagtccggaagattctaaacagtggaaagtctggtctaattagcatattagaatttgccctttagctacatgatggagaagggaatagaggcagagatgctcctgatggagactaagggtttggacttgcaggggataaacttcaggagctgccgagaaggtccagttagaggggatttgctgtcaaatgagagctgctgtcaggaagacgtccttatattggatgtaagtgtctgtggacccttcaagggatgcatctttaaacccagagctggaggtgtagacgtgtcacttagaaaggacagaagccattaggatgaacagacctccagggagaggattgggggctgcagaggcttctcctcggtgtctcattgggaattctgaagatgaaagaattctccagaaagtgggtggctctttctggaccctctgcagagagctctctgagccaaatgttagtccttatttggaagcactttttgattgttttcaccaccctcagggatcagagaaatgaaatgaatttgtccaaggtcacataactcatcaaatttaacttgggcttcgctccaaacactgggctctggcttgtcaaggcaaagacagtctagctgatgaagaagagccttcacggctgtcacccggctggtgtgaaaggcccaagagttggggcttggtcctatgggcaacaagaagccacagaagagttttgagcagttgagtgtcacggtcagaactgccctttagaaggatcactatggaccactgtggagggtggatagagtgagtgagacccgaggcaagaagacaggtgctctcttggtgtacagggggtgctgggcggggtggcctgttcttttggggccctctccttcagtcctggggtcaccgtctgtctggaaagagagtttggacttagacaaacaggctccaggcaccaggggggtcctcctgcggctgactgctgctgtcatatccaagagctctgagctgggtcccagccgtggactcattccatgaggagtcattcacatccttcaccctggagactaacaatagcctgtatttacaggacacttgctgagtgtaggggttgcttgtatggtctggagaccaaggtagctcacccttggtttttttttttgttgttgtttgtttgttttcgagacagggtctcactctgtcgcccaggctggagtgccatggtgcgatctcggctcactgcaacctccgcctcccgggttcaagcgactctcatgcctcagccacccaagtagctgggattacaggcacccgccaccgcgcctggctaatttttttttgcatttttagtagaaatggggttacaccatgttggccaggctggtctcaaaatcctgacctcaggtgatctgcctgcctcggcctcccaaagtactgggattataggcgtgagccaccgcgcccggcctaacttttggttttgtctgtgctaacctttccatttgcctgttccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccaggcaagtgggatagtgcttcaccccggggctggtggccttttaacctgggcacaatccctgctgtctgacctcccagacaccaactgggccctaggggtttcttggcaccccctgtggctacctggagccaggggcaccctgagcagcgtcatattgtattattattattcttactgttaaatgtgtgtcctgctttagcagatatccagtgcatgtatttgctcatcagaaaatgagaaaacaggctgggcgcagtggctcacacctgtaatcccagcactttgggaggccgaggcgggtggatcacctgaggtcaggagttggagaccagtctggccaacatggtgaaacctcatctctactaaaaatacaaaattggctgggcgtggtggtgcacgcctgtaatcccagctccttgggaggttgaggcaggagaatcgcttgaactcgggaggtggaagttgcattgagctgagatcgcgccactgcactccagccagggccacagagccagaccctgtctcaaaaaaaaaaaaaaaaaaaagagagagagaaagaaaacaaaacaacaactagattcctaaggattgtatttcaactttccggctgagttctagggggaaatggagtgtgttagttaaggctgcatagtagcttagggctgttgaatttttccccagatttctttgagggctagcatctttctttagcctaataggaactttgagctgtaattaaggcaggctctgtttgtcccatttgacaggtaaggaaacggaggtccggaggggtttggtgattagcctgagggtcatcctgtaagaaatagaggagtaaaggctggggtccagatcatctggatgttctgccccaccgatcaagctggcctgccttgcagaatcttctagttctcagacaggcccagaaagtggcctggctcagggcagggggtgaagctcatcccaatcggcagtccctggcagtttcctggtcccatctcggagctctcagggaaggctgcctagccgctgcacctgtgttgtggcaggtagtcaccaggatgcatgtaagtgaccaggtggctctttgcaaacctgtaagctaaaataaggcttgtgtacacttcaaaaatactctccacatctgtattctgacccggttccgcgtccagagccagcaggggacctgagaaaatcctttaggaccttagtttctctgtccgtaaaggaagagctgagtttagttctgacacaatcacactcacccaagcctcctagtgagcccagaagcaagttttgaagccacctggagagctgaggctcagtttccaagtggggaagctgcaaaatcacttgcccgtgaccttggcctcgtggatcttgatcttctctctgtttgtcgctctgaggtcacctcctggagtgagggtctggagtgaagcccagcccgccagggtcatctgggcccacagaccacaccccggtaccgggttgcaagggtctcctgccgggagtttccaactagtcactggtgtggctttttctttcatgcagcgagtctgacagtgacctagagcctgtgggggcgggaattcagcatctccagaagctgtcccaagagctagatgaagccattatggcggaagagaggtgagttggcatcccatgcttcaaagtgaaggggccgggagggcccctccagccatctttgtaggcaggcgttggttctgctctgacctgctgtgtgaccctggccagtctctgcccctctctgggcctcagtctccctcatctcaaacatgagaaaggacaaaatcctggactggggtgatggtaaaggatgtagcctgaatgtgtgtggtcttctgggccttgggaccccatgtttgtccatcacttggaacctcacgtgtggctggttcctgaaaaacctgcccttcctccagaactctccgtggctcgtctgtgccctgcctgcctatggaattgggaaaagcaacctgactgctatggagttcctggtctgtctgctcatggccccatcctgggggcagggcctcggttgtggacctcccctaacttggggctgtttccccattccacttgtataatggccatgatgggctctaaggctgggccctgccagctctatgtgttgaggggccatattcctaccacatttccgggtctgatcttgtgtagctcaggctgggagggccctctcagagcccaccacacccagtggcatcaatccctccccttctctctagtggtgacatcgtctctctcattcatgactgaggaagtgcctgcaggtaatgcccacctcccaagagtctttctcactgtccttctcctccatctcatgcatgagcaagttaaagaaaaagcccacagagctgatgggcacagcagagtaggtagtacctacttgccgcttgaagccagagctgctaacctcactgaccccgtcattaacagcacgctgggggccccaagtagctacagccaccttccagcaccccccaccccgcagtgagcagggaaaggcatccctacttctcctaccttgagcacagtgaaaaaggcagctctgtcttgaaggaaacaagccctgtctgaccgccaaggcttcatactcaaggatgtctatgcttccccgtgagcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcgtgtgactttcctagataacactgctttctcataataaagactatttgcatttgacatctgttccctttcaccggcaacctccaacctcccccgccctcccacaccactctgggctatagatttgtaatttgtggtttggggtctggccctcatccacctctgctccgagccagtctgcccccaatcccaccccagggagaacatgtagaaagggaaaggtttctcaacttagttcagaccaaaacacattgtaaaggcaaagaaggtttttatttaagtgacaacatttgagagctaaaaaccagctcacatcaaaatcaagacccagttgtaaaaatcttttaactccataatgctgtttttgtcttgttagaaatctgatatcttacattagcgtttctaacggattttgtacaaggcagccataaggaatataataaacctttttcaccacagaa

SEQ ID NO: 528 - DNA, 46153 bp, Homo sapiens
gtccgatttgagaaggggacccacgagagacacaaaatgcacgcccccacgccacatcctttttaccccgcaatgggttaagactgtcaacaggcaggccacctcgcagcgtccgcggagttgcaggcccgcccccgccagggtgtggcgctgtccccctggcgctgggcgggggaggaggggcgcgcggcggccgaggaggggcgcgcggcggccgggcggggcgagcggaggcgagtggaggacgcgtagacgcgccgcggtccccgcctgccgctgctccgccgcagtcgccgctccagtctatccggcactaggaacagccccgagcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgggtggccgggggtcgccgccgctggtagggccacgggagccgccgctgccccagctgctggggaaggaagcagggagaggactcgggaaaggtggagtcggagacagacgggacaagcagcatattcagggatcaggctggcctcccggaaagcgtgggcatcggaggaccccgcgggggctgcccaggctgagggtcgcggggctggagggcagctgcggcgccgggcgctggcagctggaagggccagcgctgacgtatgtctgccccgcggcccggcgccctattcctgctgtcctgcgcggtgggcgcggacggcggggcccctgcgggcgggcgcgttgacggaggtacccggtcctacccgaccctccgtggagctccgcccggagagggcgcctctcgggtgggcgggggctgctactgcagcgtgtgcgggagtccgggcctctcgggacgctccccgctgagcgcagcttcccaggctggagcgctgcccagcaggccctgcgagagggcggaagcgggtgcctgggaccgtcccgggcgccgggggttgctgcgcaaagcgccggggccccctgcgggaggtaggagaggcacaatggtggggctgcctggtatccccagacttcaaggcatagcccagcggacgcgcaggcccagctttcgtgtggtttgtttttctcgctcctttaatcgagtcgagaggaaaactcctacaacaggcccagcctcgcggtgtgggcggcggctgtcccgcgtgaacggctctcatgctgcccgacccacttctctccttgtggtccccaggtgtcatcggactggtggccttgtacctggtgttcggttatggagcctctctcctctgcaacctgataggatttggctacccagcctacatctcgtaagtgacacaccctgcagccgtccccttcccttcctccattcctccccgcagggctgctgcagtagactgcacatccgcaattcccgggagaaaagtgaaagctcggcggggagggatgaggttggacataaggggtggggatagtattcaccattttggaaccttaacttaatccctatctcttgacgattagcccagaggtattttcattagattatcctggtgaccagtgtcccctctctttggcacactaacaggaaagcgctaccactctgtcgtcctccctttactggtgggaggatctcagaaggtacagggagctgagcacttctgtctagtaattattttaatgagtatttcaccatatatttatgcacctagagagtaaaaccctatcaattaggtcttccttaattcataattacgttaattgagacagtagggagaattttctcattttcttttattttgaaaaagccacatgttacagacaaacttgggaaatgcttaccctagtgtaaaaacaaaaacctttaaaaatgctccatgatatagctccttggttatataagtgagtcatttatataattgagctacttaaaaaatgaatttttacgattaggatctgaatttattaccaaagttgtttttattctacaatgtgtttattttttttaattctacgattttatttttccattcgttcaagtaggaattattcctctccagaaatgaattttgttttgctctacagttcttcctaagaaagccagtggtttttaccttcattcagttggtctctgctactttcttcaaccatagggataaaaataaaggaagaaaaaattttcacctaggaggctaagacacagataacacattattacagcttgtatctgtcactagttaggctagaatttagtctatgactataagggaagaaacatgttttagaagttagttctgatttgagcaattaaattgcagttacctagtagttgttactgtgttagtccggtacagacacttagtcatactccagaaagtctagctacatatagccctgaggcctaccccgggctctgctttatggaggagactcaaggaaaaacgggattgtgtgcacagaataaagcatacagacccccgtgagcaaatattcaggcggtcggtgttacattagtctaatcaagtctgttcattgcataaccaatatgattgtataattgtccaaaagaaagaaaaagtatttgaaaatggtggtctttagtagcatcaaaatccatgttgcttaaagtgtgacctgtgaacactgtcttagtctgcttgggctgctataacaaaataccttagactggataatttataaacaatagaaatttattgctcacagttctggaggctgggaaatccaggaccaaggcaccagcagatttggtgtccggtgagggcttgctccctgcttcaaagatggcatcttctcactgcttcctcacatggtagaagggtcaactggctccctcaagcctcttttataaggacacgaatcccatgcatgagggcagagctctcatgcctgtttcttttcttttgagacagagtctcgctctatattgcccaggctggagtgcagtgtcgtaatctcagttcactgcaaccgccatccctggccgcccccacccccgccaaattcaagcaattctcctgcctcagcctccctagtagctgggattacaggcgtgtgccaccacgcctgagtaattttagtatttttagtagagatgcggttttgccatgttagccaggctgatcttgaactcctgacctcaggtgatccacctgtctcagcctcccaaagtactgggattacaggcgtgagctaccacacctggccaagccctcatgtcttaattgcctcctaaaggcaccactatttaatactaatacattgggtattaggtcccaacatatggatgttgggggaacacaacattcagaccatagcagtcaccttcattttaactattctccatacctcttgtaactcttatgctccctagccagagttattttttaaaatacaggttcatctatttagcaaaaatcaaatgccagtcacatgtgtggcactgtggtagcactttagatatggcaagaaataaggtagtcatactctctgtccttgttgaatgagcagtctacccaggcaagaaataggcaaagtagtgaccgtgtggtaagccctctaaagtaaataaacagttctggtagagaagacctgaggaatgagaaggggccagccaagagcagagccagggagagggagaagagtgtgtcaggccctgaggcagcacacagcttagctctgtgtgagcaaagagtggtgggggaggcaccagagaggtgcaggtgccagcaggtagggtcagtggtagaagtgtgcatttcattccagatggtggtagggagtttgcattttctgattgccttggatgggttttaaatagggggtgacatgatacgatttatattttaaggtcactttggctgctgtgacctctgtaaggagttcgcgatcttgccaaactattgccagtaatttacttccttcctttctcacctttcagcctttctcttgctgtttcctctccttgggccatcacaagaaggggagtagtgtcagtattgggtcaagagactgcaggatgcaaagatgaaattgggaaaagctcacttggcttcctagcttttctccctttggactccctttggaagtctgtgagtgaagctcaggtgcacctggctcctggtcagggtctgctgcacgttggagcatgtagatggttgaagacttgcccagtgctcactggggagcaaccagtaccttattgtatacccctcttcctactggttgttctttccgtgtgcataatttccctttgagctctttgagaacagggtctttcatctctgacttctagtttctagaatttttggccatcttatataggcaattcggaatctaattccagccttcctttcatcaagaactgttgacataattaccttaatctccttacttccctcttttactgataacaggaggcagactactggaaatgtttattataaagatagacctccccccattgctaagatataatttagatacttataaattgtacacttttaaagtatgcagttcagtggctagtatgttcagagttgtgtaaccatcaccactgtctaattccaaaacatttttatcaccccaaagggaaaccatcaccaatcactccctattcctcctacccagcccctggaaaccactaatctgcattctgtttctatgagtttgcctattctgagcatttcatgtagacggaatcatacaatatatggcctttaatgtctggtgcagccctgcttctaatgggattgcacaaataagagtcctctggagggtgtatgctgtgctgcaccctcatatgtgagtaagtcctcctggtgcagtccctccagggtgggcgctagtgagccagggccctagtcctgtacttgctcctttgtacaaatggaattgtgaggcaaactcagactttatcttctatttaaggaaaggggaaggtttgctttctgtcctacccagtaacttttttgcttaaaattctataaaaatgtctattacttttcctctttttatttcatattttccttaagacttgggctgccaccttcctgggactatcagagttgggccttaaagatcaaacaggtagtccagttcctttagttttaaaatgacaattcagggacagagaaaggtggagtgtgtttcccaaggtcacacagaggccaggcttggtctggaactacacaggaatgtaaagcacatttaggcatattttagtgccaatgttagaaagattaaatatgtttagggggcggggcatgatggcccacatctgtaatctcagcactttggggtgctgaggcagagggattgcttgaggccaggagttcaagacgagagtccagcactatatatttaatctttaacaacacttttgaaatctcatacccagttcagtaatgtgtcattttagtttctgtgtgtcctcacaagcccattttaaacttttgctgctggtgtaaagagttatattgcatttagctctttgtatgactcctgaaatctgtgtagcattttatttaacagatatgtacatatctctgtctaagtgctttgcaaatatagctcatttaatcctcagaacaaccctattatgtaagtgctatgattattcccatttttacagatgaggaaacacagaaagagaatttgaataacttgatcaaggtctcacaactagcagatgatgaaactggtatttaaatccaaagaatctggctccaaatttcatgcttttaatgattacgttatgctacctcccttgtggctctttgaatgtcccacaaacacaacatcaccttatgtagagatgaaaattaaaaaatgtaggcctttcaaaaaaacagttgaccctgtcaatacattacctttgtgcagtgtatttttcctctcaaataaggtactgtcatcccaaatcatatatctgcacacataggcattgactgtgttttgtagacattagttagaatatgttactaacaacttttcttatctgttatgtagctttgacttatgacagcagaggcttgctctgttttactagcacaaggccacctgaaaatggcacactgaactggatttcctaaggggatgcagcgttgcctttagttctgtttcaagagacaagtatctcaagggaagatgtttggggatgacccctatcgaggtcagatcagaaagggatggcaagaaggttaatttgaagaaaaaaaacaatgaaaatatctacaagagttgtaacacagttaaccacaagtaaaagcaacagcatcctcttagctaaatgatgctcagcacacaaagggaggacacattctggggaacacaagttaaaaagagttgcagtctacttgcttaaggtgtgcattgacagactcctaaagaggtttattacccagaggagactttgagaaagtcaccgtggtgtgaatgacagttgtgaacagacactttctgttttgcagctagtcactggaagcagagctgtttccttaacagtactggaggatgtgtatttgtagttctcttcttggactcattagtagggggtgtatttgttttcttgtgggtttttttttttttttttaaattgtaattatgttttgttcttttttactcatgagaacttcagagcagatgtattttctactgagctgcctatgttcccattacactagcttttctctctggatctatatgtgctttgttaaagtgttgaagagcagagcaatgcatgcctgcgctttgccttctggggtagtatgaagcacaagccaatgtggccttctggccgatgtgcacttggataaaaaatataacaggcattctgcaaactgtgacttaagcaatttacttaaacatttaaatctttaatttacttaatttaaatctgaaatcttaagcatttaaacatttaaccttcctcaacttttttactgtccttgtttcacttaacattactgctaagagtgctggactcttttaagatgaaagtgttgtggagaaatgaaaaagtaataaaaatatccttataacaacttgtgactattttgtaaaataatgacagccagcgtttcagttaaggttcgcccgcttgcctgtgtcataaagaaaataaagttttaaaaagcaaataagatgaatgatttaaattatttattcatgatcagagtttctgggctctaaagcagttgtggaggaggatctcatttctaatactctattctggaatgttccttatgagcttttttttttctctttatgaaggccctggagatttagtctatttgtccttctttctgtcgtagcctccctcatctccttctgacctggacttctctttttcaggactgactttgaatgaggactcagttttcaacttaattttttcacatggcatttaaaacaagtataaatacaaatataacatgttaaggtatttagtggtgattcataacattaacaattaattttggggaagtatgaattaatatggcagaagttttaaaacaatttcaaaattgtgaatgaaattactttttgtagcagctgaaatataagtgggggctgtagaaacgtaccctgacttcattctgtcacttgcacactttcctgattccagggagtggagcttatcagtcactctgagtcatgtgtctactatatatatcctgcagcctctgatagaccaagtgatctagttaagggatcgctcacttgtctagactgcggtccgcatctaaggtggccctcctttacctaggaaaaggcagcttaggttgttccccttctaagttgtgaggttacttgagattaagttaaactttatgataccaatctgacacagatacttatagaaccactggttttattgacaaagggttgtcccagtgggatttgcatctgctcttttattgctcctggcattaatcttttttaccatcaatcattcaaacagtttttttggggggacaggcagggaggctgagatgggtggattgcttgagtttgagaccagcctggacaacatggcaaaaccccatctctacaaaaaatacaaaaaattagtacacgcctgtagtcccagctactccagaagctgaagtgggagaatcacctgagcttgagaaagtcaaggctgtggtgagctgtgttgatgccactgcactcagcctgagtgacagagtgagaccctgtctcaaaaaaacacacacacacttgggaggctgaggaaggagaattgcttgaacccaggaggcacaggttgcaatgagccgagattgcgccactgcactccagcctggtttttttgagtgtgttttttttgagacagggtctcactctgtcacccaggctgagtgcaatggcatgaacacagctcactgcagccttgactttctcaagctcaggtgattctcccacttcagcttctggagtagctgggactacaggtgtgtactaattttttgtattttttgtagagatggggttttgccatgttgcccaggctggtctcaaactcctgggtgcacacacacacacacacaaacacacacacattcagttttgagttataaaatgttagctaaaaggggtcttagagactaagctgctagggtgatagccacctgtaacagatgtggaaatcaaggccacaaactgaagttaattgacataggtcacaggtgtgttgggaccaattcagtcttaagtgtagggatgtctgtccacattccgcattgttatatttgactgtgactgactcttccattttgcatttaaaaacaaaatggtggatagtggtaaatgagatcactgtaattaaacaccaaaagatttgaccactgaatgactgcatttttttctttatacttcattataggtattctatagactcatcttaatttttttttttttttttttttttttttagccagggtcatactctgtcacccaggctgcagtgcagtggtgcaatcatgactcactgcagccttgacctcccaggctctagctattctcactccactgcctctgtaatcttttttcttttcttttctttttttctttctttctctttctttctctttctttcttctttctttcctttctttctttcttttctttcttttcctttctgtctgtctgtctttctttctttctgtctttctttcttgatggagtttccctcttgttgcccaggctggagtgcagtggcgcaatcagctcactgcagcctccacctcccgggttcaagcgattctcctgcctcagcctcccaagtagctgggattacaggcatctgccaccaattttttgtgtttttaatagagatggggtttcaccatgttggccaggctggtcttgaactcatgaccttaggtgatccatctgccttggcctcccaaagtgttgggattacagacatgagccactgtgcccggtcagtctttcattagtctttctcgtactgtttgttggttttctctcttgctttaaaagcacatatactctgcagtgaaaaagatatgtaactttctgatcacgcatagtttcctgccttctttttttctatgaaggagaaaaatattttccttattggcatggaaacgaactagtgtttatgtcttaaaatgtctgattcttttttccttcttatttgaggtactgataataggaaaaccattttgaattactaagaattcctacatcatactctctgataaatacagccaaaagcaatcccatgcatggtgggcatggaggatggtcaagttatgtgtctgccataacaaaaaggattataaacattatggtccatgttcttcatattcaatttccaaagaacctatcttaacctctggaatatttgctattaaacataagttaccacattagaaataaaatataaagcagatggaccagaagatgattcctttctgttctttaccaataggacatcttaaagctttttatccatatatatggataaaattaaaatatatatgggtataaatggatatatagatatattttaatgaactgcttttttttccacactgtcagtctctggtaaatagttgatattggtacaactggtttgaataataaagccaatgctgtgaagacatactattacttaattttatgtcatttggctagtttgaattgtagcaactgagttacttatgaaccatgcacagaacacatagtatgtacctatgtgtcttaggtgtgagtagccaaaagcatgtgtatatggagctgattattacctcttgagcaaacagcttaacttttataaaattcagttttctcatatgtaaaaggtggggatagggttggggggagttgggataatatatgtcaaacgtttaggacaaatcaggcattctgtaagtgctcaattaaggggagttagtttcattaacatataaagaggaaaattgacttaatcatagtcatagttctttaactttgtgtcattaagcttttcattgatttaaggaaaaaccttcctaagagtattttctttcatttattttttcactttcattttttgttccttgtcttattatttttttcctgtacttaaatcagcttaagacatcattattcaaagaataaaacacagtaaagttttgttcttccaagttaaaaatatgtgatatggctagtggttttcttctgtactggtacaatggtgtatatgttcctaagcattgagtataagttggactaacaattttttaatattaaatcttatgcataagaaatgtgaacttggtcctaaaagcaagaactcaaaacagaaatataaaaaggttgtacagttcacatataaaaaagcatttgatctattttgcatggtaagaacaaaatagatctgaattaagaacttgtaaaagtggatgtttttccagatggatttattgtgtctgaaataatttgaaaaatagtatggaaggttgtccctttcctgtctccctccaagtaagcattagctgtaagtattttgaaatattgattgatagatgaaacctcagcaaaagaagaagagcacattttgaccaataccgagcttaagcttagcttagaaagcttttggtgatgatgcacaccttttatgtcagttcagtgagctgcagccatttacagtggcctaaagaataatgaccttgaattacctcatgtaagaagtctggaggttgaaatttcaaggcgctacagcagaaatccatgctcttttccagcgactttggagtataatcttcctcgcccacgcctgtttccttaatatataacaagattgttgccatatagcgctaaggctttcaagagcaggaagctggaagaccttttatttgtgcgcctctcatattttatcagcagaggaaaattttgtcccaaagccttctaccgtatttccttttctgtttcattggtcagaactgtgtcacatggatacccttaactccaagggggctaagaaagtcagtatctagcaaaaagcaatgggattaccatggtggatttgtactaactttgatttatcccctaggcctggggcaggagcctagcttccctgagtcaagacagatttgccaggtacatgtatataaaatcagggctctgtgggtgagtaggaaggactggctaattgataggcaaggaacagtgtctgctatttccttgagcaatgatagtgaccggttgctgtaataggatttttgaagcagcagtgttaccatgacaatctgatcatgctggtgaccatcattcagcagtgaatagttaactgccaggcagtgtacaatggagagattgagctgcagatataaatttggaagttattagcatatatatggtatctagatttatggggacagatactctctccagatcaaaacaaccaaaatggcatgatggtaataaaatagttttaaaaatctggtattatagaatgcctaggtggtaagtgaagtttttttttctcttttttgtttttaaatggattttattttttagagcaattttaggttcacagtgaaattgagcagaagatacaaagatttcccatgtacccactacgcctacacatacacagcctcctctaccatcagcatcacctacaagaggggtatgtttttgtctttgtttttttttgagatggagtcctgctctgtcgcccaggctggagtgcagtggcacgatctcagctcactgcagctccacctcccgggttcaagtaattctcctgcttcagcctcccgagtagctgggactacaggtgcacaccactatgcctggctaatttttgtatttttagtagagacggggtatcaccatgttggccagtctggccttgaactcctgacctcaagtgatccaccctccttggcctcccaaaatgctgcgattacaggcgtgagccattgtgcctggtcagagtgctgttttttataattggtgaacatacattgacacatcattgtcacctaaagtccttagagaatgtacagcttacttgtgtcatgggtcagggaatatcttaggttttctgaaagatgacacttaatttgggaaggagattccagcccagaatcatctctgctcaaccttgttttcttcacatgttaatgctattctttggccatccttggttcttgcctttgctttcagaaaatagcagccaaggtgtgaacaagtagatgggccagcaagggtggagtgaactggtaccagttactggggcccagtgtactggatgagggatggccagtgagttgtgttcatatatgtaccagtccaatgccaatgtaaagaatttctgccattctaccattgcagagtgggcctgaaaaatgttttcagcaatgttcaaatttcttcccactacctgcaaacatgaatttggggatttcagctaacttcttactacctgtagcatatgggatttggagtagggtataattaaaattgatgggtaactctaatctccttttagccttattagccatataaaccctctgacagctacttaaacaaagaaactagagtcttcttatctctctcttttcttcttaatcttttatctccctataataataagttattactgtactataattaatacctgttaagggagtatttactgagactttcttagtgctttacatatattaactactttaatcttcacaacaacacaatgaggcttatccatactagataggtgaacaaactaaggctcagagagattggataacttgcccagggtcatatatctagtaagtagtagagctagaatacagagctacaaactaagggtggtgaaatgctgcaaagccagaaaagcactgagaagaaatgaagggaaagccctggccattccatagttcagtgtaatcagtaacttatgatagtttgtattatttaagtagaaagttaaaatgagtcaatttcatgtgatgggctgtgtggctctcttttctccttgtgtgtctctttgtgggtgtgtgtgttgaaggccttttaatgctctaaaacaaaacagattatatctgaccattgttagagaaatttgtaaaaaaaaaaaaaaaatcattagctgggctgggcatggtggctcacgcctgtaatcccagcactttgggaggccgaggtgggcggatcacgaggtcaggagatcgagacaatcctggctaacaaggtgaaaccccgtctctactaaaaaatacaaaaaattagctggcgtggtcgtgggcgctgtcgtggtcgtgggcgctgtcgtgggcacctgtagtcccagctacttgggaggttgaggcaggagaatggcatgaacccgggaggcagagcttgcagtaagccgagatcgcgccactgcactccagcctgggcaacagaatgtgactctgtcttaaaaaaaaaaattattagctgttttctcaaagagaaattaaatgaatatagctgatgttcactttagtgtttatttttaacaaagcctcatagagaaaactagtctcataggagaaaatcattatagaaagtctgatgctcagccaggcacgggggcttacgcttgtaatcttagcacattgggaggccaaggtgggtagatcgcctgaggtcaggagtttgagaccaacttggccaacatggtgaaaccctgtctctactaaaaatacaaaaaaactagcggggcgtggtggcaggtgcctgtaatcccagctactcaggaggctgaggcaggagaattgcttgaactggggaggcagaggttgcagtgagccgagatcgtgccactgcactccagcctgggccacaagagcaagactccatcaaaaaaaaaaaaaaaaaacaaaaaacaaagaaagtctctgatgctcattcttttccaaatggaaatctcccccgcccccttctttttttaatcaattttagtacatactcattggaaagaccttaagtaaaattctgttattcaggattaactttatacaatttgaaatgtattgcatatctttctggatatcattcttggtctgtaaacatataaaaacatctttttttaaacaaaaaattagaattcactttttacactcaacactgtatcttggacatctttccctgtcaataccctttttaaaggcttcagaatatttcattgtacggatgtgccaaaatgtaaacagtctactgccctttacatacacatgctctgtaaccttctagtttaataaattaaaattcattttaatataactcctttctctttaaatttcattttgtctatataaaatgtagaatttgaactagttcatctctgagatgtcttccaactccacacatggtgattcctaattctgctcgattaattttagagctgccagctgctgccacagttttgccaactatcctctgccttgtagtcgtgcctctgctgctcacccagccctggcttctcttgatatctgctttggggaagcaaaatgctgccccagaacatggtaggtggctcaggagagagaataaggaagccacagcactgagcctaggcggccaggctttagaacagtggtgagaatatgacagtaaggtgtgcagagagcagtaagactgtggtgtctgtccacagaagctgtatgtgggtgtgttagttctgagcccaggatcagtgtgactgccagaggatgaggcggtactagagacagaggagcctgtaaaagagtggaccaggcctgtggagagagtggtaggaattgttgcctgttgccatggggtcattccagaactcctctaggggttagctgtgcaggctgaagttccagctagacagatacagggcttttagatgcagttcttgaaatcttagtgaacagttttatttcagtgttgttatcttgaatccttttacaaatttcagaatattcaggtgagggttctagatcatattagagttgacttattctaattttagtagagacattattcagtttgacttctacgtccaacttttcttctcttttggcctctcactcattactggaaaggggtagcctgccctctggctacagctgattatacccaaactggccatttggatttcctttcttagaacacgtagggcaggtgctgtgaagactggaactttgaggtggtttccaaacacagttctgcattatgatcacctgcacagccttgtaagagcagctgaatcactaggtctgaagaaggacccaggcgtgtatatttttaataagttctgtagatggatgtggatgatcatctaagtttgaggaccagtggactaggacaccaactcagaacactatcctgttcacttctgatagttcccccctgcaaatccaggtgagtagagtggagggtagaatggacctccagggatctggacactgagactatgaccctgcctcctatttttctgctctgtggccagtttaacctttctctggggtcccctccaaaagtaagattgtgacctcctattgtatgtatagtaattcaataaatattaaatgcctactttgtaccggacattttgctgagtgctatccagcttgccactgaactgttttcttaattagtaaaatagcataggatagtgaacaaagcacaggctttggagttaattttaagtgtaagaccaatccttgctacttgtagctgggtgccctgcacatgttatttctctacactaagcctcggtttcttctgctcaaatacaggaacaatacctatcctacatggctattatgaaggttaaattaaataataggtttctacccctccattctatggcttggccattttggctagactgcaagggacctaagagcatagagcatatcttatggtttcatgaatcctctgtgttgcctaaattgctacctctttattctgatacaccaagttggaatatgattcatatttgtacaaggcagtagagtgttttgttggagaatcacttttatctactgaattgggacaaggaagtctaatcagaaggtatataagtatcctgggcatggtggctcatgcctgtaatcctagtattttgggaggctgaggcaggaggatcacttgagccccatgagtttgagaccagcctggggaacaaggcaaaaccccgtctttataaaaaagtacagaagttagccaagcatgatgatgtgaacctgtagtcccagctactggagaggctgaggtgggaggatcacttgagtccaggaggttgaggccgcagtgagttgtgatcatgccactgcactccagcctgggtgacagagcaagaccctgtctcaatcaatcaatcaatcaatctttttaaaaagaagatatataagtaaatagcattcagaaaacctcaagtttgttttttttttgttttgttttttttttgagaccgagtcttgctctgtcacccaggctggagtgcagtggtggaatctcggctcactgcaacccccgcctcccgggttcaagtgagtctcctgcctcagcctcccaagcagctgggattacaggcatgtgccaccacgcccggctaatttttgtatttttagtagaggtggggtttcaccatgttggccaggctggtcttgaacttctgacctcaggtgatctgcccacctcggcctcccaaagtgctgggactacaggtgtgagccattgtgcccggccagaaacctcagttttaagcttttttcttctctcaccatgactacatggggcacttcacttttttgaacctcacgttcctgagtgagctagaccatctcttcccttttttcttgttttgggtagtttgtgattgttatgacacataaagacattttttaaattgaacattgtgctattttaaattaaaacaattaaatgcttcaataatatgagaagatctattaaaaaatctctttagcttaatagactcattggccttttcctggcttctttcatatgccttggttttctgcaaagttgtgatcagtgtatgtattcaatttggagttcttttatttctacttttcaatgttactatatagtgttctagtatattaacatggggactttagaattcatattgtagatatgaattaaaaaagaatttttttttcctagaagagctgaactgttaggcttcctgtttttcaatctgtggaacttgactaacatttaaaaaataatgaaatagaatggaatttaaaatatcagaatggtttcaggaaatatctatttaagtttatatttttatgtgaagatgtctgtttactggatcatgatgtaaaatgtatgcttaccgagggttgtggccaaaagaatttaaaagccactggattaacaatgacagtcccatcacattttgaggtttttacgtcatattctagaaaagactgtttaattcccaggtgtgtcctgagagttgcttcttttggaagtacatagttgtgagctattgcgttcacaaaactaagaccttgagtgaaatgtaattacgtatctcctctgcccagaatgaatgtacaggaaacaaatttttattatactaataattaaataaatccaattaaatatggataagccatactataccaaatgaaacacagcgggagaagaaatcttacacataaaggatatactgtgttctttggttaacatgcttgtctacacttttcctttggccttctattacattcgccagcttctatctgaaggaagctaaaaaaatacagactttgtgcatacattacaagccattttttaataatcagctctcttaaattcattttatatgattcttgtactttgaaatatttggggctgggtgtgggagccaccagactgcactttgggaggccaaggcaggaggattgcttgaggccaggagttcgagaccagcctgggcaacacagtgagaccttgtctctactaaaaatttagcaagtagctaggtgtggtggtgtgtacctgtagtaccagctacttgggaggctgaagtgaagggaattacataagcccagaagtttgaggttgcagtgagctattattgtgcaactgcactccagcctgtgcagagaccctgtctcaaaaaaataaaaattttgcctagtcttgaagttcaaagcaacattcaccttattacttgttcctctctctgtcttcctcattagtaatcatctcattgagctacaatttttccccttttggttattttctaaaactcacacacatagctgcttctaattaactgtacaagggctttcttagtgagtgactgagcatgatttagcagcctgactgtctctttggggagctgatgttatggagtagccaatgtatttgctttttgaaaattttttatttcaataggtttttgggtaacaggtggcgtttggttacatggataagtttttagtggcaatttctgagatttcggtgcacccatcaactgagcagggtacactgtacccaatgtgtagtcttttatccctcactacccccagccctttccccaaagtccccatagtccattgtatcttatgcctttgcatcctcatagcttagctccctgtcaatgtattttcagtagttaacctgtttcataggctaaacaagattcagagttcttttattttactgtttcagtccagctcagttacgataaatatctagatctgttaggataagaaattgtggagcttcaggtttagaataatgagattcctaggactgaaggaaatttctgtgatttagaaaattattttaaatgtatttccatccatttgcagaatgaattttgtttaagcaatagttagggttgggaaagtcctgttattaactgaggagaggaggaaagtccatagcctgtggatcagttaaagacattctgaactaaatagacaccatgaggtttgttttcacccgtttactataaaatatgctgtggattttgggcagtacctaacctatgttccaaatgttgctttatgggaaattcttattcacccatgatatatctcaattattaaaagtacataagaacctggttatcacgagagaattcttcctgatatatccctcgtggcaggacccagcttgggagtggaaattgctctagctcccagtcactagtggtatattctaggacttgtggggaggctttggcagggtggagatccagggcagtaacagctggtgctggtttctctggtgaccaggagactagaaacaagtggttataatggcttgtcccgatatccacattgcttccagtctttaagctgtactcttgcatctagtgacacagtgcctacatgtgcctaagtttctcagtggtatcagaggacaggttatgaaagtgtatttgaaaatctttcattgatatcttaccaaatgatatactttcttttgtactgcctttcagaattaaagctatagagagtcccaacaaagaagatgatacccagtggctgacctactgggtagtgtatggtgtgttcagcattgctgaattcttctctgatatcttcctgtcatggttccccttctactacatgctgaaggtatgttggtcttgctaccactaaaactccatctcagtacctgtatagaagaagtaggaataaatgcttgaatgttgtgcatctgtggctctgtctcagattataaacaagaagacaggcctgggcaacagagcgagactctgtctcaaaaaaaacaaaaacaaaaaaatgctcaagcaagccacttgcctcagcctcccgagtagctgggaccataggcgcacaccactgcacctggctactcttttaaacaattttatctaaagaaatttagatataggaaattaaatataggaagctccatcactccaaccaccatcataaatggtagtatcttgagttttagttctggttaattatggatatataattctttttgtctttggtcttagcctttttttttttttttctttttttgagatggagtcttgctccgtcgcccaggctagagtgcagtggcatgatcttggctcactgcaacctccaccccccaggttcaagcaattctcctgcctcagcctcctgagtagcagggattacaggcgcccaccaccatgcttggctaatttttgtatttttagtagagacagggttggtttttttaaaaatctatttatttgtacttcttctgggagatttctcaatctgacctccttttttttttttctgagatggactcttggtctgttgcccaggctagagtgccatggtacaatctccgctcactgcaacctccgcatcctgggttcaagtgattgtcctgcctcagcctcccgagtagctgggattacaggcatgtgccaccacgcctggtcaatttttgtattttttttggtagagaaagagtttcaccatgttggccagggtgctctcgaactcctgaccttaagcaatccacccacctcggcctcccaaagtgctgggattacaggcgtgagccaccgtgcccggactcaatctgaccatctaattttcaactgtactccatgattacattataaccattctgttattcctgctatataccgtgttcttcatttcaactattatattgttcacacctaatgtttttgcttggctctcttcttcttgtccttgtttcatattgctaatattttctcatttcttttagtatggttaccgctccccagtttaaaattcttggtcagcagttctaatattgttgctcctgaccaaaacttgtagttgattgtgttgtttttcttttgaaatgtactcttggccaggcgtggtggctcatgcctgcaattctagcactttgggaggccgaggcgggcagatggcctgagctcaggagttcgagaccagcctgggcaacacggtgaaaccctgtctctactaaaatacaaacgaaattagctgggtgtggcagagtgcacctgtagtcccagctactcaggaggtgaggcaggagaactgcttgaatctgggatgcagaggttgcagtgaaccgagatcacactactgcactccagcctaggcaacagagccagactccatctctaaaaaaaaaaaaagaaatatattcttaaaatatctttttattttagcctacaaactgcttttcatccatgagtatcagctatcccatcaggcactggaatggagggggccccagtccatgctagtactagtaagttctgggtagggggtggatgagtcctaggagtggggggccccaggcacacaggaaccatagttaaccactcttcacctacagaagagctcctcaggtcaaagcttcactgtacagtccccttctaccccagcaaagcagcatcaaaaggaagtgatcctgggttatagttcacagctctaggggttggagcaggaggggtagggaagtaactgcctttagttagtgtccacctgttttcctgagtgatttgcaaagacaggacttttatgccaaaacctctgttttagaaaaaagtagaggacaatattttttaactttgaggtatagaagcaagacaaaatacaaaagtttcaaagaaaaagatttgataaattcaactaaaaatttctaaaaattaaatttctatatgacagtgggcagcataaacaaagttaaaataatgacagactaggaagatagatttacaacatttacaccaaataaggaatatccagaatacataacaatttccataagtaaaaagaaaaagaaaatgggaaaaggttctaagttaagtatttcacggaagagaaaaaatatgaatggctagtaaacagctcaccagtgatgtgggaagtgtgagttaaaatagtgaaatcccatattttgttcattaaactggcagatattttaaagattgaaaatatctggtattggtgaatgtatagggaaatggacatgtaatggtacaggctgaacatctgaaattggaaatcctaaatgctttaaaaccccaaactttttgagtgcccacataatgatcaaaggaaatgctcattggagcatttagattttagagtttctgatttggtatgctcagttggtataatgtacatattccaaaatctgaataaatgtgaaacccgaaacacttttagtcccaagcatttcacataagggatacttaacagcctagtggtataaacttgaataacctttttaagggaccttttaaccatttcttgttgaattgaaaaatgatactcttaacaattctaaggaaatagtcactgtgcattaaagagctgcacaaagatattcatggcagcattttttgttgtcaactgtatataatatgaactgcataatgtaaacattataaacagaaatgtccatcagcaggtaaatggttcattcaattaatagtatatccatacagttaaatggaatgaaatagatccatatgtacagacccagaaatttttgcataatttagtaattatgaaaagttatacaggacagttgtgctagcttttgcctgtaatcccagcatactcggaggccaaggcagaaggactgcttgaggccaggagtttgacaccatcctgggcaacatggtgagaccctgtctccacacacacaaatttaaaaattaaccaggctcccagatcacagcatgttgaccaaaaaaaaaaaaaccgaaaaccaaaaaacaaatgccaggcatggtggtgcatgcctgtggtcccatctgctcaggaggctgaggtgggaggatggtttgagcccaggagttcaaggctacaataagcaatgatcacccaactgcactctagcctgggtgacagagtgagaccctgtctcgaaaaagaaaaaaagtaatagaacattaaatacagtatcacaccatttatggttaaaaaagaaaaaagacaagacactatatgaagtgagtgtcttttaaagtttaaaaaattaaatgaaaacatgctcagtatagattcttttatatttttgaatgacttcaccacagaatgccttgtaaggcaattaagaattttcctttcaaaactgatggaagaaaataaaaattggtctgtggaaagagttgatttcaaagattggatttttttgtttttattattcaaagtcatttaacatttataaaaatattcttacaatctttaatttggacatgacataatttaaacttcagataattttaaagcccttaataagatccatctaatcgtagggacctcacagtagtctttagtggaaagaaattggcttttgctttgggcccacttgcttgtggcagtgaacactatcttgtcagcagaactacttgcagtagttctgacctcagacttccaaatgtgagcaagcttgacttctagcctactcctaatcacctctgctaatggagttcacagagaggtagagagaagatccaaaataaatggtagtcactgaatcatttatatttggttttgaagttcatttaaaatattgctttgtagcagactttcttccctaatggtaaaatgaatgtgcatccattagtagtctccagctgcatggcatcatagtgttcatgaaagtgaatttattgcatacattccaaatagataacatacttgaaaggattaaacattcatgatgctgtcaatcaaaatactttcttcctacattagtggcatactctgaatgacctagtgaacagactgagaagaggcctctgaattgcagagtctcgtctgtaggagaaggttcaggagagtattgaattttagggactagaatccatcttacctatgctgttgcaatcgcatgctgactggaagtgtgggaaagagacttacaagtaaggacatgggtttgttttgttttttgttttttgggacagagtgttgctctgtcacccaggctggagtgcagtggtgccatcttggctcactgcaaccactgcctctccagttccagcgattctcctgccacagcctcccaagtagctgggattacaggcacgcaccaccacacccagctaatttttgtatttttagtagagatggggtttcgccgtgtttgccaggctggtctcaaactcctgacctcaagtgatctgcccgcctcggcctctcaaaatgctgggattacaggtgtgagccactgctcccagcccgaggacatgtttaatattttattttttgcagagttaatattgttggctttattttcatttttctaaagcagctgataagattggaggaaaataaaaggagccaatggcttggcatcaaagcttagttgagaagataatatatgatgtatttaggtagaaattggatcatgcatattctgagctttgctctgacatctggccttgagcaagagggtttaaaaataaatttaaaagctttttttcttgattatgaaatttacatatgctcattcctttattcagcagatttatttagaacctccatgtgccagattctgttctacatctgggagatactttggcgaataaaacaaagtccttgttgtcctactgtttacatttgtgtgtgtgtgtgtgtgtgtgtgtgtgtgtgtgtgtgtgtgtgatgggatgtgttttatgtagggaggaaaataacatttgtaatcctacatcttagagtagtcttcctattttttaaaatgtgcaaatatattggtctgtgtatataaataaaaacagaactctgtgtgtatgtgtatatatatatgtatgtattgctgtcttaacatatgtgtggcttagatcacatatgatatataattctgtgtcttgcttttttcaattaacacagtattctgagtattttctcatgttattcagtattttttgacatagctatctaatgttattgataatttacctacttcccaattgaaagacattgaggacatttgtcatgcgattatacataatgctgcaattaatatctttgtatcctctgtttaccttcatttaaatcattttctagatttactttactttttttgagacggagtcttgctctgtcgcccaggctggagtgcagtggcgtgacctctgctcactgtaacctctttcccaggttcaagtgattctcctgtctcagcctcccgagtagctgggactacaggtgcacaaccacgcccggctaatttttgtatttttagtagagacggggtttcaccatgttggccaggctggtctcaactcctgaccttgtgatccacccacctcagcctcccgaagtgctgcaattacaggcgtgagccaccaggcctggctagatttatttttagaacaaggttgagtaaactctggcaagattaggtcctgacctgaattgtcacctgtgctatttcacccattgacagagaatataacatttttcttttcttttttcttttttttgagatggagtttcgctatttcactcaggctggagtggagtgaagtggcgtgatctctgctcactgcaacctgtacttcccgcattcaagcaattctcctgcctcagcctcccaagtagctgggattacaggtgcccaccaccacgctaggcaaattttgtatttttagtagagatggggtttcaccatgttggccaggctggtctcaaactcctgacctcaggtgatcctcttggacacctcagcctcccagagtgctaggattacaggcgtaagccactgtgcctcgcaacatttttcttcttaatgttcgtaggaggctaaaaagacagggaaatctttcctttaacacgttcttttaagcttttatttgtgcatgctgagcaatgtagcctgtaactattctgtggctacactgcaaaagctttcttctgacattaactctcagttccgtaactgcatgttaagcatacccctacctgggaaatatctcttctgggggaaaatcacatggtgacagcattagaagcacagacggaatagaatggcctgttgtaattcgtaatttaaggagtcattgtgtcagtgctaatagtgccaagagtccagttaaaatagcatggactctgtctgaactgcaggcagcagtgggcttgtgagtctccttgggagtatcatcagctggcactttgagggcagcttgattgaaaagagccagatctgtgtgggtgactttaataaactcaggctattcctgggctgtagaatagttacacagattaagaagagagggttgtaagaggtggcagctgaatatcaccttgggagttgaacagtaattaactttatttttaacataagaaaatgatttcatttcagaacaggaaaatgctaaggatgtagctagagagcagtaattattttactgtctcaagacaatagctagagggtaccagaaagtagtcaattaacagtctgcagtctagcctacaaagtaatcacattgaagaggtacaaaactgtggacacttaattcatccagaaaagataataagcttgtctggattgctgaagggttggcatctacataggcaggtaatatttcagagattttccacaataagaactttaggatttggtaatactactattctattgtacactttcttcaagtacattaatttgtgactttcctaaaactctgcagaagagaaaactgtctcttaggttgatttgcctaaagtcataaaacacaccccacctctcctgatttttttttttttttttttttgagacagagtctcgctctgtcgccaggctggagtgcagtggcgcaatctcagctcactgtaacctccgcctcctgggttccagtgattctcctgcctcagcctcctgagtggctgggactacgggtgcccaccacaatgcccggctattttttttctaattttagtagagacagggtttcaccatgttggccaggatggtctcgaactcctgacctcgtgatccacctgcctcggcctcctaaagtgctgggattacaggcgtaagccactgcgcccagccccacctctcctgattcttaatccaatgagtcattttcacttcaccttaatgctctggttttaatatggacatctgtctctctcttgataatccatttctgaaaatcagatattctatgtaggaatacattctatgcagaagcttattttccactattttaagtgggaaaaattttaatgtattacatgtcaatgtaaaactcaacgaattcactaagtattaataaaatacagcaaaatacctatatataacaaatatcatgttaggatgttagatgctaaaaacacttgctgctctccaaatagttaatatagtaagtaacaattgctctgtgtgcaggaatacatagcacatcccctgtgatgctctgcatattcttcaaaatgtccaccaaggattctgatattctgtcaaaaatgttactcaagacatttcctgcatatcataatgttgtattgcattttggggatgtatagcttttcctatataagcaactacagtaaaacattgtatgaattttggatattaaaaaccaaaaggcagcagggtgcagtggctcacgcctataatcctaagcacattaggaggccaaggtgggcagatcacgaggtcagatcaagaccatcctggccaacatggtgaaaccctgtctctactaaaatacaaaaaattagctgggcacggtggcatgcgcctgtagtaccagctactcgagaggttgaggcaggggaatcacttgaatctgggaggcggaggttgcagtgagctgatcacgccactgcactcccgcctggcaacagagcaagactccgtctcaaaaaaaaaaaaaaaacaaaaaaaaccaaaaaaacaaaaccaaccaaaaggcttccacagggaaataactagagaggtggtcttgcagggtctgctgtaattaactggcactatgccaaggaaacaaagctaatgccagtgaaaaatacagtcatttaattctccattttgggtcaatgcaaatgcgtatctcaaaaaaaccaaggttctgaacctctggcaacatcttataattcagtaagatctgctgctggctaaacttagggcatgctagagcagagttgctgggaaaactaagagtaacatcgaactacttgcacatactgagggtacctcaaggcgctggcttccttggagtgcttggacctttaacagaaggtcttagtctaccattgtgtgtgtgcagaaggctgatttgagtttttgcatgattgcacattcatgcacgtagcattactatccatgtgtagcgagactactagatgctagtctgagtctttacctttccatcatctactgtcatgctttcccaagtctgaagatcctgttttccaagatctgtgctcagtaaacaagctttggagtctttaaatgtaaggaataggaaaggtgaagagaggcctggcttaaaatcataacatggagattatggcagtgaatcccattggattgaatggtctgatatggaaagcaggctgtgtagttccactagtccaaaaattctattttttgagacacagtctcgctctgtcacccaggctggagtgaagtggcatgatgtcgactcactgcaacctccgccttccagattcaagcgattctcctgcctcagcttcccaagtagcttggattacagacgcctgccaccacacctggctaatttttgtatttttagtagaaatggggttttgccatgttggccaggctggcctcaaactcctgacctcaagtgatccacccacctcagcctcctaaagtgctgggattacaggtgtgagccactatacctggcctggtccattctttttttttttttttttttttttaagaacaaaactagtttatttggattggggactctgaacagttctgtctctattacccgacttcctcctcccacgacttcggcacctagaggaactttggctccggctgcggtggctcctgcggctctggctccggcggccctggtcccagctgcggtgcctatttcttcctctgcttggtgaattgtgcctctcccgactctttgatgtgcgtttgtgagatttcttccccctatgactactcttttttctctcggattccccatttcttttgtaggtgtggtctggactagggtttctccttccccgctgcctgctgtagtagtggtcgtggtggcccatcttctccctcctctcggagttcttgccaaaggaggagccagtctgatctgaagacaagtagatgtctctattagcttcccagaattcattgttgggatttctgaacacatgaagaaagttgcagtgttttcctcttggacattgttgtatttcaaataaaccacaaatcgccattttccaccgggtcactgggcagaattcacattgcagctgtcgtcctgcataccatcgtccgttaaacagagaaagggctgcttggcattcttcttccgactggtactgaacatatacattgcccctcaggtgaggttccaaattgcagctgaccttgaactgaatcactttccccacgttcttgaactcgggcaacacatcctcatagaaatctaggaactgttggtaggtttcttcctcgctgtactccaggcttgcgtcagggtcatagtcatccctcctgcactgctccattccaaacgttgtaaacatgctcttaataagaagggtaggactagatgttgggaaattatgtttacgtgaacatctgtctccaaatctgcaagctcctgttttactgtagaagggacaattagctcgatccttctccattactctgaaatccacgggtggttctgggttttgccatgtggtactattttctaaatcattttcagcctgatccagcatcttctgcacagcttcctctttttctttcttctcctgttgtttctgctcctcctcttctctctctttcctctgctgttctttccattgttcctttaactttctctcttgttcttctagccattttttagccgcctcttccttttccttctttattctgaattcttcttgtgccttctgctccctcagcaaccactcctcatgtaatctttccctctctctttccaatagcttctcttcttctagttgttgttcttcaataaaagtgtcctcttcctcctcctgtgagagtcctgagtctctcagtcgagcaagttcctgccgacgtttctttcgtttctccttcttcagggcggccctgtactttttgtggcttggtttctctggaaatgtcatcttcttgggaaacgtcatcttctcaagtgcagccatcttgccagcaccgcctgacccctcagacattcttaacctatgggaatatatggaagattttgttcatagctgccactgtcagtgattctacttatgaatattttatgttttctagtattgttttgtttgcatacttatatatattacaaattactttcattttgtttctcctttatattgcagttagactttttttgtaattaagtatatcataaatttgaatttcatttcatgtactaaaaggagagttctaaaatatttacttatggccaggtgcggtggctcactcctgtaatcccagcactttaggaggccgaaatgggcggatcacctgaggccaggagtttgagaccagcctggccaacatggcaaaaactcatctctactaaaaataaaaaaattagccaggcttggtagcacgtgcctgtaatcccagctacttgggaggctgaggcaggagaactgcttgaacccaggaggcagaggttgcagtgagccaagactgtgccactacactccagcctgggtgacagagtgagactctgtctcaaaaataaaaaataaaaataaatatttgcttaaatatttttggttctaggatttgctttcccctactgaaagctaacatgttctcctgttagtaatgtttcatagatgttgttagaaaacacagtattcttgggtcagagaaagtccttgctatgcttagtaattttattttcttacaaaattataggggtaaattttaaaattttcaattaatacctattttatagaggaaaaaccagacttaagtgattaagtaacttgtataaggtttgcttagctagtaaatggcagaaccaggattggaagttagtttctttgagtccatcctgttactctctatatactatattaactctttgaatccctctttgttgggttgagagatctgtatatatctttagagtgagattttaggccaggtgcagtggctcacacctgtaatcccagcactttaggaggctgagatgggtggatcacttgaggtcaggagttcgagaccagcccggccaacatggcgaaaccccatctctacaaaaagtacaaaaattagccagacgtgatggtgcgtgcctgcatgcctgtggtcttcagctacctggggggctgaggcgggagaatcacttgagcccaggaagttgaggctatagtgttttgtatttgtgccactgcactcctgcctgggtgacaaagtgaaacccttttttatttaaaaaaaaaaaaagacttaaattttgtgttctttattctgtattcttactaatttctaggttgttttatatatcaacttttttttgtctttttgagacagggtcttgctgtctcaccaagcctggattgcagtgatggtatcacagctcactgcagtctcgacctcccaaggtcaagccaccctcccacctcaacctcccaggaggaccacaggcatacatcaccaagcctggctaattttaaatttattttttgtggccgggtgcggtggctcacgcctgtaatcccagcactttgggaggccgatgggggtggatcatttgaggtcaggagttcaagaccagcctggccaacatggtgaaaccccgtctctactaaaaatacaaaaattagctgggcatggtggtgtttgcctgcagtcccagctacttgggaggctgagacaggagaatcgcttgaatccgggaggcggaggttgcagtgagctgatattgtgccacagcactccagcctgggtaagagagcaagaatcagtctcaaaaaaaaaaaaaaattttttttttcctagagatgtggtctccctatgttacacaggctagtctcaaaactcttgggctcatgtgatcctccaacctcagcctcccaaagtgctgggattacaggtgtaagcctggctagtatatcaatttctgatggaaatgttaaaatctatgattgcagattttgtccatttgtctatataattctgacttacatttaaatatttcaaagccatatttgaaagctatctatagctatatataaatatataattataaaaataattctattgcaaacatatgcaaagttagatataatttacgtatttcaaaggtatatacaagttcaggaattttaatattcttggtgaattgctttccttctttatcatcctatttacttattttgccttaagtaatttgtatgtattaatattgctaatgagctattttgggagttggtgtttgtctgatatatctttcccataactttattttcagtgttcctatttggttttgttgtaggtatgtttcttaagcatacagctatagttttggggttttataaaaaatttagtcctatagtgtctgggttttgttttgtttttgagatgagctcttgctctgttgcccaggatggtctctgcatttgtctgttctcatgctgctaataaagacatagccgagactgggcaatttataaaggaaagaggtttaattgactcacagttccacatggttgtggagacctcacaatcatggtggaagatgaaggaaaagcaaagggatgtcttacatggtggcggcaggcaagaaagaatgagagcccaagcgaaaggggaaactccttataaaactatcacatctcgtgagacttattcactaccatgagaacagtatggcaggaaaccacccccatgattcagttatctctcaccctgtcctttccacaacacatgagaattatgggagctacagttcaagatgagatttgggtggggacacagctaaaccatgtcagtctccaactcctgggcccaagcaatccttgcaccttggcctcccaagtcactgggactacaggtgcatgccaccatgcctagcaagtctctgtcttaaaaactcttgtgcatgtgtaacaaattttaattcacaaaggttacatttcaagagttactttttactgtagttgagataaggggagtctggacaacattgtgacacttgtctctacaaaaaaaagttataaaaaattagccaggcctggtggttcatgcctgcagtcattcccagctacttgggaggctgtgggaagattgtttgaacccaggagttcaaggctgcagtaagccatgttcatgccactgcactccagcctgggtgacagagcaagactctcagaaagaataatctggagatattgttgagaacttgggttttgttttttattttgagtgttatacaagttcaaagtctagtataaatttctcagagccaacatggtgctgatggagtgagctatttgtgcattttaaactgaaactcttgtcattagtgttagccctttatcagctttgtatctctaaaacacctgaaagactgtcttagaaaaccatcatagcttgttgattatgagtacatcccttggtttggaatcataaggactaagacttaaatttaaagcatgagaaattaagatgtttttacactaaggagaagttgtaaaaaatactgatttggaatctctgtaagtgacttctgtttttttgtagagtcacctaggctgtgtggaatacaatgtggttagaatcttttaaactaaaataactcagtatattgtttattaaactttctagggaaatgggcagattactctgaatattccttttccttctgcttttctttttatcttaaaaaggagtaaattgcatggatgacttgaagtgacgagttggtatttattatttgaatcaacagtaaaaattttttggacatagtgtgaaaatccttatttaagtaattagggcagaattcttgtcaattaaaaaaaaatctcaatggcaaagtagagctgtaaagaaggagttaggaataataactacattcaagatgaaagatgaagaacaactgtaaagattccttgaaggctaagatctacccaaaactgaggtccaccaaaggaagaattcaggaatggacaaggtattttttccataataggatgaataaatgtgataaacttaccaagataagcctaccaagcacaggcctcctagatattaggcttatctgtacagggctttatacatgcagataagtactatattttcttaaattgatttctaagagttatgattaataaaagcctcttacagctatatactaaaacgtggtccaagttaggaagatagttaagctcctggacctggtgtgttttaccttttgttttttagtctcagcttttccttaccagctcattactcatcatgttttttccatctaaagaaagcccacctttaacctgcagaaaacactggtaatgcctttggggaaaataacagaggcatctcccatccccagagtagtgaaagacagtgtgtattctcagaatgtgccccctccaccctcctgttacccatgctggctctttttctgtgcagtgtggcttcctgttgtggtgcatggccccgagcccttctaatggggctgaactgctctacaagcgcatcatccgtcctttcttcctgaagcacgagtcccagatggacagtgtggtcaaggaccttaaagacaaggccaaagagactgcagatgccatcactaaagaaggtaagactcaggaacaagatggccccacatgtgagaggagatgtgacacactgggctcaaataacaggcttcctggccttcttgtcttatcaccacccctcagccaaatgccaacattactctgggatttctttacaaagtctttgcctattgagaacacttacagttctcgacttttcccaagactcttcctccatgccacatttaatgtagccttcagtcagaacattaggaaaaatgactttccttggtaggcagcgattttagagaatcatctatattgatatgcaagtccatctcttctaattgtttatttaatttttttgtattatacttaattacataggtagttttaaataaatggagaaagcacctttcaaaagctatactagcaggaaaaattccatcaagcatttacgtagtaaatttctataattttacaaaaaattcttgatctttacttgaactgtacatgaggggaaaagagccccctcaggtatgtgttctctccacttgcagaagaaaactaaaggacctaaaactagagacaagcctgggatgccaaaaagcgggaggagaaatgataaagagccattcatgaattccatgtctactctaagacacttgtctaatcaccctcacataataaatatttagggcaaactaccactctttagaaaaagtacaacctcaaaacctatagttctgaattgtaacatatcgaataccttggactgctggatgccaaaagacaatacttggggttatctatgacgtttaaacaggtaaataggggaattctctaggactgtacactctgtgacgttttgaatgaagcgcaggcaggcttctctgctatcctccaggcagtgtaatagtcaaggaaaagagcaacagtattggatcactccttagacactaaccagctggtgaaagagttcattggccagtctcctccttagaatggtttgcaccaagtggagaggccatgtcgctgaaggggaaaggggagccctcatacccacagtcactgtaaacatccagtagacaggaagatggcttcgggcagtggctggatggaagtagattggagatacccaggtctggaatgaagtcatcttccacaaagtcttccttcactgagaccacgaattctgggtgatcattctctaaaaggctgagaggtgcttccttgattttcactaccgcattagcttggctctctgtctcagactacgggcttggcatatatgtagtcaaaattaattagttcattaatagcttcaagcttggctgataatgtccccactgacagagaaagggaggctggttaggaattgggtccttctgagtagacctctgggagctgctccaggctggcagaccctggggaaggacatttgaagaacactagtgggtctaagttgtccagaatgcccaacaggatatcatactgggaaggtagttgatgtttacttccaaccccaccacaactaacttctaccctcatctgcctagttagggatgtcaagcatcaaatagatggaattatcttggctttcgcctcctcttcagtaaccagagcatccatccccaagtgctgtcttcactcatggttctcaactacgagtccatgcattttctcttgtaaaaactgattttctagcaaaagtttttggttctgttctaaatctaccacttgctgtttcaggtcactcatttgagcttgctttctgtctctggcagtttgagctgctaatcctgtttttcctcctcagtgccttctccttggggctccccacccccacagcactcaccatctcctggctggctcctctctgggctggcaccatgagcagcagggcctagctggccaaggctgtagcagcaggctgaccagacagaagcagtactttggaggccctgacggccagcctgattcagttcagattgatcggttcagtatgctgttcagtttttgttatgggtacaaaagaatgtccactctcagctctgattaattcactcaataaatatttatttattgaggtgtttaatatgtgccaagcatgttcataacactggcagtgaaccagcataccgaagagaccatactccttgaattcatgaagcttacagtctagttgagagataggcagtaaaattgaaaattagatagtatatttaccatataatatagggaaaaaataaagcaagtagaaagatgggggggggccaaggactggagggatggttatgattttaaatagagacgtttaggaaatctataccagaaggctctactgaatcagactcaatagtagtaaaggaatcaggaacagtgactcagcctgtaatcccaacattttgggaggctaaggcaggagatcacttgaggccagaagtttgagaccagcttgtttgtgacagggtctcctatggagacccgctctctacaaaaatttaaaaattagccggacgttgtgatgcaagcctgtggtgccagctactcaggaggctgaggcaggaggatcacttgggcccaggtaatcaaggctgcaagtgagctgtgccactctagcctgggttacaaagcaaaaccctatccccctaaaaaaaaaaaaaaatagaaaatggtaaaagaaggaaccatggggaatcatactttagaatgagctgcatatacagaagtccggaggtgggagcaacaaaagaagtgatctagaggggtgcaggaggagatgaggtggaagaagttgcgaatggaggctggaagacgtatcacataatgccttataggccattgtaaaggtttggcttctactctatgtgagatgtggaggtactggggacttttaaccacagaagcaaaatgatctgtcctgtgttttaataagatgcctgtggccactgtattaggaacagactgaaggggtaaggcaggaagttgggagaacagttaaaaggttcttgcagtgatctggctggaggtgatgatggtggcttggttccttgtgtagcagtagggggtaagaagtatcagattcttgatatatttcaaaggtagaagtaatgggatttgcttatggattggcttatggattgggcatgggtcagaggggttaaggacaaggacgagctttttagcctgaacagatggaaggataaaattgccactgagctggagaagactgggtagaacaggttttgttggggtgggaggttgtggtgggtgggaggatatggaatttagtcctggacatttgtttgaggtgtctgtttgttagatacctacaaggattagtcaaatagctagttggatacaggtgtcaagagttcaagaaacaggtctggactggagatataaatttgggggccacaagcttatacatattaagcatgagactagatgagatcacgaaggtagtgtagttaggaaacaggaggtccaaagactgaacgctggggagtctaaggtttagagactggagagatgagaagcaactagcaaagcagactgataaggagtggccaattgaggtagcaagaaaaccatgagcgtgtggtatccctggggccaagaacagaaagtttttctttcagagaggagaagtgatctgtcatgttacatgctgtcaacaggtcaagtaagataaggactgagaactgagcagatttagcaatgaggaaggtactagtgattttgataacacagattttgtggagtgatatcaaactcctgattgcaatggatttgagagaatgagagaaaagggatgagagaatatagatctttcttttgagaaatttcctgcaaaggagagcagaagaatggggctataactggaagaaggaattatggtcctgaaattttaaaagtttttttcttaaggtaggagaaacaaagcctgtttgaaaattaatgggaataattcaacagagcaaaaaatgatgataggagtgagagggtgaattgttggagctctgtccttgaccagtgaaggatccagtatacagtagagggattggtcgaagagctggaagtttatggtaacagcagggaaatcaggttttatggtatgctgtgagcacatgtgactatgggagcctacagaagtgactttctaattgtttcatatttctcagtaaagtaggaaggccaattgagagaggatggggaaggagacaatggaaagagaaggtatgaaatagttgcgaaggagagggactgctcatctttttctgtaaagggccagataacaaatgttttaaatttcgtgggctatcatgtctctgttgcagctactcttctctgccattgtagtgtgaaaacagccatggacactacataagcgagtttggctgcagtgtgctggcccctctaggacagttggagagtaaatggactgtcaggcagtgttaaaggcatgcttgagatttgcgttcatgaatttatagtgaaaccagttcttgtttatgtttttctccagccatactcagctacatgggtatagctacagagtaggtggagagttgtgtcaaggttgtgatttccagcaagaactatgaagtgagggtgggactgtggagtggttaatgcttgacaatggaatttaacctgagtaaggtgggaagtggtggtggaagaactctgaatcaggataatagcgggaatactccatcatcatctacaatgagcaaaaaagcagggtggggagtgcactacaaagataaaaggtgatggtggctgagtgggatgcttgatacaagattatggagggactgcagtattggtactaacagggatcctgggagtcagtgccatatgtagggtggaatataagggttattggaggggaggaactaagaggtcaggatattagaagatcatcacatatgtctacatggatattaaaatcatcaataattaaaataggagtagtaggtcaggtgcagtgctcacacctgtaatcacagcacttccagaggtcaaggtgggtggattgcttgagctcaggtgtttgagaccagcctgagtaacatggtgaaacccagtctctacaaaaaaaaaaaaacacaaaaattagccagatgtggtgatgcgtaccagtagtcccagctactcaggaggctgagatgggaggatcacctgagcctggaggttgaggctgcagtgagctgagatggcatcactgcattccagcctgggtgacagagtgagaccctgtctctaaataaataaataataggagtagtgttagaaaggaacattaagttaggagctaaaatcttcaagaactaaggcaaagtagcccaagagtcagggatgacagggaaagggaaggctactcagtgatagaatctgatgacatgagattctgaaagtggcaatgaagaacaaaaacaacacctaccagatccatttgtactagggtcatgagaggaaagaaacagccaccacttgagaaagcagtgtcctcagggcacagccagctttctctaagagcaagaaggtaaaggaaacattcggaggaatggatgaggatatagattttgccagtgatgggtcttgagttccagagggactcagattttagaaattggagaaaggtttttgtgttttagagctctgtggtagttagacatgggagttgtgaggttgcctgaccatggggaagtaaaatcccaagacagttctccagcagcactgatgccccagaagtggtatgttccccatttctccctcacagacctctcttctctggactcctatttttgggcatacaaatccagtctacttgaatatgttttaggtattttttaacttgtagccttaacctcctcccactttaggattgccagctttttttttttttttttttttttgaaacagagtctcactctgttgcccaggctggagtgcagtagcatgatctcagctcactgcagcctccaccttccaggttcaagggattctgctgcctcagcctcccaagtagctgtgattacaggtgtgggccaccacgcccagctgatacttgtatttttagtagagacaccgttatgccatgttggccaggctggtttcaaactcctggcctcaagtgatccacccacctcggcctctcaaaatgctgggattacaggcatgagccaccatgcccagccaggattaccagcttatttttaagagctttcttttcttctcccttcccttagcctaatcagcaacctgtggtgatgtcatttctgtctacttcacccacatttcttagcctcttggttctcttagatatcaatacttaaaatccaatcttactttgttatgacacattcctaaataggggcaagagaattaaaataagttaggaggaatttacatgctgccacattttagacttttctcaaagcttttggattaactaggaatttctacaaagggttagttaagggaaggactacattttctcctttgctgtgaacttggttcagtaattttaactgagcaaagggagagcaactatcaggcagctggtggacaagaagggactccttggctctcatcactaaggctctggctccatcaagaacagctgcagattgtaaaatctcacagtgggccctggaggcttctagacaacccctttcccctccatcttacacactgtactggttctcatagcacattccctgccacttggtaattagaaagtggaaggcttggtctcctgcagaagtaagaaaatatatttttcttttttttctatagagatgggctctcactgtgttttggccagggtgatctcaaactcctggcttcaaggaatactcctacctcagcctctcaaagctctgggattatagacatgagccaccacacctggacagaatgttttcttgatgaatgtagtgtcttgtcaccaactcaaagacttagagcaaactcttctcatcataggagagaatggtggcacaataagagtataaatacagattttaaaaacaatttagtataacaacaatttatatagcattcatgttgcattaggtactttaactagagatgggcttttaaaatttttttaaaatagaggtggggggtgggggtctcaccattcatattggccaggctggtctcaaattcctggcttcaagcgatcttcccacctcagcctcccaaagtgctgcgattacaggcatgagtcattatgcctggccgaatttaaagtatatggaagaggccgggcatggtggcttacgtctgtaatcccagcactttgggaggccaaggcgggcagatcacgaggtcaggaaattgagaccatcctggctaacacagtgaaaccccatctctactaaaaatacaaaaaaaaattagctgggcgtggtggtgagtgcatgtagtcccagctactcgggaggctgaggcaggagaatggcatgaacccgggaggcagagcctgtagtgagccgagatcgcgccactgcactccaggctgggtgacagagcgagactccgtctcaaaaaataaataagtaaataaataaagtatatgaaagcacataggttatatggaaatactatgtatgccattctatttaagggcttgagcactcacagattttggtatctgtagggttcctggaactaatctcctctcccccaccgcccccccagcccccccccccaaacacatatatcaagggatgactgtatttctagtgctgggaatgaggacttctctgatttgtcgccatgggataaatatgatgacctagttgtcatcagattgataatatattgataagtgaaatcttacaggcaagcacacagatacaaatagaatttgaacactactcttaaggaatctctgcttctttcaatgcttaaaggagaatagagggcagacagtttcggtgacactgtcacaacaaggggctaggctagatgaccttcaagtattttgctcaagtatttaggatttgtgctctaagaggtaccttctccatttcctggaaaccctcttagcccagaccacaaaccccaacatgatcgcacctgaacatgagtcatccaagttttgttatctagtagctacattaggcacaaagcttgcaagcttgcattccaaagaaagagctttgatatatttttctttccctcctaacaaacaaacagcgaagaaagctaccgtgaatttactgggtgaagaaaagaagagcacctaaaccagactggatggaaacttcctgccctctctgtaccttcctactggagcttgatgttatattagggactgtggtataattattttaataatgttgccttggaaacatttttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgcattttctctgtagttacatttaggataatctttatggttctacttcctgtaatgtacaattttatataattctgaaatgtttttaatgtatttgtgcacatgtacatatggaaatgttactgtctgactacaacatgcatcatgctcatggggagggagcaggggaaggttgtatgtgtcatttataacttctgtacagtaagaccacctgccaaaagctggaggaaccattgtgctggtgtggtctactaaataatactttaggaaatacgtgattaatatgcaagtgaacaaagtgagaaatgaaatcgaatggagattggcctggttgtttccgtagtatatggcatatgaataccaggatagctttataaagcagttagttagttagttactcactctagtgataaatcgggaaatttacacacacacacacacacacacacacacacacacacacacagagtaacctgtaactctcaattccctgaaaaactagtaatactgtcttatctgctataaactttacatatttgtctattgtcaagatgctacaatggaaaccatttctggttttatcttcaaagcggagaaacatgttgatttagtcttctttcccaatcttcttttttaaaccagtttaaggaacttctgaagatttgtccacctctgattacatgtatgttcttgtttgtatcattagcaacaacatgctaatgacgacacctagctctaagagcaattctgggagaatgaaaggaagtataaagtaacccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacatgactacatagtaagtacagaacagtaaagttaaaacggatgtctccattgatctgccaaatcgttatagagagcaatttgtctggactagaaaatctgagttttacaccatactgttaagagtccttttgaattaaactcgactaaaacaagtgtataactaaactaacaagattaaatatccagccagtacagtattttttaaggcaaataaagatgattagctcaccttgagataacaatcaggtaagatcataacaatgtctcatgatgtaaaaaatattaaagatatcaatactaagtgacagtatcactctaatataatatggatcagagcatttattttggggaggaaaacagtggtgattaccggcattttattaaacttaaaactttgtagaaagcaaacaaaattgttcttgggagaaaatcaacttttagattaaaaaaattttaagtatctaggagtatttaaatccttttcccataaataaaagtacagttttcttggtggcagaatgaaaatcagcaacttctagcatatagactatataatcagattgacagcatatagaatatattatcagacaagatgaggaggtacaaaagttactattgctcataatgacttacaggctaaaattagttttaaaatactatattaaattctgaatgcaatttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaaaacaagcgtttatttgaatgtgaatagtgtttcaaaggtatgtagttacagaattcctaccaaacagcttaaattcttcaagaaagaattcctgcagcagttattcccttacctgaaggcttcaatcatttggatcaacaactgctactctcgggaagactcctctactcacagctgaagaaaatgagcacacccttcacactgttatcacctatcctgaagatgtgatacactgaatggaaataaatagatgtaaataaaattgagttctcattt

SEQ ID NO: 529 - DNA, 25700 bp, Homo sapiens
tctgcctgcgacggtggtgttgggtgcatcctgcgccacgtgaccgcctcccagccaaccaatggaggagcgaggcggaaaatttcgaatgtggcggcggtagttccaggcgacggcggacggtggtacggtcctggagggcccagtgcgcggggctagccgtggctggagagcttcgaagagccttgaaatgtgaggaggaggaagatagctgttgcagaagtagtggccaaggtatcgttctggacgcgcctgcggcaggagggtcgccgcgtccacttccgccagccccacctccccccggccttcctggagtccctgaaagaggaagaagtaggttttaaggtgcgaaacaagggcgtagtgatccctgtttgacttcccttcggttttcagtatcattctaaattcggtggccgaaagctcgggccgtggagtcccactcgccgcgcttttcgccgttcagccactcgatctgcgctttcagatgttccggcttccatggagaccctaatttcctactttgcaaaattgtgtagattaagtgatgtgcaaataaagcttttacaatagctaaaagcctggctcaacgtaaggacacaagaaaattgacagcagttctttgtgcagcgtgataccgttgacgtcctccttgtccaggccattctcttcctcacttaccctggagaggccggcactgactagtatcctacctggctgtcttcgcagcaggactaattggagaattatggacggagatcaaatatgctaggttctttaaatccagagcgcttacacgagtactgtacagattgagaccgtcatctcgcgctgtggtctgtctttgctttcatcccttctgtctaccacaccccctgctaataaccatcgccttatttagacaggatataaaacttttgatatggcaagtttcttttgtgatttttaacttgattaaaagtaataacgaaagctttttaggtaaggctttgcctttaaaataccttaactaaactagatccgttacttaatctgtatgactctcaaacatctccaattctaacttaattgtgtaaaacaacccctttaccgttcgtgcttttaaaaatagctaccctatctctgctaggaacctcccagtacatattgtatataccttggtagaaagaaagttcttaagtggtatctacaatacctatatttaagattccagacactgcatagaggaaaataaggcctggaggaaatactcaagattaagtgtaaggtttaggaaaatatttgactatcgtagaggagatgaagatatcctttgtagtgaaaattctgtgcatagattgttattggaaacaagtcttttttttttgcaattttaagatctgcaaagtgcaatctagcgtaaaagatgtttgtgaaaagtggtttgacatgtttagtagcatgctaaagcctacctgatttgcaacgttgaaagattaagtatagttatgtatttaatactcaacgtttaactgtatgtacaacaatatttaatgtctgatttgttatgttcataatttactgggagttaacagccctaacttttagccacagtttgagaatactagagtgttcctctgcccaagttcctgctctagctctgtacttgttacaatagcctattaaaattgtatgtagtgctacatagtttaaacctctaaggagtaccttgactttcttgagactgtgtgcatatcataagtgataattgcgtttaaagagtatggaaaaatagttgaatgacctaatctgatgaattaatcattagagaagagctggaaaacaaaacccaaatatataattgcctcagaactaatgctgtaagcttaagcagtaaaagttggtcctaaacattttctataaaaagtgtaaataatgcatcaaaatataataataagcattttcaatagtgtctggcatataccccacagtgagtatttgttaaagaatgaataagtggcatattgtggaatctttgggttggaaatctatattcaataaaccttttctataaagtgcctgaggaggaagagagaatatcagaaatatgaatgagattttaaaaggggaaaatttatattatcaagttggttaactatctactttgagctaattctacagtttagtctatttaatgcattctttatgaacagcctatgttttttaagttttatatttgataatattctctctgagaaaaaatattttttattgtttaggcaaaagatggccaaggaaagatgcctgaaaaagtcctttcaagatagtcttgaagacataaagaagcgaatgaaagagaaaaggaataaaaacttggcagagattggcaaacgcaggtcttttatagctgcaccatgccaaataatcagtaagagatttttatgttgtccttttatatcacttttaagtttagatttaataactgataaatttttttatcctcttttagccaacacttctacactgctgaaaaattaccaagacaacaacaaaatgttagttttagctttggaaaatgaaaaatccaaagtgaaagaagcccaagatatcatcctacagctgagaaaagaatgttactatctcacatgtcagctatatgcattgaaaggaaaacttacatcacaacaaacagtagaacctgctcaggtattttcattactaaggccgaatttcttagtttagttaagccatgaataagtagtttagatcaattatgttatttaaatgaattactgatagctcagttatgcatgaattgtttaaaacatccttctttagtgctccagcatagctattgcatttggccatttaagaaagcttcaagcatataggtgattgaggcctgttcctgcctgtttcattcttaaagcaggtagcaaaacaggatccagaagaaatagtttagccttttgcattgctggtccatttgaatgttcaactaagtgagtcaaagatagtgcaactaagctaaagatgtaaaagtggtagttgaagtggacttatccaaaagttttaatcaatgctatcttagcttttacctagccttttgttttgctatgtcattttgctttatccagtggggttttataagaactacctttatttaggacatagggagtatttaagtgctttttggagaaccatttttacctacttgttggctaagtagagaagactattaactcccagacaagtaagatcataaacatttgctgctcaaatatttttttttttttgagacggcgtctccctcagtcgcccaggctagagtgcagtggcgcgatctcggctcactgcaagctcggcctcctgggttcacgccattctcctgcctcagcctctggagtagctgggactacaggcacccgccaccacgcctggctaattttttgtatttttagtagagacggggtttcaccgtgttagccaggatggtctcgatctcctgacctcgtgatccgcccatgtcgacctcccaaagtgctgggattacaggtgtgagccaccgcgcccggcctcaaatttttaatctgattctctttgtgtctaagattgtaaagaaggtgttcaaatatggtcctgctagccaaaatataacagatatggagaaagtttgctttaggatattctttgtgtctggctataccattgtgtatcactgtacacagtaatgtgtatcattacttacgaaaaaagtaatgatgagctagtttatttttccctttttccagtagccactgccaaggaaatggggcagagaaaaaaaaagcagtggtgtcaggtgtacagcaagttgaatttcttcccagtggccattgcttcgctatgccagtgaaaacagttgagttggcacttaggccggaaggtcagataagaaagcgagaacattgtgattaggggagggatatggggggtgggaggaggtgggcaggtacttgagaatgaaattaacatcacttctccattgacaggagaagtcagtgaaagagttcttgcttcccttttgattccttatttttttttctccatgtgattaagatacatgtaatatatacatatatacacacatagacaataagtacatatatggtatatttgagaactgcctctataaagattagatatgttttcttcacgggaactttatgtttttttttcttttttttttcttgagacagagtcttgctctgtcacccagggtggagtacagtggtgcaatctcagctcactggagcccctgcctcctgggttcaagtgattctcgtgcctcagcctcccgagtagctgggattacaggcatgcgccaccacacctggctaatttttatatttttagtagagacagggtttcgccatgttgttcaggtgtctcgaactcctggcctcaagtgacccacccacctcagcctccccaagtgctgggattacaggcatgagccactgtgccaggcgtggtagattactttttctttttcttttccagaatgtaatcttttctaattttgtattttccttgttcagtcaactagtagggggaaacagttcctctaaaggcatttgaatcttcctcctccctttacaaagtttttgctgaaaaacagaaatagtaggaagcaaatactcaatgagataattacaaaagcagttgggaaaaaattctattactgcagctcaatagtttttgagtatttattaaaaacattgttagttgctacgcaaatatattcttagcatttagaaggtcattgtttctattttctgctatgtactaattgcttgtgtcactcattctcaacctcattgtacacccgtgcttcagtgcttatcaaatcaatttagcagtggtggagaagcttaaaatgtaagaattttacaagaatgttttcttgcctagccctagcaatagttaacgtttaggtaatttttaacagccttttgttccctaattttatagtagatttttcaatgacttgtttttaagttatattagtatatagttaaatgttcttttttatttacctgcattaatattagtttcagaacattagctatattcatgtcaaatttaaagtttcatctttggccagggtaggttgggggtggacagagtctcgctcttacccagcctggggtgcagtggtgtgatcacagctctctgcagccttcacctcccaggctcaagcacactcagccttcacctcccaggctcaggcaatcttcccatctcagcctcctgaataggtgggactataggcatgcactgccacacctgtctaatttttttgttgggggtagagacaggatcttgccatgtttcccaagctggtcttgagctcctggtatcaagcaatcctctggccttggcctcccaatgtgctgggattacaggcagaagccgccacacctggcctaaagcttttaacaggattaaatttctagttgttttgtttttaatgaacatttttagcttatttattataatgtcagcatatgttcatcaaatttcaaaagataattaaattagaattggcttcttaggaattgagtgagaattgtcatcttcataacagagatctgcaaatccacctctatacttaggttcttcatcttccctcttgttacagtggcagaatggcccctgttcctactaaaggcaagcaccaaccccagccactccccagcccatgcatccaattttctcttctcacctcctctacaactttattcctggaatattgttctctcttctatatatccccctctccactggatcatttcagtcatcataaagatgtgctttcgtatctctcaaccttagagaaaaagtaatgaaacctctcctggtctcatatttctttatctcctcatttctttgcttcccttcacagcagaactttttaaaagaaaacagtatattcttcacttcctcagcttccattcacatttgaaacgactcttttttttcctttgagacagagtctcgctccattgcctagactgaagtgcagtggcatatcatggcttactgcaggcttgacctcccaggctcaagtgatcctcccacctcagtctcctgaatagctggaacaccaccacgcccagctaattttttaaaacttttttgtggagaccatctcactatgttgcccaggttggtcttgacctcctgggttcaagtgatacccctgcctcggcctccctaaatgctaggattacaggcatgaggtaccacgcctggcctgcagccactctgaatctagattttatccttaccattctgttgtcactgcatgtcaaggtcaccaaaacctccatgttaccaaattcagtggtcacttctctttcttcttgaccttgcagtaataatatgcaaaacagggaccactctttacttgacatactttgatctcttagttttcatgatatcatgctcccctgcttttcattctacctttctgactgttccatgtcggtctcttttgctgatttcttcctcattctacctgtaaatgtcaggcattttattggccaggcacattgactcgtggctgtaatcagagcactttgggaggctgaggtgagaggatcgcttgagcccaggagttcaagaccagcctgggcaacacagcaagactcccatctctacaaaataaaaaataaaaattagccagttgtggtggcatgcacctgtagtcccagctacttgggaggctgaggtaggaggattgcttgtgcccaggagttcaaggctgcagtgagctatgatagcaccactacacttcagcttgggtgacaaagcaagactttatttcaaaaaaatgaatgaatgccagttgttgtagactcatcttataccctctcatagctttatgtactgtctgtctgctgatgcctccccagttaatagtacaaaatctaaaaacaaacacatacacacatatacccacagccaccatttgctatctccacttaaagatttataagggatctcaaacataccttatataaagcacaacttccccttgtctcccccacagatgctgtatacttcctaccttcctttataagtcttactcagtaaagtagcctacatgtttgcttaggccaaaaccacaagaggctttcctctccctcattgttcccatctccatcccttttcagtccttgagcttgacctgtcatctcaaggccttccactgggcttcacctccatagccatgactctaatcttagctgatatcatatcttgccagatatgcaatgatgacctctcagctctttctacccccggcctctttcaattcagactgatctttcaaaaacttaaatcagtttacttcctttcttaatattaagtaccttcccatcatacttagactaaaatctaaactcatggctctcaaggccctacattatgtggcccctgcatgtacatctcctactgttctcagtgactatgttccagccacaacaacctttctttcctaaacacagcaagatttttcttatgtgtatttgctgtttccactgccttcttttcctcctgttctttcagtggctagctcctttgcagtcttctgatttatatcacattcactgtatttaaaagagcaatccaacctgagttactctctatcacctcacactgggtatttccttcatgacatttatcgcaatctgaaattttgtacatatatcttctctttttaaaattttacttccctgcactagaatgtaagctttaaaaggataagacttactctgcttttgagctgttatagtctcagttcctagaaccatggcatggcaccatgatagactgtcaacaagtgcatattgttgaataaattaatgctttcttgtgaatacttcagttataacagtgttttgttttaatacattaacagaaccaggaaatatgttcctctggaatggaccccaatagtgatgacagctccagaaatttatttgtgaaggatttaccgttagtatcaaattctttatcatgattattaatactaagaaaggtttaattctgtgattcatttatgaaaggaaatgtgcatcatgtcaactcttatatttgtagtctgttgctttctctactgagaatatatttaagagaatttgatgtgttgaaattctattacatatagccaagctaaacccttctttttcttatatttcactccttttttgatgcctaggaaaaagaagccttaccacagtttttaattctacttcatactttccttcagtcatacttttctgtgtaccatgtttttattctaagaaggattagctattgaaatgagatgttttgccagccctctgaatagtctggttcagaaaataaataaataaataaataaataaaatatcatatttaacacagttgtcccattgtctcgctgatccagttcatttttctagatcccatataccctcctccccttctcttggatcaaatgtactttgtttgtttatgaattattaagatttaattataaacagtaaaatgcacagatcacagttacaatttgatgagtttgactaatgtatatatcgtggaactaaaatttcaatgaagacatagtgttttcactgttaacattgtgggccagataattctttgttgtagagagctgtctgtgcatgatgggatgtttagcagcatccatagcctccacccagtgaatcccagtaacatcatcaggagaacaaaaaatgacttcagatattgtggcatgttccctggagagcataattgcccttggatgagaactactgccatagacagttctttcgtatgcctatcaagtccatccccttctccacagaagtaaccactaagatgatttctatcaccatagattacttttaatcattagtagtttttaaactgttgtactttaagatctgttgtgggcaaaaggtaagataaggtaattgaatttgtagaagatttctaaagtagttattatttaccacagccattacttacctaaatctgtttaatgtctagagtagaaaattctctacagagaataaagaataaaattacaattagaatgaaactgccagtaatagtgttagagtataaagaacacttcatgtttcatgaaccaaagaacaacatttgtaaagaaaatgaacaatgttaacttcagaagagttcaatagttaagcaccataaaagcatatattaccaacaaatcacagctctgctaatgataaagcaggctcctaaagagttgagtgatcaaactacattttttaaaaaacatttaacaaattaattctcatgggctgtttccgtagttaaattgagttatataatgtgttttcaggtggaactctccaacttgataggttggttcttcaagtgggaattgaatgtcagtcataacaaatcagtctccctgtaatcagcataagtgtcctttggtttcctttgatacagaatagatgtattgatttgaaatcgaattatgaaatgatactaaaggaaagaaaaattataatttaggaaaatactgaatttgtttttattacataattgttaaatttctgtttttcattggtattttctaaggcaaattcctcttgaagaaactgaacttccaggacaaggagaatcatttcaaatagaaggtaattcaagtgaaaatctaaaaatattattaagggcaaaataaggtctttgagaacaaataatacaattaaatttatctaattctttttttttaactttttaaatttgttcatctggtattctgctcaaagcaaatctgtttattttacacagagtaatagagtgttaaaatatatttattgtgtcaaatctgtaatctgaatctttggctataactatggcagcaatttactgattgctactacgtgtcaagctctatgttaggcattttatgtgcataatctcacctaaccctcacaacaacctaggactataagtacagttagtcctgttttataggaactcaagaaggtaaaatatctcacatgaagaagtctagatgttaacagctagcatttaaaatcaaagttgaactccaaagccatccctttcttactacttttaaattgatatgtccatgttctcaagtgtcaatctcctccacttgaaccaagcattgaagaaaggatagtatttgaataagcaaaaccagacgtcgaaggaaggatagtatttgaataagcaaaaccagacatagccccacttttccttaaaatacaaattatatttcttacctgagaagctttctagttattcaaatcttatttatttttcaaagaacaacttagctcccactttctcatttgtcccactttggaatatgcggttctacttctctgaatctgtactcaatgatacatatagactattcattttctttaaaccaagagcacataaaagcctgttataattttttttttttttgacagtcttgctctgtcgcccaggcttggagagcagtggtgcgatctcagctcactacaagctctgcctcctgggttcacgccattctcctgcctcagtctcccgagtagttgggactacaggcacccaccaccacgcctggctaattttttgtattttttttagtagagacggggtttcactgtgttagccaggatggtctcgatctcctgacctcgtgatctgcccgcctcggcctcccaaagtgctgggattacaagcgtaagccaccgtgcctggcctataatgtttttaaagattataaagattgaatgtcccttatccaaaatgcttgggaccagaagtgttttggatttattttttaaattttggagtatttacattatatcagttcatcatccctaatttgaaaatctgaaatccaaaaccctccagttagcatttccttggagcatcatgactgcactaaaaaagttttggatttcagattttcagattagggatactgaacctgtacaagattctttcacatgtcagatataagccatcagttgatcactgacaagtaaatagatggtaatatttaagttcccaggtttttatttacagattttataatgtaggaaaactacagaatgaccttttggtcattcacttttttagtttgaattctaaagttcttgaaattcaaatttccacaaagtaaaactacttttctcatttattttttaaattctcagatcagatacctactattcctcaagacacactgggagttgattttgattcaggtgaagctaagtctactgataatgtcttacctagaactgtatctgttcgtagcagtttaaagaaacattgtaacagtatatgtcagtttgatagcttggatgattttgaaaccagtcatttggcagggaagtcttttgaattcgaaagagttggatttttagacccactagtaaacatgcacatacctgaaaatgtacaacacaatgcttgtcaatggagcaaggaccaagttaacttatcaccaaagctgattcagccaggaacgtttactaaaacaaaagaagacattttagaatctaaatctgaacaaactaaaagtaagcaaagagatacacaagaaagaaaaagagaagagaaaagaaaagctaacaggagaaaatcaaaacgtatgtcaaaatataaagagaataaaagcgaaaataaaaaaactgttccccaaaaaaaaatgcacaaatctgtcagttccaatgatgcttacaattttaatttggaagagggtgttcatcttactcctttccgacaaaaagtgagcaatgactctaatagagaagaaaacaacgagtctgaagtgagcctctgtgaatcaagtggttcaggagatgattccgatgacctctatttgcccacttgcaagtacattcagaatcccacgagcaattcagatagaccagtcaccaggcctctagctaaaagagcactgaaatacacagatgaaaaagagacggagggttctaagccaacaaaaactcctaccagtaagtgatctacttgtttacctgtatttttaatgttcgtgataaatgatcactcctgatgcttatatactatacttaccatctgtttctctggtggaggttggagacttaccatctgtctctctttggtggaagttatggtctgattaaacagtggggggctgggtgtggaaatcacagttgtattgctctgacctaattcagagattgcttgttatggagacagaatttttattttcagtaaattaggactcccaaggggacagagggacttttttgtagacttaggttgaattgaagtagcttttatacacttaactgaagtatccccttgaaagtgaaatcaaatttgaatccagtgacttgttattttaatggccttgttttatattaaatttgacaggaaccgtgatttaaaataatcttctagttagtgaagatttcctcaattgataggcttagtattcttttgtacgacatctctaaaaactggctcagaaaatattttattagatcaaaagtaggcatagttcaaatgttcgtaatacaacctacacctgtccacaaagattctcatttggcaattttagttaatacaagtaaaactaacatttatagtcaagttgtatcattttcaaaatattgtcacatcattttatttgatcctcagaacaattctgtgaagtataggtgttatgatgcttattttgtttgtaaggagattaaaaccttaaaaaccaaaccaactttctaaatcggccagttagtcagtggtagcaggcaagtatcttttttaaaaatatgctgtaagccgggcgggttggctcacgcctgtaatcccagcactttgggaggctgaggtgggcggatcacctgaggtcaggagtccaagaccagcctggccaacatggtgaaaccccatctctactaaaaatacaaaaaaatgagccaggcctggtggtatgtgccggtaatcccagctactcgggaggctgaggcaggagaaaaagaattgcttgtacccaggaaacagaggttgcagtgagccgagaccatgccattgcgctccagcctaggcaacaagagcgaaactcagtctcaaaaaaaaaaaaagcaaaaatgctataatgatgttagaataaatcaaacatgattgtcaaagtgttgataattattggacctgggtaactcagagtttattatactgttattgccatctttgtgtacatttaaaaatgtccagaaaaagttgggatttttttgttgttgttcactttttaattgagacagggtcttgctctatcacctcggctggagggcagtggcactgtcatggctcactgcagtctcaacctcccaggctcaagtgattcttccacctcagcctccccagtacttgggactacaggcatgcgccatcacacctggctaattttttttttttttttttttttttactttttgtgaagatgaggtctcactgtgttgccagggtggtctcaaattcctgggctaaagcagtcctcctgccttggccttacaaagtgctgggattacagatgtgtgagcctgtatccataaaaatacataaaatacataaaaaatacgtttttaaacgaaaaaaatatactctaaaatggtattactcagagtttaatccctagacgtcttttaagaaatgcagaatctcaggccataccccataccgtggagtcagaatctgcatcttttttttttttttttttttgaaacagagtttcactcttgttgcccaggctacagtgcagtggcacgatctcagctcatcccaacctccgcctcctgggttcaagcgattctcctgcctcagactcccgagtagctgggattacaggcatgtgccaccacgcccagctaattttgtatttttagtagagacaggctttctccatgttagttaggctggcctcaaactgccaacctcaggtgatccgcccacctcggcctccctaagtgctgggattactggcgtgagccaccgtgcctggccattaagaagtcctcctgtggattcatatacacattaaagtttgagaagcatttttccagaatatagcaactgatctgatattgttccaaacaacatatttctcaaactgaaagttggaataattaatacagtacagtatatttatgtgggaacaaaaaggacagactataaaacccagataacactggagcatatggctcttagtatacaatcatttcacagttatagtttttacttttttggggatacagtttgctttttaaagctatttgaggagattgttttgcagtgtctttactatgtgttggacatttgcctcccaatataggtgtaacttcaaagtataataacttggatgtttatgatgggaaaaacactgagtaacttttttacatgctagcttttctcctggtgtacacagaggctgttatttagaattctcatttatttaatagaaggagttttagcggctttataagactataggaagagacttgataataaaccttggtattgaaagagagaggacttgattccaaatagcaaggtatgactaaaatgaaattccatggttaaacaaagttattatgcccaagctatcctagaagaattttaagttttagtaaagtgttctgttataattaatatttcaacactgtctggtttgaaaggaagaggaaaaaatgatgaaaaagctaaaaaaagaatttattattggctgggcatggtggtgcatacctgtagtcccagctacttggaagactgaagtgggaggattgcttgagaccaggaggcagaggttgcagtgagctgagatcacaccactgcacttcagcctgggcaacacagtgagagcccatctaaaaaaaaattctattattaaatgctggattttgtgtacagttaagatatatacaattgagtacaatttaagtttttgtgtgggtttttttttttaaatcatattcagtaaaaattgttttgtagctacaccacctgaaactcagcagtcacctcatcttagcctgaaggatatcaccaatgtctccttgtatcctgttgtgaaaatcagaagactttctctttctccaaaaaagaataaagcaagcccagcagtggctctgcctaaacgtaggtgcacagccagcgtgaactataaggagcccaccctcgcttcgtaagtatttggtttgtgggaacttatttttaatgatacatgtcggggggaataaggttatggagctttgttcaagaatgagttttttctgaaatataaacatttgatttaaaaaaactgaagtgagaacatttaaaattggtgtgttttaccataacttggtagggaagagtaagttaatattgggatgcttacattatgcctgagatctctttttactcttacaggaaactgagaagaggggacccttttacagatttgtgttttttgaattctcctattttcaagcagaaaaaggatttgagacgttctaaaaaaagtatgaaacaaatacaatgaaggttttgttggatattgtttaaattcaatctacacctctttctgttgcttcaggagaggatctgtaagagtacacaaacagagtgagccattgccatagaatattctcttgacaggaccctagctcataaacatttcttcagaactatacttcaaatgggatgctttgtattaaaactttaataaatttaatttattttttcttttgaatataaataactgagcttaagcattatcatcatatcgatttcttatgctgcctaaacctcttaattttagtcgaaatatatctttttttttttttggaggcggaatttcattcttgttgcccaggctggagtgcaatggcacgatctcagcttaccgcaacctccgcctcccaggttcaagcgattctcctgcctcagactcccgagtagctgggactacaggcatgtgccactacgcccggctaattttgtatttttagtagagacagggtttctccatgttggtcaggttgctctcaaactcccaacctcaggtgatctgcccacctcggcctcccaaagtgctgggattactgagccactgtgcccagcccaaaatgtatcttatacaaacattgtagaaatgaataatgattactcaaataagatcttttaattataagcttctggcatctctatttttcccttaagtaggggatactaaagtgaatgattttctaagaggatcttttgaaactctttagtacaatatttgagtaaaataaattattgtggatcttttgaaactctgtgtagtattcgagtaaaataaatatttgacatttacagtagggtacaccctaagttgtttatgaattccttataccactgttatatttaatttttcagataaaatatgtatgggaaaatgactagagaaattgattcttttttaggctcagggacaagataagtgactaattgtgaaccccaagctctaattgtatgttcagagtgatgtctccataaaattacaaatgtcatgtactttcagggtagctccttatttagtcagaaatctcagagattaaatgtgtgaatatttagggtttttgcatatttttgaccaaccaatgaaagcgaattagttcagtttagaaagtttgatgtctatacttgtatatacctctttaaattttagaactttgtaggttattcatttttaaagagcaataaagtttgtataagatagtgattgctttccttctattctttaaatatcaaaaatagagtatctctctgtcttcactattctcatccttggacatttcctctcccctccccttggtattctcttttttgaggggggggtgttctaggtgagttaatccttagtattttcagtagtcattgctataaaactctcagcttcccctccatactttcaacctaacacttctctctcccaacttatctctgtgtaatctcccagttcatgattaacaaattataattttattgagggactgttctaatcctgatatctcagattttcttggctgttatctccctatctttctgtattctatgtcagtcagagccaaaatccttttcatcatcccaaatttttctatccgccacatcactgattcatacaccctagtcttccatcacagtctcttaatttttaagttttttttttcttactactcccttcatacttattctttaatttcatggaaacactagagtagctatcttaaactaagactacagaccattaaaaagtcagtttctcagccaggcacgagaaactactaacacctgtaatcccagcactttgggaggccaaggcgggcagatcacgagaggtcaaggagatcgagaccatcctggctaatacggtgaaaccccgtctctactaaaaatagaaaaaattagccaggcgcctgtagtcccagctacttgggaggctgaggcaggagaacggcgtgaacccgggaggcggagcttgcagtgagccgagatggtgccactgcactccagcctgggtgacagagcgagactccatctcaaaaaaaaaaaaaaaacagtttctcagtccatgtaaccacctttcaaatgatcagtagccatatgtggctagtggttaccatattagacaattgaggaaatattgaacatttccatcatcacagaaagtacagttggactatgggccaaatctagcacaccacctgcttctggatggtcttcaacctaagaatagtttttacgtttttaaatagttgaaaaaaaaaaaaaaaagcaaacatttgaaatcaattttaatgatagaagcactaactttgaactccagtaaagtacctacattatattcttgagtttgcctcttggcctacaatcctaaaatatttactttctggtctttaccaaaaaagtttgccaactcctgctctagaccattgagtactttacttttgccttaaagatcattctggtctgacactctgatctagctttgatccttaccttcccttcatccccaaagtcaatcattatcctaaaatcagtgttgaattgtttgtatttttagtgttcctatagtcttgctgtcatatttgttcataggcttttaagtattgttttatatcttaacattttataggaatattgtacacatcattttacaactgacttttaactcaatattgtttttgagatttatccgtgttggcagatgtagattattttcatcattgtacagtttattatataaatcagacttattcatttcttcttttgagacacaattcatttccactttattatttacaaattagtgctgcagtgaatattctgcatctttgtacacttaaagtgcttaactttctataaagttaatacctagaagtggagttgcttggttgtagagtatattgaactttaactttactattagttaggaaattgcttcctacagtggttccaccaattctgttataaggagtatatcactctcctaatagcagtttctaagttccagtagcaccacacactgtcgatcacttagttttattagacattaaaattagccaagccaggaagtatgaaattatttctttgttttaattactatgaacttgtatctgattgatttatttatgagaattcaagtgtttattattctcatttcttcctttatgaattattatatcttttgcctgcttttctaatagaatgtaaaactatggattttttatatagtctacacactattcctttttttctgttgacaagtattctaagtatctttcctcaatctctgcccttttttataccttgcttataattccctttgatatttaggagttttaaatattagtatcgtctaccaccttcttccttaagattttgtctataatttgtacatttttgtttttcactttaaggtctttaaaccatatggcatttattttgaggactagggatctaattttattttttcccatgaggataaccagttgtcccagcacaattcattgactaatgtcttctttccccactgctgaatattcctagctttgtcatagaatgggcttctttgcattgctttatttgtttagctttatgctgggtatattgtatagtcacaatttttttgtgtgttggtaggggtggtaaatatacatagaatttatcatttgatctttttaaattttatttttgtttttttattctcactctgtcacccaggctgcagtgcagtggccaatcataactcactgtagcctcaaactcctgggttcaaaggatcccctttacctaggactacaagcttgcaccactgcacctggctaatttttttttttttttttttttttttttttttggtagagatggggactggctatgtttcctaggccagtcttaaactcctggcctcaagcaatcgtccaatcttacctcccaaagtgctaggattacaggcatgagccaccacacctgaccattttgatcattttatttgtaaagttcagtagcattaagtacattcacatgattgtgcaaccatcactacccttttccagaactacttcttcttcccaaactaaaactctatacccattgaacaatcactctctcttctcccctctctcccaacctctggtaaccactacttttactttctatctctatgaatttgactgttccaggtacctcacagaaatggaatcataggatatttgtcctttgtgtctggcttagttagcataataatcgcaaggttcatccatgttatagcatgtatcaaaattttattcctttttaaggttgagtaacatctcattgtatgtatacatattttctttatccatcaatgaacatttaagtttgtatatctttgaagaaatgtctattcaaatccaataggttgttttttgttgttgtgttttagtttttatatatattagatattagtcccttatcagatatgtgatttccaaatgtcctcccccattctgttggttgcctttttactctgttgatagtgtcctttgatgtacaatagttctgaaattttattgaatccaatttgtctattttctcttctgttgtcttctaagtcataatttttttaatacataggtaggatttgtttgctaactttttttttgtttgagatggagtctcgctctgtcagccaggctggagtgcagtggtacaatcttggctcactgcaacctccacctcctgggttccagcgattctcctgtctcagcctcccaagtagctgggattacaggtgtgtgcccaccatgcccagctattttttgtattattagtagagtcggggtttcaccatgttggccaggctggtctcaaactcctaacatcaagtgattcgcctgccttggcctcccaaagtgctgggattacaggcgtgagccactgcgcctggccaacaattttgtttaggattttttgtatctatgatcatgagtaaaatttgcctatataatttcttgtatacacctattttcggtatcaaggctatactagcaatgttttctttttttgctctgtggaaacaaattgcacctgttgagggtttggtgaacttgacaccaaaaccatcttatctttctatgttttcatggggaaattttgtactagttttttaataattataagtcttacatgttctctaattcttcttgaatctgtttaatttttctcccttgggaattgttaagtgtacatgtattgtgataactgctataattttgcttttattgattttttttgctttatatctgctacaatttggttcctccaaatcccatgttgaaatctgatccccagtgttgctgggggatctaatagcaggtgtttgggtcatgggaacaggtccctcatgaatgaattaatgccctcactgggaggaggggataagtaagctctcactcatttagttcccaagacagctggttgtttaaaagagcctagtgccacttctctcttgcttcctttcttgccgtgtgatctctgcacatgccagctcccctttgccttctaccatgagtggaagcagcctgaggctttcacctcatgcccagtcttccagccaccagaattgtaagccaaataaacattttttctttataaattatccagcttcgggtattcctttatagcaacacaaatgaactaagaaactactctgctttttctttatgtcattttgataagggtcaaattctgtgttttccttaaaatgaattcaattttgccctcattcctgaggtataggttaagagttactaattttcttacaggcttgattttgttgttgagaagtctagtcattctaatttttcttcatattttgttagtttgtcccttagcatttcatattcttgacttattataaatgtattatttttaattttctgttattttgctgctagtttatggaatacaattgattttcatatctagaccttgctaaattcattcactagttctactaccatgttttgcagttccattaggatttttttttgtatatgatcttaattaaagtctgcacgtaaagacaatttacttctgtctttctattttgcatgtcttttcttgctttactgcactgactagaacttcctccataatgttgaataggggtgagaagagcagttatctttgcctttttctcgactttgggaggaagcatttggtcctagggcattactgtgatattagctgtaagtgatcactaataacctttctcagactaaagacatttccttgtattccttctttgctgggaggtttttttccttttttctttttttaatcttgagtgactgttgaactttgtcagttactttattgagatgatatttttttctcctttattctcttaatatggtgagttaaataaatggatttcccatgttaaaccaaccttgagttaatgggataaatccatcactcggtcataacatcatttttgtatattgctgaattttatttgttaatattttgttaaagatcttcacatctacgtttgtgagagttattggtctatagttttcttgtggtttcttaaattttttctagctttggttatcagagtaataataccagcctcataaaaggggttcacaagtctttccacctcctcttttctgaaacagtttgtgtagattgataatctttcttgaatgtttgacacactagtgagactatttgtgctaggacttttgtttttagaaacgttttaaattacgaattcatttttaaagttgatgtagagatgttttaagttttctgtttctttagacagttttgctaatttgtgttatacaaggactttgttcatctaagttatcaaattgttagacatgttattcataatattcccttgtactttttgtcttacatgtaagagctgtagttatcctcctctcttttcattcctgatattgataacctttttcccgtttgccccaagaatattcactggcagcacttgcagctgcagcgtttacccaaagataactttgccacaaaataatctcgctcttattatttttccaacactctagtatattgacttcggaaacaaaagatattctatttatagcattctgttatagtagtactatatttccatttagaaaatgtagtaattctcaaaacctgaaaatgtcaaatcctagaaaatatagcaatcctacgtgtgatgttaatatcattcttgaacagttgttggtcaaagattcatttgatgaacccagtttttccaaaatagatgattctgatgattcagacaattccaatgttagttctgttagaactaactccaagaaaagtttttatattttattttcacattgaaaatcagtcaggtttgcttcagcctcaaagagcatgtttatgtaaaattaaacgagtgctggcaacaggctgtgctttttttttccaaacaggaaaagggattatttgtgctttcttcttgatcagtctaaatagaagtttatgactttcaaagaaccagtttttagtttcagtgatttctctcttttttattcattctctatttcattgattcctactctttgacattcttccgtctactttggatttaatttgccctttcctaacttcttaaggtactatgaattaagacttctcttattttaatgtatttttaatgctgtaagttttcctttaagcactctattagctgcaccctacagatttttatatgttgtcatttagtctaaagtattttctgatttctcttgtgagttttagtcttttcttccctctgggcttcattttggatagtttcttctgctttgttaaatcgtctattaatcctatccagtgtattttttctgtcatgatattgtatttttttttttacctctagaaattccatttggttctttattttatatatatattttatttgtctctttattgtgttcatgttttatattctagagcatatttataatgttcagaataactattttaacacccctatctgccgattccattatctctgtcatttctggatcaacttttattggcctatttttcttttagtcgattattatactttcctgccttgtatatcttgtaactttttaaattggatactgtatattgggaattttacatttgtataagctatatcttcttgtattcttttaaagagttaacttcgttttgtcaggcaattaagtttgttagagatcagcttgatctttattaggcttgcttttaagttttttggggcagatctttgggagcttttactctatgctcgtttacccccagtacgaagatgtgaagcatctggggttttcactgaatgtctcatttattcaacaaggtctatccattctggctgctggttgcccaagcctgttcaaagtattacttttgagtgttgtttggctcacaactccctgtaattgttcttcactctgtagttctttccatagttacatgaagtttcatcctacacatgcatggattagtattcagtcaacattcaggagacagaattctggagctctttctctgcatagctctttcccgtctattactctgctagcaaattctacatctgcggcctctccaaacttcagtctgtctcttcaactcaatgatattactggactctggattctcactccttgtcccacaattctgaaactacgttgggaagaaatataggaagaacatggggctcactgcttattttccttctctctggaattataatcttatactagctattgcacaatttctgaaaacagttgattaatattttccatcttttttgcttgtagtggctgaacaagtcccatagtagaggactttataggcagaagtggaagtcaataatttatcctgcttgggattcactatgcttataaatattcatgctttttattatgaaaaattattggcttgttgaatattgcctttttcccattctctccttatgcaatatctcgtaattgttgggctttgatttaactaataatattcaggaacaactgtgctagatcttgttctaggcccttgggatgcctcagtgaccaaaaccaatattctgccctgatggaattcacattgtgtataacctgtgtctcttaactcctttttcatattttccatctttttagctacattctttccatatcatttcgtcagttctatcttccagttcactcattctatccttggttatatcatagcctatgtaacctgtcacttaatgttttctctatttttagcaattataagcactctaattctgatatttgttgtatctgctgacttttgattgtttgctcacatattttctaattttttattgtgagctcatccttcatggaacttatttttccttctgaataaaatctgtggactaggttgtagaaacatctctgtagactgattttgtgtttgcttttaccaggagccctggaggtatcacctgccaaagaagcaatttttattttatattatgttcgagaatttgtttcgagattcccagactgtaggaaatgtaaacttgaaacccacatctgcttgaggtaaagtccacgggcttcacatccttagaaaacttttttagtccatgcattcactaatgtatgcagacctttaatagattctagctttatgtgttgggggagagatggaggggtgttgacagtctgtttcactcagcctacatacataataaaatctaagccctttaattagagatagcaactttcccagggtgaccgaggaatcagtacgtgttgaacccctcttttaagtttccttttggttgtgtcacttggagattgccttttctttcttgtaagctcagctgtgtcctcaaatatattgcattttacccagcatttccaggtgttttcaggggtcaaagtttttaagttatcttagtctttgatattgtgtaagcgaaattctccaatcccatctcctagatgatttttttttaaatcacaaaatgtgattatgcttaacagctgtttcctgtttctcttaaaataaaatccatttcctatttctcttaaaataaaatccattattcttaa

SEQ ID NO: 530 - DNA, 6351 bp, Homo sapiens
gctttttgaccccggaagtccgggcgggcgccgagccgggtgcgttttgccacagagccgtaaaggcgcgcgggaacatggggctgtatgctgcagctgcaggcgtgttggccggcgtggagagccgccagggctctatcaaggggttggtgtactccagcaacttccaggtagcggacctgggcgcgagtagtaggggtggggagtgaggaacccggggtggggtcggacgggcccgggtggggtcgggaggtggggcccggcgaggagggccgggggagcccccacccagcttgtcttcctcggccacacagaacgtgaagcagctgtacgcgctggtgtgcgaaacgcagcgctactccgccgtgctggatgctgtgatcgccagcgccggcctcctccgtgcggagaagaagctgcggccgcacctggccaaggtgaggggaggggagggacggggaagtgaaccccgacggtcagcgctttgtcatctggtctcagctctgctgccgtgcacggcgggactggagcaagtcgctcatctgaaatgagtatgagccgaccttccctgggttacgaattaagatgggatgaaaatgctttaactttgagtgttttgaaggattaaataaccgaagtacaaagtggtagtggcggagactgtaaggaagtcgggcgtggcggcgcgcacctgtggtcccagctactcgggaggctgagggaggaggatcacttgagcccaggaggtcgaagctgcagtgagctatgatctggccactgcacttcagcctgggcgacagagctagaccccattctaaaaagaaaacccaaacccacgaaagggtaatgttggcaagaagttgggtgcagaggtgtctactggtgaacatcggtggagaaagggtctaaggctgggaagcgagacgccaggttccgatcctgttctgtagttaatttctggtgtgatcttggataaggtatcccacctgtatcttgtcaggtgatctgtttagccattccattgccggggctccattagagttagttctaaggcattcatgcttcatgcttagggcatttttgtttttgtctttgttccctcattcccaggtgctagtgtatgagttgttgttgggaaagggctttcgagggggtgggggccgatggaaggctctgttgggccggcaccaggcgaggctcaaggctgagttggctcggctcaaggttcatcggggtgtgagccggaatgaggacctgttggaagtgggatccaggcctggtccaggtaagctggaaggagttggggggtgggggaggcggggaactttgctcctgcctactcactgctcattgcgtcctacgtagcctcccagctgcctcgatttgtgcgtgtgaacactctcaagacctgctccgatgatgtagttgattatttcaagagacaaggtttctcctatcagggtcgggcttccaggtgagagcttagagccctggctgtcctcatctagggaggtgtctggggtattgggaagagaagtggctggatagttgtgactttgctctctgggctttcttcctacctttccagcagtttatccatctccaaggtttgtcttcctgccatcccttaaacatcgaactcctaggagcctcatcctacattcttcttgatctctccgttttttctctagctttaactcctgcctcccacctggtgattctcaccacccagtgtagacttcccctcttgcattcttacctcctcaggttcatatgaacgcaccacagatgctaacagtcgctgcatttgtcatctttcctctcagactttacacctagtacatccccagttaaatctaacagatgtcaccatcttccacccatttggtcaagccagaaactgagtcatcctaggtgcttccttctcctccctccaatcatttactcccctaccttgagcatctttctcagctccactcctttctctcttttttttttagactgagtctcactctgtcatccaagctggagtgcagtggcatgatcttggctcactgcctcccgggttcaagcgatgctcctgcctcagcctcctgagtagctggaattagaggctcccaccaccaatgtccagctaatttttgtatttgcagtagagatgaggtttcaccatgttggccatgctggtctgaaactcctgaactcaggtgatctgcccgccttggtctcccaaagtgctcggattacaggcgtgagccaccacatctggcctccactcctttctcttcagcccctcggacactgcctaggttaagcactcatttcttattgggatgaccacaagaacttcccagactggtttctctgcttccagactgtctcactgcattttccttgaggttgactgtaggaagctctaaagccagatctgatgctgttactcctctgctaagcttttttttttttttttttttttttttttgagacaagggttttgctcttgttgcccaggctggagtgcaatggcgcaatctcggctcactgcaacctctgcctcctgggttcaagcaattctcctgcctcagcctcctgagtagctgggattacagggatgcagcaccacgcccggctaattttgtatttttagtagagacggggtttctccatgttggtcaggctggtctcgaggctcctgacttcaggtgatctgcccgcctcggcctcccaaagtgctgggattacaggtgtgagtcaccgtgcccggccatgctaagccctttcttggctccactgtgctgtccctcctgctttctctcaggtccatctgccacggtgctgcgtgcaccagtgtgccagcaacagtggctggtccctgccccgtgcctcctccactgggctcacacctgtctcgttttgtccttcgttggctctgagaagcagcctctgcccctctccctttctcctactctttgtaagatcctcttccttctgcctctaccatgttgcttggacaccagggtggaatagcagagaacggctgcttgcgtttgaattccagctctgccactttgacagatttctgaactgagagatgtgactctctaggcctatttctgcatgggtcggagagtcggcgggactcctttactgagttatagtgaatgtagttttaacctaagcgcctcacatgactaactcctcatccatcaagaatgagctcagctctcacctccctgcatcccctcacccccctgtaaagtaaactttttctgctactcgggaggctgaggcaggagaatggcgtgaacccgggaggtggagcttgcagtgagccgagatcgcgccactgcactccagcctgggcgacagagcgagactccgtctcaaaaaaaaaaaaaaaaaaaagtaaactttttccaaggttatgcttcaacaggaatagctaacatttattaatttgtgccaaataagtatcttgaatatattggctcattgaatccccacacctactattttacagagatgccagtggggcttgagattgaatcatttgcccaggctcccactgctggtaaacagtagagggggctcctgacccatcagtctggcttgacaacccattccctcaactgcggattccgcccatctctagcttatcaccctgttgatttctccatagctgtggtaacatttgttgcatgaatggaccgttgaaatggggcctggcagggagaaattcaggaaatgaatgaatggttcttccctggcagcctcgatgacttacgagccctcaaggggaagcattttctcctggaccccttgatgccggagctgctggtgtttcccgcccagacagatctgcatgaacacccactgtaccgggccggacacctcattctgcaggacagggtaggcaagaggaatagaaaagggaagaatgtgtaggcacgggaagggcctagcctggggtctctgtttacctggctcctgtgctctgcctgccaggccagctgtctcccagccatgctgctggaccccccgccaggctcccatgtcatcgatgcctgtgccgccccaggcaataagaccagtcacttggctgctcttctgaagaaccaagggtgagtgccacaggaggaggaggaggacatggggtttgattctgtgcctttcagtgggtaatgaaggctgaaaggatgactttcgcttaagtctttcttgctgcaccaaagcagttcacggtatttgccccaagctaagctttccccactgcaggtgtgagatgtggatcccttagcccttggggcagagaccccaggccagttacctctgactgtgagccctttaaacgtaggccgtttcaatattgtgtgtcctggcttaacctgcatgttctggttggctgtgacaggcccttagctgctccatgcgtgctcagctcacccctgctttgccctaggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtgagatggcgagaaagcgtggccgagggactcgcagatccacagcagcttagacctggagtcatttgttttggtcttacttctgacactaatgggcttgggaccctgggacaaaagttctcctctgtgaagcgaggatttcaggactgaggtagcctgtgaagctatgtaacagagacactcttttccttaggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggtacagggcgggcgccagggtcgtggggagtgggggacggggtgagctgctctcttacccagcattggggccgtttctcttgcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaaggtgagtgagtgggggcgtgcttgggaggcgcaggatggcaccggcacatctaacatctacacttctctagctcagcctcacaggccaaagcatcagcaccagaacgcacacccagcccagccccaaagagaaagaagagacagcaaagagccgcagccggtgcttgcacaccgccttgcacatagcagaggctccgggctgactccttcctggtgggaaaggaagatgcctgtcctctccgtggaggaccctgggccctcaccgcaggaagcagtttgggttttgaaaggttattgggtcccttccttgggctgtgttcttgctggtgagcaaagtgttgcctgcaaaaataaaatgcagaacgtactctacgatagatcacagttttttattcttaatgtcacaagcaggagaaaaatctcacattcatactaaaagttccaactagactcaacaggaatgaagtctctatttgtaatggaaagtcccagcctcccgctgccgtccagtgcgtgtactgtacacatccacactcacactcactcagggttcccggaccggctgtcctgcctgcggaactgaggtaaactagctcaggtgctgacactaggagggtctaccttacataaggtacaggtagaagcttgattgctaggcccaggcccacccagaccctccaatcctaacaggtatttaggcttgaggttcactccctcctcagctgcacacgcagccaggtattaacgaggatcagagctgttctgaggggtgggaaggagcagccccaccaccactcactcaccctcagtcacatcggggagggggcaccagttacatttacatcacattatttataaaataagaattacatttcatataacatggccagaaggagctctagtcccccaggaaagctgccggggacagcatttgagcctcttctttgcacaggcataacttaactatacagctaattcctagttaatagcatttatacttaaccacctcaatgaaccaagcttgaaggaatttaaaaggcaatttagcttaaatacaaaaataaatttttgttaaaaaacgttt

SEQ ID NO: 531 - DNA, 58471 bp, Homo sapiens
gcaaagccatcccggcggctaaggagagcgggcaggcaaggagattccgggccagggtcgcggcggcagtcggcaagcgttcgattctctggcgttggatcgcgagcggtgtctgcttgtcccgccgagggctcccaggacagggcagggatctagggggtttgcgcacctgctttttaatgccccgcccccccttttttttttaaagtggagggggtgaaagtgagggaggagaatggacagaatactgactggaacgttaattcgagcatttcatatgcgaagagcggaataacagttccgtattcttctttcagtttctccattagattagcttcattttcgaatgctccgttttgcatgcttaattttgaaactagcccgtggtttggcagaatttgactgaattcaggggtgagagtttgatccagtccaagtgtatttgaatttgagcacgcagttcaaccagtgtttacaatggaatttctgaagacttgtgtacttagaagaaatgcatgcactgcggtttgcttctggagaagcaaagttgtccaaaagccttcagttagaaggattagtactacctctcctaggagcactgtcatgcctgcttgggtgatagataaatatgggaagaatgaagtgcttcgattcactcagaacatgatgatgcctatcatacactatccaaatgaagtcattgtcaaagttcacgctgccagtgtaaatcctatagacgttaatatgagaagtaagttttcaaaagacattgttaccttttttaaaaaaatcactttcataaggtatgccgttttaaaaaattgactacgcttctttggtttacataaatgaatcatttaggtttttaacaatacctctgcaaatatttccaaaatttttgaaattgcaatggccagggaatccttctggccatttgtattgacaaaatataagcttgattgttttcatgcgtccttaaatatgtaagttcagacttgagaactgtgtctgtagctaacttttttttttttgagactgagtctcactctgtcacccaggctagagtgcggtggcctgatctcagctcactgcaacctccgcatcctgggttcaagcaatttctcctgcctcagcctcccgagtagctgggattacaggcgcatgccaccacaccgggctaattttttgtatttttagtagagatggggtttcactatgttggtcaggctggtctcgaactcctgacctcaggcgatcctctgcctccgccccctaagtgctgggattacagacgagccattgcgccctgcctatgtttgtagctaaatttctgtccagggaactttgtggtattctgagatccgtcacaggcttcggaagtatagttgtttcctagtcagtttagaatttatggggttttttgtttgtttttgagacagagtctcactctatcggcaggctggagtgcaagggcgctttcctggctcactgcaacctccgccttccgggttcaagcgattctcctgcttcagcctcccaagtagctgggactacagacatgcgccgccacacccagctaatttttgtatttttatagaaacgggagtttcactgtgttggtgggaggctgaggcaggagaatcgcttgaatccggaaggcggaggttgcagtgagccaagaacgcgcccttgcactccagcctgccgatagagtgagactccatctcaaaaaaaaaaaaaaaaaaaaaaaaaaaagcattgaaatgactttactgtgattgtctcatgaagtctacgtttgtattctttgttttgaagtagtaattgctactaccagttgggcatgccgttttcctttattctttttatattaggcttgaagagaattcagttttttataagatatgtcttttagtggtaagttttactcaatgatcagcatgttttttcatctcctttgattgtaagttctttcaagattgatcccatgctttgtcaacctgtttcagtgcttcacatacgcagttgtcattcagtcactatttctatgcctttttatatttttgttctgacttaagataacaaacttaaattagcagtattttatctatgagtaatttttacattttgtcttcgtttaggtctgttagctttttatttctttaaatgcacatgcgtaattcatgccgtgtacattttcatttaaacagaatggctgtatctagacttttcttggctgctgtttaataatataacactgtaaaacattttacttttatatagtattcttgaaacatcttagttttttatgacttgaatgggtaatattattcgcaagttatcctctttttttttttctcctaccttttgaggatatttattgtcattgcagaagatatctgaaacagtagcttggggaaataaaataatgagtagaagactgtaaactgtaggaagcagttatttcccttggcaagaaagcaagagacatgtctattttatttgaaagatgaaggctggctgtttttctggagacggccactactgttggacgtaaaataataaatcatagaaatggctaaagaaatgaagaatttttacatggggaaaaaatgcagccaacagcatcataccaacaaagtttggtgtctttagatgggattaaagtctttaaactgatgacagatttaggatttttcaaattggcccaactctctgaacaagtcaaggtgtcaacccctgtcaataggatggaacacttaagggccccattcagtcatccgtgtcaccaaacaggttctcaattactaactgccagctgactacattctgggttcaggggcttgttagatagtaacagtgagccaaggctactcagttgatgtattagcattatcaggggaccaagaaaactaaaaacaaccttgggctgcaggctctgtatctcaaagaggactgaaacctttctgcagctcttaaacagcagctaaagtttgacacgactaaatgtccacttctgttgttcaaaccacatagaagtttcagtgaataattgtttaattatctttagcagtggaaaaggaatgtaaggcaggaaaagtgaagcacatgacttttgtgaatattacaagtgaagttgttttttttttccctgacagagtataatcctgactccccagatggcaaatgttgtaatgttggtataatggccatcagcttagattttctgggactttcccacctttcaaacactttatcccatgtgtcttgattttttattagtaacacaactcatgcaagctacccacctgtcagcatctctctcggtatcttctaccttccctcctgctgtatggattagctgtcactgctttcacataaggccagccctcggcttgtgtttctgatcccatccccctcacctactctgggatatcattccggcaggtgtctcctgcatcatcagtcttttcttttctactggatcatctccattagtatacagacttgctgttatttctcctttcttaagaagaaggaaaaggctgggcacagtggctcacacctgtaattccagcactttgggaggccgaggcaggtggatcacctgagatcaggagttcgagaccatcctgatcaacatggagaaaccccgtctctactaaaaattagccaggcgtggtggcgcatgcctgtaatcccagctactcaggaggctgagacagcagaatcgcttgaacccgggaggcggaagttgcagtgagccgagatcacgccattgcactccagcctgggcaacagagcaagactctgtctcaaaaaaaaaaaaaaaaaaaagaaaaaaaagaaaaaagccactcaaaagtcctctgtccatcccagttcccacttcgagctactgctccatttctctgctccctttgcaacaaaactgttttaaagagagttcagtcttctcatgtctccagtcccttatttcccattctctcaaaagtgcactacacagcagttgctcctggcagggttaccaaaggtctgttagatccaggcttgtttgtttgttttaaagcctcttagcatctttggaccttatttgaaaacctgtctcccgtcagcagcattgaatgtctttaaactgccgccttagtctcctttgctgctttctcctcatccctaagatctaatggattgcccacaggagtgggtgcggggcaaggggagacgtacagagtgggttagtgactgtggagcatgcgttgtggggcagggagtgagtggtacatgacactggagaggtaggcagggtgcctatcatggaaagcctcacatggcagacaggttctcaaaaaaaggtcaagcagaagagagaataacagatacttttgggtctgagaaaagtcacgttgtatatggaagccatgtaataaattactctggattattatagagtagcaaatttacttgaaccaaaaaattaaaagaatgttttcagttttatttagctgatatttatataagtattctttttctttttctttttctttttcttttttttttttttttgagacagagctttgctttgtcacctgggctggagtgcagtggtgtgatcatggctcactgcagtctcaaactcctgggctcaagcaatcctcctgcctcagcctcctgagtagctgggattacaggcatgtaccactatgcctggctaatttttaaaatttttagtagagatgagctctaggctggttttgaactcctgaactcaagcaatcctcccaccttggtctcccaaagtcctgggattacagatgtgagccaccacacctggcctgtaaatagtcttaaaaataaaaagatatgggccaggtgtggtggctcacgcctgtaatcccagcactttgggaggcaaggtgggtggatcgcttgagcctaggagtttgagaccagcctggccaacatgatgaatccctgtttctacaaaattagccagacgtggcgcacacctgtaatcccaactactccagaggttgaggcatgagaatggcttgaacccaggaagtggaggttgtagtgagccaagatcacatcactgcatttgggcaacagagtgaggcttcatctcttaaaaaaataaataaaataggccgggtgcagtggcttacacctgtaatcccagcactttgggaggccgaggcgggcggatcacgaggtagggagattgagaccatcttggccaacatggtgaaatcccatctctactaaaaatacaaaaattaggtggctgtggtggtgtgtgcctgtagtcccagctactcgggaggctgaggcaggagaatcacttgaaccctggaggcagaggttgcaatgagccaagatcatgccactgcactccagcctcatgacagagcgagaccctgtctcaaaaaaataaataaaaagatgtgaaataaaacaacttgattttacacatcagaacagatgcagccaagaggctttttatcactcaggaatttattccaatttatttcaaagatgttgttctagaaacatgtttaaggatgtggggatcattactggtaaactgttgtcagcatcaagtactttatattcttgccttatttatatattgacttcaaacagcttaaacatttgtcttcaccagacctggcaccaaatattctgttgtttaaaaagtttgtgaatgagtacgttaataaagacatgaatacgttaataaagacatcatcttcaaagaacaaagcaaaactgtataaaagataatactaaaagttctgaagacagtttcaaaatttgaatttcaaaaatattttgaacaatggtggctttagtttaataagtgattatcactttccaagtaaattttttttaaagaaaatctttttatgctttcccatgtaatggcaaaaaattataaggttgattacttttttaaaaaacttttaagttgagaggtacaagtgcaggtttgttacataggtgagcttgtgtcatgggggtttgttctacagagtatttcatctcccaagtattaagtctcatacccactagttatttttcttgatcctcttcctcttcccaccctccaccctctgaaaaaccccagtgtgtgttgttcccctctatgtgtccatgtgttctcatcatttagctcccactttagttttctgttcctgtgttaatttgctaaggataatggcccccagttccatccatatccttggaaaggacatgatctcgttcctttttatggctgcatagtattccatggtgtgtatgtaccacagtttttttatccagtctatcattgatgggtagttaggttgagtccatgtctttgctgttgtgaatagtgttgcagtgaacatacacttatgtgtctttgtaatggaatgatttataatctacatcttgaagacctaaaattgtactggactataaccctgtagtagttttaaaagcatttcatacttacatttggaggaaacagataaattgtattttacaggtggttatggagctacagctttaaatatgaagcgtgatcctttacacgtgaaaatcaaaggagaagaatttcctctgactctgggtcgggatgtctctggcgtggtgatggaatgtgggcttgatgtgaaatacttcaagcctggagatgaggtgagttagggaatgccactattcctgcggggatccaacccacagaccctgatccagcgacggatgagagacgcacactgacacagatactttgcctgtcagtgcagctaaggggcttctgctccctgaatctgcagcatctgccccctaaactgacaaagtttgcatttatttagtacagattaaatgacgtaggtctcgagtaaacaccactagagggtaattaacattgccgaccgtgccctgcctctgcagcagtagagagcaatcatgcatccatgaaagatcaaagattggtcttaggaccacttgagtaaacaaactatttagataaactcccccacattccctagttatttgctctattgctatcaactcaaggtaaagagaattaggctgctttcagccaaatgttttactaaagctgtgcaacacccccggccttccaagtaggtttgtgtctacttcctataactatctttataatttttcctcttacaatttttcccaccaccctgactgaactcccacatattcctttactaaatgtgcaaatttcattctgtttcagaagtatattctatgctgttgaacttttttcttcttttcaacaaatatactgagctttgactagaaccatcacttttttggttctgttgttacattttttcacaaacaattccaaaatatcttgactgtacctgagtttgtgttttctaagtttagtacttaagaaatgcaagactttaaaatatatagaattagggtattttttttttccttgaaagggcctttaaatgacaatttctgccttatggatgagatggctttaaaatagcttaagtttggtataatcacctgtcacttgtcactttgaacttttgtaccaagaaatgatagttcataatcatagctaacactgttctggttgctttttataaaataagtcatctaatccctctgaggtagataaagttaggcccagtttacagatgaggaagccaagctataaagaggtctcatagctaataagtggtggagccaggactcagaccccagagattgtggtcttattgggactcgaagtagtcagtaaatgcagcaggatatgctggcatctgcttccagcgtggtttgacttgataaatctagaatcatactaagtaataaatttatatcatgaaaataacactcctgcttggtgtagtgctgacttctgtgtttttcacagcacagggtatatattagggaacactttcttgcttagcttcggtcaaaaaatatctgtgtttctaatgaagctgtctgtctgtgtgtgtttcaggtctgggctgcagttcctccttggaaacaaggcactctttcagagtttgttgtagtcagtgggaatgaggtaacttaccaactctgctgaaatgcattagaaagtttaaacaaagactggcaaatatctgaaataactggtgtttttcagatctagtttatgtttgatggggcagtttataaaaagataatatagaatataggaatttttgagagattaaaaaagtatttgatgccattcagtaacactgcctgctaacgtagctgtttttctctcatagagcagggatttggaatgagacctagaaccctgctgtgttgcttggttttaccctagataaatagttgaaaacagatataggcagtagagaggatggattagtcatcagtggagacatggaaatatccagcggttttgaataactttaaaaacaggagtctaatcaaatacagtcaggagaccaacaaattgaatagagagaaaggggttaacattgaggaaattggctacagaagggagggcaggaagggggaaaaggttattactgagattagagaaaacctagaaagatttcctttccagaaaatgagagtaaaggaaacagctgatctcaaaaactaattaggacgtgtttttgagagttcaaggtttatttggatttacttcacgactaatgggaatattgatgtggtctttttataaacaatgaagtagttatatctgataatgtagcctacataacattactgaacatctgtgaggcaggtagagctattctatacaatatttattaggataatcttggagtagggtatgcatattgcttaccctactccaagatatgcaacagatagagctatgcaatatttattaaggataatcttggagtaagatatgcaacaaacatgaactggaatgattttatagatttatctgtgaaaatacagttgacccctgaacaatgcaggagttggtgcacctacccctgtgaggtagaaaatgcacctacatcttttgactcccctaaaacttaactgctaatagcctactgttgcccagaagccttaccgataacataaaaagccaactaaggctgggtgcagtggctcacacctgtaatcccagcattttgggaggccgaggtgcgtggatcacaaggtcaggagttcgagaccagcctggccaatatggtaaaaccctgtctctgctaaaaatacaaaaattagccgggcatggtgttgggcgcctgtagtcccagctacttgggaggctgaggcaggagaatcgcttaaacctgggaggcggaggttgcagtgagcagaggttgcagtgagctgagattgcatcactgcactccagcctgggtgacagagcaagactccatctcaaaaaagtcaactaacacatattttatatgttatgtatattatatactgtattcttagaataaaggaagctagaatatgttatgtatattatatactgtattcttataataagggaagctagaatatgttatgtatattatatactgtatccttacaataaaggaagctagaaaaaatgttattaagaaaatcataggccaggcgcggtggcttacgcctgtaatcccagcactttgggaggccgaggcgggcggatcacgaggtcaggagatcgagaccatcttggctaacacggtgaaaccctgtctctactgaaaatacaaaaaattagctgggcgcagtggcgggcgcctgtagtcccagctactcaggaggctgaggcaggagaatggtgtgaacccgggaggcggagcttgcagtgagccgagatcacgccactgcagtccagcctgggcgacagagcaagtctccgtctcaaaaaaaaaaaaaaaaaaaaaaatgaagaaaagtatacttactattcattaagtggatcatcataaagattttcatccttgttgtgttcaagttactagaaagaggaggagtaggaagaagaagggttggttttgctggtctcagaggtggcagaggcaggaaatccacgtataagtggacttgcacaattcaaacccctgttgttcaagggtcagctggattcctgtgaaggtaaatgtgcttaattgtgttcataggtttgcaagtcattgcttatttttgactgttgtcttcaaatgtaggtctctcacaaacccaaatcactcactcatactcaagctgcctctttgccatatgtggctctcacagcctggtctgctataaacaaagttggtggcctgaatgacaagaattgcacaggaaaacggtaagtgtatcagtcagtggcagcatctaaacctcttttctttccttctgtgagttccttgcagtagatttgtcagagctttgaaatttagtatcatttacacgaacagagctgtactaacatttgaaaacaatttccaaagcattctatttgtgtcagtttgcactttcttagcttcattctgtggattctcagcccaatcacttgggaattttttaactgagatgtgtggatggaatggactttaggagtcagaaccttctaaaataatgcaaaatattatatgtgattctctaggaagaagatccatatcttttttttaatgaaattcctaaaaaggttaagaatcatcccatacagtttctaaagaatgatgtcaaggttaagatgttttttccctacctctcccaggagttattctcacacttgcatatttctataaagggactgcacaactattgaatattcttaagttctctcagtctcaatgcctaatatccattaggtcaattctgattccccaatgccttgagcgtgtactcatttgggttagcagcaacatggtgaccagaaatgtctcagatgtacttgagtttatatgtagattctgttgctttccagttgggtgacccactcactcactttttaatgagttttgttttgaaggttaaatgaggtaatgcacattaaactggtgacacagtttatggcacgtgggaggcactcagtaaatggtggctactgttgttagcaaggaggttgtggtgttccttgtattttagaaagttgccatcatagagaaaactgatgattttgttttttgttgagaaaactagatactaagaaccgtttaacaattgtaaggaaggaaggagctgtaggtcaaactataataaattaaaataacctagttttttttattactaaggattgtgttggtaacataactgaagtctgtgtgattctgttctattgttatgaaacattgcactttacatttaatgtgttcggtgatagagcattaaattttatgaaagtttaatagctgtatttttgaaaacttatgaaagctatacatctagtgaggtactacccttccttatcttagaattcaaggtaaatatttattctaaaggtcaaccctgtttactttttaagctattgtggcttatctttcttgaagttgccattttggtcaacactttgtttaaattaaattagttttgaccacatagatttttctaatggtttctcttagttaataaccttgcaaaaaccttattgaagatttttagacctgtattgtaattgtagactctgcaacagcattggttttattgttttgttttttcctttaaaaacattatgttttctatgcctgcatgactatatgtgcactattgttagagagctctcatttcttttactggttcagggctctgtggacttacttttaatatactgtaaaaaacaatttagaagataagaaaaaatttaaaaatttagagacaaagatctgtctcttcttagagacattggtgtgagtcctcagtttgttgttggctttgtgggtaattctttggtactctgttatcttctgtttaagcaacaatggcctggaactgggaagttggagccctgggtcctgttctgccattaactaaccaggtgaccacatgctatatatttatggtctctttgtggtttcctctgagtttatgagtataggacagtgtaggttttgaggagagctttgagaaatggaaagttttagaccttattaggtgatgatatcttgtattgagttgggtctgtttattgatttagccaatgttaaccaatctagagtgaaacccattgcaaagagtctcaacaattcacatcatggacttctgctgcattcacatgttgtgatctgtaggacacatttgtcctgagtgactcagtgagcacagtgagaccttgctgtcttagtctgttcaggctattatcacaaaataccataaactggtagcttaaaaacaagagaaatttatttctcacagttgtggaggctgggaagcctgagatcaaggtgacatcaggttttgtgtctggtgaggaccaactttctggttctttaacagtgctttctcgcttgtcctcatattctggaaggggtgaggatatctctggggtctctctctcttataagagcacaaatcccattcatgagggttccgcttgcatgacctaatcaccccacctcctaataccatcaccctgggggttaggatttcaacatacgaattttggtgggacacaaacattacaaacattcagaccatagcacttggtacttgctgctctcagaaatttcggtttactgaaattaccacacatgggttataataatggcctacctcttttaactgcttatttgtgagagtcacatgagagatgtgagcaccttaaaatactgtaaaaatacttttaatgaagaaattctataatgagattttattgtacctaaactcagaagttccagtgtccaaagtggattttccatttgactattcattgtgattgatggagcatattttggcttcaatatgctaagcaataactgttctttttctgttagctattagctattggcattaaggcatgccttagtctgcacaaagcacatcagtatttgttatcaaagatgaatcatcttttttttctaatcagttaattaaaaaaaaacaaaattaacaatgacaaaaacacctatcagcaccttggaagattttataggatttctttataacaaacagcttatttgaaattaggacaaatctttctaagggttcaatgatgtttacctttttccccctttgttctgtagttacttttctgcagcagctgagtatcagtgaaccaaggaaatagtttattcttgatgtcatataatactgtcattttgtccacacattgatatcattagaaaatgtcaagtgaggccaggcgcggcggctcatgcctgtaatcccagcactttgggaggccgaggtgggtggatcaagaggtcaggagatcgagactatcctggccaacatggtgaaaccccgtcgctactaaaaatacaaaaattagctggacgtgttggcacacacatgtagttcaagctactcgggagcctgaggcaggaggatcatttgaaccacagagttggaggttgtagtgagctgagattgcgcaacggtactccagcctggtgacagagcaagactccatctcaaaacaaaaaaaaagaaaaagaaaatgtcaagtgaaaattattttctttttatcagcccatctatagtttcttcatgatttgttcagtaggaacacatagataacttagggctctcaagataagtagaaatttttttaaaaagttgttacaaccggatattttttgaatatgttaagatttgatggttttatttattggtagtgtcattggtgcacttgaatatttcatgctctgcctgaaattcatgtcttgccgggaaagttgtacttcattctgtttgacagaagtattaaaaggtgttaggtgtagtgttgcgtgcctgtagtcccagctactcgggaggctgaggcaggaggattgcttgaacacgggaggcggaggttacagtgagctgagatcatgccactgcactccatcctgggcaacagagttaggaattgaactattcctcctccacaaaataaatttcacttttaaattgtgtatacttgcaactcaatgaagtgaatttaggaatactttttttttgatattaggttttatggcagtaaaattttgtcatgtaagtgtaaattaggtgtctgattaattctgatatagaattatagaattaggcccagagttaaaaacattgggtttattccctaccgatatgcttatattaaaattaaaatgacagccttcttctttcaaatgcattctaaggccttttcttcaccccaccaccacctgtttcttcccactccccaagcccattacccttttggactttaagttttcatttgcacctgactgggttgtattgttaggggggtaaggggaagtagaaagaaaccccagctgttttcttgcataaacaaagtatggggttgaggaggcaaggagagtgagagtggaggctctggcttggtcagtgtgatggaaatgaatcttcctttgcttcaggtctattttccagggagtcctgggtgggggggtgggggctgtgggcacttgaaagaatagcagaaacctcactcctggaaatttgtgttttatacaatagctttctaagtgactaggttaactatctcgtgaggttacaagtcatttactcttcaatggactgtaatctagcttctagccttgcctttcaattgcatctgccctcactggggtcgtagctaacttaagtgacttaagttgccaagcccaaagacatttttcagttcttattttaatttgatctctctgaagtagctggcattgttgaacacttcctaaatacttacttttcgtatggtttcagggacattaagacttttaagttttctttttttgttgttgaccatttcttgtcatttttagaagcccccacttcttcctccagccctttaaatgtgctgttttcccagtattccactctattcttcctttttgtttcccagggttatctcatctactcccagcttctacttatagtttggtaacttacagatctgtatttctaactctgtcctcttactgagttccagtcagatgttctctttatatctcaaactcaacttgagcaaaacaacacttaccaactaccaccccaactcttcctctgtaatcctaatgtcagttaattgtggtttaccctaagtcaaaacctgacattgttcataaaccctgctctttcaccttcctcagcactactcattattgttcgtgtcatgtaaaatataagattgttgccaaatttggaacaatgtcttccaagttccttttatatgccagctataagatttgtgaacccaaaatatctgagacaggtctcagtcaatttagaaagtttattttggcaaggttaaggacacgcctgtgacacagcctccggatgacatgcacccaaggtggtcagggtgcaacttgcttttatatatttttggaagacaatacatccatcaatacacataagatttacattggtctgatcttgaagggtgagacctcttgaagaggggtgggcttccaagtgataggtagatttaaaaattttccgattggcagttggttgaaagatttattataagtgaaatggaatgtctgggttaagataaggggttgtagagacctaggttttgtcatgcagatgaagcctccaagtagccagctttagagagaatagactgtaaatgtttcctatcagattcaagttctgtgttgatgttaatgctgcaggggtataatgaggcctgcaacctcctctctcatcatgagcagaactagattttcagggaactctggaatgtccttggccaagaagaggagtccattcagatggctggggccttagaattttatttttggtttacagatttcaaggcatttcacgttttcttgtgtagtgaataagcctaaaatactgttgtattttaatgaacaatcctgattagtttgttgttaacctcttccatatagtgttgtcttgtaaattcttacatttttttaattggaggaattttccacagactagcttctggctttgtacatttcaaaccttgtttaactttctttctccttcactactcacatgaccctgtgctgggtgcagtgatacacagctttaagaaaatgtcatgtggcttaggtgagttgacttaatgagaggtaggaagaaattcctggaaggcatttcttaaactaggacagctagggataacttaactttacacagaagtgactacgaaccacatcagtattttccactaaaccccaaacaagtatatttccaatcaacttccctttagctagatctagtatcacctgagaaaaaagcaagactgatgagtaagagtgaaaaaagaccaatcttaactgattgtggttagcatatcttttacaaattttacaaaaacatgtctgttacatataaagtttcggcgccacaaaagaaatagcacttgaatataaaattttctttttaattctcagcaaggccagttacttctatatagaagggtgcgcccttacagatggaacaatggcgagcgcatgtttggacaagggaggggaaggggttcttatccctgatgcacgtggcccctgctactctgtcattcccctattggctagggttagcccacacagactaaactaattctgattggctaatttaaagagaatgatggggtgagtgctttggcgggagtcagggcagagcaggtagcaggtaatcggaatgagttatggtggagcaggtgatggaatgagttagggtagagcaggtgattggaatgagtcagggtggagcaggtaattgtaaaaggttgctttatgaggaagtttaaaagtagaaggcaaagaattgaacatactgacatattaattatttgaaaagaaatttagaactcgtatctaacatgtctatgcaaaatattgctagggttcctctctgggccttgtgtaagtgaagggcttcggcttcattggctccatggtaaatcctctgacctcactacttctctctgtcttatgccctattgtcacccatcacaagcttttttttttttttttttttttttttttgacggagtcttgctctgtcgcccaggttggtgtgcagtggtgtaatctcggttcactgcaacctccacctcccaggttcaaacgattctcctgcatcagcctcccgagtagctgggattataggtgcccgccaccatgcctggctaatttttatatttttagtagagatggggtttcaccatgttggccaggctggtctcgaacacctgacctcaggtgatccacctgccttggcctcccaaagtcctgggattacaggcgtgagccaccatgccctgcccatcacaagcatttttccctctatctgcttctgtataagattgaaggaaccagtgatttgggatggttcccactgcctatcccatttggggggatacattcccagtacccctggttgaaattctgaatacacttcggataacaaagccattgttatcctgtgtataaagttcttcgtcgattatgggttaactaagtcttcataaatggcttaccctggccaccttaccaagatatataaatagctttgttttcttgggaaaatgtgtttaactttctaaacatttaattcacacacaaactcttctgtaaattgggggatgtcaacatgcattacagaggcttagaagaagaggacacataaatctaggctatcttggtctcctttgattgatttgttttgtagctatatttttccacttattcagattaagtttctcactcactttaagacaataaacctggcgtattatgctaagacactttgctatcttttatctgttttccccgtgatttaaaagtcatgtgtgtttcagaacctccacaaggctgagaaaaaaagtagtttgtggaggtgaaagatgagatacattttcagcataatccttatttcttaaaaccatttgtttctactgatggtcgatttcaccatatttaaatcatctttgttcataagtcattaggatttaatagatgacactctaatcttataatgtggcttttttcactataaatctggggcaattttgaaggccatatatgtctgtttcaaaggtggagaaacaaaatataagcttaaattagatggaaagcacctgttctttttcattgactcccagagtacacttctgtcatcatcattttgtaggtgacagatctgagggccagggattccattagagagagagttgaaacctgaacccgtgactctagatacccagccctggcattcagagatttttgggatcaagtcagaatatagaaacttgaagatgattttctacttctggatgtcttgctgttttgtagcatgtttcgtgtttttgtttttttttttgtaaggcagctaagggggttggcgccctacctcataagattacaatactgaaaactgtgattgtagagggcttaggtgcccaaatgccaaataaaaagtgactcagtcatggaaaagaagccaacattgcttcagtgccttaatgtatgtttagggagaattcagagattaggcaaaaaggacagagcaagttagattttagggtttaagaatgcctaagtaatgtaatactgattcatattttctccatatttaaaaaatatctgtcactagtacaatcccttctgacttccaaagaagctctatatgtgtacttaagaagtaatagaggcatgcaattaaaaaccttggcgattttgaataacagtgcttttttcaagtagagtatttctgtacacactttatataaaccaacaaatacagcacacgtttcttcactatcacaaataggcttctacttcagtgagattcgaatatatagtgtggccattacagcaagctaggtaaaaagtattcccactgtgtaggacttaagtgaagggccattgggaggtcagcaacagcagttgcttccctttgcattgaacgtgctgtgaagaatacaacaagaataattagttgagccacaagacttcagactttagaagaccgaccggcttattgttggcttgaaaatttattttgccgccgggtgcggtggctcacacctgtaatcccagcactttgggaggctgaggtgggcggattgcctgaggtcaggagttcgagaccagcctggccaacatggtgaaaccccatctctactaaatatacaaaaaaattagccaggtgtggtggtgggcgcctgtagtcccagctactcaggaggctgagtcaggagaatcccttgaacacgggaggcggaggttgcagtgagctgagatagcaccattgcactccagcctgggcgacggagtgagactccgtctcaaaaaaaaaaaatttattttgcctactctctttttggggactttgaagaaagatatggttgaaacctgcacaaaatgtggagtttacaggaccagaaaacgatgtgtcctcagggctcctttacaagctaacagcgcttcattcattggacctgctccttgctgcttttgcacttggggtcgccatcaggtggcaacacaaagaattgaagctgctattgcagaaccactcttgctaagccctgctgtgaaacacagttttgcttttttatttgagggaatgaagttgctttggatcaagagttatagggaagagatgaactgacaataatgaggtcggagatgtatttggcagttggatcctgaagtagccattatatttagtatccagcattcacagagagagaattagaaattattttcaagcttttctttactggaagaaacttgaatgcagtctttcaagtagccaggcgatcccctcacttgaggtagtagcagttgttgccttgattgtaggacataatggtgattggatgatttctttttttagagacaaggtctcactctgtcacccaggctagagtacagtggcacaatcattgctcactgcagcctcaaactcctgggctcaagccatccttccacctcagcaccaccatacctagataatttattttttatttttcgtagagatgtgatctcatgatgttgcccaggctgatcttcaactcctgggctcaagcaatcctcccgcctcagcctcccaaagtgccggattacaggcgtaagccaccatgtctggccatggatgattttgaaagtcaagaaactttgatcaggcatctgctacatccagggcactgtggccaatgcagggcataatatgaagtctctgaccttaagagcttgcagaataagttgggaagtaggatgtgtggcatagataacaggttccaggctatgttaagggtattgtagaggaaaactgggacttggtccttcaagggaaaggagacctcagcaggtaattatagcattctagagcctggaggaatggaccagtgtgtgtgcaatgtagggggaagaattaggggaacagagtctcagaggaagagttccattcaggaaatagtgagaggaaaagttggagagtgcaggtaatatattgtgaggaacttaaatgagaatttgactagcaacacttctataagaatggacaaaagtaagagggtgaaatatttcatgggggaattaatttttgaatgtatttttgaagcacttttcatacttttttccctcatttaggaagactaaagctatgtttgaattgtcagggcaaaaggtactttacctctgccctctgaaggttctataactgagtctgctgaaatcaactgataatagattaataggagaaaagttatacacattatttatttccttttaatgttagttgatatgtaatgtacacatttatggggcatagtgtgatatttcaatacatggataccatgtgtaatgatcaaatcagaacaatcagcatatccttcaagtcaaacattgattatttctttgtgttgggaacattaaaaatcctctcttttagttttttgaaagtatacaataaattattattaactatattcaccttgtagtgctatagagtactagaacttattcttcctatctagctgtaattttgtatttgttaaccaacctcaccctgttcttccctccctgctacccttcctggcgactgataaaccacagttctactcactgcttctgtgacttcaaccttgtctagctcccccttgagtgaaaacgtggtatttatcttcttgtgcctgacttatttcacttaacataatgtcctccaggctcatccctgttgccacaaatgacagaatatcattctttcttttttatggctgaatagtattaccttgtgtatacataccacattttctttacctgtttatctgttaatggacatttaagttgattccatatcttggctattgcaaatagtgttgtattaaacatgggagtgcagatatctctttgatatgactgattctccttcctctggataaatactcagtagtaggattgctggatcttacgatagttttacttttagggaaaacttcataccgttttccatattggctatactaacttatattcccaccaaaggtgtataagagtccccttttctctgcatcttttccaatatttatttttttttgtcttttttctatatggaacacttcacaaatttgcatgtcattcttgctcagggaccatgctaatctttgtgtcattccaattttagtatatgtgctgcctaagtaagccctgttttttgtctttttggtaataaccattctaactagggtgagagatctcattgtggtttgaatttgcatttccctgattattagtgatgtacagcatattttgcctatgcttgatcatttttctctttttgagaaatgtctgttcagatcctttgcacgtttttaattggattactagtttttttgttgttgttgagttttttgagttccttatatattctgggtagtagtcccttgttggttgtagagtttgaatatactttctcccattctacaggttgtctcttcattggttgtttcatttgctgtacagagttttttagtttgatatagtcctatttattaatgtttttgctgcctgtgcttttgaagtcttacctatatcatttttgcccgtattcccatatgctttcttctaatagtttttttttgggtcttatgtttaagtctttaattcattttgagttggtttttatatatggtgagagatgggcatctagtttccatttttctgcatatggatatccaattttcccagcaccatttattgaagaaattatcctctcaccaacatcaattcttgttgcctttgtcataaatcagttggctataaataggttgatttatttctgggttctttattctgttccattggtctatgtatctgtttttataccagtaccatgttgttttggttactgtagctttgtggtatagtttgaagtcaggtagggtgatgcctcctgctgttttatttttgtgcatattgttttggttattcaaggtcttttgtggttccatgcaaattttaggatttaaaaaatttctgtgaagaatgtcattgatattttgataaggcttgaattaagtctgtagattgctttgggtggtttgttcattttaacaacatttatttttccaatccatgagcataggatgtccatttttttgtgttcttttctatttatttatttaatttatatgtatgtttttgagataggctggtcttgaactcctgagctcaagcgatcctcccccacttggcatcccaaagtgctgggattagaggtgtgagccaccgtgcctagccctctttgatttcttttatcagtgtttctagttttcattatataaatctttcacctccttggttaaatttattcctaagtggtttttttgtagctattgtaaatgaaattgatttctttttcagctagttcattgttggtatatagaaatgccactgatttttaaatttttatttatatttgtttatttaaaaaaatttctttttggagacagagtgttgctctgtaacccaggctggagggcagtggcacgatcttagctcactgcaacctccgccttcctgggctcaagtgatccttccacctcagcctcccaaatagctaggactacaagcgtgtgccactgtgcccagctaatttttgtatttagtagagataggttttgctgtgttggccaggctggtcttgaactcctggactcaagcgatctgcctgcctcagcctcctgaagtgttgggattacaggcgtgagccactgctcctggctgctacggatttttgtatgttgattttgtgctactttaatgagtttgtttatcaattctaagaggtttttggtggtcttttgttttttctatatgtaagatcatgtcatctgcaaagagggacaatttgacatcctcttttccaatttggatgccttttatttctttctcttgcttaattgctctggctagtacttccagtactttttcctgtagatgtatctattgtgttgtttgagtagagtgctttggctttgttcctgggtgagcgcagtagtgtagtctctgtatgatttcttttttttttttttttttttttttttttgggacagagtcttgctctgtcgcccaggctggagtgcagtggcgcgatctcagctcactgcaacctctgcctcccgggttcatgctattctcctgcctcagcctcccgagtagctgggactacaggcacctgccaccatgcctggctaatttttttgtattttttttagtagagacaggatttcaccatgttagccaggatggtctcgatctcctgacctcgtgatctgcccacctcggcctcccaaagtgctgggattacaggcatgagccactgcacccagcatctttgtatgatttctttggctgtaatcactatcaatcgtgtcagtaattcctcagtggcttacgctgtagtttgtggaggctgttaggcactttttttttttttttgagacagggtctcgctctgttgccaggctggagtgcagtggtgccatctcagctcactgcaacctccacctcttgggttcaaacgattctcatgcctcagcctcctgggactacaggagtgtgccaccgtgcccagctaatttttgtatttttaatagagacggggtttcactatgttggccaggatgttctcgatctcttgccctcatgatctgcctgcctcggcttcccaatgtgctgggattacaggcatgagctaccgcgcttggcctgttgggcacttttgttggacataggggtgccaggcagtctggttctcaggtcactaggtgacacatacagctacatggcattcctgctgctggtgtggatggcaggctttgggtggactagtcctcagcactgtggtcattgtgcatgagggccagcagtggtagttgtgggccccaggtgaactggtcctctagtctctgcactgcatgcatggcagtgtggcagctctactactggaggggtggggtcactgtcagtgttggtggcagcagacctgggcaggtaataaggtgcaggtgcatggaagtcacacaaggtacaaacctcaaagaagggccaaatgggtgatgcctacataccctcttcatagggtggagggaaggggagtatgtaggcaattttagaggaagagcaaattattttgaggggagatgaatgggcccaaagaacagacagtagcctaggacaaaattcatctgggctgtgtgtgtggcacctactctagtcttctttcatgtgagttaatcttctgtgtttggtgagattatagggagggggcccaagaaaatagcattccttctgagggaacttcagagaaatcgtccctttgcacttcaggagagacaaagggaagggatgagagaccgtggccgggatggtgagagaaggtcagagagaccttcgttctgaggctgcttctttacttcaaagtactcagcatgtcaaagtgacatactctggggtattgttttctgaaccctaacaggatctttaaaatttcttctagtctttataattttggaaattataaatccttctagaaggaacacaatttggaaggagacttggcttaattacatttaatggttttaatttcaaagggaacaactggctcaaaaattttagtagtaactgttaagctataaataagggtgacaaacagccttctatgatttgggcaagatagaaaaaaatgaaatgaaactagggtgaaggttatagatagaatgcgtgttccaagatttggtgtacttactagagataggtggcaaaattccctgcactttccagcagccaaggcagtagggacccacactagcagttactcaatttacggtgatgttaaataggacagatactgccaccacttagtgttcagaaaagtgttttttttgtaggccgtcataaagagaattctcatgaattctgtcaacaatatccccttagctaatacagtatcagatatcaaacaatcactttttataatgtccctcagcctcaatcagtagcatgacaccaaagtacagtacaaacaattttctgggacttgaaaccatccagtccaagtaggcagttctctgaagctctaccttaatttaagaataaaatgtaagagcatggaaagcagttttttgactggtgattctcttttggattgcacacttctttgggaaatagatgataggtctagattcctttccttgtcaataagcatatgcatcatcgcacaaattttacatgttattttaggaaattcacaatttcagagagttcataatcccttaccctacccctcaccccttcacccttgtcccgccccaccctcctgccctgactgatccaggctcagcaccctggtcttcaaggctattgtgagttaacatggtaagaacatgcagtatgaggatggttgtgctggtttgacagattcctctgctttaacaggaagccacatcgaggatgggaattgattttcatttatgaaagttgatgaacttgacatctctgaacaaaagatgtttatttcgctttggtgagaatgtagtcaggaatgtgatttttcttagagaacagctaagcataacaaattaaaaagggccccaaatctccctctcatagaggaagctctaacaattttagcctagaaaaattataaggcagatattacaaaggaccatctgagctatcttaaaccaacaaattattggtattttcggtatttgatattcttggtacagagctcatagaatgtctttattttaagcaactgcagtttcttggtgaacctaaaataaaaatccttgtgtaatatatcttgggaagctgaataactttattttcttttagaattatttatcatcttatcatcaaccagttatttgttgaaaacgtttatccagttatatctgctttagattctcgttaattgtggtttcctttgcatttcagtgttctaatcttaggcgcttcaggcggagttggtacttttgctatacaggtaaaaccattttttaatcttgtgaataggaggattttgtttgcatgaatttataaattaagatacattatttctccttaaaagctgagagaaaggtaggtctggtaaatgtactgtaatttcagcttgttctgtaagaggaaaatattctttttttattagaaaaaattattttttagagatggagtcttgctgtgtcacccaggctggagtgcagtggcacaatcatagctcactgtaaggaaaatattctaatgtagaaggaagcattaagctttctagtagtttaatatgagtgggtgtgtggatgtccttgataacagacgtaggaaagcttttaagaaggaagaccatgggcagtgcaggtagatggaagttagcaatttaataggaaacagccaatgtcaaaaaccaatactagtttccaagcagaatttttgcaggctaaaaagcctgcaaaatgtagaaattggtaagctgattctaaaatttatatagaaatacagtagccaaaataccgttaagatggcaatactcccctgaagtgatttatagattcagtacaatccctatcaaaatgcaactgctttttttttgcttttcataaatggacaagttgaccccaaaatgcatgtggaatcacaggggaccccaaatagccaaacaatcttaaaaaagaataaagttggaggactcacacttgctgatttcaaacttactacagagctacagtaatcaaaacataagggtgaacttatagatcaatggaatagaattgagcatccagaaataaacccatacctctgtggtcaattgatcctgacaagaatggcaagaccattaaatggagaaaataatagttccttcaacaaatactgctggaacaactagatatccacatgcaaaagaatgaagttgagcccctacctcacatcatattaaaaaaagaaaaacaaccctcaaggtcaggcatggtggttcacacctattatccctacactttgggaggcaaaggtgggtggatcacttgaggtcgggagttcaagaacagcctggccaacatggtgaaaccctgtctctactaaaaatacaaaaattagttggacatggtggcatgtgtctgtaattccagttactcaggaggctgaggcaggagaattgcttgaacctggaaggcggaggtttcagtaagcctagatcacgccactgcactccagcctgggtgatgagtgcaactctgtctcaaaaaacaaaaacaaaaacaaaaaactcaaaatggatcaaagatctaaacataagagctaaaactgtaaaactcttagaagagtaggcagggaaagggaaaaaaagagtcttggaaggaaacataagacaaaatcttcatgattgtagatttggcaacagatttttagatatgacacccaaagcacaagcaaccaaagaaaaaaattcatcaaaattaaaaaaacttttgtatgtcaaagggcactatcaagaaaatgaaaagacaacccacagaatggaagaaaatatttccatatcattttctggtaagagtctagtatccagaatatataaagaactcttataactcaacaacaaaaagacagcacagtatttaattagcaaagaacttgaattgacatttctccgaagaatatatacaagtggccagtaagtccatgtaaggatggtcaatatctttatttattagagaaatgcaaatccaaaccacagtgagatactgtgtcttacaataaaaagcaaacacagaaaataaaaaatgttagcaaagatgtaaataaattagaacactcatacattgctggtgggaagttaaaatggtgcagacattgtgggagagtttcttgggtcctcaaaatgttaaacatagaattaccatatgacccagcaattccattcttaggtatatacccaagagaaatgaaaacatatatttaagcctaatcttattcatgaatattcatagcagtattattcataatagtgaaaaaaagtggaaataactatcagttgatgaatggataaacaaaatgtggtatagacatataatggaatattatatatctatattatatatcagccataaaaaggaataaaatattgatgatgatacagcatggatgaatcttcaaaacatgctaagtgagaaaaatccagaaacaaaaggtcctacatattgtatgattccatttatatcgtatgtttagaataggcaaatccacagagacagaaagcagattagtggttgtcaggggctgggggtagatggagaagggagtggggaatgactacgtaatgagtgtgaggcttattcttggggcacttaaaatattctggaattagtggtgatggttgcacaacattgtgagtgtactagagactactgtatactttaaatactttaaaattgtgaaaatggtgatatatatgaattttacctcaaataaaacaaaacaaaccaaaagttccccaagcctccagaaacatgatggggcccagtgactgctcctgttgtggtcagatgtgtaactgactggctcctagaagagggagcttgattaagactctctcaggatgaggggagagattcttttccccagtaggggccagcgagtagcctcagaggctctgccacattactttccaggagggaggtttgggtgttatagaccaccccagacccagcttagactttttgagaacccagatggtgctggaggcttcctgtctgtctgctgactgaactaggtgaaggaggcgaggattcctgggatgcacactttaacttcttttaactcatcatttgataatcagaatccaatccagaggctcagtaaatatgagttgaatacataaataaatagaagaaaggaaaagagggagagaggcaaaaagaaaagagaaatatcatacacagttggttagagtataaattgatacagccacttaagaaaaccatttggcatctactaaatgtcaatataaattgtaaaatttctaaaaaaaaaaaaaaggacagcacaagaattcctattttaggattataacctatagatagatatacaagtatgtttaccaaaagatatgtaccagaatttcagagcagggctattcctgttaaaattccccaactagaaaaacccaaatgtccatcaacagtaaaatgagtaagtaaattgtggtatattcttacattggaatattatgcagtcatgaaaaaactataattgcacacagtgaagtggatgaataccacaaccgagtgttgagtaaaagaaatcagatgcaaaagtacatcctatatcgttccatttaatgacattcaagaacaagtgaaactaagcagtggtgtttaagggtggtgtctacttagtaaaacttcttaaaaaaaaaaaaaagcaaaaagggttacactaaaggtccagttagtagttactttttaagggagttgaggaggttttaattgggaggcttagggacacaggtggtattctaattcttaattttgaatagtggttataataatatttgctttgtaataatttgttaagctgtatatttatattctgtatgcttttatttgtattatattttacaacaaaaaattttaataaaattaaaaagtaatagaaaagcatcaaggttaaatcccatacaaagctattataaggaaagggaaaataaggtatagaataacatgccctataataaaagcacatcagaatacatgcctacagaacagcctgaaatgtcacctactatttcaaagcaagttaaaagacattaaaaatataatacaagatgtgaaaaaaacaaaataaatcagaataggaaaaaatcaggaaaaaagtaaaactaaatgaaaaaatcatttagtaatagaagactaaactaagaggaactcaatagcaagtaaacacaacacataatgctccttaatagaaacaaaatgcatggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcagcctacaacgtgggagaaaattttcgcaacctactcatctgacaaagggctaatatccagaatctacaatgaactcaaacaaatttacaaggaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaagatgtggagaaataggaacacttttacactgttggtgggactgtaaactagttcaaccatcgtggaagtcagtgtggcgattcctcagggatctagagctagaaataccatttgacccagccatcccattactgggtatatacccaaatgactataaatcatgctactataaagacacatgcacacgtatgtttattgcggcattattcacaatagcaaagacttggaaccaacccaaatgtccaacaatgatagactggattaagaaaatttggcacatatacaccatggaatactatgcagccataaaaaatgatgagttcatgccctttgtagggacatggatgaaattggaaatcatcattctcagtaaactatcgcaagaacagaaaaccaaacaccgcatattctcactcataggtgggaattgaacaatgagatcacatggacacaggaaggggaatatcacactctggggactgtggtggggtgcggggagcggggagggatagcgttgggagatatacctaatgctagatgacgagttagtgggtgcagcgcaccagaatggcacatgtatacatatgtaactaacctgcacaatgtgcacatgtaccctaaaacttaaagtataattaaaaaaaaaaaaaaagaaacaaaatgcagaaaaaaattcaaattacaaaagaaacaaaaagataggctgggcacagtggctcaccctgtaatcccagcactttgctaggctgaggagggcagattgcttgagctcagcgattcaggaccagcctgggcaacatggcaaaacctcgtctctacaaaaaatacaaaaattagctgggcatggtggctcatacctgtaatcccagctatggagaggctgaggtgtgaggatcacttgagcccaggaggtcgaggctgcagtgagctgtgatcacaccactgcacttcagcctggacagagtgagacctatctcaaaaaaacagaaaaagataaaaacagagtcaagagaaagtatcaaatattgatgacaggcaaggaaaattgatatatggatactaggagtcctcgaaggggaaaaccaaagcaagggaattgaacccatattaaaacaataattaaagaaactttcctactgtcctgaaattaaatgatttgaaattacatattgaatagacacatcacttttctaaggacatggacccagactgagcaacactaaggaaaattactaataaaaatgtggagaaaaattatagtgaaattactggcctttaaagaaaaaagaaataagatcctttggaaatctagacaaaatagcacatgtgctacttatgtgtccatataagaaaaaagatgacgtgacttataagagaaataaaattagactatcatgagactttttggcagtaacacttttggcagaaaaaaatggagtaacatatttaagatactcaaggaagagtgcgccaagaatcttttatacaacaaaacaggccttcaggtatcatggacacatacagactgttatcaacatgaagaacgtggggaatattgttcttctgatccttttctgaggaatctactagataatgagcttctgactaggaatgactatgaagacattttaaggactagtggtaaatgttcaacacaattacctgtagaacaaaactaaatgagggcttagaaggagagagtgtaggaacagccatatgttctgataaggtaaatacagtgcaatagttgtcattatttttgagacagtgtgttgctctgtcatccaggctgagatgcagtgacatgatcacagctcactgcaacctcaacctcctgggctcaatgatcctctcaccccaaactcctgagtaggtagaactacaggcacatgccaccatgcccagctaattttttcacgtttttgtagcgatggggtcttgctgtgttgcctgggctggtctcaaattcctggcctcaagcaaccttcctgcctcagcctcccaaagtgctgggattttgtagtctcaaattagaattggaagtatcaatatgaactcaagagatattttgtgtatgtgtgtatgtaaagccatcacttgaaatatcatttctcactgaaacaaggcagggcttcttagagaagtagctgatttcagatctagagcacaaatataaagaattaacctggagtatattaaatagcaaggaagatatcaaagactagtcaggtcatgtcaaaagactcaagagctaacttgaagaaatgcccaaagatgtaacagtttgagcttcagtaataataatgaccattacaatgggttgaaaccttttaaatatatttaaatccatgagttcatgatacttttttcaaaagaggtcacttttggaatttgatagggaaccaatttattatcttataaactgataaagaaaaacagttaagcatttgtcttgcctttcctacattaactgtataattgagcagacaaaataatatgtgaggggcagtgatatgaggggcagtgttattttgtgaaagtattcaggctggacgcgttggctcatgcctgtaatctcagcactttgggatgccaaggcgggcagatcacctcaggtcaagggttccagaccagcctggccaacatggcgaaaccccttctctaataaaaatacaagaattagccgggcgtggtggtgggcacctgtaatctcagctactcgggaggctgaggcaggagaattgcttgaacctaggaggcagaggttgcagtgggcagagatcacgccactgcactctagcctgggacagagcgagactgtcccccacaaaaaaaaaaaaaaagaaagaaagtattccaactacttaaataaaagaagtagaattagaagatcactatttcgcaaccaccaataagcagatatgggtattaagcattgacagctgctaagataataaagagagcctcaagcagacatgatgtgcctcctctagttttgccagacactgtccatagttttgctaaagggattgaaatggaatcagatctagtctccagatccatctgccgagttgcagaaaatacagaggacagagcgacgtgtggaactgtcccgtgggtgtgcagttagaaattccagactgtgggaaactccacagatcaaatggcctagattcttccatagataaattataggaaagcaaagggatagaacaggagcctatgatttaaaagagacttaaggccgggcacagtggctcacacctgtaatcccagcattttgggaggccaaggcgggtggatcacgtgagctcaggagttcaagaccagcctggccaacctggtgaaatcccatatctactaaaaatacaaaaattagccaggcgtggtgtgacgtgcctgtagtgccagctactcgggaggctgagggcaggagaatcacctgaacctgggaggtggaggttgcagtgagccgagatcatgccactgcactctagcctgggcaacagagtgagactgtctcaaataaaaaaccaaaacaacccaaaaataaataataaaaaaagagatttaaaagataccacgttttaagaatgcacaagactatagtgtctagagactgcattgttgggtgataaactttttgaaatgcaaggaggtgattactataaaaatcagaataattattttgggaaagggtaggaggggcttctgtggtttggggcacatgggagaatttttggcatagcttccagtgtgctgctgctttatctgggtggtgttcaccctatagctgttttctttctttctttctttttttgttttttgttttttgagacagaatctcactctgtcacccaggctggagtgcagtggtacgaccttggcttactgcaacctccacccccgccggctcaagcgatcctcccacttcagcctcctgagtagctgggaccacaggcatgcatcaccaggcccagctacttttttgtatttttagtagagacggggtttcactacgttgcctaggcaggtctcagactcctgagctcaagtgatccatccatttcagcctcccaaagtgctgcgattacaggtatgagccaccacaccccgtctataggtgttttctatagttgtgttttatattacatgaaaaatttttattaagtaaaactgtttttaaaacattttcataatgttcaaagataataaatagctctaaatgggaaaggaaaaactagaaatttgaggggaaaaaccagaaatttgaggaaaaaaacctgtttcaacatgtgacagattcttcctgaggatttaatactgtttaaagaaaaacatgtattaaatgtgggtgcttagaacatacttttctttttcctcaatagtttcttttttaatataggtatagagaaaggatggtcacaatgagctattcatcttggattatattcttcacatatttgaatttgatttgggacttgctgtgaaaagcaacgtatcattacactcaagtgtctctgtttgcagcccataaacaataaattgtatatcatatcactcctaaatatttcaattccccacagattttcaggatatataagtctttggtcaatgttgctttttaaaagtgagaaattgggtaagattatgaataagttaaaaaccctttatttacattttgtatttaacagaaatttactaagcacctttgtgtgccatggagtagggattcaatagtgaaccagacaaacacagatcccttgtattctagtgagcctttatatcttatattaaggaagttcaggaaattgatacttaggacaagattgagaaaacaagtgatctcttatgatctataattatctgcacaaaaatttcttagtaatcttcaagtggctattctcaaattagctgaaaatagcccccttttaagtctatgaaattaacattatagaaaagaattttagcaattttggagcagaatgctttctggatacttaattctgaataacattagaatttagctctccttttaatttaaatctagttattctttattattttaaaatataaggcatctgcattttaaaacctgggtaacatttatttaggttttcttactccaagggagaggacctgatccaagtttttaagaaaaaatgattatagtttcttccccttctttttaagagaaccttttcatatgttacctattacttaatagctcattactttgacacgctttctgattcaatattgtgttaacacttattagagatgcaaatgaagatatgtggcattttaatgttctgtatacattttaaatagtcatttttctgaagacatactatttttgggccatttaactttgctatccttgaaagtgctaaatttgaggcttttttttttttgagatgaagtctcactcttgtaccccaggctggagtgcgatggcacgatcttggctcactgcaacctctgcctccggggttcaagcgattctcctgccttggccacccaagtagctgggattacaggtgcccgcccgctaccatgtccagctaattttttatatttttagtagagacggggtttcaccatgttggccaggctggtctcgaactcctgacctcaggtgatccacctgtctcggcctcccaaagtgctgggattacaggcgtgagccaccgcacttggcaaatttgaggctttcaactcctgtcttttctgttactgttgaggcactgagtccctctctaagtggattagttataacttcatgacaataaggtggctggctgtctcatgtagggaaaatgagatctctttcttgggattttcttactgaacaaaagtttgaccatttttactagtctctgacagatggcttcctatagttctggttaagatgacgtacttaaagttctctagagattagtctgatatatgtatacatggtgccaatgatttttttttcaatgcagtcagtttttctaatctctcccttttttattctttttttctttttggtggggggcaggtaatgaaagcatgggatgctcatgtgacagcagtttgctcccaagatgccagtgaacttgtaaggaagcttggtgcagacgatgtaattgattacaaatctggaagtgtggaagagcagttgaaatccttaaaaccgtatgtattagaacaatgttcacactgggagtgggaacaaggacagttgattatgcaggtctgagatggcttggtggctttacaatcatgttggaatcttgagaaggatctatgaaaacattccatgtcactagaagttacttaggttggcttctgttttaattccagatgttaatacaacacagtaacagcatgtggataggcactgaggaagttattttgcttacatggtctttgctaatttttaagttagcatgctggtttgtaagaggcctgaagacaaaattggaaatgtgttcccttctgtggcatctgtcaccacaggaagaatatagagtagttcatgaaatacatgattagcccaaaacatactttcgtgttttggcttaaaaaaggcttaagagaaacagtgtaagtctaaatcttggtaatgggagcactgtggatgttcccagtgtgtctgaatgccaggctgtggtttggcctgaggtaccaagcaggaatgcattcaggaattctcttgggtcatgttgattctgactgtgactccagcttattcatctgacctttatccagccaagaccaagctgaagctgagagcagaaatgaggagtatttggaaagctattttactgcttctgtttaaaaggttttcccttttttgattagttttcagaagtcaactactcttgaccacattgagtagaagtatatttttaaagagaaagaaaaaagaaaaaaaagggagtccttatctgacaccgcccagcctttctcagccagtgccaccaacttctagcagtagtttggtggtgcacccagcagcagccagccaactcatcattccttcaactgttcagggagcttctactcttgccaggcagggttccaaacaccagctacagtggtgaaccagacaaatgcccactttcatggagcttacattcttgtttgggcggttttagtggtaggtgctctgaaaaaaaatgaaagggaatagatagggaggaggctgttataaatagcaaggttaaagaatgcctcactgaggaagcaacatttgagtggaggctttagtgagcaagtcaaatgaatgggatttgtgtgtttgtgtgttgctccctgctgtatccctccagctggaagagtgtagtagcatgtagtaggtgcttaataatatttatttaattattgagggaatctaggagaacaattgttccagctggaaagaacagcaacctaaagctcccatgtccggaacatgcctggcatgtttaaggactaacattgtccctttcagagattttgtcagctaccgtcttgtctgtgtgtcagggcctaagcctctttgggcgccttgagagtgacgacatgacaggtctctgagatctggcttctagaaagcagtagtttaggttgatcttgtatcttttttttttttttttttttgagatggattctcactctgtcgcccaggctggagtgcagtggcacgatcttggctcactgcaacctctgccttccggtttcaagtgattttcctgcctcagccccccaagtagctgggattacaggtgtgcgccaccacgcctggctaatttttgtatttttagtagagatggggtttcaccatgttggccaggctggtctcgaactcctgaccccgtgatccacctgtctcggccttgcaaagtgctgggattacaggcgtgaaccaccgcgcccagcccgatcttgtatcttctgatgcttctaggaatagcaacatgatactggggccaagttctacccattcccctctatctaccttaaggggttttgttttgtttttttgtatttgtttttgtttgagatgaagtctcactctgttgcccaggctggagtgcaatggcgtgatcttggcacaacctctgcctcctggattcaagtgattcttgtgcctcagcctcctgagtagctgggattacaggcacccaccatcacacccggctaatttttcaattttttttttgtggagatagtttcaccatgttggccgggctggtcttgaacccctggcctcaggtgatccgccttccttggtctcccaaagtgctgggattacaggcatgagccactgcacctggcctaccttaagttttatacatgtctggaatttgtcaccagagagtaggagaacttgacagacggaaggctagaggacactcagtctaggctcccaaagcggtgctatgcttccctccttggcatctcttcctggcaagtggtcttgctcctttcgcttgtacttttctagtagggggaacttcgtgacttataaatgcatgccgttactacttcttttctttgatagctttagttaaaattgatctttgtaatttctgcctggagtttgacctctcagtctacctaggataaatatgttcctccttccaaatagcagctttttaggtatttgaatcttagagttttatagcaagaaggggctttgaaatccttcagtccaaccctatgatgctgtagttgagaaagtgaagggcagaggagttatgagtttttgcatacttgaggtcatgccaccagtcatttgttgggagagctggatccacaacctggtctccagatttctttctcagacaatgcctgttctataataccaggctgcccttaagttttctttaagttaagtatcctcagatttgttcattcaaaacttggaaatgaagtagacacttttttagtgaaaagaatggtcatctattaaggtcatcatgctcctgcatttcatatccttagattttaattgccttttttcttcttcttcttcctcttcctcttcttcctcttcctcctcctcctcctcttcttcttctctttcttcttctccttcttcttctccttctcctcctccttctcctcctcctccctccctcctcctccctcctcctccctcctccccctccctcctcctcctccctcctcctcctcctccaccgcctcctcctccttcctcttcctcttcctcttcttcttcttcctcttcttcctcttcttcttctgagtttcgctcttgttgcccaggctggagtgcaatggcatgacctcggctcaccacaacctctgcctcccgggttcaagcgattctcctgcctcagcctcttgagtagttgggattacaggcatgtgccaccacatctggctaattttgcagttttaatagagacagggtttctccatgttggtcaggctggtctcgaactcctgacctcaggtgatccacccgactcggcctcccaaagtcctgggattacaggcatgagccactgcacccggccttgcccttctttattttagttctataagatactcaagatccacaaagttggccaaagtggttttaggaactttaatgtttgacatcatccagatgaatttgggagaaaagatttaccaaaaaggaattcatcaactgatttgctcagtttatttgcatgtattctctatatagatctttgttttcaaaattatttcaaagcttatttttatcccttttcaatagaatatagtgattacagaagttttagtttagatgtaagaagttgaatatctgtcagtttctgtggattccattatggctgaatttttttggcatgttagaacaggctgttcatttctccttttgcattgtcctgatgctgtacctgaaaccaaatgatagaaaatttcagaaggtgaagaggatgcttccatgagcatttctgactgtaaagagaataaaagcaaatcattcttgtaggtgaaaatctcatattttactttcaagtatccatgtgcactaaagaatactttatagagaatggaaagctttgcagttttttacaaagcttaattaagtcagactttctcaaccttggcaaccttagtttctcaactatcgacattttgggctggaaaattttttagcttgtgaggggctattctgtgcattgtagtgagccaaaaccactctcttttcagaactacttgctgaagccattctaaagtactagaaaatgaaatgattttatgacaaaaattagtcacattaaacttaccttggagaaaagtcatagatccagtgaatgagtatgtccttccatctccatcaaagcagccacccctctgcaggatggcgaggtgcagcacagtttaagatttgtcactgaaataaaccctaagccaactggtactggaagggaaggaggatcagagtccagtgtaaagcctgacaaccatgttttgatttggttcttcctctccagatttgattttatccttgataatgttggcggatccactgaaacatgggctccagattttctcaagaaatggtcaggagccacctatgtgactttggtgactcctttcctcctgaacatggaccgattgggcatagcagatggcatgttgcagacaggagtcactgtaggttcaaaggcattaaaggtaggaagaagggtcttggttggtgactgcaggcagcctcctgctgctagaaattggtttcccacctagccagtttctcttctcttggaggccgcatagcacggtggttgcaagcatggactctgcagtcacagtgactggcttcaaaatctgacctctacttagtagctgtgtaaccctgtgcaagttactgaatgtctctaagccccaatgtcttcccctgtaaaatgaggctgttaatagatctaccttactgcattgttgtaaggatcaaatgaagtagtccatatggagacatggcataatgcctagtacataaaaagcccttattaaatgttgcctttattattacttattgcctctcttgattacatctgatgtactgtctgtgcttccttcttgtctctacctgatgaccctctctctgtttcatgtcttaacacttaaagtctcttgtatataaagatgaaaacttacagctgctgttttcattgtattgggatagaccagtgattcccagactggggctttcagacatttagaggtctatgagtaaaacaagttgtacttttacttgagtaagcctccactcatgcctctgctgggattgtatcaacttgttctaacactgtgtattccgtgtaaatttgaaactccagctattaatggcatgatgggagtttctgggacttggttagtcagcctgactcagaaacagggccacttttaccagggctgtatggagctcaaaactgaatacatctcacccaaattgcacacatcggtgagtggcgggccttggagactagggcagatgagcctcagttacaagactaatagcagagcttgagcgtctgctctctactttacctcgtagcctgttgtcatcacagtggggagagaggcttttataatttcatgggataaactggtggtaattatagatcattggtttaaaatatgaattgatgttaaaatggaatacatgatagaaaaaataaagataggctgggcacggtgtcttatgcctgtaatcccatcattttgggaggtggagatgggaggattgcttaagtctgagaagtttaaaaccagcctgggcaacatagtgagagcttatctctacaaaacaataaaaaaatttgccaggtatgttggtgtatacctgtagttcagctgctcaggaggctgaggccagaggatggtttgagtctgggagacagagggtgtgagccatgatcgtgccactgtactgcagcctgggcaacagaggaagacgttgtctcaaaaaaaaaacaaattctatttttttaaattaagcaaaatacttgagactctggaacaaggcagtagaaagttcctcagtggtaaaaaggctgtgagtcgctgtgtcagtccgaccaacgctgacccacgtttgtgagatgactggcttgataattatctttagcattttatttattccagatattaatttgggaccttttatggggatgaaacttaggactttggtctcttgaattctgtgtactaagtacttagaggtcgtaacaaagagctatgatggaggagaccacgactcaattcttatgaaatattatgggtaatagaaatgaacaaaccaagcgctgcactgtggtgttctttattttcatttgattcagacagtagccagaaacagtgtccacagggtactttgtggagaaagggctcttagctgtcccttgtctcttctttctctttcacaaaacccagattttccagtgctttaaaatgtaagtttaagttttctgtaagatttcagtttgtactccagtgagacctcttacaagttaaccttcagagttgtcctcggagagtaaaacaggcacagctctcttcattctcttttcctcctacttgaaagatgatagtggtaatctcatgtgaaaaccttttaagtagttttcaatgtctttctgattgtgcacgtagttaaagcctcattgtcatgcttctgactctcctacctgctttggtttactttctctcctatagtggcctgggtagggggggaataacacagacctcttatagcagaatattaaaattctgctattacagaccaaaagtttcactttacagagccacatgctgtgaagagttacagatgtggcagttgtgaccatttctgttccttctttaataccctaaacaattaccagaatgttttaattgcagtctatgaagccagaccttagggaaaagtatttgaacagatcttctgtgattgtcatttactggatccacagtaagcttgggacattctcagtgcttctggcatttagccacataattcttcaaacagcttttttctttttcttgttttgtagagacagagtcttgctgtgttgcctaagctactcttgaactcctagcctcaagcaatcctcccaccttggtctcccaaagtgttgggattataggtgtgagccagtgtgcctggcctcttctttttaagttagttgcataaaccagtgcatctcaacatctttcatgccatgacagacatagaaaatgatagtatttgaacagcatgtagaggctgccttgggtaatagagatgaacaaaccaagccctactcctctaagaccagcctatctggagacttctaccagccctggctttgcctggctatgctgagggctaaggggagtcaatatctcatcacaccaattctagagtaagcttgactctctttatatctgtagtcctagggtaattattaatgatgaatcctttagctctcacaggttttctgggttagacgataatctatagggtcactcacccagtaagccatcctggcacacccagtgggaagctttgcctaggcaactgcttagttttttctttctttccacattcttaaactgaattggtattgtctcagtctttcctcagtaagtttcacttttagcactggacaagtattgatagaatacttcctatgtgtgaggcattttgtattcattctcatttaatccttccaacaatcctgcaagctaggtggtggtaccaccattctacaggaaatgggctgaaagaggtagcctgacaaaaataacataactaaaaaaaacaacaaaacaaaaataatgcaactagtaagtgctgttgtagggggtttccattgcatttttcagcctcacgccatggtagtagcttatatcatactgagtgtaagctcaatggcaaagaagtctgagctcacctcgcagttgtgggtagttgtggagagggcagcactgtggtactggctgaccctctgctacctcacattgctcccatctgatgaaggtttggttgggcaggtcattgaggtatcatggagaacctcagctcgtttgctgtttccgtaatggcctaccctacctttgacataaagaataacaattacagccaggcacagtggctcacgcctgtaatcctagcactttgggaggctgaggtgagaggattgcttgagaccaggagttcaaaaccaacctgggcaacatagcaagaccctttctcaattaaataaacaaagaataacatttataagtggcagtagagtggtcatgaaccctcttggtgtaagatttgtactcatcttcatttggagggtattgccctgtaatagatgagatggctttgtatttgccataaccatagggaaagattcagccgtgatgtataaggaactttgcactttgttttccctttaaagccactttattcctgtcagagccagaaaaaaaaattgtgattgggcttcttgtctaagatcatattttggtgacttattgtccccaaaacatttttgaatttggtgaaaacctcttttctagtgcctctgggctttattcaaaccttagtagggaaagcctagaggtctcagcccgattcctcatggggaggaaacccactgtggaaaaccatttagatgatcattttaaggaaagctttcctgtgcttacttgttcttcagttacagtttagagaaggagcctgagtgacatggatatgtctttgttcagttatttatttattaaacatttatggagcatccattctctgtcagtcattgtgccaaggtgctgtgcacacattttgtcagcatgaaatgagaaatcagtttgttgtagtcatccagaaaatgcttttccctaaatctgcatttagtcagattttatgtttttctgtatttgacatgttttgttttcttctttttagcatttctggaaaggagtccattatcgctgggcatttttcatggccagtggcccatgtttagatgacattgcagaactggtggatgcgggaaaggtacgtgcacctggaaacctggattggaagcctttgtatttctacagcacctcctgtagacctgcccactgagcctcgttagtagggactctacagaggtagcctgctcacctgaccttgtgctgccttacatggccaagtttacatgctatgtctttggttctgtctccatgggaggcatagacacagactgctccatctgcacaagagcttctctcatctagtcaaaccgccttggtttagtagatgaagaggcgggcccagggaggttataggattcccccaaagacacttggttaggtcatagcacagctgtgatctacattgggctgctaatattttatcaggtccccaggtctcctgatttctaggtgggtataataaaatcaagggcaaataaatagtccatctgagacagtcagtggccagggctagggtgagtgaggattgatggggatttgggtgaagacaactggctggtgtactctgcctactagtgtctgtcctgccgtggactctgtgggaaaggggctgttgcttatcatctggtcatcgttttttggatgtcaaaaggtctttcagggattctggggattgaaagcctcctcagctgccacctgcttatttgggtttttacatggtctaaaccaccttgacatcccatctctagaggaataacccagaaggtggtattctggtgctgatattttttatgttattgagagattatatggacttataggatggagaacttttagagggttgtgtgagatcatagatagggtgattctcattttacaggtgaaaaagccaacttgccaagaaaaaggggcatgctcaaacttgcagaaatggaaccaaaactcttgtgcttttccctctccacctttcagctgtattcttagtgcttgaagctgatttgagacttcagcatacattgtcttatctttgtcactttgcagtgggcagggactggagttagagcaggctagcattagcattgtgtgaaccactctgagacacttggacagagcccctggaggtgggctttcttattctggcccctgctccttgctggcatatttcatctttccgtttcgattttggaaaggaatatttttgggaactaatggctgctttttatgtatttaaggtttttcttctttcacagccaaggaactatataagaggatggcctgttattatttcccaaatatttgggttccaggcttatgtgtcttttcatggacttctaagttttggtgtgttctgatagggacaggggctcagtgttattgtgactgtgtaactcctcctttgtggggttctcccacatcccacaggaatgcttattttatttctaggaagaagagaatgaagtatcatcaagtaagtgcttcatgtggttggaaccctattattagagaggtctttgtcctctagaagtccacgattgtgcttgtcctgctatctgctccaggctgtccacatgcttaccactgctcttttgtattcaaaatattgtgactctctctctgcctggaaattactgtttacccaacagagatgagaggtgacttgtatatatctacctattacatttggcagataactggtaatggctaaaataggacatgataaacaacaacaaaaaaagatgtccttgaagtattctccaaggaggttgagtgagcaaatgtgccttgtgctttgattctcctctcctgcacaagctgtttgggcttgggagtcatttctggcaatgaggggttctgggactgtgaagttggtatgtggcactggatgccttgatgaggccagctctcttgtcgtgtccttgcttctgtgtggatgtgagaggtcattgcctttttatcctgggaaattagaaggaatgacacagcagatcttacttatgtgttgtgtggttggtagagatttgttaaattggaggaggacatttaaattcttccaagctttggctgagcgcttcatgattctcattagcaggtaactgttagaaaagctacagttgttttttgatcgtgaaaagctgtgaaacaacagagccaactcttttaaaatacttgaactttgaaaaaatacattcataaggttcaaaaaccctaaagatggaaaaagttatttcaagaagtcttcttttgactgctatatctcagtcactgagattctgcttgtcagatgcaaccaatattactagtttcttgggtattccaaagatactctatcaaaacaggaaaaataatttttttcctctctctctcttctttctctcctaacaaaatggataacatactgtgctgcaacctgctttttttttttttttaacagcatatgttcaaatttgttttatgtcaggatataaaagctttctcattccttttttgttaacagctacatagtatttgtatgggtgtaccataatttgtttaatttcagtcttttgcaaacagtgcttcagtggataacccaatatttatgtttagtacctaattgtatatataaccatttctgtttatggaaatggaattgctgagtcaaaagagatatgcatttataattttgatcgtttttttttttttttctttgagacagagtcttgctctgtcgccgaggctggagtgcagtggtgtgatctcagctcactgcaacctccacttcccgggtacaagcgattctcctgcctcagcctcctgagtagctgggattacaggtgcccaccaccacacctggctaatttttgtatttttagtagagatggggtttcgccctgttggctgtactggtcttgaactcctgacctcagatgatccacctgccttggcctcccaaagtgctgggattacagacatgagccactgcacttagcctttaatagatattaaaatagacagcttttgaaaatctagtatatatatttagtgtctggaatttatcttgtggcctaccttctaggccccttctctctttacttacccattatcttaccctctgaaccattttacttcattagagacttgtttttaagaatgtgaagaaggtctggttactggtcacttgtgatttaaactatctttttttttttttttttttgagacagagtcttgctctgtcgcccaggctggagtgcagtggcgcgatctcagctcactgcaagctccgcctcccgggttcacaccattctcctgcctcagccttccaagtagctgggactacaggcgcccgccaccatgcccggctaattttttgtatctttagtagagatggggtttcaccgtgttagccaggatggtttcgatttcctgacctcatgatccacccacttcagcctcccaaagtgttgggattacaggcgtgagccactgcgcccggcctaaactatcttaatatctgagctgggcgtggtggctcatgcctgtgatcccagctacttaaaagtttgaggtgggaggatcgcttgggcccaggagttcaagaccagcctgggcaacatagggcaatcccatctcaaggaaaaaaaaaaaagaatctggattaatgagtattactgatagagtctaaattctgcttgttagccctgcatgccccagtaaaaatggagaagccaccgagttaatatccacaataatgagcactctctgtcaatctgttaatagcattgtccttctaccttctttatgaacaacaaccctacctttgctttctcccagtgcagcactcagtaaatgttttggtttcctgcctttaatgtgctcactattgtcaggctcaaaagtgaagaggagctgaaatttcctaaatatgtggtgacctcacagtctgtttttcctggagatccagtcttaggcattgttttcacatgactgtcatcacgaagccttattgcaagtcgtaggactccatattcatcctatctgggcacaatttcagtttgaattttaagttacctagtattttcattatgtcttagataaagtggttggcaaactacagcctgtgggccacattcagtctgaggcctgtttttgcacatcctctgagccaagaatggtttttacttttttttttttttgagatgtagtcttgctctgtcaccatgctggagtgcagtggcacgatctcggctcactgcaacctccatctcctgggttcaagcgattcttctgcctcagcctcctgagtagctgggactacaggcgcctgccaccacgcccggctaattttttgcatttttagtagagacagggtttcaccatgttggccaggctggtctcaatctcttgacctcgtgatccacccaccttggcctcccaatgtgctgggattacaggcgtgagccaccacgcccagctggtttttatatttttaaagatttgttaaaaaaaaaaaaaagaagaagaagaagaacttagaccatgtgaagcctgcaaagcctaagacattcactatttaggcctttacagaaaaagtttgccgatccttatcttaaactagaagttaaatgttttttaactgaaacccagtcaggccaagctccagtttacagaataggcagaggaggagctgctctgctggtgaaatggtggcagggagtgacctccccgacaaatgttctttccccgcagctgctccacacagccaaggagccctgggctcttggacactagtttgcaaactgctgttctgggcattctcaaaaagaatgatttataattatccccttaagcgtactgggttggtactgacgtgcctcatgcctacagtttattggcattttctcctaagcacaaaaaacagttcctgttttcatactatttaacacacttactttttggtgggaggagatatagcaaaaattctattcaggtcacgcatatgccattgaatagcatactcacagactggaaagaggaaagctttgcacttgtctagtttactgtcttcatccctttatccctcatcctgctgtgatgtcacatttgaagggacagaggccctaagaaattaaatgatgtgttcaaggtcacataggcagggcccaggtctcttgacccttacgacagttccttctacagtcttcattgttttctgcttaaataatcatccagacattgttacctagagtttgagttcttggtattttactctgtcatcttgtatttctcagtatcttgcaggactgagaggaggtggtggtgaggcagtcttcagatgatacctgctgctaagaaggactgtgtaactgtgttttgaaggaaaatatttatacatatttgcttatatatgcatgcattagtttcctattgcagtaacaaattactatgaatgtggtggcttaagacagcacaaatttattatcttataataataagattttggtcagaagtccaaatgtatgggcagggctgcattcctcctggaagcaggctatacgggaggatctgtttccttgccttctccagcttctagaggctgtacctcccttgacttgtggctacatcactccaacctctgcttctgttaatctttgacctctaaccctcctgccttccccttataaggaccctgagattacactgggcccacttggataatccaggataatctctgcatctcaggatccttaacttaatcacaccagcaaagtccttttgccatgtaaggtgccatattcacacattttgggaatcaggatgtgaacatctttgggggccattattctgcctaccacaatgcataaaatacttcaaaaaggttatgagagcaactagaaaccttggttgctcctgaggtgggaaaccagatggctagaaatcaagtatgggaggaagatctttttttttttttttttttttttttgagacagggtctcactttgtcacccaggctggagtgtagtggtgtgatctcacctcgctgcagccttgacctcctgggctgaagtgatcctcccacctcagccccccatatagcactacccagcactacctcttggacaggaatgcccctgaccagctaaattttttgtattttttgtagagacaaggttttgccatgttgcccaagctggtcttgaactcctgagctcaggcaatctgcctgcctgggcttcccaaagtgctaagattataggtgtgagccactgcacacggccaggaagatatttttgaatgtttattgatacatgtatattcttcatctaattagtaagccttctgatgttaggagcttaatgttcacaggtatattcaaaatcttagatgccagccaagcatcttggttgaacagtgatatagatttctcagttgatttattttagccagcatcagaatagttcttatgcaccatatttgagttcaattcagaacacttactgaaggcccactatcacttacttgacccagtagatggtggagaaatgtgttggtcacactcagttaccttttgagcagcctgtcctctagaactttgtgcagtgatagagatgttctctgtctgcagtattcacttggtggccactaagccactgagcacttgaaatgtagcaagtgcaacttgagagactgactttttcattttatttacttacttttgattaacgtaaatagtcacgtgtctagaggctaccatattggacactgcagctttcgagaaaaatgtaatgagttctgaggtaggtgatttcccaggtccgtcttgaatagctgggccctcgtttagcaacgaagtacattctaaaccttaagttctttattgccactggattttgctccatagaaagaatgtagtgattagggactgaatccctaggaccactggaagagggctgccttgcctgatgtggcaagtatctcatggatcccatggcctcaatgcttctgaggtttttctgatgctactgaaattgtttctatgaggaaatttatatggggtttctcctctcaccttctggctgttggaagtgcattttttaggggtacctagggacaagtccttgatgctttcccaaatggcacacttactcccttggagagttcccccatctgccatccccctcctgtctcaccccatcttccagttttgagtttgccatctggggcaggaagtttccgagaaacagcaactgagagcaaaattcacctcttccttttgtcttctttttgtctaaaggtagactgagtttaagtccccttcttcccctttaccccaacccaggaaatactgaacctttcacagaggtcaggggcatacctgtccaggaggtagtgctggaactgcggtcctggtgcctgtccacaggtgtgtggatttggactcagaccaggagcccttaggtcttccttggtgtttgtcacctgtcagtgtcccctcacacacctcaccctctgagatctgcagcctctgtgcctggtggaagaagaggccaagggtctaggaaaagaagtggaatagactgtgacttcccagattacatccattccatgcagtaatgacattaggagtcctgggtccttgttttggctctgctattgacagctctgaccttgcacttaccactcaatcatttgcacttcagtttcctaatctatcaaaagaggcccactcggatatgttaactctactgttttgtgattctcactgggaaaacgggaattgagggaaaacctctgcctgctgccatggctgcctagacagtgtccttctccaccagcagcttcatgctcttgcagtagtgagaggttttctgtaccgtcttccgaagcctcaagtgttagagagggtttttgcctcagcaggaaggaggacttgcctagcgtcttgtaagcagcaatattccaaggccacatccagagaggttaaggttcccgtcgtccctacgttctcacagaagtgatgtcaggcagcgggtgccaaatcttggggcttggcttggttcagcctttgtatcagggatgcgaggcacaatcagcaccccacacatgaatccaagactgaatgagggctgctgctgtgagcgtccctggccggctgtgagcctcgtgtgtctgcgcagtgggaagcatggtgttgagcctgcccgctttataacagggctccctgtgccaggtggactatagcagcgtcatcacataaacatccctacttcactgtgagtaacctttctttcccccctctgtattttaactctgatccctttgtccttaacaaacaagtattctaggcctgatgtgaggctgtacatagacactgtctcattatccagttaatctctgtttgctgtcacagattcagccagcagtggcatttgcctgccttcaatttgaaacctttttttccattgtcacttacgggaattgctgaatgactcattgtgccgtggtcagccctctcgggttatttgccacaataggcctgaccagccagattaaagtgggcagtaactgtaagctgcctgtgtcatcagttcaggatctgtgtccccggtcagagctctaaattgaacattcagttcagccggttttggtttagtgccttaggaggcaggcactttgtcagtctgtggaatggatgggtatgtgcatggtacaagttagggattccaggaataaggcaaagggctgggtgagtcccactttagggtgcatacagatcactggggaagcatttttctgccccaccccctacaggttctgatgtagttgttctaacaggaggccttggactctgcattttaggcatgcattcaggtgattccttttccaggtaaacagcatcctgaaaacagcatcccaggggctttggaggagtgataggttcaggtttcatgtgggacatacaggaaacaactggtttttttttttttggagacagagtctcgctctgttgcccaggctggagtgcagtggcgcgatctcagttcactgcaacctccacctcccgggttcaagtaattctcatgcctcagcctcccgagtagctgggattacagacacacaccaccacacccagctaatttttgtatttttagtggagataggtttcaccatgttggccaggctgtctcaaactcctgacctcaggtgattcgcctgcctcggcttcccaaagtgctgggattacagatgtgagccactgcactgggccgagaaacatcaatgcattccattctgcaacattaatgcagtccaccctaaagtgggactcaccacagccctctgccttattcttggagagaatagaagacaaataggcttcgtctcacaagccagctcagagcagttaatagtggctgcagtggtgaagattctgaggtcatgctcagcttgtgggggatcagcaatagtgatgtcctccataggcgtggatggcacccgtgtagcacacatctgtcatcttggtggcctggacacagggtcgagagaccaggtcctcagctggcacaaggaaggcaggccaacatgcaggctgtgataaatccttacagtccttggctacctttcccttcctttaaggttttaggggtaggtgtagacagcagcagatgctataggaaaggctcagtgcataatggtgatagcagatgatggcatcagattgaatcctgacttgctatttatcagaagtgtgacatagggcaacttatttaactctgttccttgatttattcatctgtaaaatgggaataacagtatttaccccagaaaatggttatggggattaaatgagatgaaatctctagagcccctaaaacagtgcctggcacatagtgaggccagtatgtgccagctgttgcttttattatgagcttattgtgatttgtgggtacaaaagtattttcagctctttggagaagggaacttttggagtctaagatgctcttctggtggcttggctgtgaaattcatccaagaggaagtttcatcagatgcatctgaatgtcacgaaaacacttcttcctcttgtaaaaggaaagcgtaaaatgtatgagttggcttatgccttctgataacttatgcctgccagtggagctatgggaggcaggccactgagatacctggtggataactattgatttttgcttaaagttttgaaaaggaagaattcagttggatttttgcatggagaggatgttacctgggacctagtttcagaaggaggttgctggcattactgatagtacagtgaaaagacccagcagcattgaaacatttatgagctggctggaatgactttcttgtaaattgtaaccggctgcaccgttgtttagcaaagcctgccagggcagctccagcctgggccaagtattctcgaagcccagaaagctcacatgaggtgcgtttttcccacttaccttattagctttcacctaagtgacattgatgaagctcctactgtatgtctagcattatgcctggtgttgtgggggatgcaaacaaaatggcttagtcccctatcccacaagtactttatgctctggttgggtagatatgccaaacacttaacaaattaaaaacaaagaaaaaacaaaaaaaaaactatttccatgcactctctgtaaggagccaaatggatacatacagcaaggaccttgggatgttctctttggtatttaccacacagcacagagtggctgagatgtgtactcagctgtaacaagtacagtctgtgaggaaggccacatggttcctgtgggagttgaaagggacaacacgttgcaaactggggcatgaggacacacagtgtgagacctgggcgggaagggcagtggaattttcagagaaggatttctgggcttactgactcgtaccagcagaggcataaacataccacgtggagaaaatggcaggtagagcgtttttgcaaagcatggaatctggatgagggctgagctcaggatgctattggtcttcgaatgccggagtgggagctgttgaacggttctaagtaggagagtgaaagaccagcatggaggagaagtaagactgggcagtggggtgggaggggccataaagagagaagcagcagtgaggcaggagtggaggcagcatcatggcccttgtgagagcctgacctgggtccactggagagacacttgagagagactgtggcttgagggacaccgtcaagaaactaattagcaatgtcatctgccttgaaagatgtaggcttttttatccaccggtcaacctcttatgttttacagatccggccagttattgaacaaacctttcctttttctaaagttccagaagccttcctgaaggtggaaagaggacacgcacgaggaaagactgtaattaatgttgtttaaataaaaatgcagtttagtgattgttgacgttcttatttggtgagtgcctgtgagcccaaatttttttctagccatccctttcaaacatttttccagattagattatacattccatgatacaagctttaaaaaataaacacaccattttggccagtaattgatataaaaatatcagcacttggatttgtctgtagtcagtagaaattcgaagttttttcaagctgttccttcacactggctttgcaggttgttgtggcaccttctgttttactagcttaaactactttattgtcttttttgttttagagacagggtctcgctgtgtcacccaggctggagtgcagtggcacaatcacagctcactgcagccttgaccttaagcgattctcctgcttcagcctctcaagtaggtaggactacaggtatgcatcaccacacccagctagtttttttgtatttttagtagagacagttttgccatgttgcccaggctggtctcaaactcctgggcttaagtgatccaccatgtcagtctcccaaagttctgggattacaggcgtgaaccaccctgctgggcctgatcgtcttaatgtacaatactaaaactttcagtgtatagatggatgttggcatgaagagataatttaaagctggttccttcttgaattcatcactgagcagctttctaactgccaaggtttccttttttgttcctccaccataatgtggtcaccacagctcttaaagttctaaatctcttagtgtcatatataaaaatctgcctggtgattcatttgtttatgctcttaatattgaaaggtgagagcagagtttctaactttttaaaacccttacatcttgcataaggattaggcctgtttcggcaattgaaacatgcttctctgagggcttttccatggaaattgcagccttccaatggagcccaaagcttgccactttgatgtcaa

SEQ ID NO: 532 - DNA, 27317 bp, Homo sapiens
acgtaacagagctgggagcctggctgccaggggcgtgttatcgcgggggcagcctgggagcgctgctgcgccgcggcaggagaaacagccgaggacaccctggaagagcaggagcacgtgggcctgcgagaatggcgccaacaccagccctgcaaagccacattccaaagccgggccaaggacagccaccgttgccccgcaggcctcaaggatgacggtcaagccagccaaggccgcctccctagccaggaacctcgcaaagcgcaggcgcacctacctgggtggcgcggctgggcggagtcaagagccggaagtcccttgtgccgcagtccttcccgggaaacctggggaccggaactgcccggagttcccgcccccagacagaaccctgggttgctgggcaaccgatgcggcccccgcagctggtctctgtggtgctgggagcgagcccagtatagctcccacctcctgcgctggtaacctcccgtcccgcccgcctcccttgttgtcgcctctcctcgcgtcgcggaatccttgcccttggcactacttacatctctccgggtcccacaacaccttagcgcccacctgcttcaaagccaagctccaccgaaagcgaggcagtcagcccccggacatggcctcagcgctgactgatcgcacctctcgggccccgagcacctacacctacaccagccggccccgagcactgccctgccagcgcagccgttaccgggacagcctgacgcagccgtgagtgaccaagccagcccctgtgtggtccatacttgcaccccatccccaggccggggtctggccccttcgccctggcaaaaaagctgcttatgctgtcttcccttggctgcactctgccgaaataaaagttctgccctaaggaatctcccgtggtgtggaggagtgaagcaggaaggggcatgggttgggcatcagttaacttttagtgatatgagttgctgccgtggtccttaacatgtacacgaattggctcatttcacaaagtttgaattgtaccagtgtgtattgagggccaactacgtgctgagcaccttacggggggcattcaaatacgttttcttagttaatccacagtgctgtgaagttgattttataactccattatgcagatgaggagaccgcggtgcaaagatatccaacagtagcatatccaaaatgggagccgagtaaatctcttcggcaggctttgagcaggagtaagattattcttccatgcaggaccacagattggttttttgtggtggtggtggtggtggtggtggtggttgctgttgttgttttgagacggagtttcgctcttgtcgcccaggctggactgcaatgacgcgatctccgctcactgcaacctccgcccccctcccccactcctccccgatcaaacgattctcctgcctcagcctcccaagtagctgggactagaggcgccctccaccacccccggctaatctttgtatttttagtagagacagggttttgccacgttggccaggctggtctcaaactcttggcctcaagtgatccgcccgcctcggcctcccaaagtgctgggattacaagcgtgagccaccgcgcccggacggcagtttgtgtttttacatccatgaacagttgcaaatattcaaacatacataggaaagaaaaaaaacaaaacataagcctttttttttttctttttttttttttgagacggagtctcgctctgtcgcccaggctggagtgcagtggcacaatctcggctcactgcaacctccacctcccgggttcacgccattctcctgcctcagcctcccaagtagctgggactacaggcgcccgccaccacgcccggctctttttttttttttttttttttttgtatttttttagtagagacggggtttcaccatgttagccaggatactctcgatctcctgacctcatgatccgcccgcctcggcctcccaaaatgctgggattacaggcctgagccaccacacccagcaaaaaaaacataaactcttaaagttctcttaaagttaaacggttctctaaagttctttccataagcctcaaatgttgaattcagcagaactttataggaatgcaagctccatggatgcaggaacttttgcatcttttgttcacctagtacaatgcctggtacatagtaagcacttaatacgaattgtcaaactgatgattgaacatcaacaatgtaattattgatgcttatttcaaacgctctttctaaattcataattatcttgttctaacaaattctttttctataagagatgtctatcactgtaagaaaactaaaatagaaaatttaaatttgaagagtgatcatttatattagaaaaggattcaattttaaaattttctaatccttccaaaaacactttctggtgcctttaagtggttgcttacaaatcattactatccaatcagaccaacagattagaaacaagaatcaatggtggttcattaggaacaacttttttgatagttgattagtatattgaagtaatctattgattagtttattagtatatctgagtaatgcacaagacagaaaaatctcaattttgaggaagtattatcttacaaatcataatcattgatatcctaatggataaaatactgatattttatccataatttgcttatggataaggataatattctcctctgatatccttatgaataaaatattttttaagtgttcaggagagtagccgggcatggtggcatgtacctgtaatcccaggtacttgggaggctgacgcaggaggatcacttaaacccagaaggcggaggttgcagtgagccaagatcacgccactgcactccagcctgggcgacaaagcgaaactctgtctcaaaaaaaaaaaaaaaaaagtgttcaggagagtacttgtcttaatccatcttatgttgctctaacagagtatctgaaactggatagtctataaagagatctatttagctcacagctctgcagactgagaagtacaagagcatggtgctggcatctgcttgccttctagtgagggcttttcttgttgtttcataacatgatggagaaggtcaaaggggaagcagatccgtgggaagtggccaaacaggaggaagtacctcattttgtagcaacttgctgtctctggaactagtcctgtgagaacttaatccagtctcttgagagtaagagttccctcactactgcgagaactggtgccaagccattcatgagggatccacccatgttccaaacacctcccactaggccccacttcccaacactgccatattggaaattaaatttccatgtgagttttagtggagacgacaaaccatatccagaccacagcagtacttttagtacttgctggtgagtaactaaatgaccatatccaaaaagagtatgcttttgtgtcaatctgtctctatcctagaatgtcgtttagttctttcatgttcaaaattttatgttgaactggataaatcttcagtttttcagatgacacatggctggaatggataactaacttatgactgaagggagtcaaggttctaaattatcttgattgggtatatataactgggctgaaaccaaaaaatgaaacttaattggaaagctgtgaagttttacttaggtatgagaagtcagttacacaaatacagaaatgggagtatctgatttttcctttgaaagggtctagaaatttaacacaagtctaatgtgaatcaagaacttccaccttttcataggattataaagctgaaagagaacatttgaatactagtcttctcatttacaaacaagagaatgtaatacatcttttatgtatttcttggtagttgggtgatcataaatgccattaaattcacctttaggcatgtgtgaaaagacaattgtgataatgacattccctcattttacaaatcctttggtaaaggatatataacccttccaataaaataacatttttaatgcaaatgaattaaaaccttagaacataccttttttttatttttatttttactcaggtcaaataaggtttaaaatcaccgtagagggcagaataatgattccccaaagatgtcctcttcctagtccccagaacctgtgaacatgttatgtggtaaaagggactttgagatgtgattacattaaggatcttgagatgggagatcttgagatgggaaattagcctggcttatccaggtgggcccagtagaatcacagtggggccttaaaagtaaaagaagaaggatgggcacggtggctcacgcctgtaatcccggtactttgggaggctaaggtgggcggatcacgaggtcaggagatccagaccatcctggctaacacggtgaaaccccgtctctactaaaaaaatacaaaaaaaaatgagccgggcgtggtggcgggcgcctgtagtcccagctactcgggaggctgaggcaggagaatggcatgaacccaggaggcggagcttgcagtgagccaagattgcacctctgcagtccagcctgggtgacagagtgagactctgtctcaaaaaaaataaaaataaaataaagtgaaagaagaaggcacaggagtctgagtcatagaaggagatgtgtcattagaagcaaaggtcagaatcacacaaatgctgactggaaggcgaccacaagccacggaatgagggcagtctctagaggctggaaaaggcaaagaaacattctccccaggacctccaggaggagtgcagtcctgttgacacccattttggacatctaaattgcagaattctgagaataaatgcgttattttaagccaactatgtagttagtagtaccatttaatgaaataggaaacactgaagaagtaatgagttggaatgggagagtgataattagttcaattctgaggttgccttccaggtaacatagtgagatgtcattgggtaactggatatgcctagagttgagagaagagttctcagctaaaaataaaaattgagagttttgggtatatggattataattgaggtcttgaagatggatgaggtcaactaaggataagagaaggctgagcccggaggaaatcctccagtatgggaggaactgcaaacaaaggctaagaaaaaggtgttagagaagtagtagaaaaacaatcagaagattatagtggtaacacagaggcctaggaaagagaatgcttcagtgaaggagtggccagctgggcttaacactgcccagagatcaattaatacaagaaatgaaacttgttagaatgttcaatagtggcttcaatatatgaaaaaaaagcaacttataccccactcagaatcatttcccatagagtactgttattggtgtagggcaatgtttagtgtcttagctataagcaatatataattgaaataactttgaatggaaatatcaactgtgtttttgtattttttactagcaatcattcaatcactgaaattaatattttattttatttcttatttatttatttattttttgagacaaagtctttctctgtctcctaggctggagttcagtagcccaatctcagctcacagcaacctctgcctcctgggctgaaaccattatcatgcctcaggctccagagcagctgggattacaggtgcaggccaccaggcctggctaattttgtatttttagtagagacagcgtttcaccatgttggccaggctggaaaatagtattaacattttcaacaataactttaaaaaatatatttgggtttaaagaacaatgagaaaattgacttaatttttaagcctcatttttttattagtgtaacttttcaatctttgaatcaagcttttttcagtactttaaagaaggctccttttcaaatgggacattttcatatttcctaaagtcatacagatttacaacctaaatctagtcctgccacttactagcaaggtgacctttggcagattcctgagtctgtttccccttctgaaaaaggaatcataattcccaacttgcagcttattgtgaataataaataaaataatgtacatgaaggacctggcatatagtaagcattacataaattgtatccatttacctccttattttatggaccacactaaaacagaaatttattttcttaaaatatattgattttagtctaaatcctattgaaaatgagttacttcatagataccaatactctattaaagtggttatacagaattttctgttttacagagatgaagaacctatgcattatggaaacataatgtatgacagaagggtaattcgaggtaacacttatgcactccagacagggccactggtaagttcagtttgaatagtctaacaccgtgttctcacattatctatggggaaggatcagtttcttggtgttaatttctaatccgttgcagactaaaacattcataaaataaagatgaattactataaaaatgaaatttttaaaaagacatacaaatagaagcccagtgacagtttccaggagctgggggatgaggggaccagggagggagttattgtttaatgagtgtagagtttcagttttgcaaggtgaaaagagttccggagatagaggatggtgacagtgatagaacaatgtgaatgtaattaataccactgaattttatacttaaaaatggttaaggtgataaattttacattatgtgtgttttaccacaaaaaaagaattagctaaaaaaaaaaaaaaaaaaagcaagccccagttggccgggcgcggtggctcacgcctgtaatcccagcactttgggaggccaaggcgggcagctcacgaggtcaggagatcaagaccattctggccaacatggtgaaaccccgtctctactaaaagtacaaaaattagctgggtgtggtggcgctcgcctgtagtcccagctacccgggaggctgaggcaggagaattgcttgaacccaggaggcagaagttgcagtgagccgagatcgcaccactgcactccagtctggcgacagagtgagactacatctcaaaaaaaaaagccccaatttttcattcgattcaacagaactctgccattctaaacatttctaaacctttactctcaatttctgtacttaaattgttacagaccagttcaaatagtttatagacactagccagaggcccacattttgagtggcacttgtctattgcatctagatttgtttagattatctcatactctaatacaattatcattatttaatcaaaaagtctgaattctgcttctttaattcactcaacaaatatttattgagttttaggtcctgttctgggtacctaggatacagagatgagtaagacatggtatgatattaagggtggtgagttcttggcacagaaatgaaatacagatgaatccataaacagtatatgacatgtaagtgcctaatacaagatggtgatagagatgctcctccacttaggatgaggttacgtcccaataaacccactgaacactgaaaatgaatttaaaacaccaaacctgccgaacaccataacatagcatagcctaccttaaatatgctcagaggccaggcgtggtggctcacgcctgtaatcctagcagtttgggaggccaaggtgggcagatcacttgagcccaggcgcttgagaccagcctgggcaatgtgggtaaccctgtctctacaaaaaaaaaaaaaaaaaaccccacaaaaattagctgggcatggtggcacgcccctgtagtcccagctacttgggaggctgaggcagaaggattgattgagcccaggaggacaaggctgcagtgagctgtgatcacaccactgcactccagcctgggtgacagagggaaaccctgtctcaaaaaacaaaaacaaaaatacaacctagaaggttaaggaattgagggaagctcagtgtgccctgaatcggagtctgaggcagggagtatcaagaaatacgtgattaaaaagaagttaaagatgaataatagcattcaaatccacgttagagagaatgttgttgaatgtcaaatgagggatgtgaagaacccacctaaggtatgttcccagaatgagaccctgtctacaaaaaaaaaaaaaaaaaaaacagtgctcattagcctacagttgggaaaaatcatctaacacaaagcctattttataataaagtactgaatatctcatataatttatgaaatattaaagtgaaaaatagaatggttgtatgagtattcaaagtacattttctgtggatacttttgtatcatcataaagctgaaaaatcataaaccacataagttggggaacatctattagtctgaagcaatggttaacttaataaacatatatatatgtatgtatgtatatacacttcagccctatcctggatctcctgcattagaacctccaggggttccctgcttctcccactgaggtggtatcaacaagggtggagcaggaagctgaactgtcaccttcacccagtaccaatgaggtagtaggagatggcacaagtcagtgccccactctttctggggtggtgccagcaaacccagtggggtagctgaattgcagtcctatctggtagtaacaaggtggtatgaggcagtgctagtcaatgctgcactcgccctacaccaccaccagtgtcgacagagcctagaaaggagctgaactaccacccccacctggcaccaatgtgttggtacaagttgaccctctgcttttgttgaggtggtgtcagtggggcccagcaggaagttgaacttccaaccccactcaggcttgtgcactaaaacaaaaagggtgacttcctactgaaaaattaaatagaatccaaagtcttaaaatataatacccaaaatagccaggatacaaacaaaaatcattcatcatacaagaatcaggacagtcacaacttgcatgaggaaagacaatcaagaaatgacaaaaccaagatgactcagatgtgggaattacctgacaaggattttaaagcaacaatcaaaaatgtttcaatgaaaagtgagcaattatagacactcttgaaacaaataaaaaaatcttagcaaagaaatacaagatacaaaagtgaaccaaatggaaacttatagaactgaaaaatacaataactaaaataaactcactggatggactcagtagtacattggaaatggcataggaaacagtcagtaaatttgaagaagaatcaatgaagaacggaagttatccagctgaacagagagaaaatagaccaaaaaaaaaaaaaaaaggctgagagagctgaagaacaatcacaaagatttacattcatgttgttggaatcctagaaggagaggaggaaaactatgagatggaaaaatatttgaagaaatcgtgcttgaaaattccacaaatttggcaaaaggcctacagatccaagaagccaagtgaccccccaagaggataaacccaaagaaatctacccgagacaaatcaagatcaaacttttgaaaattaaaaaaaaaaacattttgaaattagccagaaagaaattacacgttagctaaaggagaacaatgatttaaatggcagtggatttcttacctaaaacatggagacaagaaagtggcacaatatttttcaagtccttaaagaactatcaagctctaattctaatccagtgaaaatatttttcaggagttccaaaatggcagcatagaagcaggctggcttcactccccctgcaaaagaaaatcaagaacaaatgtacagtgccaagattaccaccagcaatattctaaagctcaagttgaaggaagaagcagttcccagggctacagaaaagtgaaaaagcttcaaggagatggtaggagaatcagacgttcatgtctacagtatctctccttctagtctgcctggcactaagggtgtggaggattgtattagggttctctagagggacagaacaaatggaatagatatatatatatataaaggagagtttattaagtattaagtcacacaatcacgaggtcccacaataggccatctgcaggctgaggagcaaggagagccagtccaggctccaaaactgaagaacttggagttcagtgttcaagggcaggaagcatccagcacaggagaaagatgtaggctggggggctaggccagtctctctttccacatttttctgcctgcttatattctagccactctggcagttgattagattgtgcccaccccgattaagggtgggtctgcctttcccagcctactgactcagatgatagtctcttttggcaacaccctgagacacacccaggatcagtacttggtatccttcaatccaatcaagttgacactcagtattaaccatcgcaaggatttatctctgacttgtgatttctgcactggaaaaagatcaaggtggacaactagtttccctaccatgttgggtttcctggcaggaaattcaacccaccagaagcatcatgagttcctgaagagagaaatacccctgagtacagccaaaaacaaaatggggaggtgagactaccatctccagccctggacactctgctgtataactcaaccaaaggaaacaccaaatcagagtggctgttcagcagcaccacattgtaggagataacattgtaccggtcccctgggcacaaacccctagccagtcacactaccagtgtatcccctttgggacctcccccattcaggatgggcagtgctctgatcatttactagagccaggtgaacctggccttaaggcaccacctagagccaaaaaggaggcagcaatctagtgataaaggatctctgtcggggcgcagtgtctcatgcctgtaatcccagcactttgggaggccaaggcaggcagatcgcttgaggtcattagttcgagaccagcctgaccaatatgatgaaaccccacgtctactaaaaatacaaaaattagccaggcatggtggcgggcacctgtaatcccagctacttgagaggctgagtcaggagaatcgcttgaacccaggaggcagaggttgcagtgagccaagatcacaccactgcactccagccagggtgacagagcgagactctgtctcaaaaaagataaaaaaaaactctaagaaaatatatccaataaaaagcaaaacaagccagacagattagactggattaaataatccttcagtgcagagacatagacgtccatccacatgaaacaacagcaaacagagaaccatgacctacttaaagggacaaagcaaggaatcagtaactggccctaatgagatggcaggatgtgagctctttgaccaaaaattcaaaatagcagtcttaaggaaattcagcgatgtctaagataacacagaaaagcaatttagaaatttgttagagaaatgtaacaaagagattgaaataatttttaaaaatcaagcagaaatcttggagctgagtaatacatttgttgaactgaaaaatttattagaggctttcaacaacagaatgaatcaagcagaggaaaggatcagtgaacatgaagacaaagacagactatttgaaaatacacagtctgaggagaaaaaagaatgagaagaaacaaagactgcttataagatatagaaaattacccccaaaggatcaaagctaagaattacttgtgttcaagagggaattgagcaagagcaaggagtgggaagcttgttttaagaaatactaacagaaaactttccaaaacttgagaaagagatagatatccaggtacaggaaggccagagaataccaaacagattcaccccaaataataccccatagaataatcaagctctcaaaggtcaaggacaaaaaaagaatcccaaaagcagcaagagaaaagaagcaaatagcatacatgaaggagctccaatccatctggcagcagacttctcagtggaaactgtacaggccaggagggagtgagatgaccaggagggactggggtgatattttcaaagtgctgaaagaaaaaaaatcatgtaacaatattgtatccacaaagttatccctcaaatatgaaggagagatagtctttcctagacaaataaaagctgagcaaattcagcaccaccacgcccatcttacaagaagtgttgaagggaattcttcagcctgaacaacagcaacaaaaaacactaatgtgccaaaagaaaacatttgaaggtatgaaacttactggttaaattaagtacatagacaaacctagaatactctcatactataactgtggtatgcggtccactcataattctactatgaggcccaaaagacaactatcaaaaacagtaatagctgcagcaacctgttaagaggtaggtgatataaaaatatgtgcaatgagacagctaaaagttagtatgtggggggatggagttaaagtgtagaattttttttctttttttctttgcttctgttctttgtgatctaagataagttgtcatctctgcaaacaacttgttatatctatgttttttataagcctcatggtaaccacaatgcaaaaatctgtaatagattcaccaaaaattaaaagcaacaaactaaaatatactaccagataaagtcacttaacacaaagaaagacaataaagaaggaaggagatacaaaacaaccagaaaataagcaacagaatggtagtagtaagtccttgctttatcaataataacactgaatgtaagaggactcggttctccaattaaaaggcatagaagagctgattggataaaggaacgagacccaactatatgctccttcaagaaacccacttcacctacagagacacacatagactgaaagtaaagggatggaaaaagattttccatgcaactagaaaccaaaaaagagcatgagtatacttacatcagataaactacaaatcaaagactgtaaaaagaaacacagtcactctgtaataataaagtgatcaattcagccagaggatgtaacaatgataaatatccatgcacccaacaccagagctcccaactatataaagcaaacatgaatagatctaaagggagagatagactgcattaatattaggagactttaacaacctgttctcagtaatgaatagataatccaaacagaaaatcaggaaaaaaagaaaaagaaagaaaagaaaattggtgttaaacttcacactagacctattaggactaactgatatttatagagcattttatccatcttctgcagagtacacattttttttcttcagcacatggatcattcttcagaatagaccatatcttaggccacaaaacatgtctgaacaaattcaaaaaagtagaaatcatatcgaatatctttgctgaccacaatgaagtaaaactagaaatcaataataagaggaatcttggaagctacaaaaatacatagaaattaaacagcatgttcctgaatgatcagcaggtcaatgaataaattaaaaaggaaatgtttttattatttttctaaatatatagataggattgtgcacccatatattccagttaacagccatactttgaagttgcttttatgctttgtcaaacatctttgtaattatctgacaaagtaccaatacaattttaatgaagttactgataatcaagaaacattatgacaaatgcctttatactactcaggaattgcttttggaatggcagttcctgtatgctttaataaatattttctaaattctagaagtattttctatcactgttagctcggacggcctgattctctagagctccagagacaacgggaggctaggaagagggctcttgccagaaaacaagcccaagagcagctcagaccacaaacacctgaacctgtggaaggcagaaagcatgtcgatgtgcaaacaggtgtgtgactgtgcccttggcattgtgtcctcttggtttactcagttgtctatgtcagttcatttttatttggcctttgtattacttatgcctctcctgtgctctctgatacttccccgatcacatggtagggaagttcctttattaaagaaatacatagactaggctgggtgtgctggctcacgcctgtaatctcagcacttggggaggctgaggcggacagatcgcctgaggtcaggagttcgagaccagcctggccaatgtggtgaaataccccatctctactaaaaatacaaaaattagctgggcatggtggtggtcgcctgtaatcccagctactcgggaggctaagacaggagaatcgcttgaacccgggaggcggaggttgcagtaagccgagatcgcaccattgcactccagcctgggtgacaaaagcaaaagtccatctcaaaaaaaaaaaaaagagagagagagagagagaaatacatagactatatactattatcatagtggatatggctggaagtctgggatggggtttaaaaaaaacaaaaagaagaattttggccaagcacggtggctcacatctgtaatcccaacactttgggaggcaaggcgggaggatcacttgagcccaggagttcgagaccaaagacgccatctctacaaaaaaattttaaaattggttgagcatagtggtgcacgcctgtaattccagctactcagtaggctaaggcagaaggatcatatgtgcccaggatttcaaggcctcagtaagctatgatcacaccactgcactcagcctgaacaacaaataaataaataattttgtgaccaaattctctcttagcagttttcacatattctgttctcaaactgggatcctttctcatagcccaacatgaatcactgttcttttcattaggacttacaggaaaggagaccaatatagttctattttgtccttttgtttgtcttttgagattagtaaacccactcccatctgagtcgtctgcctctcacaccagcctcttctgtcctctggttctgtcgctgtgcacattccccagggccacacaggcacccctgagacaggtgccaggatttgcgtacttgtctcgctctgctcagctgtagaggcttacctggtcctatagggtctagctgtgttgttgacagaatcttggtcatcagacagtgcttggtgttttccttggaccactgtcactacttcaggttcactttgtacccttccaagatggtgagtggatccatcgggattatttctgcatggtaaaggcaaaagggaccattccatgctttaacccctgcctttaggccaagtctagaatgagtgtatggctgtcattaaccaaagagctaagttttcatgtttctttacaccatcagaatattaagtgatataatagcagccagctttttttggctatttcctcagagactgaaccaggtcctttatctgtgtatttccttcattattacaaagattctgtgtgacaggtagttatagcccattttccaaatgaagaaactgaggcccagagaggacatgacttggccaagtcctatgcccaacatctgactctagtgctcatgttctttgcttgataccacattacccctgcctcatataaattactcctaacatgaaatttgttttcatacatctgtttataatctgtagtgtagagggaatatcaaataacctggtgacttggtacatgatttttttaactatccaggaattttcaaatctgtatatgtttactatcttaggactcaaatatatatatatatatatatatatatatatatatatatataattgactttttatccactgttgtactctgcatcttatacacatctacggtctcatgttcttctttagttccattttcaaatacaaagctcagtgctttctagacattcagtaaatgttctagcctaactctatctatggtcttccaaatatttaaaaactcttagttcagtatgtgaggtaagcccatttgagcacttttattctaatacttattttctgattcatttaaatatgttttgaaggagctaaaatttcaaatacacatatatgcttgaaatagaccagaatttttttttctttgagacagagtctcactgtgttgcccaggctgtagtacagtgacacgatattggctcactgcaacctccacctcccaggttcaagcagttctcccacctcagcctcccgagtggctgggaccacaggcacgcaccaccacgcccagctaatttttgtatttcttgtagagatggggtttcgccatgttggccaggctggtctcaaactcctggcttcaagtaatgcaccctcctcggcctcccaaagtgctgggattatgggcatgaactaccatgcctggccttagaccagaattttaaactcgatatatatgatattcttcttagaattataccttgaagaaattgctgatcgcataatagaagttgatatggaatgccaaacagatgcatttttggacagaccaccaacaccactctttattcctgccaaaactggcaaagatgtggccacccaaatactagaaggagaggtacagtacatcctttgggcttccctctataatctttataaatgaggtaaagttaggtgtagataatgcttaatatgagcaagaaccacttcacaatcagattctacttcttggatttctttccagatattatctataatggttttatcatatagtactcagaaatgttttaacataccatgttccgatttctttgctgattaaaaacaaaatcatttgaaatatttttagaatatttccacatttgatttttgtttgtttatatgcttgcttaatgtatatatgtataagatagatttgtactaaatagggaaaaataatatccctggtataaaaaattccacagttagttgcttttggattatttaacttttgtaaagatattctctcatttaaaaaaaaaattttaataattacatttttctatcagtgtggaatgcataaataggcctgtttatgaaattgaagaagagaaggcaatgattatgttcataatgacctaagtgagttttaacacttgtgggaacttgaaagaactgtcattgaaattgggaaataaaataaatcttcagaagctacctgaaagttatatttgcctataaatcctagcaatgaatcaccaaaatatctctcattcttgttccttcattcatcaaactgttatttaaaaataaataaaaatcaaacagaaaaggcaaagaataagacagacgaggatatttctcttcagtgtcagggttcattttgatgaatgcgtaggtttttttcataactttgacttaacagatttttgcctgtaaacaaaatgttgttcattttgaggattagaaaccatgaataaagcaccagcacagtgtctggcacacaggagacacttaataaataatatcttgttattgctattcattatatttttgttgagcatttgattcgtaattaaaattttaagtttgctttattttgtatgtttaagctctttgactttgatcttgaagttaaaccagtgttagaagttttggtggggaagacaattgagcagtctcttctggaagtaatggaagaagaagagctggctaacctgcgggccagtcagcgtgagtatgaagaactacggaatagtgaacgtgctgaagttcaacgacttgaagagcaagagaggcgacaccgagaagaaaaagtatatataattatattttctttcttaggcagtcttttggctagttagcatattatgttcaaaattacatgtgatgatatatcataaaactaaagatctttgggaatatattagaaaaagatctatagtatttttgctcaagtctctcctatagatcatagatctttcatggacggaattacatcttttaaactccagcttacataaatatacctaaattgagtttccaaaagtttctaaatgaagtgaaagttcctaagttacatgtgtgccagttggaagactctcttaaatatcaggagtcctaaagaaagaaagatgtatgttggtttgccataagtcagtggcagaaagatggaaggaaggaaaaagtgaatgtattggagagagactgtgggtaaaaagcaggggatctggatagaattctgattctttttctcggtgaccaggcccttctttatacccttggtgacacaccagacctatttgggttctcgtagaatatttttcagattctagatttttagaatcttcaataaggaaaggtttacaatccagtttttttacatgtgccagtagcctacagttaggaagcactagaaaagatagtctttctggttctggcaataactgtcagcctttgttgtatactgatgaacaaattataaagtcatatcttaatacctgaaacagttaagaaaaaattcccaaggggcctaacttactatgctgtgaaaagtagcataattgttgggaaatcctactcaatacctatcaaatggactttaattctaagatgaatacttagttgtgtaaagagcatagggcttacaataaggattgtgcaaatttatagatataaaaaaactgtggcaaaataaactttgttgaaatgagtcgtgaagtctttatcaaaaaatatttgtttatttactatttggaaacatattatggaaaactggatacaagaatcacctagatttatatttgtttaaagtttgaaaatagatttaattagaaaacgtattaatgctcccacttccacatgagagtagagaacaggattcatcacctttataaatattacatggtctaaaggaagcaacaacaaaaaataagaggctttcataatcttcagaaccattcagctttacaaattcagggaattattacaaatgaactcattcattggcccactggtaatttttcttaccagtaatatttcatgataatattaatttaaaatacatataatggtgattatctttttgctaccatctatactgtcaagcattatgtcttgaaattattttacttgaatagtgacatgttttaccttaaattccatctttcataacttcctgaattcagtagccactagctgttgaaattcattaaatttttgatgaaaaatatgaacctttaatagatagacacctcgctgtccattttttgataagtctggattcttgtacttactaacttcactagattcagcacttggggagggcataagagctaaataaccacctctgtcgttcttggcaggaacggcgtaagaaacagcagtgggaaataatgcacaagcacaacgagacatcacaaaaaatcgccgcccgagcatttgcacagcgttacctggctgaccttctcccgtctgtttttggcagcctcagggatagtggctacttttatgatcccattgaaagaggtttgtagatatttttgttagattaattttgttgtaataagcatcctcttaatggttcaaatttatcttatgtccatttttattttgaattggagtctttctatttctgacacaaagtcaattttagttgtttaaagtaagtacagttgttaatgagatgtatattttaaagatcttgatttaaggatattagtatttgtttattgagaagcaacatttgtatagtagaaagaaatatggacttggtattgaaaacttgagtttgggttgcagctttatcattagctagcttgatgacctccagtttcttcatgtgagaaatgaggaatttttttttttttttttgagacagagtctcattcttttgcccaggatggagtgtagtggcgcaatcttggctcactgcaacctccgcctcctgggttcaagcaattctccctgcctcggccttccgagtagctgagattacaggcacctgctaccacgcccagctaatttttgtattttttagtagagacggggtttcgccatgttggccaggctggtcctgacctcaagtgatccgcctgccttggcctcccaaagagctgagattagaggcgtgagccactcgtgcccagcctgaaatgagaattatttaggagttaagtcataaaatatatgaaactgtgtaaactataaagtcctgtgtatgcgtaagtagttgttattaactttttctcagctgacttattcaaatcaaaaaccctttgagggcagctatcaaggtcatttattcatttagttaggcgcttaccctcttccaggcagtgtttggtattggagaaaaagaaggatccctgatctctgccactagggagcccatagcctgatagctgtctgtctgtatcccctcaaagtccacgttcctagctgctcagccagtggaaaggaagagttgcatgtcctcaccaccacccaccttcctcagagtgaaaagcacttacatccaccgtgcttggtgtataggtcctattttgttggccagtagtatcttgggacacatgttagtaatgataattttcactgattacatattcaattcaatacaaagaggtcagatcacagacaaatattattaatatacatagtatttttcataggtgatatcatttgatactctcaataaccctgtaggatagacaggtcagatagaattcccattttttcagaaatagaaactgaagctcagagaagttaaatgccttgctcccaaatcctcaggcagtggaaatattaggcctcaaactgacttggaactcagactccaagtccagtgttcattctcggctatcatcctgctgtcctgggctctagcttggactctaactgttagccagagagaccagtagccttttttctatcacagattaccaaaaaagtaagttatagatcatttaaaagcttgcaaatgaaattcatacctgagataaaaattatttatagtagtgaatataatattctatcactctccatttcatcctattgaaaaataaaattagatgcctgccccaaaaaatgctattttgaaactttaaaatgtatattgtaatagaccatatttttaaaatgcttacacagtagatttcagtttgaacaaacttgatactgatggaaacacctagtttctgacctatttctagatgactgcctcctcaaatgccctctcactgcattctctgagtctgatcagcttccttccattaggccctgggcttcaggtggagactttcttttactggcattgctcaatcccagatttgcattgcatttggattggagttctcccaaacccacatcctccccctgcctccctgatccatctcagattgcacctatgaaggaaactccaaatgccttgactccaaggaaggcctcatagttcttaaaatattgggcaaggtgtggtggctcacacctgtaatcctagaactttgggaggccgaggcgggtgaatcacgatgtcaggagattgagaccatcctggccaacatggtgaaaccctgtctctactaaaaatacaaaaattagccaggtgtggtggcgtgtgcctgtcgtcccagctactcagaaggctgaggcaggagaaccacttgaacctgggaagcggaggttgcagtgagcagagatcgcgccaccgcactccagcctgggcaacagagtaaacctctgtctcaaaaaaaataaaaaaataaaaataaaaaatcacttatgcaacagaaaggaaactgaccagaacatatataaggaatatggcaaaagttatgctgtatgagtctacttaacattttatattaagaaaccaatgttgatgagtctattacattaagagaaaagcgcattattcctctgataatacatgaaaatcaatgaattcttttattacagatattgagataggatttcttccatggctaatgaatgaagttgaaaaaaccatggaatatagcatggtgggaagaacagtgcttgacagtaagttattttatccaaaaattcatctctaaagtttttagtagaaagaataaattgaataactgaaagaaagattaattttacagtttgaatatttaaacttttagtatatcaattgtattaataaaagtgcaaatttttaccctcaatattatttttggctcttctataatttgctatctattaatatcttctgccattactttataaatgatactctgtgaaaacagaatatattttatatttaatgcattaagtgtgaagtatgctgacttccaaaaaaggttatgacataggaaagagatgaggcttcgtgaaggtttttgtaatcatctataagtgagcattataactcctgaaatataccataatatgaaaatcatagtgatgtctgaacatttaacttttcagtgttgatccgtgaggtggttgaaaagaggctgtgtatgtatgagcatggggaagacacacatcagtctccagaacccgaggatgagcctggtggtcctggagcaatgacagagtcactggaggcctctgaattcctggagcagagcatgtcacagacacgggagctgcttttagatggaggctacctacaaagaacaacatatgacagaaggtcatcccaggaaaggaagtttatggaagagagagaactcttagggcaagatgaagaaacagcaatgaggaagtccttaggggaggaagaattgtcataggagggaagcttcaaagtcatgaaaccaatcaacagccaagtcagcaagcaatcaggtaatgatgtgcgagtcccctcaggttatagaaattatgttgtatttagtcagtatgtctttttgtgtaatggactgggccaatcaaatgtgataaaattaatttgagaatgaaacttaaattgaattcatttatttaatagaatattcaaaggctatattgtaattctaatgagaattatatttaattactagctttctattaccattatatgtaaccagcaaatatatttttccttagcccttctaattttgcgggttagttttttttagtaagtatgatatttaatgttcaatatcagtgctgtcagccatatagcttttcttctctataggaaaactatttcacctactgtaagagtgaatgcctagccaggcgtggtggctcacacctgtaatcccagcactttgggaggctgaggctggcagatcccctgaggtcgggagtttgagaccagccagaccaacaaggagaaaccccatctctgctaaaaatacaaaattagccaggcatggtggcgcatgcctgtaatcctagctacttgggaggctgaggcaggagaatcacttgaacctggggcggaggttgcggtgagccaagtttgcaccattgcactccagcctgggcaacaagagcaaaactccgtctcaaaaaaaaaagaaaaaaaagagagagaatgcctaaacgttgtgctactgaaagccacagtgctcccttcctgcaaggaccatcttcaatattcaagtaaggcttaaggaattcagtggattagtatatgctctcatctattttttcacattcctactatgaaaaaatttcaggcaatgccaataaagcaaaagtccctgtttgccctcatacagtctcactcccctcctcaaaggtagatcactgttatcaggtatgagctatctaggccttttttgaggtattcctatacaaatgtatttgaaaatctagaaatatatagcttgattttctttatataaatataaacattatttacatattttatttttcacttaagagaatgtcttagatctttcaaggttagtggcatcaatctcttatcttgtcaaaatatggttaaggtattacatattatgactgtgctgtagcatagggaattaacatttgactttttaatctgaatgtgttagagaatttacctgcagtattaaaatcacaagttattttctctccaaagccttcctaatcgtaagcaataactgaagtcttcagagcctttagataaatagagcctatttttctttttacttatttttatttttattttttggagacaaggtctcactctgacacccaggctggagtgcagcagcaccatcacagctcactgcagccttgacctcccaggctcaggtgatcttctcacctcagccttccaagtagctgggactacaggtgtgcaccaccacgtctggctagttactgtattttttgtagagatgggctcttgctgtgttgcccaggctggtctccaactcctgggctcaagtgatctgcccaccttggcctcccaaagtgctaggactacaggcatgagccaccgcacctggctgagtctgtttttcgcaaaatacttacacatatataaacgtagtgatttaaaataacttataattattaacccatttaccttaatttcttttaagttaggtaccaagaatgtatccacatttaaaaaattttaaaagaatgcacccattttcccatatagtatttcactataacacttaggcctcatggcaaccttctgaagaatgcatgacaatatttgtattttttagtttctaatccttaattcggtcagccagcaaacattagctgagtgcctgctctgccttgggaatgagactgcagatacagcggtgaacagtcacgaatactacatgttttttacagcctagcagtggagctaaatgaagtaaatgatgtaaataaagaaaccaaagctcaggaatttaaagtgatttgcaatagatgacgagcctagtagggaataggactaaagctggaatccaaatctccttacttctaatctggtatactttcttctaataacttgctgtttttgtgaggtacaaagaataatttaaaataaattattgcactaatagcattttaaaaattggaatcacgcctcttatccatcatggggctggttccatcttgttaaacagtctttatgatcatcctaacatttataagatattaattttggcaagaagaccaaaaatttttaattagggctattgctgattattattgttattaccaattttaaaatatctacaactagcttttagaaaccttaaaattgggccaggcacggtggcttgcacctgtaatcccagcactttgggaggccgaggcaggcggatcacaaggtcaggagatcaagaccatcctggccaacatggtgaaaccccgtctctactaaaaatacaaaaattagtcaggcgtggtggcgggcacctgtagtcccagctactcaggaggccgaggcaggagaatcgcttgaacacgggaggcggaggttgcagtgagccgagatcgcgccactgcactccagcctggaagacagagtgagactccttctcaaaaaaaaaaaaccttaaaattgatttgaagttgattatctttcataatcttctaattctcctttagaatgatccagtccattaaacactttgcagatgccagacctatgctctataaatccataaattaattcaatttattgaaagaagtagatatctataaaccccacactgaactggttaagcttaattgcaatcctagtccatcctagagagaaatcaaaataattgagaggttagggcattgtcgctgtgagaaagcttagaggtaacacattatatgttatctggagagaagaatgttaaatggaaacaaagtttatgaagaatttcttcaagtacctgaaggactttctgggaaattacaagatagcattcttaggttccatatgtctagaagacttttcataactgtaagcaacttttgcaaatggtttgggaacataaaactcttccagcatagaagaaaatgggtactattaacattcagatggttatgggaccatcataacagtttgatgtgatatgcaaaatgctacatccccaactatgaccctcagtatgacttttaaaggaattataagctccaaatactttttggagtataaacagtacttgactttttcacacatttgctaatacccttctcataagttttatttctttctgatgtttcagctaacactgagttaacagaagctaaataataataaaatgaagaacagatagtaaatatattgaaattgtcattcctggccgggtgtggtggcttacgcctataatcccagcactttgggaggccaaggcaggcagatcacgaggtcaggagatcgaggccatcctggccaacatggtgaaaccctgtctccactaaaaatacaaaaattagctgggtatggtgacgcatgcctataatcccagctactcgggagactgaggcataagaatcacttgaacccaggaggtcgcgccgctgcactccagcccggtgacagagcaagactccgtctcaaaaaaaaaaaaaagaaagaaaaagaaattgtcattcttaacataaattcccatatcactaaaatagatcagagaggtagaatgaaattttctctagcataggcatcattacatttaagccatctgagggctatgagcgtggcctgcaaagtcactctgagcaacacaaggtggagtttgaaagcagattcaaagccagaccactgggcttgagtcctcacatgcaagcatgtagtcttcaccatggagaagggggtttgcctttctcaaagcttttttcttttaaattaagaaaaagaactgatttatcagtctagtgtttcattttaaaaacatatgaaagggtgggtaacttgcagaagaaagtatttggagcctataattccattaaaagttataatggcggtcatagttggggaagcagcattttgcatattatatcaaaatgttatggtaccataaccatccaaatgttaatggtaccaatttcttctatcctagaaacatttcattttatgttgttgaaacataacaactatatcagctagattttttttctatgctttacctgctatggaaaatttgacacattctgctttactcttttgtttataggtgaatcacagaatgtatttttatgtattctgtagttcaatagccatggctgtttacttcatttaatttatttagcataaagacattatgaaaaggcctaaacatgagcttcacttccccactaactaattagcatctgttatttcttaaccgtaatgcctaggcctaacctcaaccaaccttccacaatcttgttcacagtcagagacccaaaaaagagtgttataagtggggtgtcactattgtgaaagtagtgctaatggtgttgaattggtacctatgattcttcttttgaattagattgtatgtttcatgatctcaacttacattactaaaattcaataaactgatcatttagatga

SEQ ID NO: 533 - DNA, 5914 bp, Homo sapiens
ggatgttgctgtcaggtctgagtcggttggagtctgacgggtaggcgagacgcgcaggcgcagagagccccagccacgccggcccaggtggcctcaggtgagggggggcggagcgcacctgtggggacgggacgacgagttcaagcctccgtgggtgcagttggtcgccaggtagggctgggggccgagggaccggctcgggggcgggggggaagtgtgcctgaccggtctctgtcctcagcgagggatgcggagacgcccctgaacgaccatggcatcggccgacgagctgaccttccatggtgagtgcggccccgacgtggccggatctcccactcccgccccgggccagaacctccccccgatacggcttccaatttctctaccccgaagcctaggcggctgtgaaccctgacccaggagtgagacccatctctgactcgaaccccgcccccgccctgaactcagacctcaaacccgagcctctcgtccccagaccctgaccccatcccagcgtcaaccctaagttgcagttccactttaggaggaagggaacagatgtcctccggatgcctccaaactgaggaagttgggccccaccttgggggagatcaatggctcagcagagcctccgcccccagatgagcatcggtttagcttgggcccagtcgagttctttccacccctcaaacgtgcgtgtgtcccatatacctcctccacagaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcggtgagtccctgtgtcctgcctccttgcagcccccagctgacccaggctctccgggcaggcactgaatgcccgcaatgtgcagctcctgcaggagcagcagcagcagcagcagccgggattctggaccttcagctactatcagagcttctttgacgtggacacctcacaggtcaggctggggaggcaggtgggatggggctcagagttatgctcagggttcagccactcttcccctgggcagggtgctggtgatggtgggtgctggtgaacgaactgtggtgctctcaaagggttatggtgggactggttatggatcgggactatgggaacacaggggacacacacaatctggtgggttagagaaaggcctcctgggggaggtgaggaattggctgagacctaaaggagacagaaggcttccctggggaatagggtagggaagcaggagtatatgttccaggcacagggaacagcatatgcagaagaccaaagatggactgggcgcagtggctcctgcctgtaatcccagcacttaagggggccgaggtgggcagataacctgaggagttcaagaccagcctggctaacatggggaaaccccgtctctaccaaaaatacaaaaactgccgggtgcggggtggctcatgcctgtaatcccagcactttgagaggcctgggtgggtggatcacctgaggtcaggagtttgagaccagcctggccaaacatggtgaaaccccgtctctactaaaaatacaacaaaattagccgggctttgtggtgggcgcctgtaatcccagctactctggaggctgaggcaggagaatcgcttgaatccgccaggcggaggttgcagtgagccaagatcgtgccagtgcactccagcctgggcaaaaagaatgagactctgtctcaaaaataaaataagataaataaaataaaattaaataaaaaataaaataaaatagaaaaattagccaagtgcagtggtcggcgcctgtaatcctagcactttgggatgccgaggcggtggatcacttgaggtcaggagttggagaccagcctggccaacgcggtgaaaccccatctctactaaaaatacaaaaattagccaggcatggtggcacacacctgtagtcccagctactcaggagtctgaggctcgagaatcacttgaacctgggaggcggaggtggtagtgagccaagatcgtgccactgcactccagcctgaacagagtgagactctgtctcaaaaagaaaaagggggtgctgaggccgggtgcggtggctcacgcctgtaatcccagcactttgggaggccaaggtgggaggatcatgaggtcaggagatcgagaccatcctggctaacacggtgaaaccccatctctactaaaaatacaaaaaattagccgggggtggtggtgggcgcctgtagtccctgctctttgggaggctgaggcaggagaatggtgtgaacccaggaggcggagcttgcagtgagccgagatggcaccactgcactccagcctgggtgacagagcgagactccgtctcaaaacaaaaaaaaaaagagggaaaaaaaagagggggctgggaacggtggctcacgcctgtaatcccagtactttgggaggccgaggtgggtggattacctgaggtcaggagttcgagaccagcctggccaacatggtgaaatcccgtctctattaaaaatacaactattagccaggcgtggtggcacacgcctgtaatcccagctactcgggtggctgaggtaggagaattgcttgagctcgggaggcagaggttgcagtgagccgagatcatgccactactccatccagcctggccgacagagcaagactctgtctcaaaaaaaaaaaaaaaaaaaaagagagggaaaggctgagttctttcaggtggggcatggaaagagaagggtggaggtcagcagggaaggagcctctcaggacaagggagaagctcctggcagacttccatccttgaccttggccttgcccccaggtcctggaccggatcaaaggctcactgctgccccggcctggccacaactttgtgcggcaccatctgcggaatcggccggatctgtatggtgagtgaggttgtgcatttggttccttgatggatcactcaacaagtgtggcctgagttgcagatgccagtgtatagctgcggacaaatcagtcactcagacagtgtgacttacctgctgttcagggagacagagacatgaaggactgcagagggtggcgggtagagagcagcagagcagacaggaggagtggccctgcagttctgcagggtgcagcagggcaggcctccctgaggagggtgagggaatgagccttgttggcaacaggaggggtgggggagacctaggaaaagaggcttccagaaacgacgtaagcttcatggcaggaacttgcatgaactgcagggcggcattaccactggagcgagtgagctgcagggaggtcacaggcgaggggacagatcacacaagcctcccatgctgtggcaagaagagatcttttttttttttttttgagacagagtctcactctgtcacccaggctggagtgcagtgatgtgatctcagctcactgcaatcttcccctcccgcattcaagcgattctcctgcttcagcctcctgagtggctgggattacaggcacgtgccaccatgcccggctgatttttatatttttattagggacggagtttcaccgtgttagccaggctggtctcaaactcctgacctcaggtgatccacccgcctcggcctcctaagtgctggaattacaggtgtgagtcactgttatctggccgagaatggatctttaagtgttttcggggtccctctcgccatcatgagtggcgagggcggaagccaggaggctggggtggaggcggccacatggtggggactgtggatgtggagagtggcactggattctggaacgtgctggggaagtagaagagactggctttgtggctagataggtgggggtggggggagtgggaggttaggagcggaggcaggctctagggatttctgcctggactaacgggatggatagagttgccacgtatccacgggaccagcttggcagtgagggcagagggcaagggtgtggatgaagccggagatgcccacccgggagcttgaactggagcctgcagtgctcagggcagagccctgggctctagaggaggcataaggccctgggcttgaaggaggtcatactatgggtgaacgcagacatggaaggggccaagaactgggcctggctgctccccatggctgaaggggtcagagagtcaaagaggaggtgacaggggttgaggaattggcaccaatgaggtgagacacaggccaagggtgtgcagtcctgagtgtttcggggagggggatgaactgacagccagcactgggctcagccaccaggaggcccccggtgtcctggtgagtcaggcaaggtgcttaggaagaggctggggtctcagcacagctcagtcaggatacatgtctgcttgtcctgggagtgcagggcccgggaccctgactgtgccccctacccccaggccccttctggatctgtgccacgttggcctttgtcctggccgtcactggcaacctgacgctggtgctggcccagaggagggacccctccatccactacagcccccagttccacaagggtaagcagacgggcaggcccaatgcctggcagggccctggggtacagggggtgactgctcaccttgccccccccagtgaccgtggcaggcatcagcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtggtgagtgtggcctggcgcggagtgggtggtggctgtgtggggacactggcatggtcacctgccgcctcattcccatggtggtgagggtggcctggtgcagagtgggtggtggctggggggactggcatggtcacctgccgccgtgttgctcccaggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaaggtacgggtctggggtggccacaggtggggccgaggggctaggggggcatgggctggccctgcctctgaccccaggggtcttgtgcagttgtacttcttccagtcgctgcctccggagaacgtggctcctccaccccaaatcacatctctgccctcaaacatcgcgctgtcccctaccttgccgcagtccctggccccctcctaggaaggcccgggtcccacaggtaaggactattcccagctgggctaagggggctgccctcccactcccagtcaaggcgagaggttctggggccactcccagacaattctttctttcaggcaacacctaagtggaccaacccctctgcctgtcctgccccccagacgatgactgaaggctcctttgacaccttgagatgattctgctactttccagacttttcttacaaagcaaacacttttattttctatgcaaaggtgattcagagaatttatataaaggcgggcgaggggcagccgagcagggagctttgggacagggctggggcccccatatcccccccgggccacctgctttccctcctatggctcccctggaacaggagggagagccaagggggcggcccagcctggacagcgcccgctcctgcctgggtgcacacacggcgggcctgagctccagcatctgagtttgggggtatgagaaacaggggagcagaaggagaagaaaactgcctgtgctgcaa

SEQ ID NO: 534 - DNA, 97942 bp, Homo sapiens
cccagccccagccgcggccgccctggggacgcagacgccaaggcccctccggccagggccgggagccgggccggcctagccaggtgagcgcgcgtggcgacaaggaggcagaaaaggcgggcctggtcccctgaggtctcgggatccgagctgaggggccccaatcggggggctggggcgcgcacgcgccgcctgggttcctgctgcacggagcgggtggtcacagtgcgccctctccaagaatccgggcggcccccactgcctcggccgcgaacccgcagactgtgctccccgcctttctcagcggcaggaagttggcgccggggagaaggctgaatccgagcgctttcgactggagtctttgggaggcaggacgccgtgctcggggaccggggtcttggggagtgtgtttgggggggggcaacacccctcctggctgactccggctgagcgagggcaaaaggatgtgcgcgccgtggagcctccaagccaaggggcggcacccacggggagggcggtcggacgtcgggctttctgcctcggtttccccaagttgtttgcctcctccggtcccccggcggggggcgtggctttgttttgtaaggaaagagaaagtgactgcgtggctcagacgcctcctctttcaactccggctcagggatgggtcgtgggtgaaggcgcgcgtggcgcggacctcgcgtggccccgagccgggcggagcgtcggaactcgcccccttctcaggcacgggttgactcacccggggatttccaccccctcctctgtctctgtccttgtcagatgctccgggccccacgcgctgagcccacagtccccctcgtggggcgacacggccaggcgcggaactcgcggtgcagctgctgctgcgatctggtcccccacccccagtcttcccagaatctcgaggcgggacccctggcgggacggagaggaatccttccagtgccgcttggagacgtgggggccccgcgcgtgtggcggtctcgggggcgggggggagaggaggcgtggctcccgcgcgagcgagcgtggataccgcgcattcctaaaccagataaggaggccgagagtgcgggccagcacggggtcgggtcctgctgccatctccatggagacacgctgggctttgcctggttgatggtgggcgatgggggcgctgcccgcggaccagaggtgtctccaggctcctttgttgctgtttgggtctgggctgagcttaggagtttccacccttgggaacccactagggtctcctttgttcattggttcattcattcattcattcatttgcccattccacacgttttctgagtgttttatttgtgccaggcatccctgtaggggctgataactgacttgctccctggccttaggcattgactgtctaggtggaagccagacagaaaaggaaagatatcatgatagtttcccatagtggcaagcgctgtgcagataataaaacgagattctgtgattagaaaaggcttggagatggctgctattgtagactgggggtcaggggagtcccctctgaggaagtgacctttaaatagaaaggtcactttctataaggtagggtggctaccacgggctccatgggtgaccagggggaactgtaaccacagggcctgcctttctgaaagatggggagacagtcattcaaagatttgaggaaaggccaggcgtggtggctcacgcctgtaatcccagcactttcctaggcttaggcaggtgaatcacctgaagtcaggagttccagaccagcctggccaacatggtgaaaccccatctctactaaaaatacaaaaattagccaggtgtggtggtaggcacctataatcccagctactcaggaggctgaggcaggagaatcgcttgaactcaggaggcagaggttgtggtgagccgagatcacaccactgcactctagcctgggcaacagagtgagactctgtctcaaaaaaaaaaaattttttttttgagaaaaagagtgtgccccaagaagaacagcaggggtaaaggcttggaggtaggggtaggggtagcatggaggaggtttagtgtggttggagtggaatggccctgggggaagagtgggaggaggcttcatcggcaggggccatcctacttgggctatagggagccatggaagaatttggagttggggagtgacatggagttacaagtttaaaagctccccctggctgcttggtagagaatggcagggtagggggtcctgacaaccacagagaaaccaaaaggtagggtggctaccacgggctccatgggtgaccagggggaactgtaaccacagggcctgcctttctggaactgggagtgggtggagaggaccttggaagccactgaggcttcctccatccttcccctctcctaatctccagacaaacagtcgtctgagtctatctctcttcccttccttccaaaccccatcacttgtccctcctgttccatttcaggcctggacattctatgtgagcccagtggcctctttctgagcttctgagagggagtcagggcagacttggtgaaggtgaccgggagacaggctctgtgtccttctcaaaacctggtaaccttacacagggaggggacatgggctaggccacgccatccacctagggggtgactcttctgccagctccaacctcagtgccctgcttcctctttctgggaggcgtcaaccgcccaagtgcttgcctcagtaaagtcctagtggttaagatgagtcttggatagaatgtgggcctcagtttccccttctctaggagagctgcttctccctctgtgaatgccttagcctccccgggctgcagaaggtgagagtgcagcacccccagtcttcctctcagggaaaaagacagactgcttagttagtccctggggtgcaagggctgaacacatttcattttgttttgttttgttttgttttgttttgagacagtctcgctctgtcacccaggctggagtgcaatggctgcgatcttggctcactgcaacctctgcctcccgggttcaagcgattctcctgcttcagtctcccaagtagctgggatcacaggcgcacaccaccatgcccggctaattttttttttttttttttttttttgagtagaggggggttttaccatgttggccaggctggtcttgaactcatgatctcaggtgataggcccgcctcggcttcccagagtgctgggattacaggcatgagccactgcgcccggcctaaacacatttcttatttatccaggaagccacagcaaatctcttggtgagcagcagagggggcggctgcactgcacagcgtgctccccaggcctggaaagggaccttgattctcacttatgaaccccaggaggggcccagcaggccagggcagcctgggggtgtctggtcggggtgacccagaggtcaggctgcggttcaaactccccctagggacgtccacatagcattaactctatcctcagaaagcctgagctcccgtcgcctataaaggaccccatcggtagggctggccgtagagcgcccccaactggaccaatcagaggcagaagatggaaagcccgggccaataggcaaattgctcagtgcccttggattgaaaatgagccaatcagagcatgggctgtttccggcccatcagctgtgtctgatccagccgcagcctgggcccaagcctgcctgggactggctgcagcgtgcagagggcatcaagatgcccggggctgcgtccagcaagggaacaaggggcctctgtgtggctatctgggaggggcagcagtccccggggacgtgcacaagcccttgtctgttcccaaactaggacggatgtccctccgccctgggggagcagctgcctctatccagccaggggccaggatgccccttggagggggcggccagggactgagatggctgggtgactccggaaacctccatcactcctgggctcaggagaactggcctaaccagacttttctggaacggtgcacacagtccttgccagacgtgtttctagggacctgaggaggactccccctactctcccccctccctcccatttagctaaggctggaacttcctctcccttcatgaaaggcatacactgcactggcgcctctgacaacccctaaccctacccccaagctgggggaaggccatggtgtctgcctctcatcctctctgccgaggagcgcctctccccgccccctcccaccacggctcagttttccttggtgggtggcgatggggggggatgggagggggtagagggagggatggaagagggtggaggggagggatgggagggggttgggggggtgactcaggttttcatggaacaaatgccttaccccctcccggcggggctgcacaccccttcacggctcacatgacttcagcaaagctgccccatcctcccagccaggacctcccagatggggtctctcccatcctgactccccctacatcccgccttcctcacaccggatgtgactgcagagtgaggactccaccctgtttgttccaggggcctcacatctggatttcatcctggctggggagggggtgccagcgccctgcccatcccggcaggaccttctgtcccagggcagagctagatggtgctgatgagaacaggctgttggagatctcgtctggttggcttacatcccttcccttcccaaaggactggaggaaagaggggagctaataacatttggcagtatttgttgagtgcttactatgagctaaacgtgcctcatgcgtcatttaaaaggattttcccatcacccccatgaagtgggctttcttctctctattgcacagataaggaggttcaggctgagacagcgtctagggacttgcccagtgtttcagaggtggaatgggagcaaattctggattgccttcaaggtctgtgtccttgaagatggtgtgacctctgggatgtttgaatctcagggccgccctggtgtctccccaagaccttatcttgggagcacccgtggcctcaaggcttagacccagcctgaaatccagcgttagtgggtggtaatgaatgagcagggcacggagctatcagtggtgagactctccctgacccaggtcagcatgagggcgcaggcgcctgtgtgttccagaaaagagacaaaccctccaggacctgcctagggcttgctctctgggtaggtgggcaaggtttctggaagtccacattatatttttcatgccatttgggggagcttctttccctttgaaagcgtgtagctactcaggagactgaggcaggaggatcacttgagcccaggagtagagacaactgtgagctatgatcatgccactgcactccagcctgggtgacagagcaagaccctatctctagaaaataataatgaaaattaaaagaggcaagatgtcatggttcatacctgtaatctcattgctttgagaggccgaggagaattgcttgaagccaggagttcaggaccagcctggacaacacagtgagacccaatctctaaaaaacaaaaaaactagccaggcggctgggcccggtggctcacactggtaatcccagcgctttgagaggccgaggcaggcggatcatgaggtcagaagttcgagaccatgctggccaacatggtgaaaccctgtctctactaaaaataaaaaaaaaattagctgggcctggtggcaggtgcccgtaatcccagctactcaggaagctgaggcaggagaatcacttgaacccaggaggaggaggttgcagtgagccaagaccgtgccgcagcactccagccttggcaacagagggagactccatctcaaaaaaaaaaaaaaaaaaaaaaaattagccaggcgtggtggcatgtgcttgtagctgaagctgaggtgggaggctgaggtgggaggatcacttgagcccaggagttcaaggctgcagggagctatgattgcgccactgcactccagcctgaatgacagagcaagaccttgtctttaaaatatagataaataaaataaataagaaagagcgtagcctagggcttatagaggccgcagagccagtctctctggccctgccgctggttaaatttgagactttaggaaagtgaattaatctctctgggtttcccgtctgtaagtggggatgatgatgattctgaattcatgtggcccttcctcgaagagtaacagagcaggaaattgaatctcagcccatccgaggccagagcccaggtagcagccacagctctgacctattgtctgtctgtctgtctgtcttctctgcagttctgaaagccccatggccccagcaggcctctgagccccaccatgggcagcttgtactcggagtacctgaaccccaacaaggtccaggaacactataattataccaaggagacgctggaaacgcaggagacgacctcccgccaggtggcctcggccttcatcgtcatcctctgttgcgccattgtggtggaaaaccttctggtgctcattgcggtggcccgaaacagcaagttccactcggcaatgtacctgtttctgggcaacctggccgcctccgatctactggcaggcgtggccttcgtagccaataccttgctctctggctctgtcacgctgaggctgacgcctgtgcagtggtttgcccgggagggctctgccttcatcacgctctcggcctctgtcttcagcctcctggccatcgccattgagcgccacgtggccattgccaaggtcaagctgtatggcagcgacaagagctgccgcatgcttctgctcatcggggcctcgtggctcatctcgctggtcctcggtggcctgcccatccttggctggaactgcctgggccacctcgaggcctgctccactgtcctgcctctctacgccaagcattatgtgctgtgcgtggtgaccatcttctccatcatcctgttggccatcgtggccctgtacgtgcgcatctactgcgtggtccgctcaagccacgctgacatggccgccccgcagacgctagccctgctcaagacggtcaccatcgtgctaggcgtctttatcgtctgctggctgcccgccttcagcatcctccttctggactatgcctgtcccgtccactcctgcccgatcctctacaaagcccactactttttcgccgtctccaccctgaattccctgctcaaccccgtcatctacacgtggcgcagccgggacctgcggcgggaggtgcttcggccgctgcagtgctggaggccgggggtgggggtgcaaggacggaggcggggcgggaccccgggccaccacctcctgccactccgcagctccagctccctggagaggggcatgcacatgcccacgtcacccacgtttctggagggcaacacggtggtctgagggtgggggtggaccaacaaccaggccagggcagaggggttcatggagaggccactgggtgaccccagatagagacttggggctactgagccagatgcccccgccccacagacctgggtgatgttgcaaatatttcacacctggaaaggccagataaggcactgactagtcacatagcagtgttgcagtgcggtcctgagggccagtccagtggctagtgtgacccctttagaactggatcctggggaggccagggcaggggacctgtgaagagccagggtgagggcaggcagcatttaaggggagctcagggcaggagcactttaccacctggtacaaaggatttttttttttttttgagacggaatcttgcactgctgcccaggctggagtgcagtggcgtgatctcggctcaccgcaagctccgcctcctgggttcatgtcgttctcctgcctcagcctcccaagtagctgggactataggcgcctgccaccacacctggctaattttttgtacctttagtagagatggggtttcaccgtgttagccaggatggtcttgatctcctgacctcgtgatccgcccgcctcggcctcccaaagtgctgggattacaggcgtgagccaccgtgcccggctttttttttttttttttttttttttttttttttttttgagatgaagtctcgctctgttgcccaggctggagagtgcagtggtacggtctcagctcactgcaacctccacctcccaggttcaagcgattctccagcctgagcctcctgagtagctgggattacaggtgcctaccaccacgcccaggtaattttttttttttttgtatttttagtagagacggggtttcaccatgttggccaggctggtctcgaactcctgacctcatgatccgcccgtgttggcctcccaaagtgtgggattacaggcgtaagccacctcacctggcggtacaaagaatttctgcattttcttccctggcccctagtcctgcaccgatttctccttttcgaatgtattcctcctgccaccttctctgggcaacttcgtgcgactacagaaccactgtcctgaggagctagaggcctcctctctgaccatccagagcccaaatccacagcttccccaaatttcatcagctgccacttgacgacttctccccgtctctctgaggcccggaaaccacggctggaggtggggaggggatggcggctgaggtccattcctcattctcagacctcattgctcagttgcactatttggggcacagaataatcaccaaaagtgagaaaaacgagtttgggtggctggggaggactttgggactcttgatgcaaggcgcaacttgagaaaattctgggtgtgatatttgcacagacaccctcctttcaaaaacagccaccccccaagctattctcagctccacacctgcagccccagctaaggtaccaggtctcctgagcaaggcagagagaagccttgagccttctctgtgtcttctttcaagaaccccgctgtgtcttctttcaagattttttttttgagacagtttcaagatttttgttttgtttttgagatggagtctcactgtgtcacccaggctgaggtggcagtggttcaatctccgttcactgccacctccacctcccgggttcaagcgattctcctgcttcagcctctcgagtagctgggactacaggcacctgccaccatgtctggctaatttttgtatttttagtagagacagggtttcactacgttggccaggctggtctcaaactcctgacctcaagtgatccgcccgcctcggcctccccaattgctgggattacaggcgtgagccactgtgcccggccttcttctttcaagttatatagaatggagcatgggggtggcagtggctagggacatttcctggggacactctcccctaaccccccagaaggacttcacaaaaacctgtggataatggaagggatgttacggtacaaacgtatatttatgtgtgtgtgtgtgtatgtgtgtgcgcgcgcgcgtgtgcacataggcgtgatgtctgtgaccctcctctcctcgtcacatttcccccagaatgaatgctgtcctgtctgctcatgtttgtgttgaagctgccaaagtcggggagctctggtcctgcccagacccctttggaattgctggcccatcctcccactggagagctggggtgcagctcaccttggggaaggaaacctcatgcctcagagtaatttcttgtgaatgcaaagcctgggggagcgggtctttggggggcaaggagccagtcaggggcttgtttcccctcatagagctccccagacgtgcctccgcaatgcctgaaacccagacctaggctaataaacggttcaatttctgtttcctgtggttggtgtgtcttttcggggagcaatttcccccaggagcgccccatggctgggctggatggaacaggaggggggctgctgcctgagtaactcatcctttgccaaccttcccattctgtgctcctgacacccttaacccggcctgagccaggagaaaacagaggtcaaccgggatctttcccaggggcaactcacctgcacctcccagggattaactcggtctgggatctccctgctttctctgaaggagacagcctggcaggtggtgggaggctcctacatcctcccaattgtatgtgcctcccggggagctggagagatggtttgagggggctacaaagaacccagatacccacccttagacacggtgttcccaaaagtaatggctgatcttcaccgagcactttccaggcataaagacttgactgctcaggaggtggaagttactataaactcttatggaggtgtgagttcagagagatcaagcaaactgctcagagtcacacagcgctagtcggggtagcgcctgtctggatttgaacccaagcaggctgactccagaccatactggatccaccactgggctagagaaaggccactcagctgagtgcagtggctcactcctataattccagcactttgggaggctgaggtgggtgggtcacttgagatcaggagttcgagaccagcctgccaacatagggaaaccccgtctctgcaaaaaatacaaaaattagctgggtgtggtggcgggtgcctgtagtcccagctactcaggaagctgaggcaagagaattgcttgaatccgggaggtggagaatgcagtgagccaagatcacggcactgcactccagcctgcgcgacagagcagagcaaaaaaaaagacagagagaggccacttagctccctctttgccatggaaggaggagccacgaagttcatcaagaaccaggagaagccaagataggatgcagcctcgggtgggtccctcggtgggttccctggtgatactcttctcttttgtctgcaggcagccggctcagtggctcctttgaagaaaagtctagagtttttttgtttgtttgttttttaagacagggtcttgctctgttgcctaggctgtagtgcagttggtgccatcatggttcacttcagcctcccaagtagctgggaccacagacatgcaccaccatgcctggctaattttttttttttttttttttgtagagatggggggtctccctatgttgcccaggctggtctcgaactcctgggctcaagcgatcctcctgcctccaccttggcctcccaaagtgctgggatttcaggcatgaaccctttgatgggggaccctaggcacccaagctggagccccacacagcaacaccagctcaaagactaggacagccagtgggagagaaggcagaccgcagaggctgagggcctgcaacccccatcggaattccccttctctagcagttgagacaacaacctctgtttggaaacctgaaccctagatgggatggggggtggggtgggggaaaaaggcacaggccaggctggagtcaatagattttccccaagtacccacagggttctctatctcccccttcaggactctgctcaaatgccacctcctcagaaaggagtcacttgcttattacctggcagtatatattattaagttggtgcaaaagtcattgcggtttttgccattacctttaatagcaaaaattgcaatgacttttgctatttcttttaatggcaaaaaccgcaatgacttttttttttttttgagatggagtctcgctctgtcacccaggctagagtgtatggcccgatctcggctcactgcaaactccgcctcctgggttcacgccattctcctgcctcagcctcctgagtagctgggactactagtgcccgccaccataccaggctaattttttgtattttttttttttagtagagacagggtttcaccgtgttagccaggatggtctcaatctcctgaccttgtgatccacccacctcggccccccaaagtgctgggattacaggcgtgagctaccgtgcccagcctacaatgacttttaatggcaaaaaccgcaatgattttagcaccaacctaatatgtatcaatttatctgtctctacccccattaaaatacaagcactgtgaatataggactgcacctgccttatttactaatgtatctccagtgttgtttttttgtttttttttgagacaaggtcttactctgttacccaggctcaagtgcagtggtgcaatcacagctcactacagcctcaacctcctgggctcatgggctcaggtgatacttccacctcaggcttcctagtaactgggattataagcctgctaattttctttttttgtagagacatgattcttccatgttgcccaggctggtcttgaactcctaggcttaagagatctgcctgcctcaacctcccaaagtgctgagattacaggtgtgagccaacttgcctggctatttatggctctctaactttttttttttttttgatacagggtctgactctgtcacccaggctggagtgcagtgacgtaatcacagctcaccgcagccttgacctcctgggctcaagccatcctcccacctcaatctcccaagtaggtggaactacaggtatgtgccaacacactggcctgcttttttgtattgtttgtagagacagggtttcaccatgttgcccaggctgctctcaaactcctgggctcagtgctcctcccacctcagcctcccaaagtgctgggattacaggcatgagccaccatgcctggctatctctaacatcttaaacactacttggcatgttcccaccccagggcctttgcacctgctgttccctctgcctggaatgcctacacacagtaggtcctcagtaaatacttgttgaataaataaaacaaaagcaaatgatggtcatttcagtgagtgttaagtgctaggaagaaaataaaatagggccgggcacggtggctcatgcctgtaatcccaccactttgggaggccgaggtgggcagatcacctgaggtcaggagtttttttgttttgttttgttttgtttttgagacggagtcttattctgatgcccaggctggagtgcaatgatgtgatctcgactcactacaacctccacctcctgagttcaagtgattctcctgcctcagcctcccgagtagctggcattacaggcatgtgccaccaagcctggctaatttttgtatttatagtagagacgggggtttcatcatgttggtcaggctggtgtcgaactcctggcctcaagtgatctgcttgcctaggcctcccaaagtgctgggattacaggcgtgagccactgtgcccagccaaggtcaagagtttgaaaccagcctggccagcatggtgaaaccctatctctactaaaaatacaaaattaggccatgtgcctaattttgggattacacctgggatcatgcctgcaatcccagcactttgggaggccaagacgggtggatcatgaagtcaggagttcaagaccagcctggccaacatggtgaaaccctgtctctactaaaaatacaaaagctagctgggcgtggtggcacgcacctgtagtcgcagctactagggaggctgaggcaggagaattcttgaacccgggggatggaggttgcagtgagccgagattgcgccactgcactccagcctgggcaacagagtgagactctgtctcaaaaaaaaaaattagctgggcgtggtggcgagcgcctgtaatcatagctaccggggaggctgaggctggagaattgcttgaacccgggaggcagaggttgcagtgagccaagatcgcgcctttgcactccagcctgggcaacaggagcgaaactgcatctcaaaaaaaaaaaaaagggggggcggcatttgtccctgcgacagaactgctgccgccattgccgtctctaatatctaatataataatatctaatatctaatataataaggtctcaccacagccaccaggccttggggaagccacagtgtggccgactggccagtcagacccccaccggtgctgcctcccagcccctacagatggggctctgcacctacaagatcaggcagttcctggactgttcgaccactgagaatgacctgtccctgtgtgagggcttcaatgaggccccaaagcagtgcaagtacaaccatggtctgagctccctgccttgaagacgttggtgcagactcgagggccagctctgcacccacctgtaccccttgcccacagccagaccacaacaccagattgtacctggatagctgggattggaagtgaggaataggtttctcaccccacagataacccaagacacaaatgtgcaattaaaaaatttattttagaccaccaaaacaaacaaaacaaaacagaaacaaataaaaaaaagaaaagaaaatagtgccaggtgtgggagctcactcctgtaatcccagcactttggaatgccgaggcgagtggatcacctgaggtcaggagtttgaaaccagcctggccagcatggtgaaaccccatctctactaaaaatacaaaattaagcaggcgtggtggtgggcacctgtaatcccagctacttgggaggctgaggcaggagaatggcgtgaacctgggaggcggagcttgcagtgagccgagatcgcgccaccgcactccagcctgggtgatggagcaagactctgtctcaaaaaaaaaaaaaaaaaggaaagaaaagaaaatagggccaggcatggtggctcatgcctgtaatcccagccctttgggagaccaatgcgggaggatcacttggggccaggagtttgagatgagcctgggcaacatagtgagacctcatctgtaaaagtaagtaaataaatacatatataccctggtgtggtggaacgtgtctatagtcctggccactctggaggctgaggtgggaggattctttgagcctaggtgaccgaggctgcaatgaactgtggtcatgccactgcattccagcctgggcaacagagtgagaccctgtctcaaaaaataaaaagtctaatgtgtgctcgtgtgctgggcactgtgagaatcatttgacatctgcaaacttctggaatcctcacaataatcctatagagtaggtgctattattggctttttgacagataaagaaaccgaggcacagagaggttaagtaattcacccaaggtcaagtagcatgggagtcaaggggccaggattggaacccagtgagtcactgaagaccacacttatatctttttaaaatgtttttcagctgggcgcggtggctcacgtctgtaatcccagcactttgggaggccgaggcgggcggatcacctgaggttgggagttcaagaccatcctgaccaacatagagaaatcctgtctttactaaaaatacaaaattagccgggtgtggtggcacatgcctgtaatcccagctactcgggaggctgaggcaggagaattgcctgaacccaggaggcagaggttgtggtaagccggagatcgcaccattgcactccagcctgggcaagaagagcgaaaccccgtctcaaaaaaatgattatttatttatttatttttggagatagagtctcactctatcgcccaggctggagtgcagtggcacagtctcggctcactgcaacctccacctcccaggttcgagagtttcttccgcctcagcttctctagtagcggtgattacaggcacgcaccaccacgcctagctaatttttttttttttgagacagagtttctctcttgtcacccaggctggagtgcaatggcgcagtcttggctcactgcaacctctgcctcccaggttcaagcgcttctcccgcctcagccttccaagtagctgggattacaggcgtgcaccatcatacccagctaatttttttgagatggagtcttgcactgtcgcccaggctgtagtgcaatggtgcgatctcggctcactgcaacctccgcctcccaggttcaagagattctccttgcctcagcctctcaagtagctgggatgacaggtgcccgccaccatgcctggctaatttttttgtatttttagtagagacagggtttcaccatgttagccaggctggtcttgaactcctgacctcatgatccacccaccttggcctcccaaagtgctgggattacaggcatgagccactgcgccgggcccacaatcatatctgatcctcctcaatatctggatctgaagatcccatttgttgatagctctcaaatcttggagcccaaattaaagtggtccttccagcaggaaacacaagatgactttcacctcctttttcccctagggaggctgttgcctaatagggaccaacaaaggaatgacctggaagaacctgcttaaatgcaaattctcaagctctatggtcagagattctgactaaacaggtctggaatgaacctagaaatgtgtgtttcttaccaggaacccctaataatttaaaaatatgtagtccttggccggggaacagtggctcacgcctgtaatcccagcactttgggaagctgaggcgggtggaccatctgaggtcaggagtttgagaccagcttgatcaacatggagaaaccctgtctctactaaaaatacagaattagccgggcatggtggcgcatgcctgtaatcccagctacttgggaggctgaggcaggagaatcgcttgaaccctggaggcagaggttgcggtgagtcaaggctgcaccattgcactccagcctgggcaacaagagcgaaactctgtctcaaaaaaaaaaaaaaaatatatatatatatatatatatatatatagtctttgcactatattctgttttgttgttgttttggagacagggtctcactctgtcacccaggctggagtgcagtggtgccaattcggctcaccgcagcctcaacctcccaggctcaagtgattctcttgcctcagcctcccgagaagctgggactgtaggcgcttgccaccaagcctggctactttttaaattttttatttgtagagatgggcttttgccatgttccctaagctggcctcaaactcctgggctcaagtgatcctcccatctcggcttccgaaagtgctgggattacaggtgtgagccactgtgcctggcccttgcaccatattctaagaagcattctcggctccataattcagagcagcactgtcatgagcattacaaatacgactaatgtgaggcaggcaggggctgaattttacatattattgaattttaattaacaaatcattagctacaatattgggcagtgcaattctagatttcatatttctagtttctgcagcctctgagtaactgagctcttttgattactatctcaacaatttttcttttctttcttttttttttttttttttgagacagagtctcacactgtcgcctgggctggagtgcaatggcggctctcggctcactgcaacctctgcctcccaggttcaagtgattctcctgcctcagcctcccgagtagctgggattacaggtgcccaccatgcctggctaatttttttttttttgtatttttttgtagagacagggtttcactatgttggccagactggtctcaaactcctgaacttgtgatccgcccgtctcggcctcccaaagtgctgggattacaggcatgagccaccgtgcccggcccatctcaacaattttttttttttttttttgagacagcgttttgctcttgttgcccaggctggagtgcaatggtgcagccttggctcactgcagcctccacctcccaggttcaagtgattctcctgcctcagcctcccaagtagctgggattataggcgcatgccaccacgcccggctaatttttgtatttctagtagagacagggtttcaccatgttggctagactggtctcaaactcctgacctcaggtgatccgcctgcctcagcctcccaaagtgctagaattacaggcgtgagccaccgcacctggccagaacaaggcgttctctaacataacctcagtaaaatgatcaaaagcagaaaatctgcaaacctaattagatttcacccattgtcacatcactgacctttatagcaaaagaaaatcccagatcagttgttgtttccagttgtctttttagtttctttcacggagatcaatttctgagcctttttgtgttttgcgaccttgacgttttaacaaaatgtaggttagttattaggcagaatgtctttcaacttgggtttgtctgctgtttccttatgattagattcaggttgtgcctttttggcaggaagaccccagcgtgtctctgctataaagttactgctttccggtttgtaattattaagtttcttgtggggaggtatgtggagactctataaatatcctattattcatcagactttcactctttcagcattcattcttgcctgaatcaattattattcaaaggatttttttttttgagacagtgtctcactctgttgcccaggctggagtgcaatggtgtgatcacaactcactacagccttgacctcccaggcccaagcgatcctcctgcctcagcctctcaagtagctggggctacaggtgcaagccaccatgtctggctaatttttgtaaagaagggtttcgctgtgttgcctaggctggtctccaactcttgggctcaagcaatccacccaccttggcctccccaaattatgggattacaggtgtcagccaccacacccagccagcctcactggatattttgaagcaaatctgaggcctcaaataatttcatttgtaaatactccatttttttatctctaaaaggtagcaacacttaaaaaaatgctacaataccttttttgggcagggtgtggtggctgactcctgtaatcccagcactttgggtggctgaggtgggaaaatagcttgagcacagaggttggaggccatcctgggcaacatggtgaaactctgtgtctaccaaaacaaaaaaaaaaaaaaaaaagctgggcatggtggcatgcacctgtagtcccagctactcaggaggctgagcagggaggattgcttgagcccaggaggcagaggctgcagtgagcagagactgcccacctgcgctccagcctgggtgacagagtgagaccccccatctcaaaagcaaaacaaaacaaaaaccgaaaaacctttctgtagaaccaaggtctcactatgttgcccaggctagtctggaactcctgggctcaagtgatccttctgcctcagcctcccaaagtgctaggattacagtcatgagccactgtgcctggcctttctttccacttttcactgataactaagaatgatccagggattcggatgccatccgcctgaccatgcctttgtaaattccccacttggcgtttccctaaaggtttgatcatccatggataaccattgcctggaactgttgtttcattagcagtcttcaaagggtttctggatgggcgtggtgtggcccatgtctgtaattccagtgctctaggaggctcaggcgggaagattgcttgaggccaggaattcgagactagcctgggcaacacagtgagacacccccagctctacaaaaaatcttaaaaattagttgggcatggtagcaggaacctatagtcccagctattcaggagggcaaagcaggaggatcacttgaacccaggagttggaggatgcagtgagctatgatggcaccactgcactccagcctgggcagtagagtgagactgcctctctaaaaacaaacaaacaaacaaacaaacaaaaaacctacaaacggtttctaaaccgtctctccatcctcatatctagccattttttcccatttgtctacaaagctgacatacttgcccaaaattcagacacccaataccaccaccttccccctttttttggacagatttaactattctcggataagaaattcaaagaaagcaataccaccacccttccttgaatgtcttatccaagaatagacaaatctgtccaaaaaaagggaaatgaagtgggtcggatgtgattcattgttgtcggcaattgtggtggcataactgttaaaagtgcatactatcaagttaggaaaagcagatttgaatctcacatcccacactcaacaacccaagtagcttttggggatggcacatgacaactgtcagctggcctcatctataaaatgagtatgttactttattttttttgagatggagtctcactctgtctcccaggctggagtgcagtggcacgatcttggctcactgcaacctccgcctcccaggttcaagtgattctcctgcctcagcctccccaggagctgcgattacaggtgcccaccaccacgtccagctaatttttgtatctttagtagagacggggtttcatcatgtagccaggctggtctcaaactcctggcttcaagtgatctacctgcctcgtgatccacccgccttggcctcccaaagtgctgagattacaggcgtgagccactgcactcagctcattacttttaatagcaaagatcgcaattacctttgcaccaactaatgatccccaacttgcagattgcttttggagaatcagctgtggttaattggtggtcttttccaggaaggagtctcctcacgtgacatccctctggcttaatttaaggccagggcaggcctagcttttattcctgctcaccgcagtgtagacagggaaactttctttgcagttcaggagcagacgctgtgtattttcacgtcattctccaggaggtgggcaagtctctggcctgtaactggcattttttctctagggcttgtggctttcatggacaatggccatgtcatggaccctggcaggcagaaggaggctgggaagagttgagggaggaaggcagggtgtaagtggcctggaaggaaaaaaggaagcctaagtttgaagtgggtgagaaaaatgaagataagtgccttggtaatttctataatcagaattacacagtatgtaccctcctatgactggtttctttcatacagcataaggtttttgaaattcactttttttgtttgtctgttttttctaagatagggtcttgctctgttgcccaggctggagtacagtggcataatcatagctcactgcagcctttatctccagggctcaagcgatcctcccacctcagcttcccgagtagctgagaccacaggcttgtgccaccatgcccagctaacttaaattttgattttttttattttttgctgggcgcagtggctcatgtctgtaatctcaactctttgggattacaaaaaaagaaaaaaattagctgggtgtggtggtgcatgcctgtagtctcagctactacttgggagcctgaggcagggggattgcttgagcctgggaggttgaggctgcagtgagctatgatcacatcactacacaccagcctgggtgacacagcaagaccctgcctctaaaaaagaaagtttatgacccttgtgtataatattccatgtgaataagtaactatttatctgttctattattgttcatgtagtcttcagcttttggctattgtgagtaaactattatgaacattccttgttcatgtcaattggtagatatatacactcattccaggcatgggattggtgggtcctgggcagcagtagacttggctttagcaaatgttgccaaatcattttccaaagcggctataccatttgagacttcctccagcagcatagaagagttctggttttgccaatacttgaaaaaaatttttttttcatttgtgtgtgtgcgtgtgagggtgatattgtattgcagattgagtttgcatttccctgatgactaatgaagttgagcagcttcccacgttagccttggccatctgggcatcctcttttgtgaagtgcctatttagctcttttagccacttggtaaaaaagtgattgtcattaagttgaaggagttctatatgtattataggtatgagtcttttgtcagacgtatgtctgtggcttttatttttttgtttgagatggagtcttgctctctcacccaggctggagtgcagtggcgcgatctcggctcactgcaacctccgcctcctgggttaagcaattctgcctcagcctcccaagtatctgggattactggtgcccactactgcgcctggctaacttttgtatttttagtagaggcagggtttcaccatgttggccaggatggtctcaagctcttgacatcatgatccacccgcctcgacctcccaaagtgctgtgattacaggcgtgagccaccgtgcccggctgtctgtggcttcctttttaatggcatcttttgatgaaccaaaactcattttcagctgggcatggtggctcacacttgttatcccagcactttggaaggccaaggtggaagggtcacttgaggccaggaggtcaagacctgcctgggcaacatagtaagaccctgtgtcgaccaaaaaaaaaaaaaaattagccaggtgtggtggtgcatacctatagccccagctactagctactctggaggctgaggtgagaggatcacttgagcccaggagtccaacattgcagtaagctgtgattgcaccactacactccaacctgggagacagaccctgtctcaaaaaaaaaaaaaaaaacccaaaaactcattttcatagagtccagcatattttcttttattaatgtgctttgtgtcctgccgaagaaacacttgcttgtccacaagtcacatagatgttctgtgttttatttcaaaagctttcctgactttgctttcgtatttagatatgtgatgtgtctgagttgtctttttttttttgagacagggtcttactctgtcacccaggtgggagcacagtggtgtgatcatggctcattgcagcctcaacctctttgggctcaggtgatccttccacctcagcctccagagtagctgggactacaggtgcctgccatcatgtccagctaatttttttttttgagagggagttttgcttttgttgcccaggctggagtgcaatggcgtgatctcagctcactgcaacctctgcctcccaggttcaagcgattctcttacctcagcctcccaagtagctgggattacaggcatgtgccaccatgcctggctgattttgtatttttagtagagaaggggtttcaccatgttggtcaggctggtcttgaactcctgacctcaggcgatccacccagcctaatttttgtatttttttttgcagagatgagtcttgtcatgttgctcaggctggccttgaattcctatactcaagcaaatccacctgcctcggcctcccagattgctgggattacaggtgtgagccactgcccagcctgttggtaattttgatggatatttgtaaactgagcatttaatgtgggaagaacaggcttcgtaccctctctcatctgtgtagggctccataacactttattgggtgctaactacatcctgggtgctttgctacacactgggcatcggtgggggtatggctgatgtaaatctcaaaatatatgatcaacagctggggtaaaggctctgaaagaaagggcctgacttctaaaagaccatggaacaaagacctgaaagggctaggggaggtcaggaaaggctccttgaaggaggtcatggttgagccacaatagggagaataattgtagattatccaagcaggagaactgggcgtgtagaataggactttccaagctaaggaaacagcacatgcagaagccttgcaatacatatctatggctgcattaacaacaagcctcaaaccccagtggctcagaacaacacccatgcattatatcctgtggtttctgtgggctgggaatttgggagcagctctgttaggcgtctctcatgaggttacagtcacatatcatctgtggttccacccatctgcaggtctgatgggggctggagtgcagctacttccaatatggctcactcacctggctgataaattggtttctcttcctatgggcctccctgcagggctgtttgagcatccttacaatatggcggctggtttcctggggaacacaaggtggtgctgcaatgccttttatgatctagccttggaagtcactcaccttctcttggccacataaactggccctgactatggaagaaggcttggcagggcatgaataccaagaggcaagagacattgagggccttcttggaggctggccaccacatgtcttaggcagaaagaggctggaactgtccatgatgtggctcaagtggagtgggttaataggtgggcagcaggagctgaaaggacaagacagggctgggcactgaggccttgtgggctgcagcggagaaggtagggttgggtttaccctaagagccctgagaagccattcaggggattcggtgaggtagggaggagctaacatgatcagatttgggttctgatgaacttcttccgtggtgaatggatggtgagggggccaagtagcagcccaggaatgaggctgggcaggcatccagcagaaaggtgagggtgacctgggccaggggcccaggaggggcagatcagctgactcaagggctctttgaaggaaaaacccacagggcttggcagcaagcctcttgtgatccccaacagagagctgtctgcctgctcaaaggccccacgaggagtaggcggctctacccagcacacgctatgggacttgggtttctgcagatctgattcctagcttaggcaagtcgagcctggagagagtgcttctgaggcccttccagggtaagggtggtaaagtgtccccattgttactgagtgctgctgttcctgcccagggcctctgatgggcctggcactgagcacggtgtctgggatgactcaccttcagccttctgactgaccgtagctcaggacacgtggccagctctccaccagccttcgtgctctgggctgcctggacctcggttagactggtctctgggcctctcctggcctccctggaatgtggcctgggaagcaaggagctatggcctggcagatctttccttttcatttacattttttctttttggtggggacagagtcttgttctgtcacccagggtggagtgcagtggcatgatcttggctcactgcaacctccacctcccaggttcaagtgattcttgtgcctcagcctcccgagtagctggaattacaggcgcctgctaccatgcccagctaatttttgtatttttagtagagatgaggtttcgccatggtggccagtctcggacacctgacctcaagtgattcacttgccttggcctcccagtgtgctgggattacaggcatgagccaccgtgcccggcctaaatttattttttgttttttagagatgtggacttactctgttgcccaggctagagtgcagtagcatgattatagctcactgcagcctcaaattcctgtccttaagcaatcctgccccagcttcccaaagcgctgggatcacaggcatgaaccaccatgcctggcctggcaagtctgtcttgtggcatattaggaaatgtgactttggaggctgagaggtggaggcagagtgaatgcccatgaaatctgtacctgttttcttttagaggctccacttccttctctcaggtaaggcatgagccactgtactcgacctttgtttggtctttcttttctcctttcattttttttttttttgagacagagtctcacactttcacccaggctggagtgcaatggtgcaatctcggctcactgcaagctccgcctcccgggttcacgccattctcccgcctcagcctcccgagtagctgggattacaggtgctcaccaccacgcccagctattttttttgtatttttagtagagacggggtttcactgtgttagccaggatagtctcgatctcctgacctcgtgatccgcccgccttggcctcccaaagtgctgggattacaggcgtgagccaccgcgccaggccttctcctttcttttcttttctctttcctttctctctctctttctctctctctcttcctctctttctctctcttcctctttttctctctttctctctctctttctttctctctctttttctctttctctctttctctctctgtctctttctctctttctctctctttttctctttctctctttctctctctttctctctctctctttctctctctctctttctctctctctgtctctctctctctttctcttgctttctctctctctgtgtgtctttctctctctctctttcttgatggagtctcactctgttgcccaggctggagtgcagtggcacaatctcagctcactacaacctcaaactcccgggttcaagcgattctcctgcctcagcctcccaagtagctgggattataggtgtgagccactgcacccagctaattttcatatttttagcatagatgaggtttaaccattttggccaggctggtctcaaattcttgacctcaagcgatccacctgcctcggcctcccaaagtgctgggattacaggtgtgagtcactgtgcctggccctttgtttgagatttctagtggtcaagtgaacaaagcaaatgacccaggaactggagacaaaactaggtttgtaacctgatctggtttgggtttctgtttgtgaaatggaaatgacactgttgttgggggaaaaacaactttacttttatttattttgagacagggtctcgctctgtcgcccaggttggagtgcagtgttgtgatcttggctcactgcaacctccgcctcccgggttcaagcaattctcctgtctcagcctcctgagtagctggaactacaggtgcatgacaccacacacggctaatttttgagggttttttttgagacagagtcttgttctgttgcccaggcttgagtgcaatggcacgatcttggctcactgcaacctccgcctcctgggttcaagcaattctcctgcctcagccttctgggtagccgggactacaggtgcacgccaccatgcccagctaatttttgtatttttagtagagacagggtttcaccatgttggccaggctggtctcgactcctgacctcaggtgatctgcctgccttggcctcccaaagtgctgggattacaggtgtgaaccatcgtgtctggcctaatttttgtgtttttagtagagatggagtttcacaatgttagccaggctggtctcgaactcctgacctcaggtgatctacctgacttggcctcgcaaagtgctgggattacaggtgtgagccaccatgcctggcctcatgtcctatatgttaattcaacctatatttgcattcctctgaagcttgtagtctgtggaggagtcagcacactaaggcctgaaggccaaatctggctggccatctgtttttataaataaagttttactggaacacagtcatacctactcatttacatattggtgatggctatttctgcactttgatgatggcaggtttgagtagttggggcatagaatgtgtggctcatgaaacccgaaatatttatctggttctttagagaaaatgtgtgccaatccctgctttgttcttgtgggacagacagattacgatagatagtaaataagaaaatctcaggctgggtgcagtggcttacacctgtaatcctagcactttgggaggcggaggcaggcagatcacctgagttcaggagttcgagaccagcctggccaacatggtgaaacccccgtctctactaaaaaaatacaaaaaattagccaggtggtgggtgcctggaatcccagccactcaggaagctgaggcaggataattgcctgaacctggaagatagaggttgcagtgagttgagattgcaccactgcactccagcctgggtgacagagcaagactctaagaaagaaaaaaaaaaaaaaaaagaatctttgacagtggtaaatgctacgaaaaaacagtaatagtaaagcatgactaggtgggtaaagggttgcttcccagtggtctggggaagcctctgttttgaggcaacgttgagctgtgtgaatcttccagaaggttgatttgggcagaagtggcagcaaaaacaaaggctttggggcacttaagaacttgagaggccaggggcagtggctcatacttgtaatcccagtactttgggaggctgaggcaggagaatcgcttgagcccaggagttcaagaccagcctgggcaacatagcaagaccctgtctctaccaaaacaaaacaaaactagtcagacgtggtgatgtgtacctgtagtcccagctacttgggaggctgaggcagggtgattgcttgagcccaggagttggaggctgcagtgagctgtgattgcaccacgacactccagcctgggcgacagagtgagactctgtctcaaaaacacaaaatgtaaataaagctaggccgggtgcagtggctcatgcctgtaatcctagtactttgggaggctgaggtgggcagatcacttgaggtcaggagttcgagactagcctggccaacatggtgaaactctgtctccactaaaaatacaaaaattaaccgggcgtggtggtgcgtgcctataatcccagctactcgggaggctgaggcaggagaatcactggaacccaggaggcagaggctgcagtgagctgagatgacaccactgcattccagcttggggaacaagagtgaaactccgtctcaaaaaaaaaaaaaaaaacaccccaaaactggtgctcagtgaagggaggaataagactcacccaaacaggaccctgtaaaaatagtaaaatgcttagattttatttcaagaacaatgggaagttctggaaggttttagtggtgaagaaggggatggcatgttccaatttatttttgtaaacatttctcagggccaggtgcagtggctcgtgcctgtaatcccagtgctttgggaggctaaggtaggaggattgcttgagcccaggagtttgaggctgtagtgagctatgatcatgtcactgtactccagcctgtggtgacagtgagaccctagctgggttgctgttgttgttgtttaaaaaaaggccggacacgtagctcacacctataatcccagtactttgggaggctgaggcgagtggatcacttgaggtcaggtgtttgagaccagcctggccaacatggtgaaaccccatctctactaaaaatacaaaaaattagctggacatggtggctcgttcctgtagtcccagctacttggaaggctaaggcaagagaattgcttgaacctgggagatggaggtagcagtgagccaagatcacaccattgcactccagcctgggcatcagagtgagactctatctcaaaaaaaaaaaaaaaaaaaaaaaaaaaggcctggtgcggtggcttacacctgtgatcccagcactttgagaggccgaggtgggtgtatcacaggtcaggagttggcctggctaacatggtgaagccttgtatttactaaaaatacaaaaattagccgggcatggtggcaagtgcctgtaattccagctacttgggaggctgaggcaggtgaactgcttgaatccgggaggcagaggttgcagtgggctgagattgtgccactgcactccagcctgggtgacagagtaagactctgtctctaaataaataaataaataaataaataaataaaataaagctttctagccgaagcgtttggaagggactctccagggcagctgggaggtcagggaggaggcttctagaatgaagtccaggtgagtgatgatggcagtttgggctggggtagcaggagcgtggataagtagaaagacttggcttatattttagaggaagaaccagcagagcttgctcatgttttgcatgtgaggcaaggagaggcatgaaaggagatgcctggattttttgcccagacaacttggaagcaaattccaacttgcagggtacccttaaggcaaatcgtttccatatctgagttttttccccatatctggaagatgggtcaagctatctcttcctgacaaggttgacaatgctgttacaaaggaaatctagcttagaggaagtctccaataaatgcagctggtctccttgcgttgaagtccctgagtaggaggtctgttcatctgtcccctcttcttatttcctcccctggctctaaggtgggttaggggccctgatcatgggttctgacaggtttatgggcctaaggttcactctggtgagactgtcttctgtcattccctttctgttcctaccctagtccagcttccttcaagtgctatccctttggtctcccatggcctggacaactggccatccctggggccactgttttgccctcaggttctggatgaaagacagctggattcatggtccgtactgctgagtgagtctatgatcttgggtaagtggcctctgagagtcctatgtgatgaatatttcaggccatggcaaacagggtcctgctacctaccttttatggttaaggattaaattaaataattcccaggctgggcaacatgggacaccctgtctctacaaaaatatataaaaaattagtcaagcctggtggtgtgtgcctgtgggtcccagctacttgggaggctgagatgggaggattgcttgagcttgggaggctgaggttacagtgaatggtgatcgtgccactgcattccagcctgggtgacagagtgagaccctgtctcaaaatagaagaaggctgggcacagtagctcaagcctgtaattatagcactttgggaggctgaggcaggaggatcacttgagttcaggagtttgagaccagcctgggcaacacggcaaaaccttgtctctacaaaaattaaccaggcgtgctggcgcatgcctgtattcctagccactcgggaggccgaggcaagataattgcttgagcctggaaggtggaggttgcagtgagccgagattgcacaccattccattccagcctgagagacgggagtgaaaccctgtctcaaaaaacaaaacaaaacaaaacagccaggcgcggtggctcacgcctgtaatcccagcaatttgggaggccgaggcaggcagatcacgaggtcaggagttagacgccagtctggccaacatagtgaaacctcgtctctactaaaaataaacaaaaaattagctgggcttggtggcgggcacctgtaatcccagctactcaggagactgaggcaggagaattgcgtgaacccgggaggcggagcttgcagtcagccgagatcgcaccactgcactccaacctgggctacagagcgagactcagtctcaaaaacaaaaaacaaacaacaaaaacaaaaagccccaggcacagtggctcatgcctgtaattgcttgagctcaagagttcaagaccagcctgggcaacatagtaagaccctgtctctattaaaaaaaaaaaattgaaaaagaaaaagttatctaaagagcctggtagactacgtaagtgctgattcaatattaatcgctgggaattttagtcttattattcagtcttcctgggtcctgccaagtgtgagcaattcatagcaaatggagggtctgtgtgaaggttcacttctggccaggatgacccttccctaccagctgttgggggaactgtgtgtgcatgtatatgtacatgcatataaacacattcacttgtgaattttataatacaaatattttgcaatacaaaaatgtaaaagtatgccctaattttaaactcctttctggtgcttcttgtggttgaaggtaaagtactttttagggctaggtgccgtggctcatgcctgtaatcccagccctttgggaggccgaggtgggcggatcacttgaggtcaggagttcaagacaagcctggccaacatggcaaaacactgtctctgctaaaaatacaaaaattagctgggcgtagtggcgcgtgcctgtaatcccagctactcgggaggctgagggaggagaattgctggaacccaggaggcagaggttacagtgaaccgagatcgtgccactgcactccagcttgggcaacagagtgagactctgtcaaaaaaaaaaaaaaaagaaaaaaaaaaagaaaaaaacttagccccatttactaatagtattttatttaccatcttatcaatttttcagtgtacagttcagtatatacacattgttgtgcaacagatctctggaatcattttgtaaaactgaaactcttgaacaataactccttttcctccttcccccccggccttggtaaccactattctactttctgtttctaagattttgattactttagatacttcataagtggaattgtatggtatttgtctttgtgtgattaggttctctcactgtgcgtaatgtcctcaaggttcatccatgttgtagcatataataagatattttttcttttcttttgttttttggagacggagtttcactcttgtcacccaggctggagtgcaatggtgtgatctcagctcactgcaacctccacctctcgggttcaagcagtactcttgccttaacctcctaagtagctgggattacaggtgcatgccaccatacccagctaattttgtatttttacttttatattatttatttatttatttatttatttattttgagatggagtttccctcttgttgcccaggctggagtacaatggtgtaatctcagcttacctcaacctccacctccagggttcaagcaattctcctgcctcagcctccggagtagctggggttataggcatgagccactatgtccagctaattttgtatttttagtagagatggggtttctccatgttggccaggctggtctcgaactcctgacctcaggtgatccacccgccttggcttcccaaagtgttgggattacaggtgtgagccactgcacctggccattttttcttttttaaagactgaattaggctgggtgcagtggcttacacctgtaatcccagcgctttgggaggccaaggccagcagatcgcttgagctcaggagtttgagaccagcctgggcaacatggagaaatcctgtctctacaaaaaatataaaaagttagcccattgtggtggcacatacctgtagtcccagctacttaagaagctgaggtaggagtatgccttgagcccaggagtttgacacctgcctgggcaacacagcaagaccccatctcttagcagcaatatgatctttttttttttttttcctgtctcttggctgttgtgactaatgctgcaatgaagacgggtatgcaaatatctctttaagatcctcttttcaattcttttgaatttatatccagaaatgggattgctggatcatatgataattctatttttaatttttttgaggaacttccatgctgtttctcatagcagctccaccattttattcgactctcaaccgtgcacaagggttccagtttctccacatcttcaccaacacttattatttgacagtggccattctaaggggtcttagggatatttcattgtggttttgatttgcatttccctgatgaccagtgatgttgagcatcttttcatatgcctgttttctatttgcatatctcctttgggaaagtatgtattcaaatcatttgctctttttgtttgtttttgagacggagtctcgctctgttgcccaggctggatggagtgcagtggtgcaatctcggcttgctgcaagctccacctcctgggttcacaccattctcctgcctcagcctcctgattagctgagactacaggcgactgccaccacgcctggctaattttttgtatttttagtagagatggggtttcaccacgttagccaggatggtctcgatctcctgaccgcgtgatccgcctgccgcctgggcctcccaaagtgctgggatcacaggtgtgagccaccgcacccagcccatttgctcatttgtaaatcgagtttttgttgttgcattgtagaaatttattattttttaaatttttatttgagacagagtttctctcttgttgcgcaggctggagcgcaatggtgcaatctcggctcactgcaacctccgcatcccaggttcaagtgattctcctgcctcagccttccgagtagctgggattacaggcacaccaccatgcccagcaaatttttatattttgaggagagacagggtttcaccatgttggccaggctggtctcaaactcttgacctcaggtgatccacccgccttggcctctcaaagtgctgggattacaggcgtgagccaccaagcctgacgggtagtaatttattttttatataatttttttcttctttttttggtagagacgaggttttgccatgttgctcaggctggtctaaaactaccgggctcaagtgatctgcctacccgggcctcccaaagtgcagggatcacaagcatgaaccaccatgcctggctgtaatttttcatatattccggatattaaccctttaccagataatacagtttgcaaactttttttttccccattctgtaggttgccttttcactgttggtcatttcttttgctgtatagctatccttaagtttgttgcaaacccatttgtctatcttttgtcttgttgcctgtgttttgctgtcatatccaagaaatcattgccaaatccattgtcatgaagcttttccccatgttttcttctaggagcactatagtttcaggtcttatgtttaatctttaataagttttgtgtttttgtatatggtgtaaggtaagggtccaacttcattcttttgtatgtggttatacagttttctcagcaccatttgttaaagacacaatctttcccccatgttctggtgctttaaaaaaaaaaaaaattctggctggttacggtggcttaggcctataatcccagcactttgggaggctgaggcaagtggactgcttgaggctaggagtcccagactagcctggccaacatggtgaaaccctgtctctaccaccgaagatacaaaaattagccaggcgtggtggagtacgcctgtaatcccagcctactagggaggctgaggcatgagaatcgcttgaacctgggaggcagaggttgcagtgagccaagatctcaccactgcacgccagccggggtgacagagtgaggcagggtcttaccctgtcgcccaggcaggagtccagtggcccaatcatggctcattgcagcctacactgccagggttcaagccatcctcccacctcagcctcccaagtagctaggattacaggtgtgtgtcaccatgcccagcaaatctttgtattttttgtagagatggggtatccctatgttgctcaggctggtcttgaactcctaacctcaagcgatcctcccacctgggcctctcaaagcactgggattacaggcgtgagccactgcgcctgacatggtgcttcttaatttattcttactttttatttttatttttttgagacaaggtcttgctctgtctcccaggctggaatgtagtggtacaatcatggctcactgcaacctctgcctctccggttcaagtgatcttcctgcctcaacctctggagtagtttggactatgggcacatgccacaacgactagctaatttttgtttttctttttttctttctttctttctttctttttttttttttttgagatgcagtttctctatgttacctaggctggtctaaaactcctgggctcaagcgatcctcccaccctggcctcccaaagtgctgggatgacaggcgtgagccacgtggtgcttaaaaaaggcaacaaaaaaccccccacacactgggtatagaagtggcatgggcctctatacactgtgagattcttggtactagctacaaattctgtgtatactcaagattttctagagtaggtgcaattaccccgttttacagatgaggacacagaggctgagccgtagtgacccacctaaggtcgtatagccagcaaatagatggaggttggattggaactgaggactttactcaagggctctcacaaacccttgggggcttctcgctgctttatccccatcacacctgaaagaatgaatgaatgaatgcctcgggcaccgtgcccacctcccagcaaaccgtggagcttggacgagcccactgctccgcgtggggggggtgtgtgcccgccttgcgcatgcgtgttccctgggcatggccggctccgttccatccttctgcacagggtatcgcctctctccgtttggtacatcccctcctcccccacgcccggactggggtggtagacgccgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgcaggcggtaggtaccatgggggggaacacggactcagggggacaggcagggcgctgggtggggggtcgcttcccctcggggtggccggtggccgctgctgacagacgggcgcgcatgcgtggggtggtgcggcgcgcagcggcagttggcgcgggcagggtggcacttccggtcgcgcgtgcccgggctgtttggcgccaaaatggaccgtggattcccccgtagctccctggtggctagaaactaggcggggtgggggttctcttttgatccccaaatacagcaagctttgggttcgtttccggggtccccttcttcaagcagcggtgggccgggctcttgactccagcttggtcgcacaggaagtgggcagcccgcggccaacggacacccctcgggcaccggcacttcggcctccacttccggtgtccggcccggtccccgggggcgcttctgtggtggggggtccctcagtgcctttcccccaaagctgtgcatctcgatggcggcctccagagacggatgtcacccgtcggggcctgggctgggctggctcatgttcgagagcccagccttccgtggggtactcattctgtcagttgggactgtgtggttcttgctccttgggaaagtccatgttttggcaggaactttaaccgtgcattgcagcgcagggcccgggaagcgtgaaggctgcatggttggtcttttcctgtaaatctgtgcctgtgagccgtgggcatcagggaagtcttgctaatgagaactggctacactttcgtgtgtgtttgtgtgtgttcatgggtgtgttctttagtgtgtgtctaatgttggaggccctggctttagcagttcatgcctctgtccaacttccgtgcacaaggatcagtgggagcactggtcccagccccttgttcatgaacgccatcagttcattcctgaaaacttgttcaagtgaggtgtgcgtgagtcagaggaaccctcaccaggcgtggacacttccagctggatttgtgaaagcactctttgccatttttctatttccttaggcttgttaactgacctggttgggccagtccggttctgatttgggtctttggggagggatggatatttggttcaacccccgctttttttcttttctttttttttttttttttgaaggctgggtgctgtggcttatgcctgtaatcccagcaatttgggaggcagtggcggacgaatctcttgagccaggagtttgagaccagcctgggcaacaaggcaaaaccccatgtctactaaaaatacaaaaattagcctggagtagtgccgtgcgcctgtggtcccaactactcaacagactaaggtgggagtatcacttgagccccagaggttgaggctgtgtgtagcgagctgagatcgcgctattgcactccagcctgggtgacagagtgagaccctgtctcaaaaaaagaaacactttttatttttagagatgggtctcactctgttgtccaggctggagtgccctggcacaattataactcactgtagccttgaactcctgggcttaagggatcctcagcctcctgagtagctgggaccacaggcgcccaccaccatgcccagatgactttcttagtttttgtttctgtatacgtgaggtttcaccatattgcccaggctggtcttaaacccctgccctcaagcagtcctcctgcctttgtgtcccaaaggttaggattacaagtatgagccatcatgccttaactactacttttttttgtttgtttgtttgagatggagtctcattctttcacccaggctggaatgcggtggcgtgatctcggctcactgcaacctccactttcagggttcaagtgattctcctgcctcagcctccgaagtagctgggattacaggtgcacaccaccacgcctggctaatttttgtgttttcagtggagtcggggtttctccatgttggtcaggctggtctcgaactcctgacctcgtgatccacctgcctcagcctcccaaagtgctgggattatagtcaaaccacttcttaaccagttagtgggtatatatcttcttgaatcatctgtgccagtattctcccaaaataaaacttgatttaaaatggaatggaagtgaaattatgaaagtgcctggcttcatgatgttacacccaattcagagaagtttgggcccggccttccttttttattccttttttttattttgtagagatggggtcttgccatgttgctcaggctggtcttcgattcctggcctcaagcgatcctcctgcctcagcttcccaaagtgttgggattacgggtgtgagccaccatgcccagcctgcccagccttcttgaaaacatgacctccactggctcaatgaccttaaacaagcgtatgccacctctatatccatagtctaggaataatgacatgggttttcagctggtattgggttaaatgagaatatgcatggcacataaaggttcacatgctagtggctaacttagcttgtttttttcagtttttttttaagagacaggatctcactgtgtcacccaggctggaatgcagtggcacagtcatggcttactgcagccttgaacccctgagctcaagcaatcctcctgccttagcctcctgagtggctggcacatgccaccatgcccaagttaatccttaaaaaattttttagaaggctgggcgcggtggctcacgtctgtaatcccagcactttgggaggctgagatgggcagatcacctgaggtcaggagtttgagaccagcctggccaacgtggcgaaaccccatctctactaaaaatacaaaaaaattagccaggtatggtggcaggtgcctgtaatcgcagctactcgggaggctgaggcaggataatcgcttgaacccaggagccgagattgcaccgttgcactccagcctgggcaacaggagcgaaactctgtctcagaaaaaaaaaaaatttttttttttagagatgagggtcttgctttgttgcccaggctggtcttgaactcctggactgaagcaatcctctgcgttggcctcccaaagggctgagattacaggcgtgagccacagggcccggccattattcctcaagagttcttaaaagtggatgctgcaggagttaactgccaggaagcaggaattcctgctaaggtctgctgcttgccaaagcctttcccttcaacaggggttgccagtaggccactggctcaggggctctgttggccctgtgcaaatattttgtttggctgaattggaataccattaggtgagccttacaatccaccactgaccctgggttccacatttctttacactcagattgcttcactgtaggcattggagttttggaggactgcttttgaccatgtggtagacattgaaattgtagtttatatgactcactccacagacttttttttttttttttacattttgaaaatatttcattaaatgaaaaataaacatggtatccaacagtacttgaaacttagatttttttttttttttaattgaggcagggtcttgctctgtggcccaggctagagtgcaatggtgtgatctcagctcactgcagcctccgcttcccgggtttaagcaattctcctgtctcagcttcccaagtagctgggattacaggtgtgcaccaccacgcccagctaatttttctttttccccctcgaggctgagccttgctctgtcgcccaggctggagtgcagtggccgtgatctcggctcactgcaacctccacctcccgagttcaagcaattctcctacttcagtgtcccaagtagctgggattacaggcgcccgccaccaagcccaggtaatttttgtatttttattagagactgggttttgccatgttgaccaggctggtttcaaactcttgatctcaagtgatccacttatcttagcctcccaaaatgctgggattacaggtatgatggtgtccagccggttcattgtttttattttattttattttattttattttattttattttattttattttattttatttttgagacagagtcttgtgctgtcgcccaggctggagtgcagtggtgcgaacttggctcactgcaacctccccctcccgggttcaagtgattctcctgccttagcctcctgagtagctgggattacaggcatgtgccaccacgcccggctaactttttcttatttttagtagaaaccggggtttaccgtgttggccaggctggtgttgaactcctggactcaagtgattcgcctgcctcagccccgcaaagtgttgggattacaggcatgagccaccgtgcctggccttttaattcattcttaagcctgctctcagacagctaggcttgcttctccacaataaagagtgttgaattttgtcggtgtatcccgcatggtgccattataacactgaaattagtgattatttcagggtctgttaccagagcgtgtctgccgtattcactgtatctgcagcttggagcacagtagactcaaatgcttgcatgccagctcttcccctgtacagcctggattaacactgatgctagcagactcctttgcacaactgattagctttcgtaactaccacagctttcttactgctagtcattctgtgatgggattaagctaggtcttgaactccttaactccagttccttggctactactgagtacatactgaataaggcaaaattgacttacctcttttgttttgctcccctgtggtagaattctaggggtacagactgctgggtttcaaatgccgccctacttgccagccgtatggctaagttattgaacttcttggtgccttggtgtttcatctataaaaagggggtggggctgcctgctcgacaggggtgttaggaagactgagcttatcagtacagatatgttgagagcagcacctgtccaaagcccttcatcactggttattacgtggtactgtgtgtacagtggggatgctgtgggtttggttccagaccactgcagtaaagtgaatctagcaagaaagtgagtcacacacacattttggtttcctagtatgtgtaaaagttattagactaggccgtgtgcagtggctcatgcctgtaatcccagcagtttgggaggccaaggcaggaggatcgcttgagccaaggagttcaagactagtctgggcaacataggaagaccccccccatctcaaaaaaaaaaataaagccaaaagtggtggcatgcacctggggtcccagctactcgggaggcagaggtgggaggatcacttgaacccatgaggtcgaggctgcagtttgccatgattgtgccactgcactccagcctgggtgaaggagtgagactctgtctcaaaaaaaaaaaaaaatcagctgggcgtggtggctcacgcctgtaatcccagcactttgggaggccaaggtgggcagatcacgaggtcaggagatcgagaccatcctggctaacacggtgaaaccccgtctctactaaaaatacaaaaaaaattagccaggcatggtggcacacgcctatagtcccagctccatgggaggctgaggcaggaaaattgcttgaacttgggaggcggaggttgcagtgagccgagatcatgccactgaactccagcctgggcaacagagcgagactccgtctcaaaaaaaaaaaaaaaatcatctgagtcttcagcgattcataatctttttgcaggtggagggtcttgcctcaaacttgccggcttaaaggacatacatttattaccttatgcaggtcagaaatctgatgtgggtttcaccggatgaaaatcaaggtgtaagcaggctgcattcctttctgggggctccaggggagaatctgtttcctattttggggtgttggcagaaggtggtagttgtaagactcaggtcccattttcttcactggttctaaactgagggtcgttgcccgcttctggaggcggtctcatccctcggctcatgcccccttcctctacctttaaagtcagcatttgcgggttgcatctctctctgacccgtcctccaacgttgcccgctctctgcagctagaaaggttctgtgttcttaagggctgaagtgattagattgggcccaccccagataatccaggataatctccccatctcaaggtctgtattcttagttacatctgcaaaatcgctttggccacgtaaagtaatatattcacaggttccagggattagggcatgaacatttttcggtgggtccactctttttgagatggagtctcgctctgtcacccaggctggagtgcagtggcatgatctcggctcactgcaacttctgcttcctgggttcaaatgattcttgtgcctcagcctcttgagtagctgggattacaggcgtgagccaccaagcccggttaatttttgtatttttagtagagatggggttttgccatgtttcccaggctggtcttgaactcctgagctcaggtgatctacccgcttcagcctcccaaagtgctgggattacaggcatgagccactgtgcccagtgggtctactcttttgcctactgcggatgccttcttgggcagccctgctccagctgccatgcagccggcctgaagaagctggtttgacagagacttgtaacttgtcttgcatggtccactatattttatttttagagacaaggtcttgctgtgtcacccaggctggaatgcagcggcacaattatagctcactgggctctagtgatcctcctgcctcagtctcctgagtagctaggaccacaggtgcatgctgccacaccaagctaattactattttttgtttaggcagggtctctgctgtgttgcccaggctggtcttgaattcctgagctctattgatcctcccgctttggcttcccgagtagctaggcctataggcacatgctagcacacccagctaattactaattactattttttgtagagacagggtctcgctgtgttgctcaggctggtcttgaattcctgggctctagtgatcctcccgcctcagcctcctgagtagctaagactataggtgcatgccaccacacccagctaattactattttttgtagagacaggttctcgctgtgttgcccaggctggtctcaaattcctgggctctagtgatccttccgcctcggcctcctgagcagctaggagtacaggtgcgtgctgtcatacccagctaattactgttttctcgtagagacagggtctcactgtattgcccaggctggtcacaaattcctgagctctagtgatcctcccgcctctgcctcccgagtagctaagactataggtgcatgctaccacagccagctaattattctttcttgtagagacagggtctcgctctgttgcccaggctagtctcgaattcctgggctcaagtgatcttcctgtcctggcttcccgagtgtagagattacaggcatgagccactgcgcccagccatggtctgctgtatttcagacgagcatttctggcgtagaggtgttagagtaatctaacattttataatttcttcctatccaatctatactagatacctctgctgggttagttttcttaacacggctctgatgtcattggttctacttccccttgactgctttggtgtttgttaactatggaacaagatggataagtgtgatgcttttgccctccctccgactgtccccagccacctctctggaggtgcctttccctccctgtatgtggccagtctcacgtttgtttcttgtgtgtttccagaaccagccacttctcaatggtgcccctgtttgagcagcttcctgtgcccggttcacacagagctgtcaacttcttcctgaggctgttataccctttctcttgggaatcccgcaggcgtgagctgtatttgccttattcctctgtggttgtttatatatatctttttttttttttttttttttgagacggagtttcactcttgttgtccaggctggagtgcaatgacgtgaccttggctcaccgcagcctccacctcccgggttcaagcgattctcctgcctcagcctcctgagtagctgggattataggcatgtgccaccatgcctggctgattctggatttttagtaaagacgaagtttcttcatgttggtcaggctggtctcgaactcctgacctcaggtgatccgcccgcctcggcctcccaaagtgctgggattacaggcatgagccaccgtgcctggccagctgtttatatatatcttatctcccctctgcagagggttcatctctgagggaagcactaggaaggaatcatagggtctcaggctgggcactaagccggcattctgagtcctctgctccgtccttcacggctgtctgcgaccctcctggcttcagcaggtgtgatcggtgtcatcacagttttaccagggaagggatgtcgctaaagttaccctcccgccagctcctcactgcctgcctgggatcccacctgccactctggggccaggcaggttaaatccagtttctactggatgaaacattctaggggttttgaaggtttctctattctctttgccaggctaaatatcccagttcatatgaggggttgaaagaaagcagacccattctgcaaggacaccttggtctccgcaatcagttgaaccttgtccttcacaccccaggcaacctcgggatcaggggactggctggcttggtcgaggtagaagccatgtccttccagttttctcagcggcgtgactgagaagtcaagtgtaacgctattaccacagcgtgtgtgcctctggctggaagtaccagtttctgtagccctcctgacttaaggctctccttggaccccagttgctacaagggtagaatgacttttgcctggaagaggttccttgtgctcctggaaatcctgatgtcaaagcatctttttttttttttttttttcttttgagacagggtcttgttctgttgcccaggctgaacaggctggattgcagtggtaccatcataactcactgcagcctcaacctcccaggctcaagcgatcctcccacctcagcctcccaagtagctggtaccacaggtgcacactaaccacacccagctaatttttacattttttttgtagagatgggatctctcagtgtagcccaggctggtctcaaactcctgacctcaagtgatcctcctgccttggcctcccaaggtgctgggattacaggcatgagccactgcgtcttgcctggccttgtagcaccttgagtccaagtgatacagtatatataatatacagtctatattaccactgtgtttgtagggtgctaagtgtctcttctacagagcagtcttttttttttttttttgagacagagttttgctctgttgcccaggctggagtgcagtggcatgatcttggctcactgcaagcttcacctcccgggttcacgccattcttctgcctcagcctcctgagtagctgggactacaggcgcccaccaccacgcctggctaattttttgtatttttagtagaggcggggtttcactgtgttagccaggatggtctccatctcctgacctcatgatccgcccacctcagccttccaaagtgctgggattacaggcgtgagccaccgtgcccggccctacagaatggtctttcctaaccacacagcaagtcaggaagtccctgcctagtgacacctacatctaatcacttagctctttgcctggagcagggcctggcattcagcaggtgctcatatgtgagcggcgctggtggggaatcagggcccgcatgacccagagcagctgttgtaagacatgggtccagcaaagcattcctcatgctgctgcctgcacttaccctctaggaaggccagcctggaggagccacttctgcccttcaggcaaatgataactgagcacctgtctgtgcgggtgctaggtggaaaggtccagagatggcagtggcctggtccctgcctggggcaccttctctccaccaacagacacttacccagctggttaggcctgttctcaccccgcagtctgtagttagcacccaggctgggaacaacagcctgtgttcctctccctttccttggtaccttctcttcttgttcctttatttttttctgaagagataggatcgccctatgttgtccaggctggactcgaactcctgcccacaagccatcctcccaccacagcctcctgagtagctggggttacaggcacgcagcaccgcggcactgcaccggctattgttcttttatttttttccctctttgtccctgaaagagtcaagctactaattgtcagtaatcaaatcagaccacgatttcccaggcaaactcctggcagttctacatttaggaatgactagctagagacatcctgaagaatgagttattcggggaggcgccagccacctcctctaacttcacctctatctgccctctgtgtgggtaccccttgcttccctggatgcttgactcccccatttcatcctcaaaatgccaccaccccccaccaggcctttaggaacatcagctggctgttccccacagtgtcctgtggccctgggctactcattctgacactggccatactgtggcacaccttgttatgggctgttgtcagacccaactggagaaagaccagctgtaggtcatttcccttacgggagtgccccaactatatgacctgccccctctttcctggtatctttttgagtcagggtctcactctgtctcctagattggagtgcagtgatgcaatcacggctcactgtggcctcgacctcccaggctcaggtgatcttccttcctcagcctcccaagtaactgggaccacaagcacatgccaccaaacccagttatttttattttattttattttattttattttgagacagagtttcactcttgttgcccaggctagagtgcaatggtgtgaccagctcactgcaacctctgcctcccgggttcaagtgattctcctgcctcagcctcccaagttgctgggattacagccacccaccaccacgcctggctaatttttgtatttttagtagagatggggtttcgccatgttggccaggctggtctcaaacccttgacctcaggtaatccacccaccttggccctcaggtaatccacccaactgctgctgtatgttgggattccaggcatcagccaccacgcccagccactaatttttgtatttttgtagagatggagtttcgccatgtttcccaggctggtctgaacgcctgggctcaagtgatccgctcgccttggcctcccaaagtgctgggattataagcgtgagccaccatgcctggtctctggtaccttttaaaatatacaggctgggcatgatggctcatgcctgtaatcccagcactttgggaggctgaggcaggtggatcgcctgaggtcgggagttcgaaaccagcctgaccaacacggagaaaccctgtctctgctaaaaatataaaattagctgggtgtggtggtgcatgcctgtaatcccagctactcgggaggctgagccaggagaatcgcttgaacctgggagtcggaggttgagctgagatcacaccattgcactccagcctgggcaacaagagcaaaaccctatctcaaaaaaaaaaaatatatatatatatacacacgtatatatacgtgtatatatatatacacacacatatgtatacatatatacgtatgtatacacatatatacgtatatatacacatatatatgtatatatacacacatatacgtgtatatatatacgtgtatatatatatgcatgccagacatggtgactcatgcctgtaatcctagcacttcaggagactgaggcaggcggatcacttgaggtcaggaatctaagaccagcttaaccaacatggtgaaaccctgtctctactcaaaatacaaaaaattaacgaggctggtggcacctataatcccagctacttgggaggctgaggtgagagaatcacttgaacccagaaggtgagggttgcagtgagctgagatcgcaccactgcactccagcctgggcaacagagcgagactccatgtctgtctgtctgtctatctatctgtataatgtatatgtatgtatgtatatatgtgtgtgtatatatatacacatatatacatacatatatacacacatactctgttacagagctgctgtgtgtgtgtgtatatatatatacacatatgtatatatacacatatacacatatatatgtatatatatacacacatatatatacacatatatatgtatatatatacacacatatatatacacatatatatgtatatatatacacacatatatatacacatatatatgtatatatatacacatatatatgtatatatatacacacacacacacatacacataattgtgttacagagctgctatgtaatctcacaatcatcagaaaaatgacccccaaaaggggaaccttgttcagatcagatgacttcttagcattaggcattccagtaggacactctagactcttgcggggagacaaaagccagcttagttttttctaacactcatatgttaaacttgtttgtgtccaaaacttctttagaactgtgatattcttacaggcaaatgaagttgcttaacaagtgtttgtattttctcccctatttcttcctcccaggctcaaagatttggaaagagacagcttaacagaaaaggtaatctccaccttaaaatttttcttattaccaaatctgactgacacactttgtggctcataaaaagaaatttgttttctttaaatggattttgcattttttcccatggagtttcaaagataatttggatattcttgttaaatgtcagcactaatttgctgctaatagttgggtggtggtggtgtttttttttgttgttgtttttgttttttgagacagagtctcactctgtcacccaggctagagtgcaatggcatgatctcggctcactgtgacctctgcctcccggattcaagctgttctcctgcctcagcctcccaagtagctgggactacaggcacgcaccaccatgcccagctaatttttatattattagtagagatggggtttcaccatgttggccagactggtcttgaacgcctgctcgtgatctgcccaccttggcctcccaaagtgctggaattacaggcgtgagccaccatgcctggcccaggttttttttttttttaaccaatctcagttcctaaacaatctactctggattgtaacttgtcctggtaacactgttttattgtgtttttgttattgttttgagatagggtctcattctgtagcccaggctggagtgcagtggcacaattttggctcactgcaaccttcgcctcccaggctcaagtgattttcccactcagcctcctgagtagctctaactacaggctcaagccaccatgcccagctaatttttaaatattttttgtaaagatgggattttgtcatgttgccccaggctggtcttgaactctggggctcaaagcaatccacttgcctcggcctcccaaagtgctgggattataggtgtgagccactgtgcctggccgacactttacagaagcacagtattattcttataaaccatgatatgtctccatctcacctccagctttcccatttttcaccactttggagacaggagtgaagtgatcctaatggaaattccctgaacacatttcatgactgtttagtgttttgactgagacagcattgcctgccattcactcattgtgatgtgatcaggcagctcaataatttgtgtattagtccactagtgaatagcttgggaatgtgggtactgctaaacctatatccttcccttaggaatgtgtgaaggagaaattgaatctcttgcacgaatttctgcaaacagaaataaagaatcagttatgtgacttggaaaccaaattacgtaaagaagaattatccgaggtaagtcagttctcagcatcctagcctctagaaaaatgtctcctcctagtaacttgtctgtgaccagggaggcagcaagatccccagctgtcctcattgcctgatgatgatgatgatgatgatgatgatgaaggaaacacatgtgtttccttgttctctgacacttgtttacattcactgctacttaaattatcctttcctgctgtaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcgtaagagcagatgattccttttatttttaattgtttttgagatggagtctcactgtgttgcccagtctggagcacagtggtgtaacctcggctcactgtaacctctgcctcccaggttcaagagaccctcctgcctcagcctcccaagtaactgggattagaggtatgtgccaccacacccagctaatttttgtatttagtagagatggggtcttaccatgttggccaggctggtccagaactcctgacctcaagtaatccacctgccttggcctcccaaagtgctgggattacaggcataagccaccacgcctggccctgcttaactctctttctttctttcttttttttttttttttaatgacagagtcttgctctatcgcccaggatagagtgcaatggcgcgatctcggctcactgcaacctccgcctcccagtttcaagcgattctcctgcctcagcctcccaagtagctagtattacaggcgggcaccaccatgcccagctaatctttgtatttttagtagagatggggtttcaccatgttggccagactggtctggaactcctgacctcaagtggtcctcccgccttagcttcccaaagtgctgggattacaggtgtgagccaccgtgcccggccccacttggctcattttcaacctagaagcaggctttggtagcatataagggggcagttaaacttggaccccaggtcagtgtgtccaggttcctttcttttgtacgcatcctcactagtaattactggacacttcctaactagcttagatgtgtacgtctttaaattttgtcttagctgggggtgtggtggctcatgcctgtaatccctgcactttgggtggccaaggtggctggatcacctgaggtcaggagttcgagaccaccctgcccaacatggcaaaaccctgtctctactgaaaatacaaaaaatttgccagacgtggtggcgggtgtctgtaattccagcctgggcaacaagagtaagacactgtctcaaaaaaaaaaaaatgttgttttcgaccaagttgcagcattagatcccaaaacatggctatgagtgtgacaggttgcagatgacaagtgctacaaatacttactccttctaagaccttatatgcctggttaaacatttattctcagactcttgcccagttttaggcaaaggaactctaatggaaattttttttttttttttttttttttgagatggagtcttgttgtctcccaggctgaagtgcagtggcgcaatctcggctcactgcaagctctgcctcccaggttcatgccattcttttgcctcagcctcccgagtagctgggactacaggcgcccgccaccatgcccggctaattttttttgtattttttagtagagacgggatttcaccatattagccaggatgatttcgatctcctgacctcatgatccgcccgcctcggcctcccaaagtgctgggattacaggcgtgagccaccgcgcccagcctcttctggaattttttaaaaaacaaacaataggatagtacttgagctcaggtctggttctcagctacttcatttttattttgttttattttattattatttttgagagagaatctcgctctgttgcccagtggcacgatctcggctcactgcaagctccacctcccaggttcatgccattctcctgcctcagcctcccaagtagctgggactacaggcgcacaccacgcctggataattttttgtatttttagtaggatggggtttcactgtgttagccaggatggtctcaatatcccgacctcgtgatccacctgcctcggcctcccaaagtgttgggattacaggcgtgagccaccatgcccagccttattttattttcttttaatttttattttattttttgagatggaggcatgcgccaccacgcccagttaatttttgtatttttagtagagacagggtttcaccatgttggccaaggtggtctcgaactcctgacctcaggtgatccacctgccttggcctcccaaagtgctgagattacaggtgtaagccacctcacctggccctttattttatttttttttgagatggagtcttactctgttgccaggctggagtgcagtggcacaatctcggctcaccacaacctccacctcctgggttcaagtgatttttttgcctcagcctcctgaggagctgggactacaggcacgtgccaccacgcccagctaatttttgtatttttaatagagacggggtttcaccatgttggccaggatggtctcgatctcttgaccttgtgatctgcccgtcttgcctcccaaagtgctgggattacaggcatgagccactgcacctggcctatttcttttttttctttctttcttttcttttttttttttttttaagagacagggtcttgctctgtcgccaaggctgtgtacagtggcgcgatcttggctcacggcaacccccatctcctgggttcaagtgattcttgtgcctcagcctcttgaatagctgggattataggtgtgtaccaccacgcccagctaatttttttgtatttttagtagagatgggggtttgccatgttgtccaggctgttctcgaatacctgagcttggattattttcccacctcagcctctcaaagttttggtattatagatgtgagccactgtgcctggcccacttcatcttttgatattttaacaagaggctctgtttcctggccttctttagcatttggcccctcaaataactgacatgatatggctcaacaaactggcaggtgctaactgccaacattagcaagctggttgttgactagaataaaaatgcaaagatgcttagtccttagaacctggcttcctgcaatagcttagtaatgttgaactgcattattgctgtgggctttctattgatagtggcttttttttttctttttaatgctttttcttctttaaacagctgaaccttcacctagccccaggattacaaggaaaagcaccaggcaaaccaccatcacatctcattttgcaaaggggtcagtatacgataaattggcggctgccttttttaggggccggctgttttgggatggaattggtagggcgtcacgtggcaattctgtcttccgtgttgtataggttttcatcttgcggttctgttctctagacatttatgaatagcatttctgaaaacgttacctgtttttactcatataggaaagttcaaatgtacacaaaatcatgagttttgtataatgaaccctgaaatacccatcatctagtgccaacagttatcaagttacagccgttgtttcatctatacccccatattgtgtgtccctgccccacctggattactttgtccatatatagtttagtatatttctagacaatgagatctcttttgacaactttttaaaaaattactcatattttacaataattgctaacatttagcagtcttttttttttgagacagcatctggctgtcacccaggctggagtgcagtggcacgatctcggctcactgcaacctctgcctcccgggttcaagtgattctcctgcctcagcctcctgagtatctgggattacaggcgcgcgccgccacgcctggctaatttttgtatttttagtagaggtggggtttcactatgttggccagactggtctcaaactcctgacctcaggtgatctgcccacttcaacctcccaaagtgctggggttacaggcgtgagccaccgtgcccagccaaaacagtctttttaacaaaccaaagtataatactgttctgatgtctttataaaaatgtaagaattccctgctatcagatatatagttggtatttacgtttttccctttgtggtgaacaagccgtgtggcaaacagacagcgtttggttgacttgttccttaaagttatagattccttccctcctattttacttaaaattcctcacagattttaaattccttcatctcttatcttcttgccatttacttgaagaaattcatttgtccaatagttcctagattgggccgattgcatccttgtggtgttccacaggtccccttgccttctgttccctataaactgataggattacaggactgatcagattccagctttttattttttgagactgacttttttttttttttgatacggagtcttgctctgtagcccaggctggagtgcagtggcatgatttcggctcactgcaacctccacctcccaggttcaagcgattctcctgcctcagcctcctgagtagctgggattacaagtgcccgccacaacccctggctaatgtttgtatttttggtagagacagggttttaccacgttggccaggctggtctgaaactcctgaactcaggtgatcctcatgccttggactcccaaagtgctgggattataggcgtgagccactgcacctggtctgaggctgactttatggatggtgctgtgtccctccatcagaaaggtgtgtgaggtctcttctctgacactagcagctgttgatcggtgtttagacccgtgatttcttaggacttacaagatggcaagacaacattctaaacccgtcattcagagaaacattaaacttgaagcctctttcaacatcctggtgaatgagggtccacttcaggccagctggaggcctagggtcttgttccactaatggttggcctcactgtgtgtgacagccctgccaaacggaaacctcaggaagagtctgaaagagccaaatcggatgagtccatcaaggaagaagacaaagaccaggtagggccagtgctttcatttcctgactctaccttaacttggtgtatttgatgattgtgacttcatatgtgttctgtccaagtaaataaaaaccctgtctagggctctatttagggctctccagagagacaggaccaatagaatgtatatgtgtgtatacagctataggtacatatatacatatgcacgtgtatgtatatatatataattcgtttgatttttttcttgtttttatgggtacatagttggaatatatatttatggggagagactttattttgagaaattggctcacaagattgtgaaagccagcaaatttgaaatctgcagggcaggctggaggtccaggggagaaatgatgtcatagctcaagtggcaaggcagtcttacatacatacatgttatatatatgtgtgtgtgtgtgtgtgtgtgtgtgtgtgtgtgtgtgtgtgtgtatgtatgtatgtatttagacttctttttttgagacttttttttttttttgagacagggttttgctcttgtggcacaatcttggttcattgcaacctcagcctcccgggttcaagtgattctcctgcttcagcctcccgagtagctgggactacaggcgcgtgccaccacgcccggctaatttttgtattttagtagggatggggtttcaccatgttgcccaggctggtctcccatgttgcccaggctggtctcgaactccttgagcttaggcaatctgcccgcctcagcctcccaaagtgccaggattataggtgtgagccaccgtgcccagccaatttgttttttttgttgttgttgttgttgtttttaattttttttagatggagtctcactctttcactcaggatggagtgcagtggcacgatctcagctcactgcaacctccgcctcctgggttcaagtgactctccatcctcagcttcctgagtagctgagactacaaggcatgtgccatcatacccagctaatttttatatttttagtagagatgggatttcactgtgttggccaggctggtcttgaactcctgacctcaagtgatccacccgcttcagcctcccaaagtgttgggattacagttctgtcttttttcttttcttttcttttctttgagacaggtctcattctgtcaccaggctggggtgcagtggcgcagtcatggctcactgcagcctcaacctcctgggcttaagcgatcctcccacctcaccctcccaagcagctgggactacaggcgcatgccaatgagctaagttttgtattttttgtagagatgaggtttcccatgttgcccagactggtctctaacaaataaattaaacaaattcctgacacaagatggagaatctttgattcttttacatagtatcaccaggcgatctctagtgatgggcagtgtgcctgcctacttctcggacctgcttttgttttggggttggtggggattaataccagagtaagagtttctcagatcttctccccaaaacccaggccccttcttttcccactcttgctctaaccatgtcaaatgtgttaatatttcaactcacacttttggtgttgaccttcccttgaaaccagtattctaatcttttttgttcttccttccctccacacaggatgagaagagacgtagagttacatccagagaacggtaagaatagttactatacctttctttttgttctacgagttgtgtaatcttgatcacaaaactttttcagaaagtttaaggccgggcacggtgactcatgcctgtaatctcagcactttgggaggccaagatgggcgaatcacttgaggtcaggagttcaagaccagcctgaccaacatggcgaaaccccgtctctactaaaaattcaaaacttagctgggcgtggtggaatgtgcctttaatcccagctactcaggaggctgagtcagaaggattgcttgaacccaggaggtagaggctgcagtgatctgagatcattccactgcactccagcctgagtgacagagcaagactccatctcaaaaaaaaaaaaaaaagtttaaaaagaagaactttatcgtgtgtttccatggcaaccatatcgttatgaagtatctgaatttggggtcagatcattagcgtttagattcaagtagaattctcctgttttcttggaaggaatgaatcgagggcagctggcattcgaaccaggtgtaaaagtcatatcaaatactaaatgttaaatgagtatgtgtctgtcagggctcctgagataatgaagattgcttttgggggaaagaggagctttatgaaaactgcttctttggggaagctcctggcactcacacttggggtctgtgttattttgcttgacagagttgctagaccgcttcctgcagaagaacctgaaagagcaaaatcaggaacgcgcactgaaaaggaagaagaaagagatgaaaaagtaaagctctatcacctctaagtttgttaattctcccttaatcctatatggtcccaatttccttccaggacgtggggacagggggtggggaacgtggaagaacaagatgggttttgctagtgatcgaaatgcctttgactttggctaaacacctttcaaacttgttttctcgtggtctctacatgaaaggtgggttatgagattgtgatagtgaggacccttgctacttatttgtgatattttattttattttatttatttatttatttttgagacagtctcccactctgtcacccaggctggaatgagtacagaggtgcgatctcggctcgttgcaacctctgcctcccaggttcaagtgattctcatgtcccagcctcttgagtcactgggactacaggcgcccgccgccatactcggctaattttagtggagatggggtttcactgtgttggccaggctgatcttgaactcctgacctcgagtgatccacctgcctcagccaccaaagtgctaggattacaggcatgagccaccacaccggccaacctatgccacttaatcaactagtcacagagcttcagtttgtcacctcgccttcttgcttctctggctgatgagatctttgtgaagatctaattttcagacgtacgaggtgctaaaactttttttttttttttttttgagatggagtcttgctctgttgcccaggctggaatgcagtggtgtgatcttgtctcaccgcaacctctgcctcccgggttcttgtgcctcagcctcctgagtagctgggattacaggtgcctgccaccacagccagataattttgtatttttagtaaagatggggtttctccatgttgatcaggctggtcttgaactcccaatctcaggtgatccacctgccttggcctcccaaagtgctgggattataggcgtgagccaccacacccggcctaaaatacttttcaaacttatttttttgtagttctctacatggaaggtgggttatgaggttgtcatagcgaggatctttgctacttatttgtggtatttatttaatttaatttaattttttttttttgagacagtctcccgctctatcacccaggctggagtgcagaggtgcgatcttggctcattgcaacctccgcctcccaggttcaagtaattctcatgtcccagcctcccaactagctggggctacaggcgcctgccaccacacctggctaatttttgtgtttttatttatttatttatttatttatttatttatttatttatttgagacggagtctcgctctgtcgcccaggctgaagtgcagtggcttgatctccgctcactgcaagctccacctcctgggttcacaccattctcctgcctcagcctcccgagtagctgggaccacaggcgcctgccaccatgcccggctaattttttgtatttttagtagagaaggggtttcaccacgttagccaggatggtcttgatctcctgacctcgtgatcctcccatctcggcctcccaaagtgctgggattacaggcgtgaaccaccgcgcctagccaatttttgtgtttttagtagagacggggtttcaccatgttggccaggctggtctcaaactgctgacctcgaacggtccacctgcctcagccatcaaagtgctgggattacaggcacgagccaccacaccggccaacctatgctacttaaatcaactagtcagtttcagtctgtcacctcagccaccttctctggctgacgagatcttggtgaagatctaattttcagatgtaggaggtgctaaaattctttagcatcatccagacataaagttgtattctcctctctgaagtcagaccagctctttccccagtccctcatcttctttgtaaaatctgagtctaaggttctatgcaatacagatgctgggtcctgtttttttttctgtttgttttgttttttaataagatgactgagggccgggtgtggtggctcatgcctgtaattctagcattttgggaggccgaggtgggtggatcgcttgagctcaggagttcagggccagcctgggcaatgtagtgagaccccgtctctgcaaaaaatacaaaaatcagctggatgtggtggagcttacaacaggcagtgtgcctgtagttccagcttctcaggaggctgaggcaggaagatcacttgagctcaggaggctgaggatacagtgagccatgattgtcccactgcaatccagcctggatgataaagtgagactggtcttaaaacaaacaaacaaacaaacaaaacaaacaaacaaaaaaaaaccaagatgactagaagtttcttaccaacttaggtaggtgacgagtgccttacttgggagcttagtaaaggatggctgtccattggggaatcaactaaaatgtacagtaattttttttgttttttgagacggagttttgttctacttgcccaggctgcagtgcagtggtgtgatctcggctcactgcaacctctgtctcctgcgttcaaacaaattctcctgccttagcctcccgagtagctgggattacaggcttccgctaccacgcccagctaattaactttttgtacttttagtagagacaggggttcaccatgttggctaggctggtctcgaactcctgaccccaggtgatccacccgcctcggcctcccaaagtgctgggattacaggcgtgagccactgcatccggccgctgtacaataatttttgaaccattcagtacttgaggttggtctttcttgctttttttctttttttttaattgagatggaattttgctctttcgctcaggctggagtgaagtggcgcaattttagctcactacaacctccaccccctgggttccagcgattctcctgcctcagcctctccagtagctgggattataggcgcccgccaccccgtccgcctaatttttgtatttttagtagagacagggttttgccgtgttggccaggttggtctggaactcctgacctcaggtgatccacccacctcagcctcccaaagtccaggattacaggggtgaaacaccacgcccggccgaggctggtctttcattgatcacctttcctaccctgatcctagttaaattagacagcagttgcagtcagtgcatacctcgaatttgtttcagaacaagcagtcctaacgggctagttcaaccaccaccttccaaagaaggaacctggggcaagatcgaaatccctcacctgtaagcatactctcaggatttcttcttgtagtaggaagatttgctaagcgttttttttatttttatttgagacggagtctcactctgtcgcccaggctggagtgcagtggtgcgatctccgctcacttcaagctccgcttcccaggttcacgccattctcctgcctcagcctcccgagtaactgggactacaggcacctgctaccacgccaggctaatttttttttgtatttttagtagagacggggttatttatttatttacttatttattttttgagacggaatctcgctcttgtcgcccaggctggagtgcagtggcacgatctcggttcactgcaagctctgcctcccaagttcacgccattctcctgcctccacctccccagtagctgggactgcaggcgcccgccaacacgcccggctaatttttttttttttttttttttgtatttttagtagagacggggtttcactgtgttagccaggatggtctcgatctcctgacctcgtgatctgcccatctcggcctcccaaagtgctgggattacagtagtgagccactgtgcccagctgcaaagtgtttcttaatattcctgacctttgcgatctcttcacagactaccacatgtggagtttctgagggttggatttgacttgcctgattctctggcaagatgtgtctggttctttaaatgcagcctcaggctgggcatggtggctcacgcctgtaatgccagcactttgggagaccaaggcagacggatcacttgaattcaagaccagtctggccaacgtgatgaaaccctgtctctactaaaaatacaaaaattagctggtcatggtggtgtgtgcctgtaaactcagctacttgggaggctgaagcaggagaattgtttgaacctgggagttggaggttacagtgagccaagagtacaccactgcactccagcctgggtaacagagtgagactccgtctcataaataaataaatgaataaatgcagtctcagaggatgtgttgttgtgtctcagttggagctacttttcagattgggccatcctatttcattcctttaatatcggaagtagagatttataataaagttactttctgtgaggctatcaacacttaactgatgacaagtagtagaggaattttgaagtaaaaatactgaaactgcagtgttgtagtatctcctttctaagagtttcatttcctgtctacttaccccactgaagaagaaaagaaaattgctgtcttgaacacctggcacaagtgatcctctcacctcagccttccaaagttctgagattacaggcatgagctactgtgcccactggtagacagtctttactcccaccagtggactctagaatcagttcaggtgttttatttccataggacactttaatagaaagatccaaaccaaatggaaaaaattaacttgtcttttttccctgcaacttaggaagaaaagagactccgaagtcaaaccaaagaaccgtaagtgcagcgaacctgcctttgtgctttgttgtgaaactgaattgctaacataagtatcttggtaaaataacgggttggtgtggaacagtgggcactaatcatatgtctcttatgtgggcaagttctgcttgtgaaaggtgagaccaccctgaagtgaaggctgaagttaacttttttaactttaatttaatttaatttaattttgagacggagtcttgctgtgtcacccaggctggagtacagtggtgcaatcctggctcactgcaacccccacctcccgggctcaagcaattctcctgtctcagcctcccgagtagctgggagtatgggcctgtaccaccatgcccaactaattttcgtatttttagtagagacagggtttcaccatattggtcaggctggtcttgaactcctgacctccgtgacccacctgcctcgcctcccaaagtgctgggattacggggtgaagttagcttcgatttctcctcccaaccccagggcccttctcagggttggtcacacagctgtgtgtcatgtggtagtgaaaggccatcaggtgagcagctgtgtcacttacctttcactgtgaaaatgctgtgtgacaaatggctccaaggccagaggcctagaacagtgagcatttttcaagctcacttgtctacagcttggtggctgtcggctgatcttgaggtggcttagtggggatggctgggctgacccagctctgcctccgcaatttggccaggctgggtacacgcttgtggctgtgccagaccacaagggcagaaatgaaaagtagcactttttcaaacctctgttgaaaaaagttgggccaggtgcagtagctcgcgcctataatctcagcactttgagaggctgaggcgggtggatcacttgaggtcaggagttcaagatcagcctggccaacatggtgaaaccccgtctctaataaaaatacaaaaaattagctgggtgtggtggtgcatgcctgtggtcccagctacttgggagactgaggcaggagaatcacttgaacccgggaggcggtggttgcagtgagctgagatcacatcactgcactccagggtaggtgatagagcgagactctgcctcaagaaaaaaaaaaaggaaaaaagaaaaagaaaacaattagctgaagcaaattttgagactgagcctgaatccagaggtgggcagaataccccacctgagcggcagggccctggcagagtgggaggtgaagactcggacccctgtgtgcagtcagctgtccacggtcactgactgacgctgatcgcacatcagcccagctctcaacctaggcaggccagacatgggtcttcctccaccgcaggctggattcccatcaggccacggaaatcatgacatccctttgtctgctttttgtattaaaccactggcatctctgaccaacattcagatggggtattgatggtgttcctgaagaccttgagtcctggagtagtaaatgccctctgggcttcctgcagtgaagacaggagaggcagcctgtcctctgaacctggggaggagcttgtgtcagcccttaggagctgttggccccggtgcagggccccccccgagctgaccagcctgtgtgtgtgttgtcttctgtgacagaacacccaaacagaaactgaaggaggagccggacagagaagccagggcaggcgtgcaggctgacgaggacgaagatggagacgagaaagtaaaggcgggttatttgtttctgaactccccctcattcttctgctcctgtttgcttgggcgggagtgcgcagggtggggctctgggttcaagtccagccccatccacccaggctccatggggccatccagactctgggaaggtcaccttttcctccttttgggggccgggatttgtggctggatgcctgtgctggatgcctagtgaacactcagttgtcctctgtctttcacactagagagggtctgtgtgagcctgggctgagatgtgcatgaagcatcctctcctgaggcctcactgctgagaagccttgacacacagtcagctctgacgcacatgtcagccacacctttgattctttcccagcctcctacgttctgagtctagctctccccctgccagcctccccagtctagtttagccaagtgcatgcgtttaaaccctaaagcatcatgtggaacactgctgggcctctgtcaaagtacaggatggccaggttgcctgcaggccctcctgcatgaactctagggaagggagctaggtcatcggtggggggcggcgggtccctatctaagagatgccgaagaccccaagagggtctctgggtttctgcctgttacaatctagagagtggagcccaaggtcacgggcttgctgggtgacaagcaccctcacttctgacccggtcgccagtgggcttccatccccaccccatagcaggggagcctttggtattgcctccagcctcccatccctcacctcttctgtccaaatgttggtcaccttactgtcagcactccttcagactggagtagtcacattactccctgccctctattggaaactggcaggggcctgagctcacactgccagcacttttgcctcatggtagaaagggatgtgagggctgggcatggtggctcactactgtaatcccagcactttgggaggctgaggtgggtggatcacttgaggtcaggagtctgagaccagccaggccaacatggtgaaatccggtgtcacctaaaaatataaaaattagccgggcatggtggcatgtgcctctaatcccagctacttgggaggctgaggtaggagaatcacttgaacccaggaggcagaggttgcagtgagccaagattatgccgctgcactccagcctgggcaacagagcgagactctgtctcaaaaaaataatatggtaataataataaaagcagtgcccagagaacaaggattgttggctgttccaccccagggggccccttgcacaggaggtgccatctctgcctcccaaagctctaagagccactgtcccccatcccaagagacagggtcttgctttgtcacccaggctggaatgcagtggtgcaatcacggttcactgtagcctcgacctcccaggctcaggtgatcttcccgcctcagcctcccaagtagctgggactataggcaggcaccaccatgtccagctaatttttttttttaattttttgtagagatagggttttgccatgttgcccaggctggtctcagtcaaactcctagactcgagttatccacctatctcagtcccccaaagtggcggagtggtaggattacaggcatgaaccgttgcattcagtctgtttggtttgttcttttttttttttttttttttttttttttttttttttttttttttaagatagtctctctctgtcatgcaatggtgtgatctcgagtcactgcaacctccacctcccaggttcaagtgattctcctgtctcagcctcctgagtagctgggattacaggcgtgtgctactatgcctagctaatttttatatttttagtagagacagggattcaccatgttggccaggctggtctctaactcctgatctcaaacaatccacctgcctcagcctcccaaggtgctgggattatgtgtgtgaggcaccacgcccggcgtgtttgtttgtttgtttgtttgtttgtttttgagacaggatcttgctctgtttcccaggctagagtgcaggagtgcagtggtgctatcatagctcactgcagtctcctgggttcaagtgatcctcccacctcagcctcccaagtagctggcactacaggcatgcaccaccatggatgtctactttttaaacttattttttgtaagccaggcgcggtgtctcacgcctataatcccagcattttgggacactgaggtgggcggatcacctgaagtcaggagtttgaaatcagcctgaccaacatggtgaaaccccagctctactaaaaatacagaattagctgggtgtggtggcgaatgcctgtaatcccagctactagagaggccgaggcaggagaatcgtttgaacctgagaggcagaggtgagccaagatcataccattgcactccagcctgggcaacaagagtgaatcaatctctctctctctctccatatatatgtatatattaaccatatatatatgctgctttttgtattaaaccactggcatctctgaccaacattcagatggggtattgatggtgttcctgaagaccttgagtcctggagtagtaaatgccctctgggcttcctgcagtgaagacaggagaggcagcctgtcctctgaacctggggaggagcttgtgtcagcccttaggagctgttggccccggtgcagggccccccgagctgaccagcctgtgtcatatatatatatagtatattttgcagagatggggtctcagcatgttgcccaggctggcctcgaactcctggcatcaagcaatcctcctgccttagcttcccaaagtgctgggtttacaggcacatgccactgcacacagcctgtaaataaagttttattggaacagagccacactttctcatttacattttgcctgtgggtgcttttgtgctaccatagcagagatgatcatcctgacacagaccacgtggtcagcaaagctgaaaatactgatcctctggctcttacaaaaacagtttgccaagccctggtctaggaggttctttagtgccctcttgttagtttcaggtggggaattaagtgagggaaagtgaagcctcgtgtctacccggtagatctgcccaggcctgcctgtcttccagctccacagtgctgggatccctaacctgtaacttcagtgtttgcattttatctcactctggctcagaaactaattttttcccttctttatctctctacctcccccttatttttctgtcaggatgagaagaagcacagaagtcaacccaaagatctgtaagtgtttaaaatgcttgtgcttttgtgtcatctggatcagtagaaagcctgttctaggccaggtgtggtggcttgcacctgtaatcccagcactttgggaggctgaggtgggtgaatcacctgaggtcaggagttcgagaccagcctagcctggccaacatggtggaaccctgtctgtactaaaaatacaaaaattagctgggtgtggtggcgggtgcctataatcccagctactcggaaggctgaggcagaactgctagaagccaggaggtggaggttgcagtgagccaagattgcgccactgcactccagcctggacaagagtgaaactctgtctcaaaaaaaaaaaaaaaaaaaagcctgttctagaaacctgtggtgatgtagatgtgtggggaccctggggcctctgaaggcctcgtctcgggatgacaagctggcagtgtgcctatagagctcccatgggtatcttgctttcccatggggaggcattagtttgtcactttccgtgcgagttggcgatgtggttagtgtttctaagctgctacttgctgtgtatctgttcaccctgcagagctgccaaacggaggcccgaagaaaaagaacctgaaaaagtaaatccacagatttctgatgaaaaagacgaggatgaaaaggtaaaggtctcacttttctttctttcttttttttttttttttttttccccaagacggggtttcgccatgttgcccaggctggtcttaggaaaaagaagactgggcgtggtggcgcacgcctgtaatcccagcactttgagaggctgaagcgggtgaatcacatgaggtcaggagttcaagaccagcctgaccaatatggtgaaaccctgtctctactaaaaatacaaaaattatctgggcatggtggtgcacgcccgtagtcccagctactcgagaggctgagataggagaatcgcttgagcctgggaggtggaggttgcagtgagccgagatcgcactccaggctggggacacagcaaaattagctgggcgtggtggcatatgcctgtagtcccagctgcttggaagcctgaggcatgagaattgcttgaacccaggaggcggagattgctgtgagctgagatcgtgccactgtactcctgcctggacaacagagcaagactctgtctcaaaaaaaaaaaaaaatgctgggcacagcggctcacgcctgtcttttcagcactttgggaggccaaggcaggcgcatcacctgaggtcaggagtttgaaaccagcctggacaacatggtgaaaccctgtctctactaaaaatacaaaaattagccagttgtggtgataggggcctgtaatcccagctgcttgggaagctgaggcaggagagtcacttgaacccaggaggtagaggttgcagtgagccgagatcacaccattgcactccaggctggggacacagcaagactctgtctcaaaaccaacaacaaaaaatacaaggacattggtcttattggatggggccccacctttattacctcatttaaccataattgtctcttaaagactctacatccaaatacagtcacatagcaggttagtcttaacatatgaattttgcaggggacatgactcggtctgtataccccctcatcaattgtttgcttacctttacattttagtatttatttttgagacagggtctcactcttgtcgaggctggagtgcagtggtacagtcatagctaccatagccgcaaactcctgggctgaagcaatcctcccacctgggccttcaaggtagctgggactacaggcagatggcactacacccagttaactttctatttttgtagagacagggttttactgtgttgcccaggctggtcttgagctcctgtgctcaagcagtcctcccacctgggcttcttcaagtgctggaattacaggcatgggccactgtgcctggccagttatttatttatttatttatttatttatttatttatttatttacttatgtatttgttttttgagacagagtctcgctctgccgccaggctggagtacagtggtgcgacatcggctcactgcaacctctgtctccctggttcaagctattctcctgcctcagcctcctgagtagctgggactacaggcatgcgccaccgcgcccaactaatttttgtatttttagtagagacagggtttcaccatcttggcgaggatggtctcaatctcttgatctcgtgatccatccgcctcggtctcccaaagtgctgggattacaggcgtgagccatcgcgcccggccctgtgcctggccaattatttgtttaccttgaggtgtccacttacacaggaaagctaaggttttaaaaaattggcttttcctctaaatcttttcaggaagtctttggttatgagatttatttattcatttattttgagatggagtctcactcactctgtcgcccaggctggaatgcagtggcatgatctctgcttactgcaacctctacgtctcgggttcaagcaattcttctgcctcagccttctgagtatctgagattacaagtgcccgcctggctaatctttgtatttttggtagagacgtgatttcgccatgttggccaggctggtctggaactcctgacctccagtcatctgtgtgccttggcctcccaaagtgctgggattacaggcatgagccactgtgctgggcctgactataagattttgtattctatgactttagatggtagagtgagtcagagctcacctgctggccctctcactgcctccctccccttctctctgttttatgataatcacttatacaaagttcttaacaccgaagcactatctgggtgtaaaacactctcttagcctttaatcctcttttgttttccctgtgtaggaggagaagagacgcaaaacgacccccaaagaaccgtaagaatttattcttgacattatcgaaagcagatggtaatgttaaaatgatggttctagaacaaaagggaaggggtttcagtaattgccagagcaaccttaggctcattttggatcgggttggtgaacataggaccaaggtgcgtcaggcaggatgcccctgcggtgaagagccactgtgaccacgcgcctgggcctcactgccacagccggtgcctccctgtgccacaggcacctcaggcagaaacctcacaggggcgattttgatattttctgaaacaattaaacaaacgatcttgtgatttttttttttcccccagaacggagaaaaaaatggctcgcgccaaaacagtcatgaactccaaggtaaacatctgccgggaataaagccggtggcggcgctcacgaggcggctgggagctgctctctgagtgccatcatctgtgttcctgctcccacagacccaccctcccaagtgcattcagtgcgggcagtacctggacgaccctgacctcaaatatgggcagcacccaccagacgcggtacgtacagctctcttcccagccttcctctgcctgtcccttgtcccactgctcaccagccccgtgtccttcaggtggatgagccacagatgctgacaaatgagaagctgtccatctttgatgccaacgagtctggctttgagagttatgaggcgcttccccagcacaaactgacctgcttcaggtaagtgcactttcgtgtgcatgtttgcttcgtggaaggaggcacatccccagaggtgcctgcgggctcacgattctggtgatgttttttagtgcctgacctgcaacatgtcttaagctaacacttcgtggataagagccaccgtggagggctgggcgcggtggctcatgcctgtaatcctagcactttgggaggccgaggtgagcagatcacttcaggtcaggagttcgagaccagcctggccaacatggcgaaacctaccgaaaatacaaaaagtagccaggtgtggtggtacgcgactgtaatcccaactactcgagaggcttaggcaggagaatttcttgaactctggaggcggaggctgcagtgagccgaggtggtgccactgcattccagcctgggcgacagagcaagactccgtctcaaagagccacgtggaaagctgatgaagggacaatagagctttgctgatttttggtttggtttttgggtttttacactacacatattacccctccattctgcccacatcctgagggtcacacgctcagatgaaggcctactctgtgctaggtaccagtgatctaggtgtcgtggatgtagctgctcaggtcctgccttcacggagccagaaatgggtgatacctgtcgggtagtgacagccacgacagattttaaaagcctggtgacatgcagagagaataagtgggaggaggaagttctgtgaagacgggagaggtaatgattttcagtaaagaccttgatggcctgtgagagaagaggccgaggggatggccggggtggggcaccctaggtagaaggggacaccattaccagggctcggaggggcctgtgccagctgtggaaggtgaatggtgagtctggtgtggtggttgctgggttggggctgggccacacagggccttgcaggcctcagcactgactctcctgtcctctgagggaaggtgcctggcgtccggcccgtaccttcaccgaggctcacgtcagctcttgagtgggcagaggccctgtgctctcaggcatccccagccccattttgctccctctccctgcgggtgcagttaccctccagggcttcaccttgttcttcgtgggaaatgcctcagctccaggaacggccctgcctccttttaggcctgggtggtattttccctctctgtgaagaggagggggaagtgccttggggacccctgttggaagcacccccaggcagcggttcctgtacccactgggagggcacccacacgttccccgtgcttggctgatggttgttcccctccctctccttctatgggatccttctatctagatcaagatgctgttgcgtccaccagcaaccgctagccccccgaggcctggcccaaagcagggccacacacctctgcctgctggtgtgagtgaggtgtgctgtggtgggcagagctggcaaccatgcccgagggcctcactctggccttcaccagggacaaaggcttgggggagcctggggctggggctgccagagtcctgagtgtctcagcttcctccctaagttgagatctatcatagattcgttcctggagggtggatggtggcctggaggacactttccagaagtcacatgccttctgtccactggagctggactgcctgagttatttaggggctctccatactgctgtacttggcttgaaactggcgatagaagccagtcatgggtggggtctggcctaccaaccagtgggtcctgcccctgcctggggcttagagcttctctcccatgtctcccctatggagagagcctccagcccacctgtgcagcggggagcgggaccccctcttctgtaggccctcccttgatccacgctggcttcatctctctgtctcttcttctgggccttacatcctgaggcagggctgcaacctattctgtctgccatgcctggtacgcagtaggggagctccgcaggaggtatgcagtgttttgtttgagcctttctggcttccaaggcactaagctgggtgagtgtggtggagggtgctctccagagacctgtgcagacttcatatgggggctctgaggatagcccagcatctttggccgggaaagggtggtccttgtctagatgagcaggtttgtaagcagaacacccagttcatgtctttttccttgagtttgacatcttgcctctctgtcttcactaaagaacgtgctcccgaatgtcaaggggcatctggacagtggggccgcaggtgtttgagatttatgcccaaaaggaggcagaagtccttccttcccacatcccttttcacactgttctataacctgctttattttctaaattgaggtctaactcgtataatataaaattaaccatatgaggtatcttgaataggtgaattcataggtatagaaagcagattggtggttgccgggggctgggggctgagggccggttgggaggagactggagagtgactgctacttgatgggaatgaggctttattaacatttgagtgacagaaatgttctgcagctgaatagagctagtggctgcactgcatagtagaaggtgttctagaaaccggtatttcccgcactgtaagtctgactgatcttttggtgttgctgttgcagacacacatacacttgatgcttaggtgggagaataaggtagaaactctgggtgatagaacgctgtcttaatccagtgttcccgcaaccaaaaaatgagtgtcggggccaggcatggtggttcagcctgtaatcccagcactttgggaggctgaggtgggtagatcactggagataaagagtttgagaccagcctgctacacatagtgaaaccccgtccctactaaaaatacaacaattagccgggcatggtggttcaggcctgtaatcccagctactcgggaggctgaggcaggagaattacttgaacccgggaggtggaggctgcagtgagccaagattatgccatcgcgctccagcctgagggatagagcaagactctgtctcaaaaacaaacaaaaaaagagtgtcagacttgtacattctctcattgcctcgtgcctgatctgaagtctgcacgaagacccgccttcacggcttagctggtaagcatgtgctttgtttcctgtctagtgtgtactgtaagcacggtcacctgtgtcccatcgacaccggcctcatcgagaagaatatcgaactcttcttttctggttcagcaaaaccaatctatgatgatgacccatctcttgaaggtaaggaatagtccgggattatgtttggggcacactttaaaaacagccaggcagggtggctcacatctgtaatcctagcactttgggggtctgaggccagaggatcacttgagcccgggagtttgagacgagcctggacaacatagcaagagcctgcctctattaaaaaaaaatatatagcatatatatatagtatacatatatacttatatatatgtataaataaaaaacatacttatgaagcaatagtcagctggagttgctgctgcctcttaaagttagggtgtgagactttgtgccaggagcagctgtaggccaagtcattgtgatgactgaggagcacccgacctggctgatgggatgtctgctgagtgggcgcttagagcgcctcctgggtttgggatgtgagtcagagcctttagtccatttcctttttctgctctaggtggtgttaatggcaaaaatcttggccccataaatgaatggtggatcactggctttgatggaggtgaaaaggccctcatcggcttcagcacctgtaagtgtgtggcccatcataggctggccggggtctgaaaggggccttcatgttctccttcctgggggctgacggggctctggtgggaattctcagcaggcttgcagaaggccatgtgactgggaaccttagcaggttcagttggggtagcctcttgtgttagttatgactggctctggaactgactctccagttgtaagagcaggtcttggccggatatggtggctcacacctgtaatcccagcactttgggaggccgagttggggggatcatttgaggccaggaattcgagaccagcctagcctggccaacatggtgaaaccccctctctaccaaaaatacaaaaattagccacgcatggtggtgcatacctgtaatcccagctacttgggaggctatggcaggagaatcacgtgaacccagcagacagaggttgcagtgagccgagatcacgccactgccctccagcctgggtgacggagcaagactctgtcctcccctgaaaaaaaaaaaagagcaggtcttattcttgcaacccaaacccagactgaattccaaacaccagagatgagctcaatgaaggcctactcagctagtcttcgctctctggctggctcagacaggcttcttcagaacaagccagctatgatgtgttgtgccctatgtttctgacatttgggtacgggatgacttttagactgttgggtgagtttggtagactcctccatgccctgtggccactgtaggcgccatcagattccagccccttttccacacctcctctgttcaccccagcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgaggtaagagatcgagggtcctcagcatccgggattcccactggaaacttgccttcagaaccagcagacactgttcttcagttggatttaggccagtttggcttaagcatgagagaaacctgttctctttcaagaccacggttcctccttctggcctcaacttgaaccgcttcacagaggactccctcctgcgacacgcgcagtttgtggtggagcaggtggagagttatgacgaggccggggacagtgatgagcagcccatcttcctgacaccctgcatgcgggacctgatcaagctggctggggtcacgctgggacagaggtaaggatgcggcagggaccagagtgaagactggagaccggggagggtagagcatggcccacatcctctgtcccagtcctctgagatgctggaacctctcccgtaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtaacctcacctgtgggtgctcccgctcccctaaggtggcccagcctctggcctgatctgaggactgctccatctttctctctgtggcttgagactctggctgctcaaatgtgacccctgagacagaaattagttagtggtctgggaggaccctgcatacttcattgaacgtcaataggacagatgtccacagaggcatgcttgggtgctttgctgataatgccactgtccttaattgaagagcctggcttctgggtggctctgctgtgcctgcatctcacagtctgaaggcccctgttggactgctaaaggggtattcacatctaagtgggcactttgtccagcttagatttgaggccctcaggaggcgtccctttctgtgagtttttaaaatatatgtttacttcactcaggaggaactaacttcctagtcctatgacccaaagaccaggactattttgatacctattacctgactttcttttggataaagactggcttcagggctttgcttttgatccccgctggcatctcttaacaggagcctgcatgtcctcaccattgttattttggttttattttatttttcttggttaacacacgtgtgtccaatgttttataacttctaaaatcttttttttttttttttaatttttttgagacagtctctctctgtcacccaggctagagtgcagtggcaccatctcagctcaccgtaacctccgcctcccgggttcaatcagttctcccacctcagcctcccgagtggctgggattataggcacccgccaccatacccggctaattttttttgtatttttagtagagatggggtttcaccatgttggccaggctggtcttaaactcctgaccttaagtgatctacctacctcggcctcccaaagtgctgggattacaggtgtgagccactgtgcccagccctaaaatcatttgtttttatttgtgtaactgttacgtgttgatactggtagatctagttatttcattttaaatattctgtagtattttgttaaatgaatatcctaacttactcctcaatgataggcacctcttcagtattgtaaatatgtggcagcatccttgagcaaagcttctcgcgagtgtatctgcttagaagtagcgttgctgggttgtgggtgtgtattcttaactttgatctagaagattgctctccaaaatggttctaccaacttaccatttgagcagtgtgcgttcttctttcctcacaccacctatctggcttcttaacccatctggagaatgggaagggaattttatttctctcacttaccatatttctaatgaggttgaatattgctttttttttttttttttgtagagacagggtcctgctgtgttgccttgcctggtctcaaactcctggcttcaagtggtcctcctgtcttggcctcccaaactgccgggattagaggcatgaggcactgcacccagccaaataggcacatttttaaaagtcttggttttgttgttgttgttgttgttgttgttgttgagatgggtctcgttctgtcacccagtctggaatgcagtggcatgattgtagctcactgcattctcaacctactgggctcaagtgatcttcccaccttagcctcccaagtagctgggaccacaggtgcacgccaccatgcccagctaattaaaaaaaaacattttgtagatgggattttgccatgttgcctaggctggtcttgaatgcctgaactcaagcagtcctcccgccttagcatcctgagttgccgggactgcaggaatttgtcacacgcctggctaattttaattttttgtagagttgggggtcttaatatgttgcccaggctggtcttgaactcttggactcaagtgatccatctacctctgcttcagcctcccaatgtactggttcaggtatgagccaccatgcccagcctaaaagtcttaattcaccgtttgtttcattgttgctaagggctgtgtgactcactttttttttttttttttaattttttgagacctaaaagtcttaatgcatcatttgtctcattgttagtaagggctgtgtgatttgccctttttttttcctttttttttttttttttttttttttttttgagatggagttttactcttgtcgtccaggctggaatatggtggtgtgatcttggctaactgtaatctccacctcccaggttcaggcaattctcctgcctcagcctcccaagtagctgggattacaggcacaccctaccatgcctggctaatctttgtatttttagtagagatggggtttcaccacgttggccaggctggtctgcaattcctgaccttaagtgatctgcctgcctcggccttctgaaatactgggattacaggcatgaaccactgtgcccagccctgatttgcctttttaatgccattttttaggtgtgtcagcagcctgagtgtgggaaatgtaaagcctgcaaggacatggttaaatttggtggcagtggacggagcaagcaggcttgccaagagcggaggtaggtcaggccgagtcttcctcctgtggcagaggacttgccagctggtggcagatgcactgtggagaagggcctgcatgtgtgggacagcaccaggattccttcgttaggcattgtctcaggacctgtccctgttatgaagaaaacagccccggttggtcttacttagaaaaggggccttaggtataaccagtgacattgcaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaaggtaacccttggagccccttggtcagctcactgccatgttcccaataagcaggttgccctctagtatctcgccaacctgacctctcaggcagcctgagccccggcactaagaaacctgtctgtttgcccctgagaagagcgggactggccaagagaccatgttccatggctcagtaccagcaaggcatttttgtgtggccacaaggctcagttctcctaatgtcccaaaatgggcatttgacacagttctaggggcatcaggcaggtgagccctcatagcttgtttttctgttttgttttgtttaagatggaatcttgctctgtcacccaggctggagtgcagtggcacgatctcagctcgctgcaacctctgcctcccaggttcaagcgattctcctgccccaccctcctgaatagctgagattacaggcgtgcaccaccatgccaggctaactttttttgtatttttagtagagacggggtttcatcatgttgcccaggccattctcgaactccggcctcaagtgatccacccacctcagcctcccaaagtgctgggattacaggcaggagccactgtgcctggcccctcatagcttgtttccaagagagctgtcacagccccctctggtgtggggtgggtctttttggggcaccaacagatggcctcccatccgttctgtggtcattggcttcactgaaggtcagttcctttaccacagtgtgagagagaggagtgagtatcctctgtgttgcttctctgacgtccataaattaaagatgcaatcagttcacttaattatgaggcttgccacctgctggctgcctgggccgtggctgagcccctgcaggaggacagacatgggtactgctgcatggcatgagtgcctctgcagggtagggggctgggaggaggctggggccacgaggccttgcagaggtgacacctgggctgagatggagaaggtcaggtaggacctagccacacgacctgggggagagctgcactgaggtggcagtcagcttactttgttggagaaaaggaaggaggcccctgcagctggagtggcttgagccaggggatgatgggcaggacaggggtcagggttcaggctgtggccttacagaccatggtgaggtattgtgggctgtgctgttaaaatcaaatcctgggacccgagtggcagagcagaagtgggagggacatggatgcccttggccacagcatctggccaaggaaggtggatgttcttcttttttcttattattgaagcccttgtagaacaggatgttctctttagcagcaactcttcattgacttcttaatgaaatcgagtcatgtcttactttaagtaacagaggaccatgcaagtcaaggccagcaaagaccctcagaatgatcctccatgaacttatgctctcattttcagactgatgggaagaagagttactataagaaggtgtgcattgatgcggaaaccctggaagtgggggactgtgtctctgttattccagatgattcctcaaaaccgctgtatctagcaaggtttgcatctttctttttgcttgacttctgcatgcactttctcatcaagtaggagatgcctgttttgccaaaatagcaccagcagctttttgccctagatgaaaactgaaaaggacgagtgctcctgcatagacttggtcacatatctgctggccaagtcagaactttctccccatgcccgtcttctgattccagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggaggtgagtgcctggtgtccctcgtgagcccctgccttatcgtggagggtcactgctgacgtgcgttctgttttgttttgatttgtatttttttttaatttggttttttttttgtttttttttttgttttgagactgagtttcgctcttgttgcccaggctggagtgcaatggcatgatctcagctcactgcaacctccacctcctgggttcaagtgattctcctgcctcagcctcccgagtagttgggattacaggcacccaccatcacgtccagctaattttttgtatttttagtagagacggggtttcaccatgttggccaggctggtctcgaactcctgaccttaggtgatccacccgcctcggcctcccatagtgctgggaatacaggcatgagccactgcgcctggcctgacacgcattcttatctcccaagggaggcatggatcccgagtccctgctggagggggacgacgggaagacctacttctaccagctgtggtatgatcaagactacgcgagattcgagtcccctccaaaaacccagccaacagaggacaacaagttcaagtgagcactggggctggactcggggtcagcaggcactttcagcccacatcactcccttttcccgtgtgcttccgtctggttggcttccgccaacggccccccagtttgtgtctcttgctcgtcaaaggccagcctgactatgaatgatgctcaagtgtgtagatggcctggagttgctttaagtgtgtggatgacctggcgttgtctttgtaagagggttccctacccaggaacagggttcgtcttgccatttcaagacttcccgtgtgttcttcagtgtgtgcccagctcttgcatgtttttggctgtttcttagatattttctcctgtaaatgagacctcttatttgattcttttctttcctttttttttttctttttttttttttgagacggagtctcgctctgttgcccaggctggagtgcagtggtgcgatcttggcttactgcaaactcagcttcctgggttcatgccattctcctgcctcagcctcctgagttgctgggactacaggcgcctgccaccacacccggctagttttttgtatttttagtagagacgaggtttcactgtgttagccaggatggtctcgatctcctgaccttgtgatctgcccgccttggcctcccaaagtgctgggattacaggcgtgagccaccacacctgtcctcgattcttttgtaactgggtgactgctttgagggaagcttttattttttattttattttattattatttttttaattttttttttttttttttttttgagacagagtttcgcttttgttgcccaggctggagtgcagtggctcaatcttggcccaccgcaacctctacttcctgggttcaagcgattctcctgcctcagcctcctgagtagctgggattacaagcatgggccaccatgcccggctactttttttgtatttttagtagagatggggtttctccatgttggtcaggctggtctcgaactcccgacctcaggtgatctacccgcttcggcttcccaaagtgctgggattacaggtgtgagccaccgcgcccggcgagcttttattttttaatgtccaatgccccatgccttctttttaacctccgtacctcacttgtttcaactaaaagcagcagccagcacccccagaggagcaggtggcaaccagggaaacccaggaggccaagagggctccccgggggcatctgtgcttctcccataagtctcgtgctagctttggcttgatctctattttcattttattttttacttttttgtgatggagtttcactcttgtcacccaggctggagtgcagtggcacgatctcggctcactgcaacctccacctcctgggttcaagtgattctcctgcctcagcttcccaagtagctgggactacaggcgcctgccaccatgcccggctaatttttgtatttttagtagagacagggcttcaccgtgttggccaggctggtctggaactcctgaccttgggtcatctgctcccttcaggctcctaaagtgctgggattacaggcatgaactactgcacccaacctcatttacttatttatttatcacccaacctcttttatttatttatttatttatttatttatttatctgagacagggtctccctctgtcacccaggctggaatgcagtggtgtggtcacagctcactgtagcctcgacctgctgggctcaagtgatcttcctgcctcagcctcctgagtagctgggactgcaggcatgcaccaccctgcctggttaatgttttaaaaattttttgtagagacggggtctcactgtgttggccaggctagtctcaaacttctgggctcaagcgaccctcctgccttggcctcccaaagggctgggattacagacatgagccaccatgctgggccttgatctctatttttaaggccatcttcaagtctcctttaagggcttactagtcaagaataatgttgaatttcctcaaatacctgttgagcctttatggagagaacagtaggagtctctgctggattgagttcctcactgagccactcgggactgttgctcgtggtgtgttcttaaccatattctagaccctgttcattgatatcttagggtttttgtctcaatgactcaaaagttgcctgattttcttgctatgttctctctgggctttggtctcaaataagtgccttcaaaatgtcaacacaaagcacaagaaagccacctcttccttctagcatctgcaaatgttttttcctcttggttaccagagtctctggattaagctggcagtagctgctgcggccactgccggccacctcagggccttatgtttctgtccctttgtttccttcagattctgtgtgagctgtgcccgtctggctgagatgaggcaaaaagaaatccccagggtcctggagcagctcgaggacctggatagccgggtcctctactactcagccaccaagaacggcatcctgtaccgagttggtgatggtgtgtacctgccccctgaggccttcacgttcaagtaagtgccccctcggagcagccggggccagggcgctccaggctgagccaggctggctttgtggtgtccccctccttacagacattgccaatccctccgcaccagctgttgtcctagccgtcacgttggcataggtggcaaacagacaacataaatcgtgtagactgaccatgatgctattgcagagcaaagctgagcgtaaaagtcaactcgctggtttggctgggtgtggtttctcacgcctgtaatcccagcgctttgggaggccgaggcagtggggaatcatctgaggtcaggagtctgagaccagcctggccaacatggtgaaacctcgtctctactaaaaatacaaaaattagccgggtgtggtggtgcgcgcctgtagtcccagctactcgagaggcagagacaggagaatcacttgaacctgggaggcagaggttgcagtgagccaagatcatgccactgcactccatcctgggcaacagagtgtgactccgtctcaaaataaaaaaagaaaaaaaaagaacttactggataaagcgcgagggacagctgggggcccacccccaagttctgcctctgcccaaggacacctcctctccgtcccctactgtgaagtgggagagtgggatcttgcctgctggggctcgaagggttgagtgagttgaaagtgctccatacagtacctggcttaaagtaaaggtttaacggacatgagttacttcttggttagagggaatcacatcagatgacttctctgtgtcagaggatcgaggctcttccaggaaaaacctaaagccacagatcgtttccacactgatccattctgtgttttttctaagaatcagcgtgtggttggaattacagccaacgttttccagatgccttcccggctcacaattccatttccttagagccccagctcccttgccttagttcagttactgtgaattatgagaactggagaagcaggttccctccagccttggcacagttggggcgcgttaccccctctggttgtccttggtgggaaggggacacctccccgtagtgttttctgccagttgctcctggcaaagtgggagagtcagcacagagacgcctttggggcccgtcagactcctggggggcctagtggggagaacgtgacagctgacttccctaacggcaggccttcttcaaagaacagcttttccacactagtcagaccacactcccattgtcccaggccctgtggcgccttacattggcctccagtgtcgcttctagatcagagccttagtcagggtagcgtaggttgtatcatagcaacaaccccaaatcacagtgacttaaaaccacagaagctggactgggtgcggtggctcatgcctgtcaggagttcaagaccaagaccagcctggccgacatacctgtctctactaaaaataaattagccagggttagctgggtgtggtggtgggcacctgtaatcccagctacttgggaggccgaggcacgagaatcgcttgaacctgggaggaggagttgcagtgagccgagattgtgccactgcactctaacctgggtgacagagtgaaactctctcaacaaaaaccacggtagccgctgtctcgctcatacgaggtgcccatcacaggtcagcagaggactccacctgttgtgtcccttggatatctgggccgctggagtcagaagttgccagtgtttgagcccaagggaaagcacacaggacattccccaggcagtgacatcctctttggtcacttctgcccacgtcacatgccaggaaacacaagatgccaagtagtcgggaggcaggagcctggggtatttgagcagtgtcagccaccaccgtagccagtaatgcgcagagggtgaatgcgtgcttcaaactgtgagactaaatctgcagctaaatcttttttttttttttctgtgagatggagtcttgctctgtcacacaggctggagtgcagtggcacaatctcagctcactgcaacctctgcctcctgggttcaagcaattctcctgcctcagcctcccaagtagctggaattataggcatgtaccaccacacccggctaatttttgtatttttagtagagacagggttttaccgtgttggccagggtggtctcgaacttctgaccttgtggtccacctgccttggtctcccaaagtgctgggattacaggcgtgagccacaatgcccagcctaaatcatttcttagggtacacacctaccttaattcatcaggtgcttgactttaaatggttattttcactggtcagtcatgcctgactgaccactgcaaggtggaaggttcattgatgtcaagtgggtgcttctctgcagcatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggtcagcagaggcctctgttcttccacgaggccacagactcttctagaaggctctgcctgaaacaaggttgtggcatagcacccacagttgttctaagagttaggttgaagtagctgtttttccaagtgtttctgattatcggtgggcactgataatgactagaattctagttcccagccctcacttttaggtccttattttaatgttgcagagccctttttccaaaagaaatccttaagctggctgggcactgtagctcacgcctctaatcctagcactttgggaggctgaggcaggaagatcacttgagtctaggagttcaagaccagcttgaggaaacgtagtgagaccccggccctaccaaaaaaaaaaaaaaaaaaagactagctgggcgtggtggcacacgcctgtaatcccagctacttgggaggctgaggctgaagggatcactgaaacccaggaatttgaggctgtagtgagccatgatcccaccactgcactccggcctgggtgacagccagaccccgtctcaaaagaaaaaacgggtagagtgcctgggcacccccagagaacctcccaagctccatctatgactgtccaggttctgtcccgctgtccccacctcttcccaggtcctcctttctgtctctgggattttttctctttcctaagcttttggcctattacgttttctttttctaagacccgagtaacttgcggtgattaggcattaacctgaaactagcctgtacaggaagctatacacttgcctcacctcttagctaacatagatcaaagatttcctgaagcctttgtaataacaggaaataaaacaagggctgtgagtggtacaggtgagagaaacacactcgagaggctgctaccggcaggcggacacagcagggcagggccaggcgtgcagagcaagcagccaagctgacctaatggttggggggtctctaccctgtggttccctaattgggggcgaatctaccttgcagttccctcatttggggaggggttatctttacctgcggttccctaagtaggggggtctttaccctatgactccctaactggggaggtctttaccctgcggttccataactggggggtctttaccctgcggttcccaactgggtcgggggtcattacctggcggttccctaattgtgggggaatctaccttgcagttccctaatgtgaggaggggatatctttaccctgtgattcccttactgggaggggtctttaccctgcgattccctaacttgggggatctttaccctgtggttccctaactagggggggtctttaccctgcagttccctaaatgggggggagtctaccttgcagttccccagtgtggggaggagatatctttaccctgcagttccctaactgagggggtctttaccctgcggttctcgaactagggggtctttaccctgcagttccctgagcaccccaggaacatggtactgtttaattcagcataagctcaccacaaaggagagctcctaacgaggcctctcccgctcgcaggcctgagaacacccacaagtccactccagcgagctaccacgcagacatcaacctgctctactggagcgacgaggaggccgtggtggacttcaaggctgtgcagggccgctgcaccgtggagtatggggaggacctgcccgagtgcgtccaggtgtactccatgggcggccccaaccgcttctacttcctcgaggtggtgcccctgcttgctagagggaaggcttcggggtcaaagttggccagaaggagtctgatgtcgggttatacacaaggcggcttggctgcagggtttcagcttttgtaagaagtgggtggttggctgacgtgaagctgttctgcaggagctttacgggggtctgagcagggttctccagagcacaagttgtatgagattcaagtggtcccggagtttaacactcctggtttttaaaaagtacgtcattagagaacctaacgttttagtgtcttggtgcaactgaacgttgaggaccatgaggcagcttccaccagcctgactggtgtcttagtatgagttggagaaggtgcccctgctcctgggtcccttgggccaggcgcctacgtccaggcccagcccacatgcctgtgcgggtggccctcgttatggagagggcccacgagtcagctgatcaagctcatgacttgtaaattgttggggcttggcctttccgtgttgttaccttaaaacgatacatccacgttctcccaggcatggatgaggtagcccaattggacagcagattctgcatagcactttttcctgttctagaaggtactctcaagtgcttgtaataggcatttcagtgtcagccagatcaaatgttagtattaataaaatggattgttttaagtttctattgtagcaaagtcaaactactcttattggtggctaattggtcatggccccactgagggagaaattaagtgactatcaaattgccttcttactagtctgcgttagagaggggacagtgcgtttctctcccaaacgattgcagttctctccttttcaggcctataatgcaaagagcaaaagctttgaagatcctcccaaccatgcccgtagccctggaaacaaagggaagggcaagggaaaaggtacgtcattgtatgagtttcttttcaagttattcttctgtaacttggaggctgcctgtgaatccctcagtgtaaaaccacctctggtgttactgactctgggacagcgaggccgcctgagttaacaaggcgcttgagagcaaggtggacttggactctgaggatcgggtttagcctctggcctctctcccccagggaagggcaagcccaagtcccaagcctgtgagccgagcgagccagagatagagatcaagctgcccaagctgcggaccctggatgtgttttctggctgcggggggttgtcggagggattccaccaagcaggtgagcgcccgtaggctccatctctgaatacctggtgagcccagaccgggcaggtgctacctgaaacgacttccaaccccggtcaccttcctgactcaagaatctccttccgaggccaggcacggtggcgcacgcctgtaatcccagcactttgggaggccgaggtgggtggatcatgaggtcaggagtttgagaccatcctggccaacatggtgaaaccccgtctctaataagaatacaaaaattagctgggcgtggtggtgtgtgcctgtagtcccagctactcaggaggctgaggtgggagaatcgcttgaacctgggaggcagagcttgcagtgagccaagatcacaccactgcactccagcctgggtgacagagcgagactccatctcaaaaaaaaaaaaaaatcttctggagagttgaaagcatggcttcgtgcttgatctgccaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcaggtaaacgggtagaagccccccagtgttgccagacggcccggggctgtgccgcatgtcagcagtggtcattttcgccctgcactgaggcctctgccccccggaagctcacagctcagctctcaccagggagagactttgataacattcgtgaggggcttccggcacagtgggtcgtttcttccctctgtctgtggaggtgactcctgcagtctctcctgccccctacagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggtgggccctggggctggggcgggcagacagatgtggccagcacgtgacccggccagcagccagccatcccttactgaaggcagggttcaatggcataggcctgccatccaggcagcagaggctggcatggtgctctgtcccactggcggagtcaggggagatgcgtgctcagccggcccccagcaagtccaccgctagtgtctcttgagctgtgttctcgaacatgcctgggagggctggctacaatgggcttctcgccatgcagctcctggctcctttccctcgatggggaagggtgagcagcccaccatggagcactgtggaatggctgagtctgcacagagcgggaggggaagtgaggtgcgcagagccatgtgtaggcggcagctgttcgattggtttaaaagacagttttgctctgggtaactgcgcacacaaacccccacagatggccgagggttgcactccaggtggctgtgtctgcagggacagggatggacatagtctgtggggcccaggccttatctgaaaagcatcccccatcctctctgtatcagctcagcaattgagggcataattaaaaatgaaacagctatccagatgctagcacaggatgtctgcctaagtgggcaagcacttggctacccggtcccctagctcagcctcagggcgactcaggctcaccagacaagacttgttgcagccacgttctctgtccttgtgaccacagccatcagggaagcgacagggctcctggtctccagtgttctccccgagtgctaagaccttggggcccttgcagtgctttcagagctggccggacttccccgcagggtttgctcccaccttccccagtggctgtcccctgggctcagctgcttttgttctttatctgctccaaactcctctgaccaggagcacgcctgctgaggtaactggggatttctgcaagtgcactccgcattggccagccactcccgactcaggctgctgaccctgggcctgggtctggccagtccagttgggagtgtcccactgacggtggggttgtccgtccttctcccccacaggccggtcagtacggcgtggcccagactaggaggcgggccatcatcctggccgcggcccctggagagaagctccctctgttcccggagccactgcacgtgtttgctccccgggcctgccagctgagcgtggtggtggatgacaagaagtttgtgagcaacataaccaggtaggtggcccccgtcgctcctccacacactgccgagcaggcctcagtagctcatggggcccgtgagtactccctggtgaggcttggggaggagaggatggtacagcatctgccctgccacacggtgctctgccacatggcactctgccacctgtggtctccagttctgaccctgcatcatctgcttccctagtagatagcatgtgcagagcggccagccgcatgcttggctgtggtcatccacaaagcccacgccatagccccatccccccttccagatggcatccaggcacactgccacccatgtgacctcgggcagtgctgtgatctcgggagaaggccatctgagcaggcagggggtggcacctgtgatgaggggacagctgctgcgtgcatctccagaggtgttgacctcctcctctgttgcaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggtaatggcaccctgacagagcggctcctcctcgaggcccagcccagcagcctcgtgggaacagtcagcctgcccaagactcaggggagacatggaatctgatcccaggctcctcctcccgagtcctcagcctttgtgtgacccctggtctctcttgcatggtcatgggaagtgtcagagctcccgcagtcctggacttggtctggaatggtgtcaagccactgcccacccaccactgccttcccccttgctgcctctccccgcatgttttcccaggatgccaagaccagccctttcaccatcccctggcaccactccccttcccccaccctaaaggctcagcttagattcccacgctctcctacacctgcgctgcctcaggtccctgccgtggcctcgagccaagtgcgatatccctgactgtctctttcccgatgggcgtgagccccagggggcttcctggtcaccatggtgttcccagctcccagcccaccatggatgctcggatgctgctcacatgaggtgacagctgggccccccacactctttcaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggggtctgctcctgcgtggaaggtgggtcctgtaagttgtggttcccggtgggctgaggggaaggaaggcagagccctgggcctttggcctgtgaacctggaggccagggcagggcacagacacaccaagcctgggtgtcccagagaaggtagctgctgaccatgttgagtagtaaaagcaggctgggttcatggcccacacctataatcccagcactttgggaaaccaaggcgggaggatcacttgagcctgggaggttgaggaggctacagtgagctgtgattgtgccattgcactccagcctgggagacagagtgagaccctgtctctaaaaagaaaaaaaaaaaacaataaataaataataaaagcaggtcaggcacgatggctcacctctgtaatcccagcactttgggaggccaaggcaggcagatcacttgagatcaggagctcgagatcagcctgcccaacatggtgaaaccccatctctattaaaactacaaaaattagccgggcgtggtgtcgcacgcctataatcccagctatttgggaggctgaggcaggagaatcgcttgaaccccataggcagaggttgcagtgagccaagatcatgccattgcactccagcctgggcaacagagcgagacatataatactaataataaaaacagtgcccagagaacgaggattgttggctgctccaccccagggggccccttgcacaggaggtgccatctctgcctcccaaagctctaagagccactgtcccaagcctataccccatcccacaactgcagcctcatcactgtcctgtcttccagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcaggtaggtggggagggggcatccgagggcctgggtcaggccctgtacttggcggcctaactaggtggaagtgtgggtttagccaagtgggggacagcaccccaggaccccaggcacctggcctctgcctcctgcccctccacgtccacgggacaagctcataggccaaggccatggccgtatgctgtcacagtgccatttccctccctgtccccgacggtgacccggcctgggtgctactgccctcgcccaccgcgcctctttcccccagggccgcgtgctccacccagagcagcaccgtgtggtgagcgtgcgggagtgtgcccgctcccagggcttccctgacacctaccggctcttcggcaacatcctggacaagcaccggcaggtcagtggggcggcgcccgctgggtctggacaggaaggaggcttctgtgcctgtcaccaggtggggctggggccagcgcagtcacttccgggaggacgcctgctggctgccgggtagccccatcactctcagtgggaagacggcccacaggagggacagtgctgagacatccgagtcaggctgcgtccctatgctggttccttactgtttgtttttgaggcagagattgagccagaaggacagtccgtcgcgctaaaggagcaggctaaaacccatggtggcgacagctcactcgctgtaggttcaaatgaactagcaccttaattcctacctgcttctcaggtgtcgggttggcttaacaagttagtctatgagttagtctcagttaagtgtattttcatcatagggcacgcgcattgcttaaaaaccagtgtccacggttcttgtgaaaaccacatttcacccctccccccgaatctggttctcgggaagcagccactctctcttttttttttttttttttgagatggagctttgttctttcgcccaggctggagtgaagtggcgtgatctcagctcaccgcaacttccacccccctggttttaagtgattctcctgcctcagcctcttgagtagctgggattacagtcatgtgctaccacacccggctaatttttgtatttttagtagagatggggtttcaccatgttggccaggctggtcccgaactcttgacctcaggtgatccgcctgcctcggcctcccaaagtgctgggattacaggcatgagccactgcgccggccagggaagcagccactcttaactgggagcgaaacgtgtctaggtggcccatttgtcttttttttttttttttctgagacagggtctcactctgtcccctaggctggagtgcagtgacatgatctctgcccactgcaacctccacctccagggttcaagtgattctcctgcctcagcctcctgaggtgctgggattacaggcatgtgccaccatgcccagctaattagtttttgtacttttagtagagacggggtttcaccatgttggcgaggctgctctcgaactcctggcctcaactaatccacctgccttggcctcccaaagtgctgggattacaggcgtgagccactgctcccagccccacgtgtctttgtctcaagtctttctgaagctcttcaaaggcccagtgacttgtggctgtggggcgggatgatgggccagttggagggtccaaggatcttgtgctggaagggttttgggcccatgtgagcaggaccagaacccttccccaaggggtgcaatgcccaggttgtcctccatctgagcaggggctggcagtacacctgcccccgggccttgggcctgggtgtccacatcaggcattgcccttctcccctcctgcaggtgggcaatgccgtgccaccgcccctggccaaagccattggcttggagatcaagctttgtatgttggccaaagcccgagagagtgcctcaggtatggtggggtgggccaggcttcctctggggcctgactgccctctgggggtacatgtgggggcagttgctggccaccgttttgggctctgggactcaggcgggtcacctacccacgttcgtggccccatctttctcaaggggctgctgtgaggattgagtgagttgcacgtgtcaagtgcttagagcaggcgtgctgcacacagcaggcctttggtcaggttggctgctgggctggccctggggccgtttccctcactcctgctcggtgaatttggctcagcaggcacctgcctcagctgctcacttgagcctctgggtctagaaccctctggggaccgtttgaggagtgttcagtctccgtgaacgttcccttagcactctgccacttattgggtcagctgttaacatcagtacgttaatgtttcctgatggtccatgtctgttactcgcctgtcaagtggcgtgacaccgggcgtgttccccagagtgacttttccttttatttcccttcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaaccac

SEQ ID NO: 535 - DNA, 13876 bp, Homo sapiens
ctcgcgggcctaattatcaaggtttcaaattcgactgcagtcctagaatagcgcttcacccccaggaagcttttccggccatgaccaccccatcaaaatcacctggccctggatgaaattcagctttctgtcctttccacgactccggaatcccaactcccaggagcgtgcacacagacaatgggcacccgctaggggattctgacacaggtgagctccagccaccgctctggcttcacctgcgcccactgtacaggggcagccggtccagcgagcaggtgagtatttgctcaggtggtgcaaacctgccgctcctgtctcatgtggggctcctgccgaagtgcaaattctgagctcctgctctgaagtgtccgaattggaagctgtggggtgggatggaggaatctgcatttttacagctgttttaaacaatgtgtgcagagagggcagaagattgtgaaattaatggaaacaaggtcttccctcatccctctatctgtcagcccgggtgatgcctagtcccgggcccggtgctgagtttgggccaataaatgcttgtactcttggcctggcacgatggctcccacctgtaatcccagcactttgggaagtcgagatgggaggatcgctggagaccggaagttcaagaccagcctgagcaacacagcaagatcccaaatccacgaaaagttgtttaaaaattaaaataaaataaatgcgtttactcttggccccatgcggaacgccggcgtagaagcggcccggaaccccacccccggctcttgattagggccgtttgcggcgggcgccggggacaggtgaagggacaccaaagctggcgcccgcggcaggagatcctgacagcgccaggtgcacgcccacgggcggggcggggccggggtgggggcggggcctgtccgcgggccggggcggggccggcgcgcagcctccctcggccttgccaatccgcgggctcttcgcgagcgcggtctccgcccccccgcccgcagacagcgcctataggctgtctaccgccttcctataggctggcgcaggccgtcttccggccggggcgggctctcgccgtggcgggaaaacggcggccgcggcgtctcctccgggacgctgaggggcccgaggagaccgtgaggctctggcctgcagctcgcgccgccatggacgctgccgaggtcgaattcctcgccgagaaggagctggttaccattatccccaacttcagtctggacaagatctacctcatcggggtgaggcctgggcccgccgtggggaggggaggccgggctgggcgcgtccggggctcccgcgtggccttcagccccggggtcgcgggctcgccctgctcccgcatctgcggaggccaccactcggcgcttgactcgctcaccgccgttcccgcttctcggatgaggaaagcgagactgcgctctttgccagtgccccgaacgcccgggtttacagggtttttttgatctgtttgggggcttttttggtttgttttttggtttttgaggtggagtgtcactctgtcgcccaggctggagtgcagtggtgccgtctcggctcactgcagcctccgcctcccgggttcaagcgattctcctgcctcagcctcctgagtagctgctgttacaggtgcccgccaccacgcccggcgcatttttgtatttttggtagagatgtggtttcaccgtgttggccaggctggtctcgaactcctgacctcatgagccactcgcctcggcctcccaaagtgctgggatgacaggcgggagccactgcgcccggcttatttatttggtagagatgcggctggcctcgaactcctgggctccccaggcgatcctcccacgtcggcctcccaaagggctgggattatgggcaaaagtcggctttgcctctgtttgtttttgtctttatctttgagatggagtttcgctctatcgcccgggcgggaatgcagtggcgcgatctcggctcactgcggcctccgcctcccgggttcaggtgattctcctgcctcagcctcccgagtagctggattgtgagcccccgcgcccgcccggctttgcgttttcagtatgagggaggcgcctcggcgctgggagtcctggagaaggagggcaggctctgtacctgcccagacccacctccccgcaccccaggaccccaacattgggtgtgtgaaacctgttccggagttggagggtgcaggcgggagagggagcgccccccacccactcaggggagacttgcatcctgtccgcggaaaggccagaaggactgagccccacgctcgcaggtgtctcggagccgctcaggaggcgctttgttctgagtctggtaacagttgggtttttattaattgcatttggacttcagcctctgcaatgccttgcctcttatttgatagcagtaacgcacagtaatgctttttttgttctttttcaatcttacggggaattgttttacttttggcagggggacctggggccttttaaccctggtttacccgtggaagtgcccctgtggctggcgattaacctgaaacaaagacagaaatgtcgcctgctccctccagagtggatggatgtaggtaaggatgtggtggagactggttgatgcgtgggtggggctgggcttggggtgacgccctctcccacggggtggaggcatggggcctccttcctgactaggtccgtgctccctctgttccgttatctactgatcagctgaaaggaatacttccagattcacctctcagcagagtctgctaaccactgttagtaatgtcatgttaggttttggtgtgtgtgaaagttgtagtttgttttttgagacgggtctgactccatcacccaggctggagagcagtggtgcaatctcggctcaatgcagccttcacctcctgggttcaagtgatcctcctgcctcagcctcccaagtagctgggaccactggcgtgcgccaccacaccctgcaaatttttgcgtttttgtagagatggggtcttgccatgctgcccaggctggtctcaaactcctggggtcaagcgatctggccaccttggcagatctgctgggattataggcgtgagccactgtgcccagcctatattttaatgtaagatatttcaatttgctttaaaataaatatatgaccttaaataagcatttgttttaaaattttaaaaataagtatagattagcatgttgagaagcagttatagagaatgcatgaaaataatatatcacaataaggttgaatattattcagctataaaaaggaatggaattctgatacatgctactgcgtggatgaacctgaaacatcttaaagatcttgctgaatgaaagaaaccaggcacaaaaggccgcacactgtatcattccatttctatcaactgtctagaataggcaaatcaatagagacaatgtagattagtagttgcttaagtatgggggtcttgctttgggtgatggagggattgtggagtttctttttggcatgatgaaaattgggattgatggaggtaatggttgcccaagtctgaatatactaaacaccattgacttgtacactttgtttttaatagcccacaagtgctactaaaacttgtatactttttttttttttttgagacagagtctcgctctgtcgcccaggctggagtgcagtggtgcgatctcggctcactgcaagctccacctcctgggttcacaccattctcccgcgtcagcctcccaagtagctgggactacaggcgcccgctaccacgctcggctaattttgtttttgtatttttagtagagactgggtttcaccgtgttagccaggttggtctcaatctcctgacctcgtgatccacccacctcaaaacttgtatactttaaatggctgaattgtatgatatattaattatgcttcaataaagctgctagaaaaaactgaaacaaatcaaagatgcagacaggctttattctgagcctttgaaatctttttcttctcttggagatatgagtagcttattatagggaaaaaaaatcttaatttttttgtgtgtgttggtgaggagaggggtatggtcatacatatagaatttgaaaagaccctgagtgattttttttttttctttttatggagatggggtctcagccgtgagtgattttgactgccccctccttactgggacttattgggggtacctacctcctagaagcaagagctcattgagccagccactctggggtccgtttaagacagactgcttagtgtcttccccttgctccctgtcctaaagtggcaagtgactcaggtagtcctgaaacataatgggaaaccccagttcctctgctttgagacggtttttttttttttttttttttgagaaagggtcttgctctgtcacccaggctgggctatagtgatgcaatcatagctcactgcagccttgacttcccagcctcaagtcatcctcctgcttcagcttccggagtagctgagactacaggtgtgcaccatcatgcctgactaattttttgattttttttttttagtggagatgggggtcttgctatgttgcccaggctggtgtcaaacttctgggctccagtgatcctctcagagtgctgggattacagatgtgagctgttgcccctggccggaaggcttttgtagaggagaggctcaccaggcctggctccattaatgcagcatcctctccaggccccttgtttaaaatcagtgtctggcacttttgtcccatctagaccccaggtgataacatggcaagggcctgttttatcgcaggctagagtcagaaggtgtggagagttccccttgaactttttacctgggctggagccatattgtgggaacagtgaggcaccattaacctgtctatagaccctacccaacagcctgctgcctcctgacttctgcaccacagataagttctgcctgttctgggccaggcgcggtggctcatgcctgtaatcccagcactttgggaggccgagatgggtggatcacctgaggtcaggagttcaagaccagcctggccaacatggtgaaaccctgtctctactaaaaaatacaaaaattagctgggtgtttggtgggcgcctgtaatcccagctacttgggaggctgaggcagggagaattgcttgaatccaggaggtggaagttgcagtgagctgagatcgcgccactgtactccagcctgggagatacagcgagactccatctcaggaaaacaaatccagttctgcctgttctgggacttcatgtaaatggaataatctagtatgtcattttttgtttctgatttctcttatccaacactgtttttgagatttacctgtttacgttctcaacaccgggacacagagctcagctcccaacccctttctccactactgaaactcatattcacaccacctggctatgttctttcattgctgggtactctccatactacatatttgttcaccgattcttctgttggtagatatttgggattcccctttttggctttaacaaaaaatttagagacagggatttctctgttgcccaggctgaattgcagtggttattcaaaggtgtgatcatagtgaattgcagcctccaactcctgggctcgagtgatcctcccatctcagcctccctagtagctgggactacaggtgtgcatcaatgtgcccagctcatttttggcttttgagacagtctctcgctctgatgtccaggctggagtgcagtggcgtgatcatggctcactgcaacctccacctcctgggctcaagcgatcctcccacttctgcttcttgagtaactgggaatacaggtgtataccatcacattcagctaatttttatagagacagggtttcactttgttgctcagactggttttgaactccggggcttccacctcggtctcccaaagtgctgggattacaagtgtgagccactgtgcctggctcatttttggctattcttaataaggcttttgtgaatattcttgtccacgtcttttcatggatatgtttctttttcccttgggtaaataaatacctagaatgatggacttgctggatctcagggataatgcttaactttgtaagaaacggccacctggtccttcaaagcagctgagcctttatcctacaagaaatatgagttcccattgttccatgtcctggccaaaaattttgactgtagcttttttatttgctagaaagttggaccagaggtgtttcataagctgattcagatgttaatgaaaggatcactctgctgtgtagagaaggttggtgcaataggagcagggaatgaatccaggcaagcactgagagtggcctctggctgatggaggtgggagatgtggtaggtgtctaggtgtgttttgaaggaagcagcagcaggattggctgaaggactggccatggggtgtgagggagaagagtgaaagctgacagccaggctcttggctggaggcccaggagagggagttgctgtctcctgaggtgggaggctgcaggagcaggctgtgggctgcagtgggtatcaggagttgggggtttgaactgttgtgctttctggatatccaggaggaagttacagcagcaatgaggttattgagttaggagttagagctcaggggctgatgggggtataaatttggaggtctttctgagcatgtgggtagcatttggacgaggtggtgtggatatgagtttaggtagtgaagaaaggggttgggagctgagctctttgtcccagtgtcgagaggtcaggaggaattgccaggagacaaaaaggggagcctagtgagttcataagcaagctcagaggggtgttcacggagggccttctttttaaggctatatctattagtgtgtttgggaggatcaagcaaggaggggacagtgatcatttaagagcatgagagctgctggagtgccttactgtgcaggtgagaggagggtccaggacacctggaaggctggtcctcgagtgggtaggagctacacagggagtttgggggatggggtggtgtgtgggtcacactcagctgggtgtcaggtgagaggtgggtggtgggttgaggcggtgctggcggcagtgaagagagggtgagtagaccaaggaattgggccaggattgcaggacggcaccaagggccctggggatgggtagttggccgtttacaatgggaccctgcagcgtagctgtgctccgtgcttgtcccttagctatagtacacagtctgctcccaggacaggtttctctgtagagggggagggctgagggagctggagcatgtgtgagaacagtgctgatgctggtggaattggatacagctgtttgattctagacgctgggctttcacccctctaggatgtcatgcctcctcccggctggggtggcttagccctctaggatattgtatcgtgcccaggctggggtggcttaacccctaggatattgtatcgcgcccaggccagggtggcttaacccccctaggatattgtatcacgcccaggctggggtggcttagcccctaggatattgtatcacgcccaggctggggtggcttaacccccctaggatattgtatcgcgcccaggctggggtggctctagttttgtaagttgtcttgctcccttctgaacaaggcttagtataaataaatttaagtcactgactagtttgatcacttattgcatcaaaggtctaatactgaccaggtgactcactcctataatcccagcacttcgagaagctgaggcagggcgatcacttgagcacaggagtttgagaccagcctgggcaacatagtgagaccttgtctctacaaaaaataaatggtggcatgtgcctgtgatctcagctactccttgggaggctgaggcgggaggattgcttgagcccaggaggttgaagctgcagtgagctgtgatggtgccactgcactccagtctgggcatgagagagaccctctcaaaaaaaaaaaaaaaaaaaaaaaaaaaggcggtaaaggtaaatcactttgctgtttccctaaaaaagaaaaaaaacaaaagcaaaacacaacaaacatcaaacttttgactctaacattgtttttaggaatatcttctgcaggctaaagcagcgacaaaaatttacctttcttttggagagaaagtttcaaggaggaggcctcaaatcatctagataatgatacaaatgtcatcccaaaatgttttttcatgtatttgctagttgataatgtatttgccagataatataggcacttggtaaatttggaaggtttaataaatatcttggttataatgatggtaaaatgtattaacttctaaatttcagaaaagttggagaagatgagggatcatgaacgaaaggaagaaacttttaccccaatgcccagcccttactacatggaacttacgaagctcctgttaaatcagtaagtagatctcacctcttagaggccacacccaagactggactcgccatgcccttcccctaaccctcgtccttcctctccgcttccctgcttattgcctcagtaagtggcaacactggccgccctgtttctcaggtcagtgaccatgaggtcatctgtgtacacacacctgccaggtgcactctgtctgtctctgtgtgtctttctgtctgttctttgcctttctctgtctctcatttttccttttctccacttcccggtgaagcccttggctctttttgttctgcctcacatcactcgacattggaccccagtgtgagccaccagcatctcacagaatcggcagtagccattctttgccatgtatgtgttttatttagcacagctttactcctgtttctccttggagtaggtggatttgagtttttttgtgtctttcgcaggaaaggccagagggcttacatttgcctctgtccttgggttacaggaaagcccacttcctggcaaaatcatgctgtagtaactccgtagcttgtttgccttcatccatactggctccgctcagctttccattcattcttcacatctcagccagaggggcctttgaaaggcagaactgccatgtgactccctgcttaaaatcctgtcttccctctcgtctacctgagcgtggtgttcaagcagtgtacagcctagtgcgtgctcctcctccctctttcaccctctctacagctcttttctctgcttctggagggctcaggctcacactggcccctgtcacttcttcaagcattctgactttgcatatactgttctctgccctgtaagtctgtcctttccctgcccctgctcacctctgctggttagcataacatgtctcttctgggttcagcacacatgtactcttggcagctctacacattgctatggcatttgccagttgtaattttcttgtttgcctggctgtgccatcacatgtacccattctaaatgggcaggggctgggtctcgtatgcatatgtccccagtgagatgcctgcggctcatgtttgttgagtgaaagtgaaactagtgaagaaggcagacaagggtggataattttgcttgggagatacttagaatgtcatttgtacaatttcaagcttctgaagctccccgggtatcctttaactgggttcaagagcagaactagaataaaaaattgtgacactagtactactgcatgctgcagagcagcaggaagggctgggagcccactgaatggcgctgctgaatttaaaggaaaagttggggacacaacatgggcttgtgcttaggctgagatgaggctgcagtcagcccatgaatttcataaaaagctgagaagcagcaatgcaccaagcattccactcggcagtggcgtttgtcccataggcctgcttcctggtgtggtgcgggagagatgtgggcctgggagcctatagtgaatcttcagtgtgaccaatgctcttgacagtccatcagagcgcagtaaggccaggtggtgccagagagggctcacagaggtttgctgggagtgcagacttgtaggaggtggacggtaggggagagggcagtgaggcaggaactgatatgctcaggcagagtgtgaaggacctggtgtagccgggcaagcagagatatttgaggatgtgtagtacattcatgggagcagaggaatggaggcataggttctgctgcagtggccagcccctgggaggggcatgtggcctcagagggacctgagagagactgtagtggtggtggggatggtagctggaagggagaggatctataaacaggctaggtaagaatttggcattagctaggtgagggggcctatccattttttgtttttgaagttcaatatattatggatgtagtttttatcaaaaaccttgttttataattcattcggttaagggacttaattttacgtttgttctatagttcagctgacgaggagttggggtcctttgtcctttaacctgctgttgagagcacaagatctaaatgtttgggtttataaataaaactcactacataaattttgtaccagtggtttgccacttactcatcaggaattaattgtagcatatggagagaatgtctagcgtaacctgtaatgcctagtgacgaacaatatttgcttctgcttttatcgtgtagtttttcttcaaaggttagtttaaaatacttcacaacgggagcctcgactttgtgaaagccttccttcatcccttgctggctttgagcttctagccagaattttgctatgtgtaggtgtgctcactgtatactaatttgcagtttcttctgtgatttttgaaacttgtttttgtcttctctgaagagcaggagagtcccttcccttcagggcttttgtgaggatagaaatgccaggtaaagtgctgagcccagtacctggcatggagttggcgttttccttctctaggctgtgagccctggattcctggtggggaatagggagatctgctcaacactctgtaaatgaggagcaatagaactcgacctttgagccagccctcgaaactgattccttgtagatggaggttaggcagcacggaatgctgttatcctgagacagaggcttctgacttagagctgattctctactaattttcttaggtaaacagcagtcctgttcagcagcctgccatgggatagttaatgtgagcaaaagaaactccatgtggatcactgccgcaccaagcttaactgctacaaatctttacaccctaaagttgaaaataaagcaaaacagactttctgagtctggaatagccacggtattttgcctgaaaagagccactctatccagcattgcctcaggttatcaagtgttccccgactgactttagcccttgctcctttagtgcttcagacaacatcccgaaggcagacgaaatccggaccctggtcaaggatatgtgggacactcgtatagccaaactccgagtgtctgctgacagctttgtgagacagcaggaggcacatgccaaggtaggtgccgccttgcctgggtgctggtggccttgatgccgcataatttcacatggctcccgtctgctgaggctattacaggcaggcattactagctgtgcttttcaacagttcattggtttcttatttttattcagtagagtttacctttttctcaaaatcaaaaactccttggccaacttggtctgttttcttgctttagctggataacttgaccttgatggagatcaacaccagcgggactttcctcacacaagcgctcaaccacatgtacaaactccgcacgaacctccagcctctggagagtactcagtctcaggacttctagagaaaggcctggtgcaggcggcttgctgggggatgtgagcgctcaggacgtgatgaggtactcgtggttctggagctctagaaacacttctgatgcatgaaaaatgtgtgatggtgcaaggaatggattcaggatgttgttggagaaacaagtttgtgattagtccttaaaacttagctccctgggacattcttcaattccacatctgtttctagaaaccagccctttttccccccacttttgagaaataaaaaagccttaggtaaataagtcattctccctagcagagccacttgggtctcctgcatggaagccatcacacttgggcaggtgttcagtgactggtaggtgtagatacagcaggagtggccatgtggtccacggctttttaccccttcttgatcctgatttcttgggctgaatttagactctctcacagaggtggctcacagagaaggatggcagatggtgcagccaacaatgctgaccggtgcttatcctctaagccctgatccacaataaaaatggacccaactcagctctgactctctaggtttttgtgctgcgtaactaccaagtaaaaggactgagcctgtggctgagatgactcagtcaacgaaactgaggcacacggcagttaagtggaaactgcagaccaacacctggggtgtctccttctcttggctacttctagctcaggtttaatgggttgcttatcaagaggagagtcaggaaaaaaacgaatccaatgtattgagcatgagtgacaatgtattgagcatgagtgacaatgctagaagaaaagtcactttcagtgctgctcttgatggatttggggaaggattctttgttgtaggtaacagtgggctcaggggaaattatttttttcctaagagaaaattactttattcgtagcattttggaaatgttaggacctttacagaaattacattaccttgagaggtgaaatgatcgtccagcatcatgcaatggatagaaggttctgtaatcagctttaaaaaaaactttaatttttggccgggcacattggcttggctcatgcatgtaatcccagcactttgggaggccaaggcaggtggatcacaaggccaggagattgagactatcctggctaacatggtgaaaccccgtctctattaaaaatacaaaaaaaaaaaaatttgccaggtgtggtggcacacgcctatagtcgcagctactcgggaggctgaggcaggagaatcgcttgaacccgagaggcggaggttgtagtgagccaagattgcaccactgtactcctgcctgggcaacgagagcaagactctgtctcaaacaaaaaaaattttaactttttttttagacagggtctcgttctgtcatccaggctgcagtagagtggcgtgattatagctcactgcagcctcgaactcctgggttcacacagttctcccaccacagcctcccaaagcactgggattgcaagcatgagccgccatgcctggccagcctatttttggctggacaccagtgggccaaaagcagtggggtgctgtctggggagctctgagaatgcgcatgtgtgacaggctgagcctaaagacttatcacccagcatctgccctccagtgtctagcatgctgcacactatcactccatgttgctgcccacgtgtccccgccaggcaggttttggtggttatttggacactgaagggtcagacctggaagactgggaccaaaagatgaggtctccataatttaaggtgctgttcagacttggttcagctcataggacttgttctttcatctcagccttccttggaatcctcctgctttcatctggggatcttttagaatgaaaccacttgttattgtggagggcaaggggtcctaatgccctcctcttagagcctgagccagtggaggcagctccgtctgcggagatgtatagttattgagcttttctttgtttggctttgttttatatcataaaaaagattttcctcttaacataa

SEQ ID NO: 536 - DNA, 46767 bp, Homo sapiens
gcgcagtcccgcgagcctggcctcggcggccccagcttctaaggagctcgtgagggccaggctgcgcctgcgtcgggcggctggtgggcggggcgagggccgctggggccgcgaagtggggcggccgggtgggctacaagccgggtctgggctgaggggcgcggcttcgcggtggaccccagcccggcaacgggaaggcgagctctcctccaccgtccaaagtaaactttgccgctccttccgcggcgctcccgagtcctcgccgccgccgggccgccgcagtccgcgaagagccgtcctgcgtcagggcctccttccctgccccggcgcggggccactgcgccatggacgccacagcactggagcgggacgctgtgcagttcgcccgtctggcggttcagcgcgaccacgaaggccgctactccgaggcggtgttttattacaaggtagggccgggcccggcgcttcggtcggagttgctcagtcggagtgcggcccgggcctgcggccgaggggcgggatccgggtgcggaggctagcggccccggctttgcttttccctcgtccgcctcccggccctcctcttgttgggagcggcaagcccgagtgcagaggccgacgctgaggctgcggggaggctgggtcgcggcttgcagccgccgctcctccacctgtagtcctgactggcaaatgcccaccgttgagccgctttggggggcaggtgttagatatgggtagttagtagccaattcttgctgtcacttgactctgatttacagctagcgggaaatggcctgtgatatatatcaaaataatgcatgctcgttaaataaacttaaaaagaataaaaaccatctcctgtcatagcatttgacatacagtcatgcgtccttagcgatgtgatattttctgagaaatgtgttcttaggccattttgttgttgtgcgaacaccgtagaaagcgcttacacaagcctgaatggtacagcctgttccacacctaagctgtatggcatggcctgttgctcctaggttacaggcctgcgcagcgtgttgctgtactcagtggtgtgtgcagttacatgcagtggtaagtatttgtgcatctaaacatagaaaaggtacagtaaacatgcagcataaaagataaaaaaaaaatactacaccagtgtggggcacttacccacaaaaggagcttgcaggactggaagttgctctgagttggtgagtagtggtgagtgaatgtgaaggcctgggacattcactgctctactcttgtagactttataagcagtgtacccttaggctacgctaaatttttttaatctttcttcagtaataaactaaccttagcttacggtaacccttttactttataaacttctaaattttcttaactttttaactcttttgtaatagcttaaaacgaacttattgtgcagttacacaaacattttctttatatctttatttggtaagtttttttgtttctttttttttttttattctttagttaaaaactaaggcacacgttagcctaggcctacacctcgtcaggatcatcaatattactgtcttccacctccaatcttgtcccactgggaggtcttcaggagcaataacaggaatgaaactgtcgtctcctatgataacaatgtctcttgaaatatctcctgaaggacatgtcagagactgttttatagttaacttttttttataaaaggagtatactaacagtacatagtatagcatagtaaatacataaaccagtaacatagttgttgattatcaagtattatgtactctacattattgtgtgtggtagacttttacaccactggcaccccagtaggtttgtttacatcagcatcaccacaaacatgcgagtaaagtgttgtgctatgacattatgatggctatgacatgaccaggcaataggaatttttcaactccattataatcttaggggaccactatcatatattcagtctgttgttgactgaaatgttatgtggtgtgtgactatatttttgtgtttttttatgcgtatgtgtatatgctttttttttttttttacaaactggtttatactgtttttagtaatagctgcacagtagttcattatgtgggtgtaccatatttttttttttaagagacagcgtcttgccctgtcactcagcctggagtgccgtggcccactaataatagctcattgcagcctcaaactgcaaagctcaagcaatcctcctgcctcagtctcccaattggtgggactacaggtagacacaaccacacttggctaattttttttttttttttttttttgtgtagaaatggagtctcgctgtgttgcccaggctggtttcgaactcctgggtcaagcgatcttcctgcctcagtctcccaaaatgctggaattacaggcgtgagcctctgtgcctgtccagtgtactataattaatttacagactcttgggcattcagttgattttgttttttcaacatcataagtaacgatgtagttcatatctttataactaattcttatgactagtgcaaatttttgcctgaattttctttgggataaattaccggggacagaattgataaatcaaagggtatgagcttccatggtccactctcttctctccaattctgaggatttgcaaatatacccctctagctctagctagatttggagggagctgtgtcctcatgatagtgtcaccttttcttttagaaagattatcagactttgataatactgtacaatagtagtactttttttcacaaatgtatgtgctgtcaataaagtgtggtttgtttcagattaatattttgttgctttcattttataatcttttttcctttttttttgagacggagttttgttcttgttgctcaggctggagtgcaatagcacaatctcgactcgctgcaacctccacctcgtgggttcaagtgattctcctgcctcagcctcctgagtagctgggattacaggcatgcaccaccacccccggctaattttgtatttttagtagagaccgggtttctccatgttggtcaggctggtctcaaactcccgacctcaggtgatccacctgcctcggcttcccaaagtgctgggattataggcatgagccaccgcccccagcctatttttttctttttttattgataggtaatgtacatagtttcagggtacatgtgataatttaatacattaatataatttgtaaagataaatcagcatacttgggatagccatcaccttaactacttcacagctgaactgtgcagcttttattactgaatattattcccttaatatttatgctaggaacatttgaattaatctagctattttgaaatgtacaatcaaatattataaactctggtcaccctgtgatctatcttaacagtaggtctcattctattataatctgctttatgtttagagagttttggtgcatttcagaatccttttagacttttttgacaatttcacaaggcattgtttaagagaaaaattgtgtgtgttttgtgaaatagctttgacaacaggttaaaatagtgctatataaaaatagattttattaaagcaaaagaaactgctatgcactgccccttgtttcctatagacttacatacatgtcaggaagaattttttatctttgagaaagccaaaaaaagtggttgtacttctagaaattatttatataagcttcatcagtttagtatttagtgttttctgcccagtcctttctataagctatttatttcttgtcagttttgaatataaatgaaatgagtaaaataaaattgacaccagcagttttttaaattggctttattttatttttcagagacagggtctcattctgtcacccaggctggcgggcagtggtgagatcataactcactgcagcctcaaactcctgggctaaaacaatcttccagcctcagcctcctgagtagctgggactacaggtgtgcaccacaatacctggctaattttttttttttccagaaatggggatttcactatgttgcccagttagtcttgaactcctggcctcaagcagtcctcctgcctcagactcctaagtaaaaaaaatagctttttttaaaaagtacaataattatttggaaattaataatcacatacaagataactgaaggggcaatatatgtgtattatatacttatataatttacatgtatcaaaaacattccgtttattggatttaagtgtagttacaatgtatttagataatgatggtatgtaagatatatttaatgtttacatgtaaagttatactttcctcctctgaaatagttatagaatctaaggaagtcatatcttttctatcccactgcctttaggctgaattttcattgtagtcaaaactgtactttttcattccttccttgcttccttcctttttttttttttttttggacagtatcttactctgtcacccaggctggagtgcagtggcccgatcacagctcactgcagcctccacctcccagggctcaggtgatcctcccgcctcagcctcctgagtagctgggactactttgtagagacagggtttcaccatgttgcccaggctgaaaactgcacttttcttaattttgttaggttcagtgaaacaactcctgctcaaacaactggattcaaaaagtgatgttcagtagatggcatctttggaaacaggcatgatgacccatgaagtgtacacgcttgggttactgcagagaaggtgctgttacttgtagaaatctgtctttgcttttctaggtggtagcattggtaaccttcctggaatggtgatgaggagaatggaaacaccaccttctagccatagcataactggtcgtggaagttatggaataactggaagaagaatccagattttcttaaaattaaaataagtgtaatttatacaactaaaatctgctttaaaatgtgtcatcctttgtcagtattttctgtggagaaaactgttttccttttactgtgagatatttaacctgtgtaatctcctgtaatcttttcttgataattttattttagcaattattactcgttttaatgctttgaaggctcaattcatatttttttgcgtgtgaattacttgcaatcagttcacattttcaaggtatataattttaaatctgatctattgcataaggaaaaaggaaaacgaaacatgtaaactgcagctattctaaagaagtgtttataatcagttccttatgcgtgaattcataaattttcaatgatatgttaaaattgagagagagcctggatagctccttcggtagagcatcatcagacttttaatgtgagggtccagggttcaagttcctgtttgggcgtgtcctgtggcttttagcacctaattctgactctatctttgaaaaagccaaaaaaaaaaaagtatgatttgggccaggtgtggtggctcatgcctgtaatcccagcactttgggaggccgaggtgggcagatcacttgaggccaggagttcaagaccagcctggccaacatggcagaacccaatctctactaaaaatacaaaaattaaccaggtatggtggtgtacacctatagtcccagctactcgggaggctgaggcccaagaatcacttgaacctggggaggttgagctgagctgagatcacaccactgcactccagcctgggtgacagagcaaaactctgtctcaaaaaagaaaagtaaaagaaaattgagaacattgaatactgaagaaaacattggaagattgtataactactttatgaaaaaaattactattaataataatttaaagacattcttgttttgtcattcatggaaaccaatattgaatgagaatgtgataaagaaaattcaagttgtaatacatctattggattcctttgaattctttcatttttaggaagctgcacaagccttaatttatgctgagatggcaggatcaagcctagaaaatattcaagaaaaaataactgagtatctggaaagagttcaagctctacattcagcaggttagtaaaggactactaaacttgtcactctattttttcttttctcccatcatgtctttcccccatgtttgtttctcttcttcatttttatctttgaatcttgatgctcactctgttgctgctcattccacttttggtaatcacctctttaaaagtcatttagaaataagtcatagatctttgaagaggaaccttatagacaatatagtccagtttcctaatttcccagagtgcagagatggtgaattacctatgttcaaacaatttatcattggcaaagttaggattaggattcagttaaagtctgcttttaaaatatctgtcacgtctcttccttataaaattaagtgactgttcctcttcagtgtttacagacttcagcagtaggttcacagtgtcttctctttcggtgtcttctactttcagacctttgctaaactctttaaaaccatatcttgggaaagtgacatgtaaacagagacttggaactacttgtatttatttttgtaaacagcacaacaggtacaataatagaaatatatagtcttaatggtcacagttttgttagaggtaactgatgttgacattgtatttacaaatacattgatttctgtagggattctttttaaccctctttttctgttgctgcatgataaagcgccaagcagaagaatatttattctcatggactttgtgtaactttctaccactcattttgagtagatacgagcaattacaagaacatcgttgggataaagtagatttaatcattggattccttgttatgacagttcccttaaaaacaaggcggtttacttttaatacagtgcccagaaattgcatgtattgaaaagtgtactgcctgtgttattggaacctcacttgatacaaagtattgattcatgtattcaaaatatcatataaaattcaaaggaactttcttttcccagccaagtaaatgaagttcttaaatttaactgcccaatattaggaactttgtttcataaccagtgttttcaaataaaattatctttgaagtagggaaggtagtctttcatgtttacttccatgatctccttgttttttcatagatagttttcttcatttcaataactatgtattgaatacatgtttgggctctatggtaagtacagggtaatagatgagtgacagtccatgtcctcaggaggacttcatcaggtgtggagagagaacagtgtcaacattgcactatcatggaaacccctttctgaagcatgctagactaaatgttaaagcagaatgctctagaaaggagagattatatggtgatattattccaggagtagaatctctggcagcctaaggtatatttccatctttcttttccatatgtacacacagtcaagcacatttatgccctagggtcttgattccagtaagattgctctttaaacccttgaaatccttgtgacaattggaaaaaataaatatgaatcatttttttctaaggaattttaaaaattattcttactttatattaaatacagctaagcctaaaaacttacatgtgatttttgggaaataaattctaaacattgatatatatgtgatattcaagcatcaaatgagacaccccaatctcttgaagaataaagacttgccagtgaaatagagttcaaaaaggattttttttttttttttttgaggtggagtctcgttctgtcttccaggctggagtgcagtggcgcgatctcagctcactgccaagttccgcctccggggttcacgccattctcctgcgtcagcctccccagtagctgagactacaggcgcctgccaccacacccagctgattttttatatttttagtagagacaggatttcaccatgttagccaggatggtctcgatctcctgacctcgtgatccacccgcctcggcctcccaaagtgctgggattacaggcgtgagccaccatgcctggccttaaaaaggatttttaaagcataacatagcttgttttaccaacttctttctgcttttgttgaagaaatggagtataatctctagacaatttaaaggattttcttatttattattttaagcagaaaagtcctttttcaaataaaaatcctgttaggaaccctaagttttaaaacaagatagtctgctgacagttaagagaatcctgagagagagttgattttggggtggggaaaggtaacataatttaaaattaaccagtataggccggcacagtggctcatgcctgtaatcccagcactttgggaagctgaggcaggagaatcccttgaatctaggagttcaagatcagcctaggcaacatagacttcacccctacaaaaattgaaaaaatttgctgggcatggtggtgtgtgcctgtagtcccagctcctcagaggttgaggcaggaagattgcttgagcccaggaggttgaggctgcactgacccgtgattacaccactgccctcagcctggatgacagagtaagaccctgtctcgaaaaataaaaagtaaaattaaccgtcgtagtacagagttcaagacttggaattaaaagatccctgttgagtctctaccctttcacttgtagctgtgaaatcttagactagatcaatgggtctcagtagaaagcaatttgccccccaggggacatttggcaatttctggagaagtttttggttttcacgctgctgggtggcaaggaatatgcttctgggatttagctgggtagaggccaaggctgttgctaaaaagtctcccacaacaaagaattatccagcccaaaatgtcaataatgccaggctgagaaacactgggctagatatttcaacatttttgagctttggtatctttttcatcaatggaattagtatatacttcagagaggcatttaagaaggctaaagttttgaaaacatcagcacaaactgggcacagtggtgagtgcctgtagttccagccacttgggaggctaaggcagaagggtcacttgagcccagtagtttaagagtttaaggccagcctgggcaacctagtgagaccgtgtatttaaaaaaaaaccaaaaacacgtaactttaaagaactaacaaaatctcagacttttcttaaatagcaagtttagcgagatacaatttccatatcataaaattcaccctcttaaagtatataattcaggtgtttttagcctattcccagagttgtgcagtcatccccactatctaattttagaaagttttcatcaccccaagagaaacctcttacccattagcagtcaatccccattcctccctccccctagccaccactaatcttgttgtttctatggatttgcctattgtggatatttcatacaaatggaatcatccaaaacatggcccttttgccatgtggcttctttcactgagtttaatgtttgcaagatttttccatgttgtagattgtatcaatacttcattgctttttatggctgagtaatatttcattgtattgatgtgctgcattttgtttatccgttcattagtttttggagacatttgggttgtttacaccttttggctgttataaataatgcagttaagaacattcatgtacacgcagtggctcatgcctgtaatcccagcactttgggaggccaaggcagacagatcacttgaggccagcagtttgagactagcctggccaacagggtgaaaccccgtctctactaaaaatacaaaaattagccaagcgtgatggtgcacacatgtagtcccagctacttgggaggctgaggcacaagaattgcttgaaaacccaggaagtggaggttgcagtgagctgagatcgcaccactgcactccaacttgggtgacagggtgagattctgtctcaaaaaaaaaaaattcatgtacagatttttgcatagacatgttttctcaattctcttggaattccacccagaagtggaactgctgtgtcataggatgtagctccatgtttaactttttgaggaactgccaaattgttttccagagtggctacatcatttcacagttccatcagcagtgtatctgggttccaagtccttcacatcctaacacttgttattgtctttctgattttagccatcctagtgggcataaggtgtcatctcattgtggttgtgttttgcattttttgatggctaacgttcagcaatttcttatgtgccatttgaccttttgaatgccatctttggagaaatgtctgttcagatcctttgcccattttttaactgggttgtctttattgttgaattttaagagatctttatatattctggatacatgtttcttatagatacgtatttttttattaaaatcaaatgaaaatattatttcaaagagcaatgaaaatacataacatattctaggctcagggtaaatagaaaaagcaggaactttatcatcagagcctagtatattacacaattttgtctgtgcagaaaaaaaagttttaattgccttaaaatagatttcttaatatttagcaatttccaagtttttgttttgtcttttgaggtagaggagcatatgaggagaatgcctgtgtttcaatttttaagtgaagaaagtgccagtgggagagagaaattcagggaaagaattttttaaataagtagtgtattttttactattctttatctctgatgtctattgtgtggtaaataattgcagattttttttcttagaccttaagattaaaaagagaagggaggaaggctgggcatggtggctcacacctgtaatcccatcactttgggaggctgaaactggcagattgcttgagcctgggagttcaagaccagcctgggcaacatggcaaaaccccatctctacaaaaaaaaaaaaagagagaaaaattagccaggcatggtggtacactcctgtagtcccagctactcaggaggctgaggtgggagaatctcttgagcccgaggaggtagaggctgcagtcagctgtgattgtgccactgcactctagcctgggtaacagagcaagagcctgtctaaaaaaaaaaaaagaagggaggaaatttgtccttttttaaggatttttttaaccttgctaagttttttaaatgaagaatacagggttttggtaaaaaatgtcttaaatagtgaaaatagtgtgttttctggctgtatttagataatactccttctgcgtatttttttttctatcctagttcagtcaaagagtgctgatcctttgaagtcaaaacatcagttggacttagagcgtgctcatttccttgttacacaagcttttgatgaagatgaaaaagagaatgttgaagatgctatagaattgtacacagaagctgtggatctctgtctgaaaacagtgtgtatagctacaaattacgtttgatgagttatgccaaaccatttcttctcttgctagtgaattttacataacaccttgaataaaagaattttaacagaataaaaaaaattattttaaatgtaacaactactcctcaatataagatgatgagtagaaagctaataatgggtttttgcatcttattaaaattttgaaagtattgagtcttaaattacaagaactatttttaacatttctgttcttacaactaaaataaacttacagaattcattatcacaaatctattaatttagaataaacttccccttttttcagtttcgtgcactaaaaaataagctagtggtttggatgagccttacttatttgcagtgtaaaatctgtatgctgagtggcttttactgctccctgctgagccttggttgggactcttagcttcaagggacatctagtgcataagagagcagtgtatttgacaggaggatgaggtaaagtagttgagactggtatccccatgtctttctgactggctttttggcagagacttttgctcagagagaccatctggcctgatttctgtaggtgccttgagactaaatgagtgctagtgttctgaggttcctgccactcagcgttccacagcactatggtcaaacagttctggtccagttatcagttgtccacataagtggttttaaagtgcacctcagtgacaaattttcaacactattttaaatgatacctttaaggatgagaattaatgtcatctttgtttgttctcaatttcagcaagtgtaatatgcattgtaaattttttgcttagaaatatggatcaagcaaattgaaaaataattatgctttaaaatgtctgtctctttctttctcttaagtcttatgaaactgctgataaagtcctgcaaaataaactgaaacagttggctcgacaggcactagacaggtgagtttgatctctcaagttctaatccatggatggcacttagtgttatttaaacaaatttatctaaatgtgttgtaaaggctgcagtaacaaacctccatcttttaactgtcatctgaaacaaatctactttctacttcttagtgaatttacctcctctctctagttccctgctttaaactcaagaaatagcaaatcaataaatgtttttaattttagtttagaacagaaaggactgtgatatttgcaatggaggacctcctttctgttatgtaatatcagactttcaaagagaacttccagagagccttccagatctgctaaaaatagaaaacatgagcatgaacttgctttcagccatgtacatacctcagattatacagtgtgtagctctttcacctcttagctgaaatgtcaacttttcaatgaagcctgccctaaccattgtttaaaattgaatctcccccagcagttgcaacctgattattctggtatttttcccacagctcttattttctgaggtctgtgagatttactagcttattatatttgttgttaatgtctgtgtcccctccaaccttcatcccccagatgtaagctctgagggcagagatttttgtctattttatttagtgctgtaaccaagtacccagcagagtgcctgacatgtaatatgtgctcagtagatatttgctaaaagaatgaatgagtttgcataagcgaattatatatcttgaaagagtgttgtagacacacaaaaaatgaaagggtggaaattgcttttatacctacatcatgaattatctccttttgaggctctgacctgatagataactgtaccaccccaagcccttctttttttaactgaagtaaaatagtcatccctccttttcattgtcatctactaactttagtttgtttcctcagattcacaaagatacgagtccttgacatacagttgtcttctctatcttgacttctttcacctgtcagaattataagtgactttattacgtctgtggctaacccatccaatattctcaagtgcaccctaagcaaagggtgggtgagatagccatgggctcctatgaggatcttttgaaacttatggatccattctctaggaaaatgtacatgaaatttttttgcatataatttcagagttttcacaagaatcctgaagctcatatatgcacctcaggttaagaacttctattttttagctcgttagttctttgacagaacaaagttaaaattctgttgcatatcatgtgaggctgtctgtgatccagcccctgctttcctctctagtctcatctcctgctgcctctcgtttgcacttctcacaggggcaacattcattcttttgcaattacctggccgggcacggtggctcacgcctgtaatcccaacactttgggagactgaggtggacgaatcacctgaggtcaggagttcgagaccagcctggccaacgtggcgaaaccctgtctctactaaaaatacaaaaattagccaggcgtggtggtaggcacctataatcccagctactcagaaggctgaggcaggagaatcgcttgactcggaaggcagaggttgcagtgagccaagattgcgccactacgctctagcttgggcaacagagtgaaacgccgtctcaaaaaaaaaaataaaaaatttaaaaaagaaattaccttaattcattgtgctgtttcatacttctgcacgtttgtacatgttcttctgtctacttagaatgcttcctcactgcccaggtgaacaactctgcagctcaagcatcagttcagagcacccttctccaactcatccccacttggcaattcattaagtgaataacttctgttgtacattcatttgcatgtaatactttcatcctagtatctgttatttttgatgcagttgtctgtctttccctacaaaactatgagtaccttaagggtagggattgttttatacgttcttttataccacttaccttaccttgtatggtgtctgattatgtaagtgcttaattaatgttgtcaatagaatattgtttgtaaaagatgcttatctttggaagtagctgaagtagtgaaatgttgattagtatgtaagaattttatatactaattttacattagggatgcttgactggttcttcaagtaaattttgtttcctgaaaagcttaaatgtgagtagaaaaactagaacagttgtttgttcctctctgttatagagcagaagcgctgagtgagcctttgaccaagccagttggcaaaatcagttcaacaagtgttaagccaaagccacctccagtgagagcacattttccactgggcgctaatcccttccttgaaagacctcagtcatttataagtcctcagtcatgtgatgcacaaggacagagatacacagcagaagaaatagaagtactcaggtaaataagtttacaattaattgtaatgaagaattttgttaacatgaatgcagaattttattttcattaggtttgctgaattgtattcagatttctcctatagtgtattgtgctgttattatgtaattatatcatcatgtagtcacaacttgaaatagttaaaattttagttctgatatattttattttattttattattttcatttgtattttttgagacagagtgtcactctgttgttcaggctggagtgcagtggtgtgatcttggctcactgcaacctctgcctcctgggctcaagcgattttcctgcctcagcctcccaagtagctgggactacaggtgtgtgccaccacatctgactaattttttttttttttttttttttttttagtagagacagggtttcataatgttggccaggctggtctcgagctcctgacctcaggtgattcgcccacctcggcctcccaaagtattgggattacaggcatgagccactgtgcccggctttagttccagtatattttaatattagcgtttttgctagacataatacactttgctgaaaatcctagcattctgtgaaactgagccactaaaggttaaggagcaaaatgagctgtagcagaccactcttaatctatgcaactttgtaaccagagccctaatgggagaaaaaatgttactttgaaataggagtgtaggtggtgtgctggcagctcacccctgcaatcccagcattttgggaggcagaggggggcagatcacttgagctcaggagtttgagaccagcctgggcaacatgccaaaaccccatctctactacaaatacaaaaaatagctgggtatgatgatgtgcactgtaatcccagctacttgggaggatcacttgagcccaggaggtggaggttgcaaagccgagatcacgccactgctctccagcttgggcaacagagggagatcccgtctcaaaaaaaaaaatatgtgtgtatacacgtgtatatacatacgtatacatatacgtatatagtatacgtatacgtatatatatatgtaaagtttttctttgaaaggttttacatgcatcaaaaaaaaaaaaaaagaatatatgacagaaacctcattgcaaagcctaagctatataccatatggctctttacagaaaacatttgccgaccccctgtctagcgggggttatagcgtgtctgaaagcagtctcagaggatattaaaaatgtaaaacacggctactctgggcacactgcctatggagtagccctgttccacaaggagctgtaccaaaaaaaaatgaaatgtgaaacacaataatgtggaaattcttgattgccctctgaaccagtgtagctaggataagtccctgagccagacagggtggcttttttaaagttgagcactgcagaaagttcagtctgcttagagctgtgtaagtcatgtaggtgttcatctttttattttctaaaattgagctgaaagggcttctgcctaggtagcagccatctgagagcatttttctttcctttcctgctgaagattgtaattgtactcctgctaatctggctccctttgtctaggaaaaattgcatgtgcaccaacacagcacaatacaggacaaagaagggtagttttgaagctaaaagactaataacagtccaacacttttccatatgctaccttcacatgtttgaaattctgtactacaccagaacaactctatattccacctaacaaaatgcagctatccttcatgcgagtgaaaagttttcattatctttccaaaataaggctgtacatagtcccaacaatcatttcatctattcctgactatattaagtagtcctcagatttccaggctattgttacctaaagactaaattctgaagttactctgcaacatctcataaatagaataagggagagaaacagatacaagaaggaaatagttaatatagataaataagcatatacacaaaacaaggagaatgcaaagctactacaaaccttatttctttaatttgtcagtagaccatagctgatatctatgacacttccttcttccactacccatttcatgtcctcataaccagaaaacgtgaagagcatgtatttcagaattgttaatgtgtttttttaattccaaaataacttaagcaattgatttctccctttaggcttagcatagaattggttttgtgtcttggtgtcaaggacactttcattacctcttgaatagtcttgtcttcttgtgggtgttagcctttaaagaatattcttattggtttgaattgattcagttattttctgattttcaattattttatgaaaatattgtccaaagatatatcaacaacatgaggttgtcagtttaattttaatacagtatcataccttgtcatttaaattttaaagagttgaaataagattggcaattaaggtaaacttgaacatttaggtttttttctcgtgtttgataggacaacatcaaaaataaatggtatagaatatgttcctttcatgaatgttgacctgagagaacgttttgcctatccaatgcctttctggtaagtaagcactgttgcaatttttaactccaatattttaacttttcagtactctgaagttcaatttaatagccttgaaattaaaatttgtaataaaaaaatttgttggaatagaggggtggctgtgggaaagggatagggcaacatagcaagagcacttttgttatttgcccagtcatgaggacatgaggatctccttttgcctaatattatttctgtagtgtctagcacagtacctggtgtaaagtaagtactccgtaaatatttgtccaagcagtgattgaatcacaacagaaattctaacacacagtaaagaaactgaatggaaaaggggaatggaatgatgtcattgtttactaagaagaccaattcaagcaaggactatttatgagagaattagttagcacagccttccaggacaatggcagcttatgtcaagagctttaaaaatattgtttggttcaggagtccgagcttgtagtcatcgtaaggaaatcaacagtcaaagatgtacataataaggacactcatcaaagcatctgttgcagcaaaaaattattgaaacaaactggcaatatgggaatgattaaataatagtacatctatacagtcaaatattatgctactcaaaataagtatttaaaactgtaggaaaaaaaatgttcccattacagaaatcaaaaagaaaattatgatgtcccaaattttttttttttttctttttttttgagatagggtctcactcccattgcctaggctggagtgcaatgatgtgatcatgactcactgcagccttgacttctcaggctcaggtgattctcccacctcagcctcttgtatagctgggaccgcaggcatgcaccatcacgcccagctaatttttgtatttttggtagagacgagattttaccattttggccaggctggtcttgcactcctgacttcaagtgatccatctgcctcagcctcccgaagtgctgggattacagatgtgagccactgtgcctgacccttctttttcttttcatgtatttatagatgcatagaaaaaaaaaatgatgtggagaaatatacccgaatatttacagtggttatgtctaggtaacaaaattttgtgatttaacctctttcagtacttttttatttttcaaaatttctccaatgagcatgttatatttattattagaaaaaaaaagctggatgcttactatatagaatatgaaggctctgtaaagaacaaaagggctgctttttattttctagtgttttgctgttcttttgccaagggttaggtatcacaaagccagttaacatatttttttcactcaggtagctgtgtgatgctagtaactgattgggaccaaaggaatttttatatctgagaaactttatagcattaatgttcagggaaagattctagagccagactttctggtctcaaaccttgtgtaacaccgggcaagttgttaaatctgtctcagtttcttgtctgtaaaatggggataataatagaaactacctcataatgttactgtgagttaataaaatgtaaaaccctgagaatggtgctgttatatagcaagcactatataataaaggttacctgctagaaaaatcatcattttgttagttactaagttatataacaatttggctgtatattccaaatactttaacattttttatacctctttgactaatgattttacttcaggaatccagttgtaaggaactatttagagatatactcaaaaattcgtacgaaagcgatttatcattgttgttataattgtgaaaatgaatcagttattctggtattttcttgacaatattcaaatagagatgtaaacttatcatttctatctttttgcaacaaattaatgtaaatcatatttgttatgcttatacgacacagtgtccataagaaaaatgttatatagccataaacaatcaagttttcaaggaatgtaataacatgggaaaatgctcataatataattggaaaagtaaaatacgtagccatgcagactcccttaatttaggcatagcacttgtcacagttggaatttttcttttttttctctttaaggtgattacttgcttaatgcttgtctgctactctagcatataaacttcataaggacagagaccatgtctgttttaattaagttgcaccccagtgcctaccacagtatctggtgtatagtaggtattcaataaatatttcttgaagtagttaaattgggagaaaaacaagaataaatactaaagttactattctaagtggcacggtattttcttattttttaaattattttactttaggaacaatcagaagaaaaagcaacagtaaatgtttttaagttgggttaacagatcatcaggaaaaggctccagaatttatctttcgctagagagattgaattattttttaaaattgtttctattcggtcgtgtattacttttaaaataataaaataagcattattgaataaatattataattgtaagtttttttattttttattttttgagatggagtctcactctgtcactcaggctagagtgcagtggtgcgatctcagctcactgcaacctccgtctcccagattcaagagattcttctgcctcagcctcccaaggaactgggattacaggcgcccaccacacgcccgactaattttgtattttgggtagagactgggtttcaccatgttgtctaggctggtctcaaactcctgacctcaagtgatccgcccgcctcagcctcccaaagtgctgggattacaggcatgagccaccgcgcctggctgtaaaatatttttaatatatttaagttctgagggaaaaaaccttgaatttaataatcctctagtgacttgagagaacaaatattatggaatcttggatttatgctgaaatatggttcatatgacaggttaataatagattacgaatttgaatttgcattaattttttctcctcaaaatttttgagagctgtctttaaactcttctgaattcaattagctcactttctgtttacagttagctcctggtattatacaggtaccaaaatgctacctggaatactagtggttctgtgagatgataataaaaaatgtttgagatatgttatatgccatattctattttaagagattgcaataaacattggcttatttaaagtctagaggtgtccttcaatgaaaaaactaatactttaaccaggagtttgtagatcatacttgaccacaaaatcctctcttctcccagtatctgtcagcattctttgaaaaaaaaaaaagttatgtttgtgccagtttgcatattatatactttctattactaggaaatcttttgaaaaccaaggatttgttgcttctgctctagaaagggtttggggatggttgggcctggtggcttgtgtctgtaataccagcactctggtatttacttcaggaaggctggtatcagccttggctggaggatcgtttaagcacagaggttctagagcagcctgggcaacatatggagacctcaactgttaaaaaaaaaaaaaaaaaagtttagggaaagggggaaaggtagatgtttccccttggtgtacacatcaattttagagaaacattgttacacacagtgagtagagggtaatggataagaatggtggatttggcaccagagacctggattcagatgccagttctgctgtttcttaggtgtctgaccttggtaagtcattaatcactttaagctatttccaaaaataattcctttaatagagttgttttaagaattaagtggattatgtatgtaaagcactttagcatgatgcctggcacatggttagtattcactaaattagctacactcattattagccttgccaagtggagtttgtaaaaaaccagctttgaatctttagcttcctaggtccttttgaatgaatcagcttgtactattgttaatggtttcattttattgctgaatttcttgaatacagttatgctaaatttaaaaaattatattcttaaatataaatgaatttaagttgttcttctgttttcaattatttaggtatattttttaattggaggggatgatcaggttgactggactctataaagagccagatttgaccagaaggttattttaagataatacagtactgctataatcactagaccaaaaaaaaaatctctaggaaatttaattttggctttgagtcatcttttaagattaatttttttattttaatttttattattacctcagtgatagatggggcaagctaccattatcacctaaacaaaaaactacattttccaagtgggtacgaccagaagacctcaccaacaatcctacaatgatatatactgtgtccagttttagcataaagcaggtgagcatttattttgtatgattttatagaaaagtcagcattttaaagtaatttgtgtatagatttgagttttttcttagattttttattatatattcaggtacagaagtgtaattggaaaaattgttcattctacacattttgactgaaacatactgagataatataagtataaatcactgttttgagtgattacagatttttatgtgggccctgtttatcattatgtacctgtaaatgtaaaacttgagaatctgaatttcacctttgataaaggaatagatatcagcaatagaaggatatttaattatttgagtaattattcaaaatcaatttttttgaaatacattatttaattttctaggatttattagaataaaatgtgtgagtcagcagtatggtgtttctatttgttactttcctattcaaataataaccaggaaaatatttagtatacattgtagcactattcaaaataacaaagacatggaatcaacctaaatgcccatcagtgacagattggatgaagaaaatgtggtacataaacaccttggaatactatgcagccataagagaacgagatgtcttttgtaggaacatggatggagctggaggccattatccttagcaaactgacgcagaacagaaaaccaaatactgcatgttctcactgataagtgggagctaaatgatgagaacagcttaaaagaaaggaacagcagacactgggttctacttgagcgtggaggataggaggagggagaggagcggaaaaaataactattgggtactgggctaatagctgggtgttgaaataatatgtacaacaaacacctgtgacacgagttcacctatgttaccttccacatgtacccccgaacctaaaatagaagttttaagaaaagatatttagtataaaaagtaggtacttggggcaatgtacgtatattgcggtaatgttgaaattacgtgaatgaatatgaatatgttaattattcttattaacagacaatagtatcggattgctcctttgtggcatcactggccatcagtgcagcttatgaaagacgttttaataagaagttaattaccgggtaaaaatgtgtctctctttacctctttttgtgtaattgtcccttaactagaaatttaaaacttaagccttatctgtatagaaagtggagagggcatatcattcagaatatggcccttctgtagaaattaagcagatgatttatgaatgtggaaagatacgctaaaacagtcttaagaacctatacacgtagttaatatatatgaaattaatgtgttttgaaataaatgaaattgatcaaagtaaaatcatgtcatattgataatactttatgattggactgttaagtgaggtagtcactagccacatgtggctatagacacttgaaatggattagtctgaattaagaggagatgcactgcaagtgtaaaatgcatgagattttgaaaacttagaacataaaaaatgcaaaattgcaaaatatctcatttttgtgttgattatatgttaaaatcatatttcgatttgtgattaaaacatcaaaattggttttactttttttcttttttttttttttttttttttttttttggagacaaagaatttcgctcttgttgcccaggctggagtgcaatggcgtgatctcggctcaccacaacctctgcctcctgggttcaagcgattctcctgcctcagcctctgaagtagctgggattacaggcagttttacctttttaacttttaatgtggttactgggaaatataacatatttctgttggcttgaactgctttagaatgtattaaaatgtttctgaaatactttttcagtttttaaaagatacattagcttaaaatcattcattgcaaaaactaagcattataattttttcaacttttcctgagcggtttttgtgtgttaagtcctaagagtataaagatgaattagacgcagtccttagtttcaactatttgccatataagtggtccaaatgtattttaaaagaaaattgatactgatagttgttgaagtatgttactgtataatttcatgcaactatatgtcaaagttgtatctacttgccttagttgtggttaattggtctttacttcttagggccagtggtaaaagattattttaactggcttaaaatatatacacttaatagatggtttattagggtatgtaagttaacattgagcacttttcagagtattttgaaatttatgtccactttgtgatctcagaaaattacttactaatagtaaataagcactttgattagggtgtagttcattttctaggcctattgtaggaaaatattctcctgtttgtttttatgaaattgccaagacggtagtatatacctgaatgaaatgtgctgtatagtagttgatattgaatactaatgttggtattttaatatttatttttcttacaaaagcataatttaccctcaaaacaaggatggtgaaccagaatacaatccatgtgggaagtatatggtaaaacttcacctcaatggtgtcccaagaaaggtgaataatgtctctccccactcccatcccttgtctctctccgttccctacctttgaatcttgagtgaaatcattaagaaatgtcatctgtttgaacattttaaaagttagagtctgtgatattatatattactaccagtagcatcatgtgttaatcattaaaaattaattaaaaccatggcaagtataaacttgttttttaaatggttttgagaaaatgtatacagtttcaaaaagtaacgttcaactaaggattgctaatgcttaaaataaattttcatctgatagttcatctgattgttttgattaaaaggaaatcagacaaactaaatctgttaggtcagaagagtgtatatgtagtcataacttaagtgtaagaagcctttgaaattatttccttttaaatatatatgcataattttaattcacacaaatttctttaaggaaagactctgaactctgttataagggccttgcattgttaaggttctccaccacctgtccatgttgagatccatgcagcaacatcagcatcacctggaagtttgttagttttgcagaatttcaggcttcaccctagacctgctgaatcagaatctgcgtttcacctagatcccctgtgatccagcctgaaaatcattgctctgtagttcagtaatactcaaattttagtatgcacagaatcacctggcaggtgattatctgttattaaaacacaggtttctggacctcacgcccagagtttctgattctggaggtctgagatgagatcaaaatttgcatttctaacaagattccaggtgatgctgatgttgttgtctagaatactctctgagagccattttacctgatttacttaaaaagtaaagaaaattattgagaataattttactgaactataattcttgacctcttgtttaaagaatctttaaagatgtatggcataatcttcctattggtgttaaatcaaaattcttatcctcatatctctgagaacactttttttttttttgagatggagtctcactctgtcacccaggctggagtgcaatggcacaatctcggctcactgcaacctccgcctcctgggtgcaagtgggtctcctgcctcagcctcccgagtagctgggattacaggcacccaccaccacgcccggctaatttttgtatttttagtggagacagagtttcaccgtgttagccaggatggtctcgatctcctgacctcatgatcctcccgcctcggcctcctaaagtgctgggattacaggcgtgagccaccgcgcccagcctcagatcactttttaatatgaattagatactgtatctgatgacttcctctgttatttatatgtattttctagccataatgttctactcttacaactatacatgagtctttttataggtttagaataaaatgacaataatactgcatttaaaagtgaggcccttttgtaattattttaaatgtacatttctagaataatataggttgagtatcccttatccgaaatacttgggaccagaagtgttttggattttggattttaacagattttttaatatttgcagaatacctacaagttgaacatctctaatctgaaaatccaaaacactccagtaagtatttcctttgagcatcatgtcagtgatcaagaagtcttggattttggagcatttcaaattttagattttttatttcagatgctcagccttttaatttcagtgatagttacatgacatttaatcaattgattgaaggttatcatctgacagattagcttgtaaaattgaataaagacatcatattaaaaagaacaacattttgtaattggtatgattctagaaacattaccttaatagccgtcagcatattgtgcgttatattttatcagtatgaaaggtatgtttttatttcttgatagaaaggattttaagatattttgtgcacctaagaaggttaatgttctctttctccaggtgataattgatgaccagttacctgttgatcacaagggagaattgctctgttcttattccaacaacaaaagtgaattatgggtttctctcatagaaaaagcatacatgaaagtcatgggaggatatgattttccaggatccaactccgtaagtaatagataagacgatccagacacagatttaagctatctaatataactgttttaaatttgaaaaattctagatagtctttttgtttatagggaaagagagcagattatcaacccctgaaacaggatgaccagtccccgtattatggggatatatatattttcttgtgtatccgggaaagcctaaactgtgtctgcttttgttgggatacaaggccaattataaatacagtgtacatttccagagcagtctgtttagatcaaatggatgtgtcatattgtcatgtatttttttatttgtaattcaggttcaaggagttacttgttttatccagtcttaacagaacttaacctataagattgaggtgtcttccagtgaccttttgttgcatgaggtaaactagacttgagccagaaagaaattagtcagattggcatgactttaaattcttacaataaccagcctgtggccttagaaaatgtgtttaacctttcttagcctcttcatgtatccataatataaggataatatccacctcttgtcttaaagtcgtaaagatgaaaattgcatctttattccaataataaaatgaagtgacatatgcaaatcacccatcattcataagtgattagtttccctgccaaaccaggtgtccttgacttttccagttttatgcccagttctaatgctaggcaaagaatatataggtcataattaaatgcaataggatgttacagtttttcttttcccagcctatactttcaattgctctatccttcacatacttttagtttagctttctaattgttgcttgttaatttactcagtggagtttagagagagaaagaatgggaatgtatgtaaaacatgaggaacatcattgcaagaactcactaaaggacttgtgactgcatcgttgaagcagttttttctgttacatgtctttttatcatattcacctgtaaaaaatagttttttattcaggaaaagcaacaaagattgtagggaaaaatatgcatgttcaaattcagttaggaatttgagttaaataagaaatatattactagttgaaaacaactaccttctgatttatttctaccaaaatcattatgccaaatcagtgagatgtaatagctgctctggggatttaagaacttgaaaatgacactggcagtcctgaaatgtgtttctgttgcagaatattgatcttcatgcactgactggctggataccagaaagaattgctatgcattcagatagccaaactttcagtaaggataattctttcagaatgctttatcaaaggtaaacatttttctttgttttatgtgtgtggtaaatgtggccgtttaaaaacatcatgctggctgggcgtggtgggtcatgcctgtaatcccagcactatgggaggccaaggcaggcagatgacctgagtttgggagttggaggaccagcctgaccaacatggagaaaccccatctctactaaaaatacaaaattagccggatgtggtggcaggcacctgtaatcccagctactcaggaggctgaggcaggagaatcgcttgaacgcaggaggcagaggttgtggtgagccgagattgcaccattgcactccagcctgggcaacaagagcaaaactccatctcaaaaataaataaataaaaatttaaaaaataaaaacatcatgcctgatttagaatagagattgcagaagttgtcgtttttagttattaaggaaattgtttttaaaatagacttcacattatgtacttcctatagccagtcctcagttatcttcccttaatagttacagttaatccaaattgtagataatccaaaatattagaatatgtaatatagaaaaattattttagatttactaattagttaccaagttgagggaaagtgggaaaagagaagtctgagaagttaagccttaaatggataatccatatccatttaagggactggaagtttgtctaaacagtgatacacattcggttgcaaaactagaaagctcagtgatttgataaataaaatgatatgcctgtttgggaaatgcctgtggtatttcacgtctttatttttatttgtaaaccacttgaaatttagcgtttgttttccttctttggtaggtttctggtttagaattaagttgccagaaacttaaaaaaagagaaatgtgataatttattttatatactgtgcattagaaatgtacttctttttgaaaattcttcaggggtaggaacagcccattttcatgtaagccattagactaaaagataaaatggtgtgatcttagattacaaatgtgttttactttaattaattgtctttggggttcattccagatttcacaaaggagatgtcctcatcactgcgtcaactggaatgatgacagaagctgaaggagagaagtggggtctggttcccacacacgcatatgctgttttggatattagagagttcaaggttttgccttaaatctttttcttttatttttcttgttggataagacatttcagggatcccagataatttatcagacttctgaatactgacaaatcaaggtttaagtggagtttataaaccatttcacctacattaacttgatctctaccgttgaaaattatgaaattaaaaggtgggaaaggaaatcatagggatggcacagatactgatgacagaacagaaatgctgttacacctctttgtcttttccataaaaccagcagttttgaggcggaatacatagcttccaagattccaagcttcttcttcgtgtttggatcaatcacagtgttaagctctaaagcagtggtcgccaacctttttggcatcagggatccgttttgtggaagacagtttttccacagactggggggtgggtgggagcatggtttcaggataaaactgttttacctcagatcatcaggcattagattctcataaggggaacacagcttagatcttttgcatgcacagttcacaatagggttcacactcctatgagaatctaatgccaccactgatctgacagggggcagagctcaggctgtaatgctcacttgcccactgctcacctcctgctatgcggcccagttcctaacaggccatggaccagtacctgtctgtggcccgggggttggggacccctgctctaaagcatagtagacactgaataaatacttatgaaagtgggccaggcatggtggctcacatttataatcccgatactttgggaagctgatgcagaaggatctcttgaggccaggagttcgaggccaggagttcaaaaccagcctgggcaacatagtaagaccccaccgctacaaaaaataaaaaaaaattagctgggcatggtgccatatatctataattccagctactcaagaggctgaggtgggaagattgcttgagcacagaagatcaaggctgcattgagccatgatcacaccactgtgcttcagcctgagtgatagagaccctgtctgaaaaaataaaaaattgtgaaaggggaagaaaataggaagatagctgggcataagatacatgccagtgtgttttgtgtaagcaagtatttttcttcctagaagcccttgcatgctgtcaggcctttcagacagaccctgtttctgcaatatctggttagaatatttgacttcattacttctgaggttgttgttatttttaactgaaaaatggatttgttctatggattcaaaaataaaaagattattaaacaagtactatttcttaatgaaggacccttgataacagaacgaatagaagtagtgatcagtcagcaataacagagcactactgtgtgttaattagactggttttcttatgtgtggcacatggatttacagtcacgtgttgcttaatgatgagtgtacattctaagaaatgcattgttaggtgattttgttgtggcatgaacatcataaaatgtacttacacaaacctagatggtacagcctactatacacccaagctctgtggtatagcctagtgctcctagactacaaacctgtacagcatgttattgtattgaatactgtaggcagttataacaacttggtatttgtatatctgaacatagaaaaacacagtaaaaatacagtataaaagattttgttaaatggtacacctgtatagggcacttacatggttggagcttgcaggactggaagttgctttgggtgagtgagtgagtggtgagtgaatgggaaagcctaggacattgctgtacactactgtagactttatgaatgctagacatgtagactttataaaaatatttttttcttcaataatgaattgttctaagccagtcaaatcatcagtggtggttgtataccaactttagtgatatgttattaataagttctgattaacccattaccatcggagcagcccaataataaattaaccttggcttactgtaattttttactttataaactttaaattttttttaactttctggctctgtaataacaactagctgaaaacacaaacacattgtagagctgtacacaagtactttacctgagcttttttctgttaatttttttttaggctgttttcttaaaatccgaaacataaacacacacattagcctaggcccacatgggggcaggattatcaggatgtcaattggcaatagaacttttccagctccattataatcttatggaaccactatgatatatgtagttcatcgctgtcttaacatttcattatatggtgcatgactgtatatgaagttaatgaggacagtagggacctattgcaccattttaaaatttatagtcttggaactttctaaattagctggtcagtgttgaaccccccagccatgctctatagaattgcttctttaaaagtggcataaaaattgcccacttaaagcaaaaaatataaaaattatgtgaaattaagtacgccaataagtttggggttttttaaaattataatttgccacaaatgccagtcaaaacattttaagtggctgggcaccgtgggtcacccctataatcctagcactttgggaggctgaggcaggaggaatgcttgaggccacgagttcaagaccagcctgagcaacatagcaagaccccatctctacaataaataattttttaaaaaattagctgggcatggtggcacgtgcctgtagtcccagctaattgggaggctgaggtaggaggatcacttgagcccaatgttgcagtgagctgagatcacaccactgcactccagcctagttgacacagtgacaccctgcctcaaaaaatgtatatttatatataaaggttttctccagtactcttttattgggtatatattcaaggagtttcctaggtgcattatttttattttttattttttgctacttatattttgaagtgtttatttaattctgacttctttttttttttttttttttttttttgagacagtctcactgtgtcgcccaggctggagtgcagtggcgcggtctcagctcattgcaagctccgcctcccaggttcatgccattctcctgcctcagccccccaagtagctgagactacaggcgccccaccaccacgcccggccaattttttatatttttagtagagacagggtttctccacgttagccaggatggtctcgatctcctgacctcatgatccacccaccttggcctcccaaagtgctgggattacaggcgtgagcccccacgcctggccaattctgacttctgttttaaaatatttccatatttgattcaagcatttatctctaggacctcttttttgcagaaagacctaatcttagactctgacagctctgctcagtattacatcattggtgactttcttcacttaaagagattttcaatatttattaatatttgcataaaagtgctatcatttttgtttgactacctctaatctgcttgcatattccaaggtcttcattttagtctcagcgattctctctttgggtcatttttgtgtttttgaggtgatgtttcatagtctactatggagttacatctccagatcagggtgctgacttcagttcagacaggtgttatcatagaatttctgaagctgtccaaggcttttcctttgctgctacttggaaataactttagaaattggatgcttcagcaaaatcaaattttttttttttttttttttttttgttctctagcattccttctttttagagctggttctctacccatccaaacaaaatctacatccatatcttggtgtccttgaatatcactgatgctgggggtctgtctctgaaaagcttagcaacaatttgctctcctttgtgctcctcttttaggaagtgttgagagtcctgaaatgagttaaattttttgaaaagaaaggaattagagttaaatgtcggttgacttatgtgtggtgagacacatacagtgtagaagatactgatgaaagaaactgtattaatgaagcttctagggaatatagcctaagaggaatgagtcttatgtccagaaatcacatacatctacccccagccacaatttgtcaccatttaaaatagcaaaggaatgtgttgttgtggttgtttagatgtcttccaaacagtttgatttatgatatcattagaaaaagtacacaatttcctaaggtgactgcttgcagtaagacaaatattattttggatttaccacctcttttattttcccgaatcaatgtaatcaattctgtagacatgcctggtatttactaagcatttacctttacattctgttccataaatgagtggaaaatctgaaaagggatgatagtgttaccatttcaaggagttgatgattacattggggagacaagatgactacatttgtaggaaacagtataagataggatactatttgttttaaactaatgtaatacagattgctagcactatgaaggttggagaattcaaagtaattaaaagaaagaaattactaaatgctagatactttatgttaattccatttgatcttcacagccatcttctagggacacatcataatcttcattttacatatgagtaaatgaatgttcagagagggtaaatgacccacccaaagaactggaatttggtcccattttattctgaccccaaagtccatgttcctttctcttttcttcactatgtctgtctgcactgagaagaaagggtagctaaagggatcaaagagggcctttcagaaaaagggaacagcatgatcaattgcctttagaggcaaaattgaataaggattttattgcactctgaaaggaaaaactagattagagccaaaggtacatggagtataaatactggaaaataaagtggagccagagtagagtgagctttgaaaaggcagaaaatacttcatgctctaaggcagtactgtctaatagaactcctgcaatgatggaaatgttctgtatctgggctgcccaatgcattagccactatagctactagctacctgtggtcatttaacatttgaaatgtggctgctgtgactaaggaactgatttttgaattttatataattttaacttaactacatgcggtgaaagactgcactattagctctagggagtaggcagccatttacagtttttgatcgatgtatgacctggtgaaagtgttaaaaatattaatttcaagttgatttgaggggaaaagaattgataagtactcagttcatcctctaataagagaactaatatggtaaaaactgttttacaacttaatgttatctcctgtttcttttttatataggggctgcgatttatccagttgaaaaatccttggagtcatttacgttggaaaggaagatacagtgaaaatgatgtaaaaaactggactccagagttgcaaaagtatttaaactttgatccccgaacagctcagaaaatagacaacggtaaatatatctttttaattttaataccatttattcttcaaaaaaaaacatgttttaacaagacaaaacatgtgtaactgacttaaatcatttagcattaagatttttttagattaacaaagatattaattttcaggaatattttggatttcctgggatgatctctgccagtattatgatgtgatttatttgagttggaatccaggtctttttaaagaatcaacatgtattcacaggtaactttttgcacattgcagagtatgctttataatagcatccactttcctcacttaaaaacataatggtgccaggcgcagtggctcatgcctgtaatcccagcactttgggaggccgaggtgggtggatcagttgacctcaggagttctagaccaggttgggcaacatggcaaaaccttgtctctacaaaaaatacaaaagttagccaggcattgtggcgcacacttgtagtcccagctactcgggaggctgaggtcagcagatcgctcaagcctgggaggtggaggttgcagtgagccaagatcatgccactgcactccagcccggacaacagagcaagactctgtctcaaaaaaataaataaataacggaatggttaatttaggaagactagcattccatctttttgtcacgcccacagtgactatcttgttaatagttgttttctttccatgcttcctagttatgccaaaaaaatttaaaaacagtaaaacaaaaccaaaaacttggatagcttaattcactttttgaaatagtgttatattttagctctatgagaaatttaattacaaccttctttgttgactttatcttttagtacttgggatgctaagcaaggacctgtgaaagatgcctatagcctggccaacaacccccagtacaaactggaggtgcagtgtccacaggggggtgctgcagtttgggttttgcttagtagacacataacagacaaggtactgatacccttctaatgatatcccatacagaaatttttttaatatagttagaacattgtgaaagacatacgtaaacaccagcctgtttaatttacataggtgccctgagaatagtgttttctcagataaatgaatattttcctctaaggaaatttgtattttataattatacacttaaaatcttgttcaaaagtcatctctgaagaaaagtatgagggagtttgtgcttttcagtgagggtttgggggttgatcgtgtatagtttagatcttaatattaacattgaaatatgctgaagggaatttggaaatgttgaatcattagtcttgattctgtaaaggttaaccataatcttaatagcctccgaatcttaatatacattcatacattgtggtcatctattaaaatgacaatttaattcagaaaaacaatgtttcttatagcactaaatagctgaaaacaatgctcttaaaattagagattttttgtggagagatttagagcatttttttggagagatttaaaaagaaaataaatagcattttgaacccattttctaaccacattggattctttgtgattttaggatgattttgcgaataatcgagaatttatcacaatggttgtatacaagactgatgggaaaaaagtttattacccaggtatgtttagtagcccagcaaacattaaaataaacatacataagattttatttatatgattaagttgaaaaatgacacattttatgtagataatatagagaaataattatgttgatagactaatagaaaccactcaagcagatgggtattcatgctgttctgtgttttgttttgatttgttttaatttggagactccaaggggggatttccatattctcgcacatggctgtcagaattttatttctgaaacttaaatgatgtcttttactctaatcaaatgtattctgtggttttccttgaacttctggataaaatctaagctctttagcatgatatataaggctttttattcccaccttaatctacctgcccccctttatttcatgccccagcttctcacagttgacatagttgctactccagaatacaccatgcccttgttgccttctttcacatggtttcttctctcaagaatctctcctcctgccttattcctttctccctattctgcttaatgcacatagttaaggtccagcctaaataccattccttccactgggcacctgagatatttaacacattgtgttgaaaccactttgctttcacatttttaaaaaatgtgtatcacttagtgagagaaactatcttaaggctctggagaatagtgatgaacaaaacaggattctgctttcatagagtttatgttctagttggggagacagttaataagcaaaatatcaagtactgatacacgtgtaaaaaaaagggttatgtgtgagtgactggttgcttttggtgggtggtcatagaagacctctttgagcagggatgagaagagctatgaataacaaaaaggaaccagtcatgcaaagaaatcaagggaaaagcattacaggcagagggaacagcaagtacaaggaccttacagtgagaaaagatggtgtatttttgggacagagaacaggccaattgcctgggtaggtgtggtatcaaaagaggtcagaaagatttgcagaggtcagatcacatgaggttctgtacaccacaggaagggttcggagagtctttggcttgtcataatcaggaaaatgacatgtcctggctccaaatgaagatgcagctaggctgttggatttttgaatagagttctggggtaagggtagagatacagataggggagtcaggagcatatagatggagtttgaagataggactgcataaatcacctgtgaagagagttgtgggtacagagattaacacccaggatctgacccttggactctcagacaccttgaggttcagcagaggaaaaaggtaccacaaaagaatttgaacagagggcctgatgaaacagtgaggtttcacataacccaagcaaagaacatttttcaagagaaaaagaaaggacagttccatctattgatgtttgagaaatcaaatgagattaggtgagagaagaaactattgtgggaactaaatgataagaacttacgaacacaaagaaggaaacaacacatactgaggtctacttgaagtggggggagggtgggaggagggagaggaatagaaaagataactattgggtcctggcttaatacgtgggtgatgaaataatatgcacaacaaacccccatgacacgtatttacttttgtaacaaacattcacatgtacccccaaacctaaaataaaaattaaagggaagaaactattggacttagcatcgtggcagtcagtcattgttgaccttgataagaacaggcatagtggagaggtggggctagaagcccagttggattggttttaaaagagactatgatgtaaggaagcaactgttgacagttcttgcaagaaagctgtgcaaagaaatgggcagtgatgggaagatgtgatcagaagtggtttaagtcttactttgtttaatcatagggaagtatggcattcttccctattacaatgtgttgatggcaggcactgagtcttgctagtcaatatccctgcgttctggaatgggcatggcacatagtaggtccagtgacaaatatcgagttaaactagccaagctttcctttttttaaaacaatgctccatcttatgtatagtgattttgccttttcagaatactttcatgtttataattttattttaattacaacactctgcagtaaataggacaggccttgttccctgtttgacagaagagtaaactgaaacatggaaaggttaaaaaccttgttcaagatccacagatatgccaattctttactcttctcactagaccacaccacccctaatcattagagacttatgatttgtttgagataccaaaatacttagtttttctgataggtcccattataaatattcagcgttcctaaataagctaagtgagaccatcgatcttaacatatagtaattgtcatgcataaaattttattgtatcaggcttgactgatgggactatcaaataatatattaggcagcattctttgtaataacaaaatattgaaaataatctgaatatccagattttctaaataagcaattgggggtgtagataaaatgtcatatttgtatgatggaatattatacaggcagttataagaaataaacttatctgtatagaacaacatagctctttttaaaatgttgagtgaaaaatgaaagatataagacatgcactattttttttaatatatacacttataccagaaacagttatttttttcattcatttttaggagtgggtacgtttgtattcaagtctaaaaagatgctgactaaatccatcaatagaagggaataagataagtgtagtggttaaaagagacattgttttatgaaaaggctagaatgaccaaaaaaaaaaaaaagttaatttaaacctgagtggtggggaatatatatttttatatacttctttttatttttttaaatttcatctcaaaaaaaaaactaatcctgactttaagatcctctacgggagaaaaatgcaacacagaacaaatagtaggaattactgaaatgcaacacagagcaaatagcaagtactattatacttcattgaaagtattcaaaaagattatttttgtttattaggaactgtttaattttaaagttttcaactgaaattataattcactaatatcattatattttaaggagagaatcagttaaggagatgtccatccaagtaattatttttcctacatcaaccataaaattaaagaaagaaaagtctccttttctctaagcctacttgtttgtttgcagctgacccacctccatacattgatggaattcgaattaacagccctcattatttgactaagataaagctgaccacacctggcacccatacctttacattagtggtttctcaatatgaaaaacagaacacaatccattacacggttcgggtaagtaaaaccaacacacaatgacaaaacacagtaatataaagtatgtaatatgctctgctttgtaagtggtattatctggagaaaaagtttatttctgaaaatgtattgctctctttttttgtgcttatcattttaatagtaaattatactttctgtagaaaataatacatttgaaaagaaatgtctttattttgaaagagcatttttattttcatagtaatagtttagccccgtggtaatatagtatgttggactaataatacatttctttttttctttttgagacagagtcttgctctgtcacccaggctggagtgagtgcattagtgcaatctcggctcactgcagcctccacttcccgggctcaagtaattctgcctcagcctcctgggtagctgggactacaggtgctgccaccatgcccagctaatttttgtattttttgtagagatggggtatcaccatgttggccaggctggtctcaaactcctaacctcaagtgattcacccacctcagcctcccaaagtgctgggattactggtgtcagccactgcacccagccaatatatttcattttaaagcaagcaataaaaacttatttcgctgtttaatatttttattgactttaaaaagactttgaacttagtgaaagagaatcagtcacctagaaatgtactgctctcatctagctgggaaggtcattgtaattttcttctatatagatttgtttgctctagataagcggctcaatttgaatagatttttagtgatgaaagggacattgggagctgctgccacccattcctttttcagatgcagaagccacagcctggaaaaattgtgatttgtcctgaggcatacagttactagcagagaaagccaagaccagacccctagcttctcagttcccagctcattaaacctgacctgatactaggctgcctataatgacttgtgtatgccaactgatttttttagtcttccaatatattcatgtatcactttgatgttcttgtaagtgtaaaatttatcaatacagtctttttttaaatctaggtatattcagcatgcagctttactttttcaaagattccttcaccatacaccttatcaaaacgggtgagaaaattcatttggttgtaatctcagcattcttttagaatttttaaattccctttcccatttctctcattttattgtttatatttagcaaaggcttcacaggaatataagggaaacgtaaatggcctcaatttgggttggaatacaagatcttcagtgagcaacatctgtgaaaagaaaattcagagaaagaagatgaatgcaaactttggttgttagagaaggcaatgtggatgaaccttaaaagtagcatttgagactaactgcagggtgggctacatgtatagaggaagattctatggaaaattcctggtagaaagaacaacttgattagaggctaagagatggaaataggggttagtggagcaaagcagcctggctgtcagcagcaaataaagatgggagagaggggttggagacacagagtggaaaattgccttttttttttttttgagatggaaaggagttttgtctttaagtggaattggaaatgaaattttgttaatactaaaacttttgtttttattagattaatggaaagtggagtggtcagagtgctggaggatgtggaaatttccaagagactcacaaaaataaccccatctaccaattccatatagaaaagactgggccgttactgattgagctacgaggaccaaggtttgtgatgagtaactttcttaaattaatgatgttctattacaaatgaacatagtataacaaaaaagtttagaaacagacctaagcatatatggacattggatttataacaatggcattatagtggagtgaggaaaggacaatcttttcaataaatggtatggaataattgagtatccatgtgtaaaaagggtaattagaaccctgtttcacatcaaattccaggtggattacaaacctaaatgtgaaaggcaaaacaatacagcttctagatgataatgcaggaaatgttttaacctcaagagaggaaagatttcttaagacaaagagcatattaaaatgtttgtaaatatgctgcattgataagaaaaaaatctgcagtttttaaaaaataaaaacacattcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgttgtggggtgaggggaggggagagggatagcactgggagatatacctaatgctagatgacgagttagtgggtgcagcgcaccagcatggcacatgtatacatatgtaactaacctgcacaatgtgcacatgtaccctaaaacttaaagtataataaaaaaataaataaataaataaaaataaaaaaataaaaacacattataaagggggcaatccagatggccagtaaaccattgtaatagccagaaattggaaacatatattcattgacaacatttaagattataatatagtcatataatagtcctgatataacaatggaaataaattacagctacacacaacataatggataagtcttaaaaagccacatgtacagaatacataccatgtgattctacttctgtgaagtcaagaacagacaaaactgaaatactcatgtaaggatgcacactaaggtagtaaaactataaagcagagcaagagagttattactataaaagctctgtcgagggacaggagttgcaattaggaatatacagggaattctgtggtgctgagaggatttgttgatctgggtgatggttacccaggtgtttattcactttgcaaatgattaagttgtatatatgttttacttaagtgttatatttcatagttttaaaaggtttaaaaaatatagagaatacagcctgggcatggtggctaacacctgtaatcccagcactttggaaggccaagacaggaggatcgagttcaggagttcaagacccgcctgagcaacatggcaaaacctcatctctgcaaaaatttttttaaaaatttagccaggcatggtggcatgtgctttgtatagtcccagccacttgggaggctgaggtgggaggatgacttgagcccgggaggcagaggttgcagtgatcccagatgatgccactgcactccagcctggttgacagagcgagaccctgtctcatacaacaaccaaaaaaaaaaaaaaaaaacaaaaacagaatacaaataaaaacagaactaccttctaaataagattgggcttaattttgcttttcttacaaactaatccagcagcagcagttaataacccattagatacgaagatttgattaaactatttttccacaagaaagtcatttttaaaacctctaccagtttgataggtgaaataggtaaataaacctatttgctcttttgtacttaatttctagatagattgaacatgtaataatgttcattacaatattgtttattccctattcatgtttcttgcccatagagttgtcattttttttaattataagcatgaaaaaggtaagggtattaactccttcacatatttgtggatatttttctcagattgtcatttttctcccacatagaaaaacatttcattttaaaataatgaatctgtcttctggtttcattttgctgtggacaggaactctcaccacattaccaaattaattttcaccatattctgattattttatggttcaattttttgcatttaaaaaattcatatgaatatatttttatatttggtatgaaatacaatttaagagtttttttctaaattttttgttacctcatcaccatctaaatgaatctttccttactgatttggaatgccacgtttataatatgctaagtacttctgtaaattcagagtttgtttcagggctttctttcctgtcccataggcctttccatttgttacaataacaattttttttttcttttttttttgagacagagtcttgctctgtcaccaggctggagtgcagtgtgtgatctcggctcactgcaacctccgcctcctgggttcaagcgattctcctgcctcagcctcccaagtagctgaggctacaggtgcacaccaccatgcgcagctaatttttgtatttttggtagagacgggatttcaacatgttggccaggatgctcttgatctcttgaccttgtgatccacccacctctgcctcccaaagtgctgggattacaggcgtgagccaccgcgcctggccaatgacaatatttttaattataccctgtggccaggcgtggtggctcaaggctgtaatcccagcactttgggaggccaatgtaggaggatagcttgagcccagaagttccagaccagcctgggcagcatagtgagaccccctgtccataaaaaaaaatttaagaaattagacagatatggtggtacatacccatagtcccaggtcctgaggaggctaaggtgggagaatcccgagtccaggagggcaaggctgcagtgagccatgattgctccactgtactccagcctgggtgacagtgagaccctgtctcaaaaataaaaaagaggtcgggcgcagtggctcacacctgtaatcccagcactttggaaggccgaggctggcagatcacctgaggtcaagagttcgagaccagcctctccaacatgatgaaaccccgtcactactaaaaatacaaaaaaatttagccaggcacagtggcatacccctgtagtcccaactattcagaaggctgaggcaggataatcacttgaacccaggaggcggaggttgcagtgagccaagatcgtgcctctgcactctaacctgggcagcagagtgagactctgtctcaaaaaaaataaaatatttcccggggagcccatggtaaaaatacagtctctcttaaagtaagtttaatctggtgttaatctttaaggcttcaactgaaaaatataaatggtgtgttatgatcaaaaatagagtgtgtatgtttctactgaaacttcagaaacataaacttagtatgacatctgcacttcagataaagttattttaaatcacgtttgagaatatatattaatacagtaattctgttcattttaaatgctaggcaatatagcgttggatttgaggttgtaacagtttctactctaggagatcctggtccccatggctttctgaggaaatctagtggtgactataggtaatgttggcatttttattgtatctattttatactttactttttgtggcatcatcttctataaaccttattctcattttctctaaatataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatctctaaaaacgtgttacagtggaatctggtgcttgtcagggtgtttggtaagaactgtatatagtcagaattacctaaatcacctagaggtaccgtttacatggttttgtgtatatagagttggcttgcattttaggggccattttgtataaaaagtgcatatgattaaaattagactcagtcatcactgtgagatgcctttgctaagaggataaaggaactgagaccagatgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaagtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttacggatattgcatagtttaagttagatttattgaaagatttcatctgtcgtgtttcatgtaaatgagaacagattatttgcatgaaaatatatacttcaacaaaaatctgttctttaacagagtagtggtagattattacactaatgagatttcactttggtaaatacttcatgctttcagttttagcctattaattttaggtggacaaatttaacaagttttctgttactttttaaaaagaaaaaatccagaacataagaactatattatgaacacatgatttgaacctgttgtggtaaagatcttgtacaggatgcaaactaaaaacctaatccctgccatcaaatttattagaagagacctatatatgaacaacttaaaggcactgatttctataatagagctctaaaaacatgccaccagtgtatgaataagggaaagattaattttggctggaccaatataaaaaattgtatttgaagaattgatactttaacttggaccttgaaggtaaagcttcaaaagacaggttactgaccattgagtgtttactatgtacccaatgtgtatatttttctttttaatcttcccaatagctgaataaagtatagatactatt

SEQ ID NO: 537 - DNA, 51154 bp, Homo sapiens
cccgcagcgggccttgcaccccaaattcctgagcctcattgggggggtcctccccccacgggccgggcatgctgccccccggaaggaacccctctcctcgctgtgagtagccgccaaggggcacgggtcgggggcgggggccggaggcggaaccgcggggggtgggtggggggcattcgctaattgggggacagtggtcttaggcctcctccgggatggggggggatggcagaggacagggggcggggcctaatgggaggcagaagccggtgggggaggcgactgggtgggggttctccgggcagggcgagttctgtgctgtggggggggtggttgtcgccgctgcctggggacaggttgtggggggtgcgtccggcggtcgctgcgtatccagctgtggggctgaggaagtaggcttagggtggggggctctccgggcgtaggtccgggcccccctttctggggcgggagtccaggttcttcctctccccatggcccctcccaccctccacaccgctgctgcttggggtggggggggcacgccagtgatggggaggggggagaggcgggcacggggtttccttggtgaccgcgcctggcaagagcggttgccgtggcaaccggggagaaccggggagtttgggaagtgaaaatgggaaagacggagggggtgattggggagtgagacaaccccctccccagtcttcagcccttctccctctggggtcaccccgcctctcctggtgggcggctcggacccctgcccctccgtctctccaagacccccgttccctgaccccactaggctttggggccttctatccttgggcacgtgtctctccaggaccactgcctctcccacctccctccgccctcccctcctggaaacctctcctcctggagacccccgccccccatttgctgcctcctccccaggcttccgaccctcacacctgctcttctaggaccttctaagacacggcatctgctcctcagccttctctaacccccatctctgacaatcccccagatatccctctccagaccttctgtccaggagaccctcacttcagccgccctctcctctagctccctcctcccactccctccccgcccctctttgggccttgcaccccagcctctcccctttctccccaacacccccagtcgccttctccttagcccatcactctctgaaacatccttctatgacctttcatcacccagagaccccctccatcgttgtctcctcaccccatagtactccccagtctcagacccccccaatcctagctctctccttttgggagcctctccttccaactcaccatcaatcccgggctctcagggttccccccatctctatgcccctgcctccctggggtcctgtcctgccaggggcccagccagtctctctccaggactcgagtctccagagcccaggatggcctcttgcccacccctccaccccttcgcctcctctctgcacccccatctccttccccagacctcctcacctctgctctcctcctaggcgccctcccctcctccctgccccctccccgcagcctctggtgactttctgtcggggtggggaattcccctggggagagcccagctgggaagggggagggggaagggagcctcggggctgcccctcggccccctccccgcccccctctccagctgggagctgcagtggcgcctccgcagcgccccattgctatgcgcctcacatcccaagtcccggccgcgcagccgccagacaggaactcgggctccaggcagctgggagtagccggagccggcttccctcctggtccaggagcctgaaaactcccgccccccacccccggaccgcggccaggaccgcacctccctcttcctgtagcatcttccgcagccttcgccttctaacctgcctttccgcagcctccacttcgccttcccaccttcctcctcctcctcctccctggggctcctctcctcctggccaccggattgtccaaacgcacacagagaaatgagggacagagagtgaagccgccgaaaggcggggagagagacccaaggaagggaagagtgggagccagggagggaggcacagagggagagaagggacccagcctccgaaacacacatacaggcaattagggcatcagcacggagtcacggagttactcacttaatttccgaaagaaagagtcggggagccggggacacacgccactcccacccagagagcagacacgcgggtgaggcagagacgcagggagccacagactcagggagggtgggacagacccgcggggtgcctgctggggccagcagggagccgggggacactggccaccagagttctgggggattagaggccgcttctgacttgtcagagggaccccaagtcagcaagtcagcgacagagagtgggagcgtgcgaggaagacacggggcacgtggaggcaaagattcccctggcaggtacacacacacacacacacacacacacacacacacacgagagcacacagtcattcactggcagccagagaccccgatatggaaccagagaggcccagttgcagacgcagcccccacactcagtcagccagtggtcaggagagacagggagcagtccccagacctgtagtcgtgtgtcacacagagacacacacagtccttcgtacacagacctggagggagagacaaaggcaggaggcccttgccttgtggtcctgtggcctcgtggcctcacgcctacggacagacacaaggcaaaaggcacggaggtggccccagagctacagagatgcagccccaggtgccgctaagacagtcacagagctgtgcactgtggcgcacacaccaaaccgagtgccagcgtcggaggcacgtgtgtgcactgcagggagggccagccccatccagcagtcacccttaatcccactcagagacagccctgagagtgttcctctcgccacggggctcctcagggacctcctcgccgtccgagaggtcagcagaattaagacatcaggtatcagagggcgctggcatctctcacaagcagagcctgtgcacacatgtgcctgcacacacaccctcagggcccatgcagagaggccgatcttcaggcagaggtgctgtgggttggggattgggggcgggggtggccgctgaatcctcagtcccttccggaaccctggccctgctttcttgccagggtccccaccccctcaatcacctgtctcacctgctaggacacctgctgtgtagctcacactggttctctctctccatcctctctccctgcatttcatcccttctcaccccactctctctggccgggcatctgtctcgaggtgtcacctggacctcctgtctctgtcaagccgtctcgcctctccatctcccctcatcttccctgggactgaccctttgccctcccagcccccaatgtcttgctgacctggcccatccgtctagtctgtggactcattcatcagtctttccctctcccaccccatctgctgtgaaacctgcctctatttctgtctctgctcgacaccgctctctgtgcctcccttctttgtccctctgtgtcactcgccctcacctctgctgctgttcctgccagcctgtctgcctccccgcctcccctgctccttccccgtggctccctctccccacatccctgaggactcacttacctggggtcctccgggcggcccaagagggttattttcccccagtgctttcaacatgtttaatttgttgccaacattttttaaattagagattttgcataaaaatctagactgtcagcttttggaatcgtcttccccctggataactgtgggttgtgctcaggtgcaaagggccaccactccccactctcccctctaaccagcatcgggatcatcttccctgctgggctccatagacagaggagtttgcaacctctgctgtttgctcctcttcctctctgctccatctctttgtgccctgtcaccctctccactctccttcccttggtttcccttgccgggtcctctctctgcccctcctccttcatccccccatcagtttgccctaactccaagcctcactttgactgggccctgtttccacttaaatggcctccttcccttgccgagagcaggaagagtcttatccttctctgggagaagtggttcttaagactgccaggacgcagagcacacgcccattctccaggaccaggatctgctgtgaaactgccagcccctcacagtgttggaaagtcagcgttgcgtgaaggcaccatgttgcagcctgtccttctcagctggctgatggctggggtgggccacagaccccacactcttgtccccagcatgtggcatcacagcccgtaggcagggggtgggcttctctgtacaccaggctgcacatttggccccagagcaggtggagagcaggggctgccttagaggacctgggatgcggacgctgtttctggagggagggcctcacctccagataggggtgcaaaggacagggctcccctctgtgcctggcagcgctcaagcccagcagcatcccctccaccatcacccttgctgggtgaagggggcacgtctttgtgtcctctctggtggggtacgggaaacctcattaactctgagtttggagaccctttgtccccactggggagaacctcccttcccttcgagtcccagttcctgaggctgggctggctccgccagacagggggtggcaggagagtaaggagagtggcaggatgccccttgttgcctggaaacccacgcgcaactgttgtcatggcaggcagaggtggaggggctgccttggagacccacgagaggggctgatgggggctcactgcgggaggcaggcgggagcccaggggactgctgtttccccaggagggctgctgagagtgagaatggggggtgtctggtagtatctgggatcctggtgggaggttgagagacctagacagagacaggccaggcatggtggctcacgccgtctcaacactttgggaggctgaggcgggtggatcacctgaggtcgggagtttgagaccagcctggccaacatggtgaaaccccgtctctaccaaaaatacaaaatcagccaggtgtggtggtgtgagtctgtaatcccagctactcagggggccgaggcaggagaatcgcttgaacccgggaggcagaggttgcagtgagccgagatcatgcccattgtactccagcctagacgacaagagcaaaactccatcgccaaaaaaaaaaaaacaaaaaaaaaaaccctggatggagaggaggaagagagtgaggcagggcaggagggggcagcagccccagccactcccaggctcactgtgccccccagatgctgccccagcccagggagttgagcttaggccccagagttcttgttcaaacactacaacaaaggtcagaaggctgtgcagccacagctccactgcagaggccagccccagggggtaaacgcagaggagattggccctccccttgcctcaaaccctctctccagagctggagatgaccatgatcgtagctaactgattgagagcatgccacgagccaggctcagtgctcagtctcttatgtggattttttccgtgtattcctcaggcaaccctgcaaggaggcacagtcatcatccctggtttgacagatggggaaactgaggcccagagaggtgggtcccttgcccaaaatagtacacctagaaatggcagagccgggactccaaaccctggtgtgggccgccctgcaggtcgcctccctccatgagactcccagtttacagagggggaaactgaggccaagagaggagaatgcactggtccattgggccctaaaagtggaaattcaattttttttttttttttttgagacagggtctcactctgtcacccaggctagagtgcagtggcgcgatctcggctcactgcaacctctgcctcctgggttcaagcaattctcctgcctcaggctcctgagtagctgagactacaggcacgcatcactactacacctggcttatttatttatttatttatttatttgtattttatggtagagacaccgtttcactgtgttggctaggctggtctcaaattcctgacctcaagtgacccacctgcctcagcctcccaaagtgctgggattacaggtgtgagccactgcactcggccataaaattgttaataatcacaataattaggttgttaataacaatacactcatagaaggttagacttttggagttgggggagaacagggtcttgctccgttacccatgctgaagtgcaggggcacaaccacagctcactgcagccttgacctcctgggctcaagcgatcctcccgcctcagcctcccaagtagcagggattacaggcgtgcaccaccacacccagctaatttttgtattttttgtagagagggggttctcactatgttgcccaggctggtctggaattcctgagctcatgcgatcctcttgccttggcctcccaaagtgctgggattacaggcatgagccaccacggccaacaagtctagacttttgaaggcattgaagctgctataacttaggggctgtcaggttctcaatcttgtttatgcctctcaagcaccagaagggaaaggactccccatgctgattctcacagtagagaatcagccctcaccgacgtgggggttgtaggatcttgttgcgggaagggcaaagaccccaaatgtgatcccatgggccccccactccttgacagatgagtggttttgatccagccagaaatgctggatttacaatggcagagaagtggcggggttgggtggggagggggctgagtcatggaatgggaaaactgtttgttcttctgacccgtaagaataaataccgttttttgtttttttaagacggagtctcactctgtcacccaggctggagtgcagtggtgctatcttcgctcactgcaacctccacctcccaggttcaagcgattctcctgtctcaacctcttgagtagctgggattacaggcacgcaccacagcgcctggctaattttttgtatttttagtagagacgggggtttcactgtgttggccggcctggtcttgaactcctgacctcaagcgatccgcccgtctcggcctcccaaagtgctgggattacaggcgtgagccactgcacccggccgagaataaatgataacttttaatgtagctgtcacttaagtgtcaagcactgtacatggtctccaggaaccccaacaagctattaataggtgtcattatcttcacagactgcaaggcggagcctggggcgggggacacagggagaaagtggccagccagagtttcaacccagttttcctcaacaccaacactctttccacctctccatccttcctcttcacaggacggtgtgatgaggtagacgaggagaaggaggatcttctggatcctggaataagttcactgagcattttccttttatgccccaggcatttccctaaactcatcacagatatcagaccttccccacctacaggtgagcagaccgaggtcctgaggggtgaagctccctttgcaagccaacatggctagtaactgtggcagctgaggttcaaacccaggtctagttgattccaaggcccaccttgagctacacccctatacagagctccggagaggagaggagggggcttcattcttcatcccgaaatggaatataggagtgagatgggcacttagagacccttcagccccttgctgtgagacctgcatcccctgggaaacagaatgacagcctcaccctagatatggcgatgcagaatctgcagttttttgttattgttattgttattttgagacagaatctcactctgtcaccgaggctggagtacagtggtgcgatctcggctcactgcaacctccgcctcccaggttcaagtgattctcctgcctcagcctcccgagtagctggaactacaggcaggtgcctccacgcccagctaatttttgtatttttattagagacagggtttcaccatgttggtcaggctggtgtcaaaactcctgacctcaagtgatctgcccgcctcagcctcccagagtgctgggattacaggcgtgagccactgcgcccggccagaatctgcctcttaacaagattcccagacagctggacacacattcatgtctgagaagcattgctccagttcacatagttttcagctttttatgacttttagcagcacccttttgttgtaaacaaaataactatgcacaaccctgtgagagaaaacagatcggatcagcgtccttcctaggcaggacccctatgagtggagctggcgggggccacgcccctcccaacctgcaaactcgctctcacgccccactgcctgagccttggcaacaaatactgttgtaaaaaccaccaatgccaggccagggcccagttctcttctggggtgaattcagttcaggggtgttaagccgccccatcccagcacagaatcacagtccagggacctggaagttcagttttttttctttcctttttttcagacagagtctcgctctgttgcccaggttggagtgcagtggcgccatctcagctcactgcaacctctgcctcctcggttcaagtaattcccctttctcagcctccccagtagctgggattatggacgcccgccaccaggcacggctaattttgtatttttagtagaggtggaatttcagcatgttggtcaggctggtctcaaactcctgacctcaggtaatccgcccaccttggcctcccaaagtgctgggattacaggcgtgagccaccacccccggccctcttttctttttctttttctttttctttttttttggaagttcagtttttatctcaaagcctacccaaatctggctatccatgggtatggcagtgcctcagtgtgcccttctgtaaaatgggcagcagcagctctcgccatgggccccttgcggggactgaatgagctcttgcaggcagctcccgcagcgcaggcctggcacaggcaaccaaggcagcgctggtcaggtgctcaggcctcagactctccataacattccatttctccagctgtgatctccctggcttctccatgagtcccataagagccctgtgaggtagctgggcagggccaaggagcagacggagcggcacttcagggactcaggcagaagcagttccaagcaggatcagtggttagatccatgctgtccaacacagtagctgccacagccactgccatgcatgagcagcaacagtcacatcaagtcgaatgaagaattcagtccctgctccttctcgacatacgtcacgtgctccgtagcctcgtgtggctggtggccaccagtgctggacagcacggagagaacatttgcatcattgcagagagtctgtttgacagtgatgcattgatatattgaaatacagccgggtgccgtggctcacgcttataatccagcactttgggaggctgaggcaggaggattgtttgaggccgagagtttgagaccagcctgggcaacatggcaaaagcttatctctacaaaaatacaaaaaaattagccgggtgtagtggtccacgcctgtagtcggctactcaggaggctgaggtgggaggatcacctgggcctgggaggtggaggctgcagtgagctgagatcacgccactgcactccagcagaaatttgtgtgatgtgtgtgtgtgtatgtatgtatgtgtgtgtgtatgtgtgtgtgtgtgtgtgtgtgtgtgtatgtatacagttgacccctgaccaacttgggggctaggggtgccagccccctgtgcagttgaaaatctgcctgtaacttttgactcccctaaaacttaactcctaatagtgttctgttgattggacaccctaccaataacataaacagtcagttaacacattcatgttaaatgtattctatcctgaattctgacaataaagtaagctagagaaaagaaaatgttattgagaaaatgctaaggaagagaaaatacatttactagccactaagtggagtgtatcatcgtaacgggctcccctgattgtcttcacgttgagtaggctgtgagcaggaggagggggcggttgtcttgctgtctcaggagtggcagaggcaggagaaagtccacatataagtggaccacacgattcaaacccctgtccttcaagggtcaagtgtagtcctccgctggctggtaaatagctcacctcagcccttcctgggtccccaccaccccccacccagccctcccagccctcttctgaaacctgctgttaattcccatttctctgatgaggaaactgagtggccacagggtactgttcctagcggaaaattggcagcaccggggggtcggagcccaggtttctgcttttcctggcttccagccaggctccgagtcctatatgtcacttgctggtcacttgctgtgtgccaggccctacttgggcccccttgccacagccccatgcagcatcatcagagaggctgcagctggcccaaagtggcacagccagggactggacgggagccgggtgggcggtgtgtccccagctcccctgctgccctgtgggtgtgaccagagcgaggcaccgcctgtgagtggagattggggctggggggcctgtggcagggacttttgcattctcttctccccgtaactgcttcccgccccacatcctcttctggcttttggaatttgaccccagatctataagaagagcctggctcctccctctccctcacctcctacaccgcctccaggttctgccacttttacaaatttgctttatctgttcactctttcccttctctccatccccgtggctccagccgcggcctcatcctctacccccggacccctggcgcagctcctccctggcctccagccgcgccgctccagtccactcagaggggtccttcacccaccagagctgagcctgcccctctgttgtcacagcccgttgtgagaggaaggagggcccccccgcccccggcccattgccacggcctctgtaacagctcgacattccctcctcccggcttccctcctggacgttccggggcccaccctgtgcccgccctctcacttagccctcggacggctcccccacccccacacttgcctccctagagacccagggctccttgcctcgggtgccagcagaggaactgccggtagggggcgctggctcgctcgttcctgcagcaaatactgaggctcggaggggccagcgccgttggccggccttgaggatgcagccgtggacgccgcggcaaagccctcaggggctcccctcttagcaggaaggcaggcaatgaacgcaggaacaaatcaccgagcatcaggtgctgggtggccgtgacacgagctgtgaagaaaaggaagtgcaagggatacggacggtagggggagctcaaagaagacctcctggaggtgtcgtgggaacgcagagccccccctgaccccaggaagagcacccccggctggccgagggcacagcaggggcaaagtcccctcaggggaacgggtctggtgtggatgggaagagcctgggtgggaggcgcctggtgggtgggaggagcctgggggagagcggcgtggctgcacgggaaaggacagcccccctccaagcaagtcaccacctcacccccacccactgcacctcacccccaccccgactgcacccccactgcacgggccgcctgttggtcctgctgcccagtggccagtggcccgggaaattcgtgagctgagccaagcccctagtcctgcttcctcatcagcagctcctagggggcctggactgccctttccctaaggttcttctacctccagacatagaagcctgacaattctcggcgctgtggggctgcttttattttgaaagcattcaggacatggattggctcagaacgccagcgctgcctgtcccctcccccagaacccgggtctctcccataggaccggcttccagggacagaagggctcatccctccccggcttcaatccctctccaccctctgggctccaggctccacttctgccccagtccctcgcagtggggaagttcttctctagctctaacctccaggcctcttgctgcaatggtagtcaatttcctatcttccctctggccgtctgaatttagccccccaccccaccccaaaaaatgagtgcgcctgacaggaacgttccctgcctcccatttctcctcaccccgcctctcctgggtccccgagtttccgatctgccatctgcctgaatcctcccaggcacagtgcccgagatctctcagagctggggctggggaggatggcgaagccggtgaggactcagcttcacgcctcgagtgcccgggccctcccagcctctgccttcgcctggatctcagctccatctcggggcctcctgtcctcctgcccctttcatgcccctttgtatgcctgtgtctgtctccctgtgactctgccactctctgcccctcgtacttctcctctttggggtccttctgtgtctgcacctctggcttgttccttgcaccaggtgagggaggagaacaggtgtacccttgtgatgggtcctctcccggggcagctgcggtgggagaggcaaccgtggtgacctggctaagttctgggactggggttccaatgccggctgtgctgctggagggctgtgtaacctttggcaagtgccgctcacctctgaatctgtaaaatgggcacaagaaccatcccttcctcccagggccgtggggagaagccagcagcttgaggagtggatagcatggcacccacatgtaatcagtatttcccatcactactaggggtgcgtgggggcagagggcagtccatggagcctctgccagccgggcgtgaagccgtggtggggtgtcgggcgtgtgatatcctgtgcagtgcgggtgactgcaggggctgaggaagggtggctgttcagcatgcctgtggccttgcctgcaccctgccccccacacacaggcagcctccatgggaattgttgctgctgtcaggccacacttgggggtctttggggcccctggactctggcaaggctgacctaggaggggccacttcctagccgtgtgtttcgcattaggcaactaacagtacctctgtgtgtctcagctttgctagctgggaactgggtgtaatagcagtcttctctcagagggttgatgtgaactgcggtggctaatgcaagtaaagctcccagaatggtgcccagtcagtgccagatgtgtgttggacgttaccacctttggtggtgtcattattcagtgagttcacgcaagtcagatgtgtgtgcggaagagatgaggttagccagcattcctgttatccaggtcagagggctctatctggggacaactggggccaggtgccctctcagtatgcagctgtatccaggagtgtagctcacgcaggtggtatctgaggtttgggcagagtggtagctttcctctgggtgcacggagctgcgctggggacctcctgtttggaacctgaggtgtagtatctgggacttagccatccgggtggtgctggggcacggagggtgacccagggcatggagggtgacccgggacattggtgtccagctgacgtgagatgtgtgcttcctcggccaggtacggtggcccacacctgtcatcccagcactttgggaggccaaggcaggtggatcactggaggtcaggagttcaagaccagcctggcccacatggtgaaacccccgattctaacttaaaatacaaaaattagccggggtggtggtgagcgcctgtagtctcagctactcaggaggctggggcaggagaattgcttgaacccaggaggtagaggttgccatgagctgagatcgcgccactgcactccagcctgggcaacagagtgagactctgtctcaaaaaaaaaaaaaaaaaaaaggtgctgcctctgccagcaggcctcctgggatggaaggggacctggggaccgagggtgtccagggctgggagcctgcattgtgcagctattgcagtgcggcctggctcggtgtgcagaacggagagtgggggtatctgtgtgtgagcgtggggggaaatagactcacagtgatgataacgtacccatccgtccctgcacccagtgtttggtgagcaactgccatgtgcccagcactgttgtgggtcctgggaaccaaatagtcacaaactgactgccctcgggaaacttgccttcaagcgcacggacccatataaaagctcagatgctgataaatgtcatggagaaaaaggaaacagagaaggttctggagagggataggggtgctgtttgatgcggggcggtcaggacggcctcactgagaaggtagcattggagcacggacctgatagagagcagggcaagagccctgtggacaaccggcaaagagcattccaggaaaagggaagagcaggtgcaaaggccctggggccggggtgtgcacggcctgttctggaaacagcgagtgagcagggggaggagggaagcgatgaggtcagaggaggagctggggtggagagtggagacctgaaaactgaagtcctcatctctgctctgagtgggacgggagctgtggaaggctgtggagcagaggcggggcagggtccatggggtgttgacaggatacccctcgctgcccgtggggaacgcacggggagtgggggtgaaggcagaaatggggaggctggaggggaggacactgtaatcgttcaagagggagatgggagccaggtcagggaagtagcctgggcgtggggagaaagatcctctgattctggggtctgattccgcatatgttgtgaagacagaactctttaccaaggatttagcgatttaatccccacagtggccctaggaggcagatactcccattatccctgtttcacagtggagggaactgcagcttgggagaataagccaccggcccgaggttacacgggaagtggcagcagagtcaggactcaaacccaggcctctcggcactcaccaatgtgccccactctcgagaggtgccttttgtggcccatgggtgtcctgggctagtgtctagcacatagcagggactgggtagacatttgttggacagatggatggaaggatggatgggtggacggatggatggatggatggatgggtggatggatgggcggagggatggaaggacggatggatagacggatggacggatgggcggatggatggacggatggatggatggatggatggatggatggatggatggatggacggatgggcggatggatgaatggatggatggatggatggatggatggatggatggacagatggatggacggatgggtggacggatggatggacggatggatgggcggataagttgaatgaatgaacgtggctgccctgcagattttgcagaagtgtgtcaggaggtggatgtcaggatctggctaaggtccaagggagaggggttcctctaggggtgggggcctttgtggcatggagaggggctggccctcagccacgggacggggtgacggtgcagggcgcaggttccagtgccggtatatcaggtgtggtatatcagggttggagtaaaggctgtgtggcatggtgggggttcaaaggagttcctggggtacaggggcatctgcaggaaaacgctgggcaagattgtgtgcctagacccagtggggggtgtgaagctggggggttttggctggaagtgggggcgagggggtcagtggtggcccagcccggtcatgcagccaacgaggctgtctgtgtgccatgaggctccggcttggcacggcccaaccacccccctttcttgggcagcccagccggcaaccttcctcccccgcttcccccgaccttcctcggctgcctcctcggctgcccagaaccaatgggttaattagataacggagcctttgattagcgggggagggggaggcctcccccaggcggcgcagggaagggaggctgaggaggagggaggagaggcgccctccccgttcagaaggagagaaagaaggagggaggggtggggagggagggagctgaggcacagcttggctctgcactgccgtgtgactagaaattgtaatcgcggagaaagagagagacagacagagccggggagaaagggaccaagacagacggacagacagacaacctgactgagacgggctcagggccgatgagagggtgacagggatagagcaagagggaggaatagatggaggagaaggagagaaggggcctgggggtcccgagggaggcaagattgtgaggggggagactcaggagggggttgaggccagaggaggtggacggggaccagaggcggagggggaggaccgagaggggcagagagagagttaagggggctggggtcggtgggtggagagaaaggaggctgcggtcgggggagagtcgaggtagaggtgggagagggggtggaaggagaccggaggaggcgagcggggaggggagcagagaactgctgcagtggccaaaggacagccccccccaggggtgggaagggcgacaggccagtggggggggcgcggggagacccaagaagcccctgcgccccccccagcacgatctcgacaggaagccctggagaactggggaggcagagaccccggctggccggaggcatgtggaggggggggcctgggcgcagggagaggcccagcggaagccaagccaccagggtgagtgtcccccaccgtggggttgtggggagaaaaggatgggagatggcggagggcggcggggggaaggggagggaggccgagtcgctgcagaagccgtgatgggggtggggggatgcgggctggcagcgggagagctggggacagatgcggaggtagacatggcagcggcaggcctggaggccggggtgggtgccgtgggctcccacaggccctgcggggtcccccggcctcaaatccaggccctgcgctttgggccagccctttggctaagagggtgtgggctggatcatcgccagggtcttaagaggtaggagcccctgacccaggataaggactgggcattgacctccctgttcacattcaggaaaatgaagaccctcaccgcactcacatagtcagacacagacacacggccccagccctgcaggagaaaaatgagcccgggtggacacagaatcaacctctctctctttctctccccagctccctctttcccctgccctctgtctctctgcctctgcttctgtctctgtctctctgtgtctctgtctagccctcgctctcacacatgcactcagatacacagacgtatgcacacacatttttatctgggttaaaatggtcttggaaactgcaggaggagggagtgactgtgtgtgtgcatagccgtgtgcctgggggtgagcctgtgtcgggggtcctgagagtccaccgtgagaggggggtcctgagagtccaccgtgagagggtgtgccccatcactgctgagtgtgtgagtgggtcggtgtgcgtgtttgtgtgacctgccctcctcctggtctcttgggaatggtttggggttggcctgtgttggggcagggcctgctggtgtgggtgtatttgtgtgtactcagagatgctgcgtgcaaaggagagctgggagccagagggtagacccagggccgaagtaccccctctgcgccctcccggcctgctctgtgcccttggacaggccgttttccctcatagtgcctcagtgtccccatctgtaaattgggcatcctaatagctttctcctatggtcattatgaggctcacatgagatgaccgggatacagtttgctgcattgcaagggctcacccagtgttccggagagactattgttactggtatcgttgctgtgactcacccatcccctttccctctctggttccatggaaatggcggggcaggacagattggggaggtacagcgtgacttctcagagggcccgagtccccgctgtctgctttcctcccagaacccaggcagagtccctggacccccttcccttccccatcccctccccgagaaccaagctcggtcctgcggcagcagctggcatgagtcccatcggggctgtctctgcctggagcacccacagtctcggggcaaaggagggggtgcagctggtggcctctcggcctgtgccgccccccgtcaggtccccagccaccctcacacacaagctccagtctcctccctcttcaccctgctgcctcccagccctcccttcacctgcccacacctgtcacctccacggttgccttgtctgccaccttacctctctctccctcagattctcccatgagtctgactcaagtctctgaagctgctgtgaggcccccacagggcctggacagggtgggcagtgacaggagggtgtgcagcggagggtctttcggtttagctgagggcacagggggtgggggaaatgcatctcttcgctaacatccctgggatggggagagggggagggagtggaggggagaggaggctgggacccacctcccaggtgatcacgcaggtggcaaggggaccgggcgggtgttgggatgggagcgaggtcctcgccacctcgcttgctcttccccgtttctgccccctcgccttgtctgtctgtctgtctgtctcactcctctgatgtatctacctttttgaagtcatgcaaagaactgggttttgaatctggacaacttctgcacttactggatgagtgaccttgggcaggcacttcctctcccccagcctcagttttccctgctgcagaatgggcgtagaatcttgccagcatggagaggatgagctagtgcagggccaggcgggccaagcttccctctgcctgccccagcctgctgggtgggtccatcggcagctgtctccctccctgtccctttgttctgggcatggggcagggaggcggcgatggggctgcctgggtgttggcaagcacccaggccacatgggctcctgtccctcaccaagcctctcccccttctctcccccacccacagccccccagcgtccacgcggagcatgaacattgaggatggcgcgtgcccgcggctccccgtgccccccgctgccgcccggtaggatgtcctggccccacggggcattgctcttcctctggctcttctccccacccctgggggccggtggaggtggagtggccgtgacgtctgccgccggagggggctccccgccggccacctcctgccccgtggcctgctcctgcagcaaccaggccagccgggtgatctgcacacggagagacctggccgaggtcccagccagcatcccggtcaacacgcggtacctgaacctgcaagagaacggcatccaggtatgcggggccagcgggcagagggggaccttggaggggacactggggaggcatgcagatgtagcccatcccttctgggcctccccacaccggggcttccccgtctccggcacctgtggatgtggcctgcgggtctgcatcctatcagctggagccgggctcccgaggtggagtggaggccctccgggctttgagagcacagtgctccctgtctctgagccaccgtgtcggggcccaagtgcaggccacctgcccagcccccccggcacaggacaggcgggtcggcctaggccgagccctggagtccctggggtgtggagagcaaccctttcacagggacccctgtggcatctgcaccaccacaccctctcgtggccttgggaaggtgacggcatgattctgagcctcagtttcttcatctgaaaagcggggacaatgcaagcccctgcgttgaggtgttgctgtgagggctgatgggtctggtacttattggggcgttagcttgtgtgctggcacctggcgagtggtcagaggacaggaggcgtttccatggtcatttgccgggcagtgcagggtttgcgtccccatttcctggagctggtgtgagaattggagagcagagaggctgagaacgctgtggtgcttggcgccatggtggcctgtggctggtgctcaggatggggcagctgccactcaattaatgatgactctgattaggataggccgtaagcgagggcttggggggacagagctgtgctattagaaagcagggcttctcaacctctgccctattgacatttggggcctgccctatcatcctttggcgggcagggtggggggctctgtcctgtgtgctgtaggatgtttaccagcatttccggccactagatgccagtagcaccccacccccagttccaaaaatatctccaggcattgccagtgattcccaggggatcattaccccaggctgatttggtccaactcctgcctccaagcaagcctcctcctgttccagcctgtaaagctgggagagaagagggtgccgatgccagaggtcccagcccctccagatctaatcttccagatgtaacagctcccgtaagaaatgcggctgcttttctgcctggtctgtccctgggaaagggtgggaggacttggctgctcccatctgaccatcctgagagccagattcagggaagaaaagggacctctcaggggagcagtcccttcctggtggctgtggggcaagggccagcgaaggggtccagaaacgtcaggggcgtcgtcacatcaccaccccccgctcccgcagggccttgtccctctgtccacgcccacctcccacaggctcccatgtctgccagtttgctttgagtctgccctgcatctccctagttgcagtctccaccgatccatccacatctcccttgagcaggtgacattccgcactgtgcggtccccatgcacctgcccccggcttccctgcactccatccttcccccacttatacacgtgacgttcaacagacaccggcagcaccggctctgcaccaagccctgtcctgggtggtgaccgagccaggcaaagcccagccctagccccggcagctcacattctagtggggaagaaatgaggaggaaaaggagccagtggctgggacggcacgccagggaaacgcgctttgcagaaatggccagggagagcgtgggacagggaggcacccacgccactcaccagcagccccaggccgtggcaacatccccgtcgtagaacctggacccgtttctctttgtgggggggcgagggggctcagtgaacaattcagtcccacaaacgtgctgagcgccaccagcggacgtacattcatttatgataagtcatgcacaggcccgctccctccgtatatcatgcacctggtaaagcacacacccaaggtggacattgtcaaagggtgaaaagcatcaatagggatccagacgcctctatttctcatcctccccacccaggggttcttgcaccgccccctgccccacccagagacatggatggagggtgtgttcgtccagtccacgagagtggatgcttgtgagtgtttgtcagtgggcttggcctccctcagtggacacatcccagacagcaagaggcatggaccacgtcgagggtaatcagaggctctttatttttgtatttatttatttatttattttgagacagagtctcgctctgtctcccaggctggagtgcagtggcgcaacgttggctcattgtaacctccacctcccgggttcaagcgagtcttccgcctcagtctcttgagtagctgggattacaggcgcctgctgccacgctcagcaaatttttatatttttagtagagacgaggtttcaccaggttggccaggctggtctcgaactcctgacctcaggtgatccacccgcctcggcctcccaaagtgctgggattacaggcgtgagccaccacgcctggcccagaggctctttaaaaagtaataacttttagcctggcgcggtgactcatgcctgtaatcccagcactttgggagactgaggcaggtggattgcttgagcccaggagttcaagaccagcctgagccacacagcaaatccccatctccactaaaaaaccaaaaattagccaggtatggtggcatgagcctgtggtcccagctacttaagaggctgaggtgggaggcttgcttgagaccaggaggcagaggttgcagtgagctgagatttcaccactgcactccatcctgggcaacagagagaccctgtcttaaaaaaaaaaaaaaaaaaaaaagtaataactctttagttatccaaataaaaaattgaaaaaatcaccctagttccatcaccagatataaataactactgtttacattttgttctaatgccttcctggctctttcctgtctctatgtaaatggtttcatttttagagacagggtctcactctgtcattcaggctggagtgcagtgggactatcatggctccctgcagccttaacttccctggctcaagtgatcctcctgcctcagcctccagagtagctgggactactgggagacaccatcacacccagctaattcttttttttttttttttttttgagatggagtttcactcttgttacccaggctggagtgcaatggcgtgatctcggctcaccgcaacctccacctcctgggttcaagtgattctcctgcctcagccttcttgagtagctgggattacaggcatgtgccaccacgcccggctaattttgtatttttagtagagacagggtttctccatgttggtcaggctagactcgaactcccgacctcagatgatctgcccgcctcggactcccaaagtgccaggattacaggcgtgagccaccaagcctgacctttttttttttttgagatggagtcttcgctctgttgcccaggctggagtgcagtggtacgatcttggctcactgcaagctccgcctcctgggttcacaccattctcccgcctcagcctcctgagtagctgggattacaggcgccacccaccacgtccggctaattttttgtatttttagtagagacagggtttcaccgtgttagccaggatggtctcgattttttttcttttttatgaagacagggtctcactatgtttcccaggctggtcttgaactcctggacccaagcaattcacccaccttggcctcccaaagtgctgggattacaggtataaaccacctaacccagccataagtgtatttttaattacttattacagaatgaatataaattaattgagaaaaactagaaaatatacctaagtaaaaacaggaagacagaagccaaccataatcccacagccatgggtagctctccttcgctttggtgtctttgcattcggacaccctccccacccatgcacagtgtgttgcacaattgctgctgatttgtaaatggagttttagcttttttatttttttatttttatttatatttttatttattttttttttttgagacggagtctcgctctgtcgcccaggctggagtgcagtggcgtgatctcggctcactgcaagctccgcctcccgggttcacgccattctcctgcctcagcctcccaagtagctgggactacaggtgcccgccaccacacccagctaatttttttgtatttttagtagagatgaggtttcactgtgttagccaggatggtcttgatctcctgacttcgtgatctgcccgcctcggcctcccaaagtgctgggattacaggcatgagccactgcgcccggcctattttttattttttttgagatggagttttgcttttgttgcccaagctggagtgcaatggtgcaatctcagctcactgcaacctctgcctcccgcgttcaagcaattctaccgcctcagcctcccaagtagctgggattacaggcgcacaccaccacgcccagctaattttttgtatttttagtagaaacggggtttcaccatgttgggcaggctggtctcgaactcctgacctcagatgatctgcccgccttggcctcccaaagttctgggattacaggcccaagccaccacacccagccagcatcctgttatttaaccaggcccttctttttcttttttcttttctttctttttttttttttttttttttgagatggaggctcactctgtcacccaggctggagtgcagtggtacagtcttggctcactgcaacctctgcctcctgggttcaggagattctcctgccttagcctcccgagtagctgagactacaggtgcccaccacgacactcagctaatttttgtacttcctagtagagacggggtttcaccatattgacccggctggtctcgaactcctggcctcaagggatccgcccacctcggcctcccaaagtgctgagattacaggtgtgagccaccgcgcccggcctccttatttccaatttctgagttgatatgaacaacaccggggggacatccgttggctcattcttcctaatgttctggactctgcccttgggataaattcctagaagcggagtttctgggtctgagggatgatgagagaagcaccgccctgtgagttctatgtggcttcctcatttgagtgtacttctcccttacacacagagacacacacacacacacacacacacacacacaccagggcctggcactggagcattggtagcggcaggctgaattctggggattccagagcctcccgtgtgacctgccgccttggttgtcatctgtcccccgccgcgctgccacctgcatgaaggcagggactttgcaatgttccctgccggatccccagcacctagggccgagcctggcacacaggaggtgcccagcagttgtttgcctctgaatgggaggccagctcccgaactcctgcccggatccttggcagaggcctgcagccatctgtcggtgggagccgacgcgaatccctgcgacgccctcccgtgagctctggggggtggctcagagactcctgttctcgcctgcccctggcctgggtgcggtgtgggcagcaagaacctcgcggggactttgggggactctaagtccacggggtgacggtgctggcctctctctgggaagctagaacgttgccattcatctttggtgagagagttaaaatgttcttctgccacatgacagagacagtaggtggtccccatagtaagacagaggatgtgttttttaaaatatcatggccaggcgcggtggctatgcctgtaatcccagtactttggaaggctgaggcaggcagatcacctgaggttaggagttcgagaccagcctggccaacatggtgaaaccccatctctactaaaaataccaaaattagccaggcatagtggcgtatgcctgtagtcccagctacttgggaggctgaggaaggagaatagcttgaacccaggaggtggagtctgcagtgagctgagatcacaccaatgcactcccgcctgagtgacagagcgagactccgtctcaaaaaaaaaaaaaaaaaaaaaaaaatcagcaattctctgaggccctgccccggccccaccactgttttttgagattggtggggcctgcaagcctggagcctcaggaaatgccttttaaggcagaggccaggagactgcctccccgcagctcacatgccctggccccctgggagaagaccgggtgcagatcttcgcctccatctcctcgggacctggggggaaggtgcaccacctcggctgggcccagcctgtccactcctcgctcctcagtcaggtacctggtcctcaccggactggctccttcctccttccctcccttttatcctcatatccccgccttaccctctccccacagaaagtcctcctaatgtgtttactgtggattttttgcttgtgtgtgttcttgcaaaatgggtattgttgctttgcgtacacgtattcttaatttatgcagatgaagctgcgttaagatcgctgtctttgtctcactgtgttcgctcggcctgtgtttctgagagtggttcatattgctgtgtgtgtccactctgctgctgttgctgctacagaattgatgggcacccacccccgtccatctgccaagtcccccactgcttcctgatgagactggacgtcccggaggcttctagctgccccaccgcaaatcctccctcaggacccctctgggagctgcatgatcatttctgtggaatatatacccagagggaattgccgggccgtaggatattcatgtacttaatttaacaaagtaccactgaatccacccaaggcttttagcgggcggctctgggtccctcctggggccggctatgaggttgtatggcaagcaagtgtggttccagcttaaggaacaaaccaatccatcctaaggaaattattagaggggcttcaaagagttgtgtttaaggatggcccgactaccaacgtttagaagtagcctcaactcctgctgacaagggactggttacatcagcggtccccaacccttttggcaccagggactggtttcatggaagataatttttccatggactggggtgtcgaggagatggttttggcattacatttatggtgcattgctttttctttttcttttttttttttttttgagatagagtcttgcttcactctgtcaccaggctggagtgcagtggtgcaatcttggctcactgcaacctccgcctcccaggttcaagcgattctcctgcctcagcctcccgagtagctgggattacaggcacaccccactgtgagcggctaatttttcttttcttttcttttctttttttttttgagacagagcctctcattttcgcccaggctggagtgcagtagcgccatctcggctcactgcaagctccgcctcccgggttcacgccattctcctgcttcagcctcccgagtagctgggactacaggcacccaccagcacgcccggctactttttttgtatttttagtagagatagggtttcaccatgttagccaggatggtctcgatctcctgacctcatgatccgcctgctttggcctcccaaagtgctgggattacaggcgtgagccaccacgcccggccggtgcactttatttctattattattattacatcgtaatgtataataaaataattatactactcactataatgtagaatcagtgggagccctgagcttgttttcctgcaactagatggtcccatctgggggtgatgggagacagtgatggatcatcaggcattagattctcataaggagcaagtaaacgaaatccctcgcctgcacagttcacaatagggttcacgttcctatgagaatctaatgctggccgagcgtggtgcctcacgcctgtaaccccagtgctttgggaggctgaggtgggtggatcacctgaggtcacgagttcgagaccagcctggccaacacggcaaaacctgtctctactaaaaatacaaaaataacccaggcatggtggcaggtgtctgtaatcccagatactcaggaggcaggagaatcacttgaacccgagaggcggaggttgtagtgtgctgagatcgtgccactgcactccagcctaggcaacagagcaagactctgtctcaaaaaaaaatttttttgtaatttaaataaaagagaatgtaatgccgccagtgatctgataggaggcagagctcagacagtaatgctcgctcgcctgctgctcacctccttctgtgcagcctggttcctaacaggccacccaccagtaccggtctgtggcctaggggttgcggacccctgggttcaatgaatcactgtgcccattacaatggaatattatgcagctatttaaaacagagtttcaaataatagtggatgacatggggaaatgctcaaaacgtaatactgagctttcaaagaatgtgaataggatctccaattcacttttaaaacttaagcaatatattttaaaagaccgagaaacacccaggaaggtcaacagggtcttttctctttgcattagtattacagggatatttaatttcttctttatgttttctttattctctagattttcttcagtgagagcatttaataacttttttttttttttttgagatggagtctcgcactgtcccccaggctggagtgcagtggcgcgatctcggttcactgcaacttccacctctcgggttcaagcaattctcctgcctcagcctcccgagtagctgggactacaggcacctgccaccacgccctgctgatttttgtatttttggtagagacggggtttcaccatgctggccaggctggtctcgaactcctgaccttgtgatccacctgcctcggcctcccaaagtgctgggattacatgtgtgagccaccacacccagccaataacttttataatcagaacaaattaagctttaaaaatactaagtataaaatcctatgcaagctggaaagaaaaaaaaaaggctatactggaatttgctcaccttttcctaaatgaggaaaaagaaacaaaaatttcaaagcatttatctggagcagggggtcagggagcgctcatctaaccccatttattcctgtgagggcaggatgacttctcccatcttatggacgtggaaatggaggcacaggctctgagtgacttatccaaggtcgcccagcaagctgtagcccccatgggcttgccatgtgcctcagaaggtatatatgtctgtcccaccctgagagtcagtgtggagaagccaggcccagacagccaaagtggggcagctacaggatggtaattctgttgcaaaaacaaaaaacaaaacctggccgggcacggtggctcacgcctgtaatcccagcactttgggaagccaaggcaggtggatcacaaggtcaggagttcgagaccatcctggccaacatggtgaaaccctgtctctactaaaaatacaaaaattagccgggtgtggtggcgggcacctggctacttgggaggctgaggcaggagaatcgcttgaacccaggatgcagaggtggtagtgagccgagatcgtgccactgcactccagcctggcgacaaagcaagaatccgtcttgaaaaaaaaaaggcggcgtgcggtggctcgcacctgtaatcccagcacggtggctcacacctgtaatcccagcactttgggaggccaaggcaggtggatcgcttgagctcaggagtttgaaaccagcctgggcaacatagcaagaccccatctctactaaaaatacaaaaattagccaggtgtggtggcacgcacctgtagtcccagatccctgggaggctgaggtgggaagattgcatgaggccaggaggcagaggctgcagtgagctgtgattttgccactggactccagcctaggtggcagagcaagactctgtctcaaaaaaaaaaaaaaaaaaaaaaaaaaacaagacaaaacccaaactaaccaaataaaaaccccggccatagtgcattatcaaggcaaataccaagaatagcttttaaattacccactagttcgcattttccaggcggctgatccctccaggggcatgaaacatggagcttttgattggacagacttttcccagttagagccctttaaggaagaaaacggtgggagggccgggcgcggtggctcgcgcctgtaatcccaccacttcgggaggccgaggcggttggatcacctgaggtcaggaattggaaactagcctggccaacatggcgaaaccccgtctctaccaaaaatacaaaaattatctgggagtggtagtgcgtgcctgtagtactagctactcaggaggctgaggcaggagaatcacttgaacccggaggcagaggtaggttgcagtgagctgagattgtgccactgcactccagcctgggcaacagagagagactccatctcaaaaaaggcaaaaaagaaagaaagaaagaaaatggcggaagggaggatctgtagaggggaatctaggagctgacctctcttgaggtcaactgggacattccccagccgcgggcctgcgaccagcagccaggaggtcctctggataggagggagcagtgcgccctctgccgtccgttcccgggctgctgagacttcgtgtctaactgcggcctccctggctctcattccagctgagttatcctcttcattccctcagcagcgccatctcggggcccacataatccttgtcaccactccgagcctcagtttctacccttttcaaataggatttcccatactttgtcagtttcttcttaactttttctcatgatgactcacagcacacttacagaaaagaacagtcggccgggcgcggtggctcacacctgttaaagttaaattgacaaaggcgtagaattgcttggcgtcctgcaaagccacatggcccctgagcctcgggacaggctgctgggtgggagtatcagtcccacatctctgttgagcagcctgcgagtcctgagaggcacaagacccgcgttctcccctccacgaatgacgctaaggcgttgagtcacctctctgagcctgccttctcgtctagaaaatagaccaattatttctacagctcagcgagggtgggcgggagaatgtcagtcgggcccccagcattgctccaagccctttacagggtcagtgaatttcagcctcacgacagccccctgagtaggtcctattcttctcatgttacagatgaggaaactgaggcataggagagttaagacacttgcaaacggtcctggtcccatggttagtaacggagctgggactcggcccaggcaggctggctgcagaacttggttttttcaacgcgattcgtaatgcttcctaattcgtagctatccctggcgctgcaccctggtgactcagtctcagaactgccactgagtcccagtctacatccccacagcccagcctggctctggccttgtccttgctcatctggaagccccagcttcttcctagcctcccagatgtagcctgtacccacacacccctgccaccacacccagctggagtcgccacaccaactcctcctaggggacacctttctgcaagccaccctgtccccatctcagatcaggatgagtatgcctggcgctcccagctacaccaagctcaggggcaccctctactgggcaccagaagctaccccagccccttccttcccacccttccagaaacttgccctgcctttaaatagtcacagacagatgtgcttgccctgtgccaggcgctcttctccatggcttacagatatcgagacagtttaatcctcacaaggatgccgtggtctcgtcaccaccccgtggcgagtctaggagctgagctgagacccgtgcatctttctccctgcatgggctgtccctcctgtgtctgaacagccccggctaatccatctgcagcattcagtgcagccctgatttgtttattgagcacctagtgtgtgccaggcaccacccgaggcccagagagcaggacatacagagatccctgccctctcgacactgcgtgcagaaagaggtcgttcagaaagtcggcaagtctcatccgggcacagtggctcacgcctgtaatcctagcacttcgggaggctgaggcgggtgctcacttgaggtcaggagcttgagaccagcctgaccaacgtagtgaaaccccatctctactaaaaatacaaaaattagccaggtgtggtgatgtgttactgtaatcccagatactcgggagggtgaggcaggagaatcgcttgaacctgggaggcgaaggttgcagtgagctgagatcatgctattgcactccagcctgggcgacagagcgagactccatcataaaaaaaaaaaaaaggaaggtaaacaagtccagtagcagcgtgcacgagctggcggggggctgctgagctgaacatagtgaggggaggccagggaaggctgcccaggaagcggtgtaggcccatggcctgtgcctcagcttaaccccactctcccaccccacccgcaggtgccttaggcaaagtcctgctgccttgcttggtcttgcacatgcctctgatatagatctcatccccttgttgtttacacccaggttcagatgcctctctgggctcctggtggtggggaagggtgggaggcgggtagccatccagccagactttccacccaggccagggcctggtcccagaagggctcaggaggccactcccaggaggatgaatgggaggagggagacagggacgtctaggcctgagccgggtcagtgtgagaatcaggggcccacaacggcccctgcagtgctgccagtcatggcatcagggaagtccctgttggagagggaggcacaagttccttgtctcagggacaagcaagaaatatgagaagtcatcataaagacagttgatgtgacaaataacggtttttaaaatctgaatgtaaaaaaattaacacacacacacaaacaacagtaagcttgctaaacttttgtgattgactcattatattcaaaacataaaaacaggccgagtgcagtggttcacgtctgtaatcccagcactctgggaggcagaggcaggcagatcacctgaggtcaggagttggagaccagcccggccaacttggtgaaaccttgtctctactaaaatacaaaaattagcctggtgtggttgtttgcacctgcaatcccagctactcaggaggctaaggtgggagaatcacttgaacccaggaggcggaggctgcagtgagctgaaatcatgccactgcactccagcctgagcaatagagcaagatcctgtcttaaaaataaataaataaataaacaggccgggcgtggtgggtcacgcctgtaatcccagcactttgggaggccaaggcgggcagatcatgaggtcaggagatcgagaccatcctggctaacacagtgaaaccctgtctctactaaaaatacaaacaattagctgggtgtggtggcaggcgcctgtaatcccagctactcgggaggctgaggcaggagaatcacttgaacccgggaggcagaggttgcagtgagctgagatcgctgcactccagcctggtgacagagcaagactctgtctcaaataaataaataaatataaataaatacaatttataatgttaagatgaacagttcacttaattgttttcttaccacagttacatttttaataaggaatttcttcacaatttattttcttaaaaaccccaacagatctcagtgggatttttttcagctttagtaatatttacctaccacaaccaaagtggaaagtccccctacacaggccaagttgcaggataaaaggaaagtccccatcggggttagaaggcagtcattgatgggggccacgtccctttgccggattcacatctgcatcattgagatctgtcccagagcccagcataggtggaggtgggctcagcagatgggggctgaagatccagggaacttggaagtgtgggcagctatgtggctgtcagaggtggccccaggcctaggtcctctactgtaggacaaaatgtcaacatcttcgtcaggctaaagatgttagggtgagggggcaggaggatttacctgcgtcaagaaccaatccccaccttgcccatcctactctgtgtcagggccatgagggtgatgacactcacaacttcagaggtgatctggtctagggtgtttcaaatcaggccttggaggggccccaggcctgcctccccctgcaaccagggcagcctccacgatctgtgtacacctttgctggttaaatgattgttggcataattgttttgtttagtgtctctcttcttctctgaggccaggatctaggaagacagggctttgtctgtcttgtccacagctggatccccagagcccagtatgacacttgacacatagcagctctcaaaaaataacctgtcaaatgagcgaaacaatacatggtaatgtaagaatgaatgggccccacagctcaaaaagcattgtgaagcccacagacagcccaactgtttcagtttagggtgggtaggtgtggtggagactcccatgtctgtgctcaggagaaggagacgttgagtcttggttctgcaactttggagcctgtgagactggggacaagtgactttacttctctgaaccttcattttctcagctatgaaccaccagatatgaagggagcaggggtatgtgcttgataacccccatgtgacagaatttccacaaagattaaatgagatcatacctcagagcatttagcacagctctggcaataatcggcagttaacaaattatgattcccccccttttaccttattgggaagctgaccaggatgtctctttgttttagagtcagagatgagatcagctttgcattatttgggaggagaagagaagaattaactagtctttggtctttgtatcatttgggaggagaagagaagaatgaactggtctttggtctttgtattatttgggaggagaagagaagaatgaactggtctttggtatttgtattatttgggaggagaagagaagaattaactggtctttggtctgtgtattatttgggaggagaagagaagaattaactggctttggtctttaggtatgcatgttaaattttaagggtaaccactaaataatgagaaaatatataaattctaatacagtagagagaagaaatggaatcataagaaattcagtcaatacaaagaagacaggaaaggggaaagaataagctataaaaatcaggacaattaaaaagcacaaaataacattataggaagaatttcaaatatattagtaattatagtaaatgtaaatgagctaaacttccagttaaaagacaaggatttcagactgacttaaaatcgaaagacatacctaaaacatgaggacagaaatcatgaaagtaaaaatgatgacaaacacaagaaaggtgatgtagctttaatgatctcagacgtgcacacgaaggtaaaaagcagaataggttggaagcagaacaccaatgcttttccgttcccaagttctgtcatattgatgtcaacatgattttgacatgttggcattatcacccaggccaaaaagcgtgagggaaacagggaccagcacaaccagggtgttccccaataagagccttagacactctagtctgtttactcagcagaccttggccgaagtctgtcacgaatttggccttgcatagcgtgctgggaatgcagaagtcgccccaacacagtctctactcacaccaactcacagcctagacaaggagacagacgtgtgaaaccaaattatagtcactgcgatagggatctaataagagagtgtgtgtgtgtgactgatgagggaccaggggtcaaaaagggcttttccaaggaaggcaattggaattttccagagaacaaggaggaggacagtatagaaaaggggcagagcctgtgcaaaggcagagaggctggacagagtgtggcaagcagagggaaccccatgcatctctcttctccctactatggctagagtcaaggagagggcagcagggcaggttctgaagggcctctgacactttgtcgagggtgatagccatgggaggctgggagtggggatgtggcaaggtctgaactgcatttccggtcattctgacagccagtgtagaggaaagatgctgagggagaaactggaagcccagagacaggaccagtgttttgtttttttgtttttgtttttgtttttgtttttgttgagacagagtctcactgtcacccaggctggagtgcagtggtgcaatttcagctcactgcaacctccgcctcccgggttcaagcgattctcctgcctcagcctcccaagtagctgggactacaggagtgtgccaccacgccagggtaaattttggtgggtgttgttgttgttttagtagagacgaggtttcaccatgttggacaggctggtctcgaactcctgagctcaagcaatcctcccgccttggcctcccaaagtgctgggattactggcgtgagccactgtggctggccaggaccagtgttaatgatcattatcaactgaattaacaatgaaaaaatatctattactgcatgctcgccatgtcccacacattcattgtctcatcccaagcgctcactgtcttgtccaagcatcacagtaaccccatgctacctgggaggaaagtgggctcagagaggtgaggacacttgcccgaggccaccagggagttcaggctggtcagcagcaaagccaggattcaaacccagcctcaaccatcccccacgaggctgctcagcaggcattctgcagagaagaggagacagaatagactggaattctgttcaaaataaagagactccctatttaaagcagccctatgccacatgtttcaacaaaaccaggcttccctttgcagcaacacccccattccactcagttctcaactgcattattaaagtgattggcggggggaccccaccccctccctttgggagtgtcccttcatctcccttcacacccccttccctctgcagctgggtcactgcgtgctgagcgccgagcagcctcaggctgtccgcctgtggccacgctgttgtcacggtcctctgtccagaggcaccaaggagacttggaaaacactgtgggctggagccccaggtgcacgctccccgggaccggcagccctgctgagtcacttgacttcaccgagccttggtctcctgtctctgaaatgacgtgtgatgctcacctccagggctgccgggggagtcagcaggagcctggggtgccgcagaggctccgggagctgcaggcaggaggtgggcatggagggggctgaggcccagggctcaaaccctggctgtgccacttcctggtcatgtggcctcgctgagccatcttctttctctgaaaagtgagcctaggctgggcacggtggctcacgcctgtaatcccagcactttgagaggccaaggcaggtggatcacctgaggtcgggagttcgagaccagcctgaccaacatagagagaccccccccccccaggtttctactaaaaatacaaaaaattaatcgtgcatggtggcacatgcctgtagtcccagctacttgggaggctgaggcaggagaatcacttgaacctgggagacggaggttgcagtgagccaagatggcgccactgccctccagcctgggtgaaaacagcgaaactccatctcaaaaaaaaaaaacaaaaaaggagcctagcaacacgtgccctgcaaggcatcatcgcctgtgcccagcacacgcctccaggtgccaagccctgagcggagtgagtctcacctcaagccttcagagcagctcgcaaggctgacgttgtgaggtcctttcacagacaacggcccctctccacctctgcacctgcaggcctgctgtatctccattcaatcaataagcaatgggggaatgagtggagacctttgggctgggttcaagagggtgagcaggagctttcccggtggatgaaagggaagggcgtcctgagcagagggaacagcatgtgcaaaggtggagtgcccggcgagagggtccaaggactgatcctggctaacgtgtatccgagtgagggctgcgagtgaggggccatgcagaggggaatggggagaaaggcagatgcccaggcagggcttccaatacaggctgaacttcccgagggcactggggagccccggaggcgtctagaggagggcagaggcagggtcagctctggcatagcaggaccccagagatggactggaggggagagactgaagcccaggcaggaggctgcggcgggcccagggagagaggatgaggcggggctgggctgtggggatggagaggaaatgggggagtgcgctgcaaggcattaaaaggcatgaagccacctggccctgctggccgacccacgacccacgggcaaggccgcagccccgctttggacggggaggatgagctagggggggcccactgagaaaagggaccctgaagggagggaggggagggtggggcacagagtgtttgctgggaatgaagggggccccaggccatctcagtgtaacccagagagggggaaagttccagggggctcttgacagcacatggaccagcaatacctttgttctttctgtatttattattattattatcgagacgattctcactctgttgcccaggctggagcgcagtggcagtctcagctcactgcaacctcctcctcccaagttcatgcaattctgcctcaggctcctgagtagctgggattacaggcgtgcatcatcacgcccagctaatttttgtgttttcagtagagacggggtttcaccacattggccaggctagtcttgaactcctgacctcaagtgatccacccgcctcggcctcccaaagtgctgggattacaggcatgagccaccgtgtccggcctcttggtccaggctttcttttaaagtccacctcattctctgcctagcgatcagtgatgaccgggacctcctcctcctgttactattattgatgttattattattaatagaaatagcaaccgagtgcctgctttatcaatcaccagcatttcccagggaggtgataagctgcgtttggtgagaagggccccatgtgtattatgtttgggaaaactagagttgagcaaaacaaagccgctgtctcccactgggcttcacggagcttcaacacgccaggtgcactggagtctcggggagggagtgtgcaggctcctaacgcattgatatgagagagtgtttttttgctgttggtgtttagcgtcccgggaaatgagctctgagaaccggctctgagaagctccaggttgggttcttccccagatactctctctgaggaagaaatgcaagctctgggggggtcccctggcagaggggggagttttagagctctagcccagtcaggccagagacattctcaagcccctgcttctcctgccctggacaggcgatgcccacagcccccagcctcatgcccaggcacagtcgcatctccggctgggtgcagagaccccaggccggcttgggacccaaatgaccctcaggacccgcacctgcagaggcattcctgctgtactccgccattctccctgccccacaaggcctgcccgagcccatcctcaggctgtgtcctgcaggctgagcccccaccagctccctgcaaatacattcacaccctcctgcctgtgaaatagcattcacggaggtctcattcagttctgaaagctagccatgttcactctgggaagttagacaaggcagaagcctattaagaaaaaaatcggccgggcgcagtggctcacgcccgtcatcgcagcactttgggagggcaaggcgagtagatcacttgaggtcaggagttcaagaccaacctggctagcatggcgaaatgctgtctctactaaaaatacaaaaattagctgggcgtggtggtgcacacctgtaatcccagcttctcgggaggctgaggcaggagaattgcttaaacccagaaggcagaggttgcagtgagctgagatcgcaccactgcagtccagcctgggcgacagagtgaaattccatctaaaaaaaagaaagaagaaatcaagcacagacatagtgactcacacctgtaatcccggcactttgggaggctgaggcaagaggattgctcaaggccaggagtttgagaccaggctgggcaacacagcaagaccccatctctacaaaattttaaacttagcaaggcatggtggtgtgtgcctttagtcccagctacttgggaggctgaggtgggagaatcactgggacccaggaggttgaggctgcagtgagttatgatcacagcactgcacttcagccagagtgacagagggagaccctgtcagaaagaaagagagagagagagggccaggcacggtggctcacgcctgtaatcccagcactttgggaggccgaggcaggcagatcacgaggtcaggagatcgagaccatcctggctaacacggtgaaaccccgtctctactaaaaatacaaaaaattagccgggtgtggtggtgcgtgcctgtagtcccagctactccagaggctgaggcaggaaaatcatttgaacccagaaggcggagcttgcagtgagctgagatcgtgccaccgcactccagcctgggcaacagagcgagactcaaaaaaaaaaaagaaaaaaagaaaagaaagagagaaagagggagggagggagggagggaaagagacagagagaaaggagaaagaaaaggaaagatcaccctgtcaattacagatcaatgtccatacgtaggtatagccgtgggccagtactctagagggccgttcatatcatgtctttgaagcactattcatgatgtaagaaaatactcacaatgttattaaggggaaatgcaggacccaggcaagtatattgtatcatcaaaattttgtaaaaaagcaagccacaatgaatggctcatgcctgtaatcccagcactttgggacactgaggcgggtggatcatttgaggtcagaaattcgagaccacctggccaacatggtgaaaccccctctctactaaaaaaaaaaaaaaaaaaagaaaaaagaaagaaaacagccgggcgtggtggctcatgcctgtaatcccagcactttgggaggctgaggcgggcagatcacgaggtcaggagatcgagaccgtcctggctaacacagtgaaaccccatctctactaaaaatgcagaaaattagctgggagtggtggcgggtgcctgtagtcccagctactcgggaggctgaggcaggagaatggcgtgaacccaggaggcggagcttgcagtaagccgggattgtgccactgcactccagcctgggtgacagagcgagactctgtctcaaaaaaaaaaaaaatacaaaaatacaaaaattagccgggcgtagtggcgtgtgcctgtaatcccagctactcatgaggctgaggcaagagaattgcatgaacccgggagccagaggttgtagtaagccaagattgtgccactgcactccatcctgggcaacagagtgagactctatctcaaaaaaaaaaaaaaagtaaaagataatgaaaaaatatatccctgcataatatgcatagaaaaaattggaaggatgtgccaaatgattaacataaattagctctgggtagatgtattttggccaatttttattttcttctcatacattttttcctaaatgagtatatattactttttaacaatttttttaattttagaaacacggtttcaccttattgcctaggctagtctggaactcctgacctcaagtcatctgcctgcctcggcctcccaaagtgctgggattacaggcgtaagccactgcgcctatccttcgtctatccttttcactctgaggcggtggagtccttcattgcgcaagacgccctgtggttgggacccagtccctgccctccctggaggcacctggactctgggctccagggaacccagccccggggatccctgaccagactggggtggggagacgggaccaggacatcctcctgtgtaagtgaccctggaactaggtgttgaaggacagatgcagggaggtatccaggaaaaaagcaggaaaggtgcaaaggccagaggcaagagtgtgtctgctgggctcagggacttgccagaacaggaggtgggggaaacaagtagaggaggaaggagaaggtggtgccaggcggatgagctgctccagggcagagactgtgtcttatgggctctcactgtcattgtcgccttggtggcagcacagcggggcatgggagagtcttatgctgggactgacgggcagtcctgggaggattgtgaagggcccaggggagggacaggggatctgtgggtataaacagacttctattttattttatttttgagactgagtttctctcttgttacccaggctggagtacaatggcgttatctcggctcaccgcaacctcgcctcctgggttcaaacgattctgccgcctcagcctcccaaatagctgggattacaggcatgcgccctgcctaaacagacctttctagggcctggtgggagaggcagagggctgaggtgcagctggggccattggcatggagaggagaggctggaacagggagtcggaggacagggggccaggatgggggcggccctgattttctgcgggaaaggatgcagtcagacagttcttgccggggagggtggctcacgtgtgtaatcccggcactttgggaggccgagttgggcagatcacctgaggtcaggagttcaagaccagcctggccaacatgataaaaccctcgtctctactaaaaaaaaaaaaaaaaaatacaaaaattagccgggtgtggtggaggacgcctgtaatcctagctacttgggaggctgaggcaggagaatcacttgaacccgggaggtggaggttgcagtgagccaagattacgccattgcactccagcctaggcaacaagagcaaaactccctctcaaaaaaaaaaaaaaaagtacggttcttggccctaagagccgcctttcagtggacggctcagggctgtaatcccaagggcatggtacaagtttctcaacgccaacgataacgataacaatgagaatgacgacgtgctgagcacccctgaacactgggacctcatctcctctccctcaccctctgaagtgcttttcatcatcctcctcgtggtaagagtgagcccagaggtacagagagctcaagtgacaggccctacaaccaggacgggggaggcgggatttgaacagggctctgctcttcacactacacccgtgacctctgtttccgtgtctgtccacggggaacggcgatgggtgggtgtgaggtggccgagcgagacggggaggggcgcaggctccggccagccctgcccagctctgccatggagcaagccacttctttaggctcctgtttcctcctttctaaaacggggcgatcacagtccttgttcttagggctgctggatggacaaaaggtgactgtgtccacagagcgtccctgggcaccgagtaaacccgcagcatctcacagggcagccgccagcatcggggctgctggctgggctcggggactgcatgcgttgctactgagaggtgccctggacgccctgggtgtaaaacacatgttgggtttccttggatttcgaagctccaccataaagagtgtaaaatggctcaatcgcaagtttgcatctgatgacaggttcaaatgagagtattttggacctgttgagctaaataaatatattagtaaagttgatttcacctgtttggttttttctttattattatttcaatgtggcttctaggaaatttaaaattacacatgtgggctgggtgtggtggctcacacctataatcccagcactttgggaggctgagacgggaggatcgcttgaggccaggagtttgagaccagcctgggcaacatagggagaccccatctctacaaaaaattaaaataaaataaaattagccaggtgtgctggcacgtgcctgtagtcccagctactcaggaggctgaggcgagcagatcacttgagcccagacggtcaaggctgcagtgagccgagactgcgccactgcactccagcctgggtgacacagcaagactctgtcttaaaacaaaacaaccaaacaaacattacacacgtgttcacattctatttctattggacagcaccgacatacattattattattttatgattctgcctatgccacagattctaccatttcttacgctgtttgcctctcaggtatatctgggtttggttttgtttttattcctgcttactgtaaaagtaatttttcctcattgaggaaaaaatatcacacaagaataaaaattgtccataattcccaacagataaagttcactactaagaaaagcttggagtatgtccttccagtttttttttttttttagacagagtctcactctgtcacccaggctggagtgcaactgggcgatcttggctcactgcaacctccgcctcccgggttcaagagattctcctgcctcagcctcccaagtagctgggattacaggcacctgccaccatgcctgactaattttttgtatttttagtagagatggggtttcgccatgttggccaagctggtctcgaaatcctgacccaggtgatccacctgccttggcctctcagagtgctaggattacaggcatgagccaccatgcccggcctcttttttgtttttaagatggagtctcactgtgttgcccaggccagagtgcagtggcgcgatctcggctcactgcaacctccgcctccctcttgcctcagtctcccgagtaactgggattacaggcaccccccaccacccccggctaatttttgtatttttagcagagacggagttttatcatgttggccaggctggtctcaaactcccaacctcaactgatctgcccgcctcggcctacctaagtgctgggattacaggtgtgagccaccacgcccggcctctttttctcttttttcttttggtgcatatactctgatacctaattcttcagcttctttgtgatgacacaggatgcatctgaggttctcagtttcctccgttaatactgtaacaccgcattcccccagtgtccgtccccttctccctggcacacaccactatctgggctttgcagatatgatccaatggctgtgtggccttctgggcctcagtgcacccggcgtggtcatcagtagtgaggaccctgtgagctcctgcctcccgtgctctgacccagcactgcccctcccgtggaccccagctccagccctgagaggcggcagccagggtcagaggtcaagagccaggactctggaaccagagggcctggatccagtcccaactctgctgtccacttctgtgtgaccttgggcaagtcactgcacctccctgggcctaattcatcatccttcgtgtgaaactcttgaggtctgatgcgttttgacattccgatattagaaacatagtaatagatagtataggttttataatatcttagtggtcttgaaacatgggaatttctagaatgaaatgtttggatagtcacgagtgggatcaataaaagctttactttcatgtggctgggtgaggtggctcacgccggtaatcccagcactttggaaggccaaggcgggtggatcacctgaggccaggagttcgagaccagcctggccaacatggcaaaaccctgtctctactaaaaatacaaaaaattagccaagcgtgttgatgcgtgcctgtaatcccagctacttgtgaggctgaggcaggagaatcacttgaacccggcaggcagaggttgcagtgagccgagatcacgcctctgcactccaggctgggcgacagagcgagactccatctcaaaataaataaataaataaataaataaataaataataaataaaatagcttcacatgagttctgatcgggttttgccaccaagtgggatttggtgtcaaagtttggaaaaatctgattgttagggccttaagaattttggaattgcaggtatcgaataaggactggtaatagtgcccatctcacagggcagtttggaggattaaaagagttattacccacaaaatgtttagaacagtgtctggcaccaaagatgtgttcaatgtgtcttagttgctggtattactattttcattttgtatatttatttatttattttggggacgggatctccctctgtcacgcaggctggagctcagtggcacgatcacagttcactgcagccttggcctcctgggctcaggcgatcctcccatcttagccttctgagtagctgggaccacaggtgcatgccatcacacagggctaattttcgtatttgtctgtagagacaggggtcttgctttgttgaccaggattgtcttcaattcccgagctcaagtgatcctcccacctcggcctcccaaagtgctgggattactgctgtgagccaccatgcccagccttatttttttcatttttaaaactatgtatagtggccgggcacggtggttcacgcctgtaatttcccagcactttgggaggccaaggcaggcagatcacttcagattgggagttcaagaacagtctggccaacatggggaaaccccgtctctactaaaaatacaaaattggctgggcacggtggctcacgcctgtaatcccagcactttgggaggctgaggcgggtggatcacgaggtcaggagttcaagaccagcctggccaacatggtgaaaccccatctctactaaaaatacaaaaattagccaggcgtggtggcacgaccctgtaatcccagctacttgggagactgaggcaggagaatcgctagaacctggaaggcggaggttacagtgagccgagattgtgcaactgcactccagcctgggtgacagagcaagactctgtctcaaaaataaaataaaataaaataatgtatcactggcatggaataaaatatcctcattttaagtgtagtttggggagtcctaacagtcgctttccgtcatgtaaccaccacgccaatgtagcacctttcaatcaccccagaaagctctctcatgcccttccctgtctgccccagatacctcacctgcccacacacgcagagacgcacacttagaacacccagagcatggtgtggacggatccaccgcaccggctcctttgtgttcggcgtcttttgctcagtgtaaccccctagagattcatccagagggtcatcagtagccaggtccctttcatggctgagctgagagattcatccagggggtcacagcagccaggtccctttcatggctgagccgcagcatcctttacacggccacacctcgcagtgtttgtccattcacctgctgaggaacatttgggatgtctccagcttaggcagtcctgagaaaaaaatgctgtgaacacccacatagaagccgttgcgtggacatctgccttcatttctcttgaggaaatacccaggaatggaacagccgggtcggatggccactccagttttaacttttttttcaaaagttttttcctcttcaatcccaaaattcttggttttatatttctttttaaattctttttgtagagacagggtctcccaatgttgcccagactggtctcaagcttctgcgctcaggtgatcctctcaccttggcctcccaaagtgctgggattacaggcataagccactgtgcctggcccccaaaattcttttttttttttttcgagacggagtctcactctgtcacccaggctggagtgtggtgacacaatctcagttcactgcaacctctgcctcccaggttcaagtgattcttctgcctcagcctcccaagtagctgggattacaggcatgtgccaccacgcctggctaatttttgtatttttagtagagacggggtttcaccatgttggccaggctggtctcgaactcctgacctcaggtgatccacccactgcagcctcccaaagtgctggcattacaggcattagccaccatgcctggccgtccccaaaattcttgactccagttttaactttctaagtaactatctttttttctctttttttcattttcttgtttgttcatttttcttttcttttcttcttttttttttttttttttttttttttttttttttttttttttttgacagggtattacttcattgcccaggctggagtgcagtggcgtgatcagggctcactgcagccttcactttccaggctcacgcaatcctcccacctcagcctccctagtagctgggacaacaggcacatgccaccacgcctggctaatttattttattttattttatttttgtagagatggggtctatgttctgatgcccagtctgatcttgatctcctgggttcaagtgatctgcccacctcagcctcccaaagtgctgggattacaggcatgagccacccctgtgcttggtcccccaaaattcttgaatccagtttttttgtttgtttctacatggagtcttgctctgttgcccaggcaggagtgcagtggcactatctcgactcactgcagactccgcctcctgggttcaagtgattctcgtgcctcagcctcccgagtagctgggattacacgcaccaccacacctggctaatttttgtatttttagtagagacagggtttcaccatgttgtccaggctggtctcaaactcctgacctcaagtgatccacctgcctcggcctcccaaagtgctgagattacaggcgtgagccaccacacccagccttgactccagttttaactttataagaaactcatcaaaccatgttgcaatataggtcgtaccgtcacagcacagcacgggagatccagccacacggccccacctgcgcccgggaccttggtgatccccccacggtccccgtcagtatctccgtgactgatccgtgtctccctctccccaggtgatccggacggacacgttcaagcacctgcggcacctggagattctgcagctgagcaagaacctggtgcgcaagatcgaggtgggcgccttcaacgggctgcccagcctcaacacgctggagctttttgacaaccggctgaccacggtgcccacgcaggccttcgagtacctgtccaagctgcgggagctctggctgcggaacaaccccatcgagagcatcccctcctacgccttcaaccgcgtgccctcgctgcggcgcctggacctgggcgagctcaagcggctggaatacatctcggaggcggccttcgaggggctggtcaacctgcgctacctcaacctgggcatgtgcaacctcaaggacatccccaacctgacggccctggtgcgcctggaggagctggagctgtcgggcaaccggctggacctgatccgcccgggctccttccagggtctcaccagcctgcgcaagctgtggctcatgcacgcccaggtagccaccatcgagcgcaacgccttcgacgacctcaagtcgctggaggagctcaacctgtcccacaacaacctgatgtcgctgccccacgacctcttcacgcccctgcaccgcctcgagcgcgtgcacctcaaccacaacccctggcattgcaactgcgacgtgctctggctgagctggtggctcaaggagacggtgcccagcaacacgacgtgctgcgcccgctgtcatgcgcccgccggcctcaaggggcgctacattggggagctggaccagtcgcatttcacctgctatgcgcccgtcatcgtggagccgcccacggacctcaacgtcaccgagggcatggctgccgagctcaaatgccgcacgggcacctccatgacctccgtcaactggctgacgcccaacggcaccctcatgacccacggctcctaccgcgtgcgcatctccgtcctgcatgacggcacgcttaacttcaccaacgtcaccgtgcaggacacgggccagtacacgtgcatggtgacgaactcagccggcaacaccaccgcctcggccacgctcaacgtctcggccgtggaccccgtggcggccgggggcaccggcagcggcgggggcggccctgggggcagtggtggtgttggagggggcagtggcggctacacctacttcaccacggtgaccgtggagaccctggagacgcagcccggagaggaggccctgcagccgcgggggacggagaaggaaccgccagggcccacgacagacggtgtctggggtgggggccggcctggggacgcggccggccctgcctcgtcttctaccacggcacccgccccgcgctcctcgcggcccacggagaaggcgttcacggtgcccatcacggatgtgacggagaacgccctcaaggacctggacgacgtcatgaagaccaccaaaatcatcatcggctgcttcgtggccatcacgttcatggccgcggtgatgctcgtggccttctacaagctgcgcaagcagcaccagctccacaagcaccacgggcccacgcgcaccgtggagatcatcaacgtggaggacgagctgcccgccgcctcggccgtgtccgtggccgccgcggccgccgtggccagtgggggtggtgtgggcggggacagccacctggccctgcccgccctggagcgagaccacctcaaccaccaccactacgtggctgccgccttcaaggcgcactacagcagcaaccccagcggcgggggctgcgggggcaaaggcccgcctggcctcaactccatccacgaacctctgctcttcaagagcggctccaaggagaacgtgcaagagacgcagatctgaggcggcggggccgggcgggcgaggggcgtggagccccccacccaggtcccagcccgggcgcagcctgaccgggacccctccctcccacagcccagcccaccttctgggaccacgcagggaattggggagaggtggcttccagccccatctggggctcggacccccagtaaggacagggtggggctccaggagcggagtctctgggatcctcgcctcacccccgccaatccccggtgacgggaggggacgtgggacccaggagaagtggcctgagttctccgcgtttcctcctcgctctcccaccaagcgttccgggcccgccgccttccaggggagagaggagctttctccaggggtgtcctttcccctcggccccaaacaccttccttttacggttcagtttttgcagtttgacgcccgtccctccctcccactcctccgccctcaaaactgaagagatggacacgtcgccagagctcccgtcccagcgcccggctctgctcccggccggcggtccctgtcgtcggcgcgggggggagcctccacccgccccagccccacctgccccacagacacttttgatactgaagggaggtttgcgtcaacgactacctgctctgtaattactttaaaaaaaaaacatggaaaaagtaaaaaaatattttttttggtcatgaaa

SEQ ID NO: 538 - DNA, 25112 bp, Homo sapiens
acacatgaaaagagacgtaaaagaggaaggagtttcaggagggtattggccaggtcaaaggagagggtggaggaaaagagccacgaaataaccgggagacaagctttcggaggcttttgactgactggatgtgggaatgttgtggaagacttctggcctgccatttcctgagaacgggactgctgagagaggagctgggaggagcactgcaaatttcactttggacacgtgagtcagaggtatctgtgaggggactgagttgggagggcaagcagggaattggacatgtgggcctggagcacagagaagggacttgagcatgcatatttgggtgttccctccaaaacttatgttgaaacttaatccccagagtggcagcatggagaggtggggcctttaagaggtgattggatcatgaaggctctattcccactaatgaatggattcatcatgggagaactggcggctttataagagaggaagagagacctgcgctagcaccttagcacgctcagtccccctgccatgtcatgccctgaacccctcaggactctgcagagagttcctaccatcaagagggctctcaccaaatgcagcccctcaactttggacttctcagcctccagagctgtaagaaataaattccctttccttataaattacccagtttcagatattccttgtttttaatttttaatttttttttttttttgagacagagtctcactctgtcgcctaggctggagtgcagtggcgcgatctcagctcactgcaaccaccgcccccccgggttcaagcgattctcctgcctcagcctctggggtagctgggattacaggcacctgccaccacgcctggctaatttttatatttttagtagggatggggtttcaccatcttggtcaggttggtcttcaactcctgacctcatgacccacccgcctcagcctcccaaagtgctgagattacaagcgtgagccactgcacccgaccccagtttcagatattctgtcataagcaatagaaacagactaagtatctttgacatggagtggatactggaagccatgtgacttctgtgggatcatctcgaaagaaagtgtaaaatgagaagacacaagggcccaggaaagagccctagggaactccgcatttgtacagcaagtggtgggtaaagagagaaaagggagaagcctgctaggatgctgaggaggagcagccagaggagggggaaccccagagagcgtgctggcgtgggagtcaagagaagtgtgtcagaagaagggagcggttgacaatgtcagaagctgccaagaggcacaataagattgagggaacaagtgagtgtggttgtttctttatgggccagaattttaaataccaggatgaagggcacctaacaaatagcaaatacacaaactaacttttgtacctaccagacttcagactaaaatcggtacaaagaatactcgccagggtaaggagaagcccaggaaattacaagagatatctagtttctgaaatgaattacaatgatcatctgaacaaatagtgtgaaaaaatatacacctgaaaaaatgtgtgaaaatggccaacaaaacattgaaaatcagggttactggggaagacttttactgccagttattaaaatttactatcagctgtattgactggaacagctgccagaataggtaattcaacagccaggatgggaagccctgatacataagtttggtggggactgtaggtagcccctctggctaccttctttctagttgaataggttacatatctaactcccttgcaattaggttcacctactcaggtgcccttgagttagacttgaaaggcagaagacagcagaggccattttactgctgcttctgatggagatgcgaggcttccataggaaagaggggtccactggtataaagagcccgacaaccatgttctccagatgttcagtccctcttggccaccccacaccaaatgacagtccgcgagactctgcccatggagactccacctgctggtcctctaggtggagtaactgataacaaaaatctctagcttactcctaagtgtttattctgaaggcagtatgtacagcaagaccagacttttggcccagctagcggtgactactgcaatgtcaaaagagcacataaacagacttaaaaagcaaatgacaaactgggaaaattgctgtaacataggtaacaaagggctgatattctataaagagttcttgcaaatgaataagacaaagatgaatccaagtgggcaaaagatatgctgtaggcaatctgcaaaagtgatgcataaaaacaggttcaacattactagcaattagtggaataaaacttaaaacaacaatgcaaaaccatcgttctatcatattaacaaagatgacaaaaaatggtgtgacagtgcagggtgtggagaaaagttggtgtcaaagctgtgccatctttctgtgtatctttcatatcaaacaaacgccttcaacaatgagcacacctttcgacacgagttcccagactttatcctaaaaaaaaaaaaaatgacgtgcacacagatttagctacaagtaattttgcaaaagtgaaaagttgaaaacaacccaaatgtacaaaaataggggagataattatggtacatttgtataatagtatgccacttggtcattaaaaatgccatagaagtatatttttcataaacttatttctagctgctggttttacaggtggtttttgcttttttattttatcatttatattttcctgtaattattgcatattttttaataattttttaaaaccggcaattatatggtgaaaaggagagaagggcattagtaaattctgaagcaactgaaattaaattgtaattgctcattaataaataaacatcattacatactaacatttaccttaaataaactagatttcatttttctactatgggaggaaagacctaaaatacaaattgactcgaattatagaaaataaagttacaattcaggaatatctgtctttggactgtgaaatttgtacctgttatgtatgtgtgtgtgtgtgtgcctgtgtgtgtgtgcgtgtgtataaaaaatatttggaaagatatccactagtttaaaagtggttcctttcagcagggtgggatgagagggggacaggagacaaatttttatttacacaactctgtatgacttgttataacaagcacgaaaaatcgaaggtcacttaagtaaaaatggttataattatgaaaatacttagaaatatgtaaagtctctatggtatgattagaaatcataatgcaaaatctgtatactgtgcttatacctatgttcatatatttccatgtgagagaagcccgaaggggaatactctgcggtgaaagtagcttttcaagttcattcattggttcatttattccacaaatgtgtgctgagctgctaccatgggccagccaactgttgcagccaccgggatatagcaatcaaaaatcaaatgtgcctccactcagggaacttaaattctagtagtgggagacagacaatacatggtaaacccggcgagtatttcaggaagtggtgagcgtcctgggaaaagtggagcaggccaagggagactagcagtgctctgggtcaggggcaggtttaaacaggttggtcaggaaaggcctcactgaggtgacatgggaggaaagatttgaaagagctgaagggttcagtcctggaaatgcctggaaggggtgttttacaaatagacaacagccggtgcagaggccaatgcagctaacagaggaaggggagagcaggtcagacagctaggcaggccagtgggttgtccggctctgcagccattgtaaggactttggcgttttatttcaagtaaactgaggagccgctgtgcagtttggagcacagaaacgacaggatccctgtggctgctgtacggaaacccagcgactgggagggtagggagggcagggagacctaggtgttcaggtgagggatgaaggggggtgtggacatgttgaggtgttgcatcctagacacagattgaaggtagggtcaacaggatttctagtcagattgtgtagagggggtgagagagtgaagctggctcttctggttctggcctgagtaaatggagccgccattaatgcccatgggaaagacaggtgggcggagaaggtttgaaggtgggggaagaaagggtcttattttcttcttccttgcaataatatatcccaagcaatataattaagcaatatgtatttttccctttaaggaaattccaaaaattatatcgttccaaataaaaaaatcatctccagagtcctgacgcagcaaccattacattcccagtaatggaaatgttaagtcagtccgtgctctggagaaatcccacgacagaacacaggccaggagaccgggcctagattccggttttcgaaccgtgggggcaaacacggaggctgcaaatccatccccagtccggcaagattctcgaacatgtcgggagagggctgcataggaacttcaaaaacgagtagcggctcccctggattcagcgtgagggggaaaccgcggggcaggttcgaaactcaggagtccgacgtctgaaggagcgggaggctgcttccgaggagcccggggcacgacgggaagggccgcgccggccaggcagccctcctcccggcagcctcgggcaggccgttcacgcgccggcgacggcgggcccggccgcaggtaccaacagcacctgtcagagggcagcgcgggcgcaccctgcaagggccctgcctcgtcaagagaggcagcgagaaacagcagcgatgaacgaaacaaaaccttcctccaccacggctacacagagctcgcgtccgaggaagcgggaacacacaggccccggtgctttccgaaaggcttctcgccaggacccgcgaccagcgtggggcggagggggggggtcaccctttttgagaaaccaggtcaagcaggccgtcgctgggcgacctttgggcggagggagagggcagggctgcaccgcacaggttccgcccctacttcagcgtcctcgcccctcccaagctccgcccagcaccccaagggccaacccccccgcgacgcatgcgtgcttcttcccgcgcggctccacctgccgcgcgcttccgctgctggccagtctcttctgcccctccccctcctgtacggccgctactctgcgcccggcttccttctcacaacctggttctgcccacacctgttcttcagccctgtgaacagtggctgtagaacagtctcaggccctgcagacccacctccctcgctcccgtggtggcggtggtgacgggctggggacgttgggtagaaaaatgggcgggatgtggaacgctgcgttgccggggcccacttccggaggacgggcggaagtggctgcggtggatggtgggaggggggaaggagtgcgaggggagggccgggccgctgggggtcgagggggtggggcctgggccagcgctggggatcgggcctggggcctggattgcgacccgcggcgggccgcggctcctagccgagacggggcgggcgggaaccaggtaacgacccggcgcagttagagcgagggtcgtccgcagggcggacgggtgggggtcagagtccaggaagggtcgcagtgtcaccctcttctcttgtgaacacggggcacggggttccggggagaagggtgggaggagttaaattcttggagggggtggaggtcatgtggacgccacgcccctacaggaaggaaaggagagagagagtgtgtgtggatggatgtgtgttgagagagagaatggatgtgtgtgtgtttacgaataaacttggaggggagggggcaacaggggtgggttttcgggctgagaaatgggaacactgtggggctgctgcaagcaggacttgggccttaaacattccaggagagtgttctcgggagtagccccgggaaggactttaacagaggttgggaattacatctctggcacagttttgcaagcagagggggagcttagttaaaggagcaaagaatgcaagtggaagatgccagcatctcggtctggaaaggatttattaactagttgaagagggctggtggattaaaacactcagcaccctaagaagcttgggagattcgattattatgttgcgctttagacaggagggcaggagaaagggcgttcttttctcgatttcttagaagagtctccggttacttttctgtggtgagaacgggtacgatccatcttttatcctgaatcatgtatgtttgtacatacatataatatgtttatattatatgtgtttatatatgtaaacactattgatgaggtgactgtgttctggcgtgtgatacgtgagttaagtaggtgctttgtataaccttgcggagtgtttaacgaaggtgttttgatgatagagcctagtatggactcttaggtggggagtggaaactagaaggttttaggactctatttgggtatctagattagagagcgttataatgtttaaatgttctgcaggttaacacagaaatctgcctcctgggccatgccgcttctaaggcctgtttcttctcatgagccccagcacaagacagatgggccagttctcacagtggataacttcccctgcctgagcaagagatgggatagtatctgggatctgtccatcaccagactctgagcttaataaggcagctgaatgaagggaggtaacggacccctgagaggggcactgaagtctgcagtggggggggaggggcctggacacaccccttcccccccagactcctccccgtcagggtcagctcagccatggactttggacctggataagaagagagaagctgcactttggtggatctgatttgggattctcagttttgaaaatggagtgctgaatggggatttgatgatctcctggagagcaactgagacaagagaagaaaggtaaggctcctgtctcatttcccacttaatgtcttgctgtgcctgtgcagaaggtgttgagctggcgagttcgcggaggctactattcaggaaatcttatccagatgagtacactggaagctacacctctccattactctgtccaggtatagacttgttcccaacttccccttacccaagctggatgagtgccttgtaagggattgtgagcaatggcagttgtgaggttaggccaaggagaacatgataataattgaagacttctgaagggaggttggattagattacctttaaaggcccttccaacactgagataataggattccaagtcagtctgggttaagactggaatggattacctaggcagaggcagctgctctgttttggggagctaactgaaaaggactgctggtggggggagaaggcgggaatggtctagataacctcctaagttgtctcccttcctacttctataaggggagcttagcccatgaaagctcgggaaaagagcagaggaacagaacacaggtttgggggtcaggaaggagtacttgtgttctagctttgactttttgagtcagtgtacaaccctacacaggccatgttctcttcacctacaaaatgggggaaaactgactttccaggtcccttacaagttgttacgaggagcaaatgaaacaaggattttgaaaagtatccagggccgtgtacacaggaaacaataacatcgatgttgctctacgtgccttaaaagcacagaaacaactctgagtcaggagttctgttttcttcttgaaatagtgtgctggcaacagcctaagaagatgtccttagtgaaaagcctgcccctgaatgtgtttcatcatcttgttggtaaacagtacttgggatcatcaagttgtagaacaggtgaatagatccaaggagaacttggattgaaggagtcttgcagatactgcattggcccttatggctctccagtccaatttcagtgtgcccctttgaggtagctgattaaagagggggtggaaggatgcttaagccttgagggcaggtgtctggctaggcacttttcttggagtgagtggtggtctttaccttcctgtgccatatgctagttatctctcccgctccttaagatgacgtttttttccagacatctcttcgccctttgtattttctcaggctgtattccctataaaagcagccctgtttgtctttatcttctcacttcctgtctgctccctccttcaattccaatttacctgtgccaagatgcctgcttttcccagggacaacacacagcagaaaggaggggtagagcacagtgttgggaattttgagagacagtagggtatggtggcctgggcaaagggcaggaggcctggcttctggcatgtctctgcctctccctagctcagtaacacctaggcctcacatgttccttgaggatgggtgacagtgaggtcatctgcaaactgaaaatcctgtacttatgccttactttccatgttaaatttttttcttccatccccttccccagtctttccttttttgccacaggagttttcctcactccctccagcggcttgagaggtgggcagtggcctgggtggagctgctgctcccgagctgtactttctcctctggtctggtgcctggggcagcccctttgaggccaggctgctcctttataaggtgtgggtctcaagatgggtgtaccaccttccccagcttcacccagcaaatttctgttgccagtctttgcttagacacaggggtcacagtgatccctcggggatacgtgatgccacggtgcctcctcagccatctctggtatcccaggtaccagggagttgcgtatttgcgtaatgcttctatcacgtgatccagtcaatctgttttgtctgttttccctcaccactttgttgtgaggagaacagagcagggattcttttcccagtttgaggggaagctacggaagccctgagtgggaagggtttgcctaagggtagagcggtaggcactgaaatcacctcccagtgctgtgctgtttccacagcatctgacctgaccaggccatctgggttctgctgcaaacctccagggagagaagctctgtgccctgccagacagcctctctggtagaacgtttcctccttagagtgagcaagcattcctctccctgaccttcccaccctcctgccctgcacctgacccttccatgagacagtcccttcaagacaaccattggctttttcacatgggcaccaggatgccaaggcatagcactcagcaggtgtcaggctacttagccaggagcagtgatagacttaaccagactgtgtgtgcattttttttttgagacagagtcttgctctgtcgccaggctggagtgcagtggtgcgatctcggctcactgaaacctccacctcctgggttcaagctattcccctgcctcagcctcccaagtagctgggactacaggcacacgccaccacgcccggctaattttttgtattttagtagagatgaggtttcaccatgttggccaggatggtctcaatctcctgaccttgtgatctgtctgccttagcttcccaaagtgctgggattataggcatgagccacggtgcccggccgtgtgtgtattttaactcaattaattatttatatccttctttattccaaaaagaattgtaggtggctaaccaaaagttacatttcacagacattgtttagtgattattatgttaatctttcctctttgacctggatgagatgaatttctgggtctccattgtggggtgagggagaggggcaagcagagatattaggaggcagggagaagggaaacaaaacactgatttaaaaaatttgcttttactttttttttttgagatggaatctcactctgtcacccaggctggagtgcagtggcatggtctctgctcactgcaacctccgcttcccaggttcaagcaattctcctgcctcagcctcccgagtagctgggactacaggtgcatgccaccacacttggctaatttttgtatttttagtagagacgatgtttcactatgttggccaggctggtctcaaactcctgacctcgtgatccgcctgcgttggtctcctaaagtgctgggattacaggcgtgagccactgcgcccagcctgcttttacttttactgatgttttcaagccaacatatgttttaatttaagggcatgaattctttccaaattgtaaaaagtgtcagggatcttgggcatggtttatgggagggcagtttcctggaacagttttcacttccttttcatcttttcagttctcttttgtcagtggtggagtgggcaggggagagtattgttcctctgcctaatcttgtgactgtttatcctcctggataatctggtctaatcttgtgactgtttatcctcctgttttttccttttgcacataatccaatcccaggcccacccccagaatcctggccccttgtttctatccttcttactccagtcactgctccccatgtaacctctatcaagagctcagagcctcttttccccaggtcagtttggcactcatttaccctggtttcttgcctctcagaccaagtgcttgcttttgcctccatgaagcccattctgattccctaaccaggccctttctttttgggatggtctcttgcagtccgggaatttctccttttggatcttcctgtgagccttgggatttcagccaagggtggtagagatggggtgtgcgttacagtgcacgaacagccgccatcctgtttccccttcacctgccttagatggagaagtatcagggtcagtggtgggaatctgatcttcccccacctttcagcaccccctgatgtctgtcctttctcctggaaggtgattttggctcctcatgtcttggatctacaaaccagtgtttcccagccttttcacttttaggaaacacaattgttttttcctttacgccttgacacctagtgtgagtgtgcagagcccccaggcccctgactcctccattaggcaaacatagggcagaggtgacagacactggcctctgactggcatatccgcctgggttcgaggctcctgccacagtgcgcgcagtcagctaaagtggaagccacgggcttcccgcacatcgcacactgcacacggcggcctcggtgggcctgcccttctcccactccacctccaggtctgggctctggccacttaagcggaggcttcacggcagcgcctgagaggagacagagccctctcaaagcactggcgctggaggatgtgtgcgggggtgttggggggcgcacaggagtgcccggtctaaaacctggctatgctccccaccaggtctggtggcttgcagcacgtttgcacttaccctgagcctcaaactagttatctgtagaatggggatgataacgctcactccgcagagctgctgaggcttgaaggacaggccgagggagggtttggcccgtgaggcccctcaccatgcctggtgaccccttagcagttttgatttaggtcctcgcctccacgcaggggcctgcgggtgcgcgcggccctttgtttctctagaaccctgcacgattcgtggtttcatgtagaaacaagttagtgagcagtcagtcagtaaccacaggccgcagagttccgggctgctccgtgctctggaacacgggggaggggttgatgtcaggggcgtgggtcctgatcacatggcagcagcccttcttggggaagtcagctacccagcagcctgtagtcctcggctacccaccctcaccgcctggggtcccatggtgagacagctgggtgggcatcaggcttctgcagagggccaggccggagggagctgggcgagggagtggggctggctcctggcttgcaccggcctcgtggaatccaggcctcagacctgatcgctggcgaaactggctctgtgcgctggagcccctggtcttctgcgtctgtcctcctcccggccagactttactcctggctcagcgacaggtatttgctatggaagagctgtccctccctcccctcggtgggcctgggtccacctccacctcctcttcaggtccgcaccttcctcccctttaaaacaccagccgggcgcagacccgttctaggcttttccatggtgcttccgccaaagcttgtgaccgagtccttcccgcctagggctggtgggcctcccctgctggtaggtctctcttcgctttctttactcagaactgaagctctcattccccacccaccaaggaaaaacaaaagggaagaagccacagctggccccggcttgctttggcacaggtgtttccccccggccccccgtcgggcaccctggttcctgttctgtccctgccccacgcgaccctggggctcccacccgggctcctcagcctcccctgggttggggtggggggactggctcccagcccttggcctagggtttggtgaacgcctttcctggactgcgggcccacttcaggcgcggctccaggctgggcagctgcgctggagggccgagggcaggggtggggtcgggcgtccaccctcagggttgcgccagggagccggaaagccgactcccgaagttggggtcctgggaaaacttgggtcctgggttgactgagaagcggcggggaaaggaggcgggccaggaggagggggcctggcggacgccggccggggggcggggcgcggcggggctgtcggtcacgcccctcagtccgccccgccccgccccgcctgccggggaagggccacgttgcccgcccggccgtccggccccggcgcgccgcagaaagggctggcgagtcgaaaggcgaggcggccgcggcagcgcttgggacgcgcctgggcaccgggctcgctccctgcgccccggagcaggccaagttcggggccaggacgtcgggaggacctggtgagtaggtgtccggggacggaggtcagaccgggggaggcctcgcgggcgccgagagggagcccaagggacgtcgggtcgccccaaagccccggtgcccatgagtgctagcgagagggggcttggctggggagcggcccggtccgacccggtgccagctgcgcgttagtcccttcccgagccgagaggttggaactccgccttctgctttcggaatcccgggcctccagctgttagaggaagggcgggctccgcggactggggaggatgttgtgaaactcggccccgggcgtccgtgcgtgcggggcagggagggggtgggattggggagtggcctttcccccctaacctcactccagcatcctttccccaagttaatagaggctgattctcctcagcagaaaggaaatgttgattcagtgttgaaatatatatataataagttggcaagaaaacttttcttcctgtttgctaacgtgtgtggagtagagagccccgggacgtgcagtgcccgcgtctgataaactctgaagtagagggactgtggctggccggctccctgaaggctgaagcttcactttggttaacccttgctgctgtagtgggtctgccgttttgttttagaacatcactggctgagatgttgcccagctttattttcagtcatttacggtattttttcaggccgtgtagcctttgctcttacgtgctcacatcatccaggatctgccttccatcagcaatcactgcgtcctggtccttcccaattctggggaccattgagctcacccatttccctgcttctgtgtctcattctcactgttagaagcactgcggtatgcctgacctcagtggcctgtgttaacaagggaaactcattactgttcggggcagtagggaaattgtcactgtcgtcagtatccaggcagtgggaccttgtgatgaaccaaatcaaccctgtcaccttatagatgagagaactaaggtacaagtgggtcaagtgacttgtccaaagttgcctggcttgctggctggatcgcctgaatcccaggcctcatgccttttgtggcacttgtatttagctcttcttttccaggatgaataacctgcatcccttccctcctaggtcttattctctcaactcttgaattatttagtgtatcttctctgactacctttcttttttttccgtcctgaaattatgggcctggtacatgatacaggagtccagccaaggtctaagaacgaacatgaaagcagttcagttagagttccattacctgtgacatgtctatattttctggaatttttacgtagtgctttttaactttaagcaaagcagagatagaagggaaaatctgttaccatttcttccacttctgtacttaattttacagctaaatataacttctcgcttattgctcatgattggaagttgactatctggtgttcacttgctatttaagaaacattttttgccagataaaggaaataggctggagaacaccatggtatcagagtgttagaaaggatctcacagctcctaggcagtccttcaaatgcttcagaaactgagtgagccccataggggcaggtggcgcctacccagagccacctcggttttagctgaagggttttgtactgaaaagactcacttctcatctcccaccatggtgcagatgtctttgtacctggtggtgtggattggctgtgtcacctccctaaaggagttgtgaaaactctagaaagtcaaagccagttttgagtctgtgccttgcatgccagtctcataaatgacatcattaggaactcaggtcaggattaagggcagttgttctatttaaaaaggaaggtgtagcagattgtattttccctcaagggcctcacccgtaagtatccccttccacatgtagttatagtttgacattgtccacttcccacctagtggtggggtttatgattctctccccttgcatgtcaatagggacttgtggttcccttgaccagtgagtaagacagacctgatccaaggctgaatcaggaacaggatacactttcacctggcttgcccgctttcttggaacactcacctttggaatgcagccaccacttccaggacatttccaggccacatagaggggttctagtgagcactcctgctgataaggtctcagctgctgccaacatcatcctacagacatgtgagagaatgtgagagcctctaggggcatctggccctcagcttttgagtctttcagcaaggcctcaggcatagtggagcagagacacgtcatctcctctgtgctgcactgtccacatttctgaccaatagaaactgtgaggagtaagtgataactattgttttaagccactaaatatcgaggtaatttattatgcaggagtagatacctactaaggaaggagacatgagtggagacagggcctcagtgtttggacttggagctgagcacagagggcagggagggcacttgccctgcttgtcaagattatctagagtctgtttctctcattgcttcaggtactgatggctgcataatgagtcaccccagaacttagtggcttacaacaacagaatcattttattaacatctcagctatgtggttcttgcttgtggtctttcacgccattgcagtcagctggggctgggataatctggagggctgtctcctgtgtctagcggttgatgctggctgtcagctgggaccttagctggggtggtcagttggaatacctatgggggtcctgtccatgtagcagtgtcctgtccatatagcagggtcctaggagtcagcatcttaagaggaccaggtggaaactactgccttttatgagttagtctcacaagtcacatagcatctcttcccagaaccaaagggagggaacatagaccctcagctctggaggcaggagtgtctttatcacttgtaagaagagcatatggaatgggatatgtgcggtcatctctggaaaatgtcacacttcactctcttgctgctgcgttggccatctttctccctgatttcggtaatagtgcaagcagtcttccatccagccacttgaacctcatacatgtgccaagcactgtggtgggcacagaggtcatagagtcttttttcctaaggaggaaggtgggagtcaggtcagcgtggccacagattctgttacagcgtggagagagtgctgtgggagtgtagtcatagggaggcctggctctgtctgtgatgttacagaaggagtcacctgaagtggcctgaaaggatgtgtgggtggctggcaggtggcgctgtgggtcaaattccaggatgagggaccagctggagcagagacacagcagcgtccaggtatatgcttactggggaaaaagcagcctgctgaggccagagtgcagggtccatggggttagtggttggaggtaaggttgaaaagggatgtttcagacagtctgtctgaagggctttggatgtcatcataatgagtttgagtttgagtttgtgggcagtgcagcctctgatggtttttaaagcaagttaatgtcgtgaccaggtgtacttgtcaggaaggatgcgctgttgctgttgggaaggtttgtgagagggaagcaagattagtgacaggtggaccagctgggaaactacatcaagagtccagacttaaaacagtgtttcctacgaaggaatgagttcaggttaaagggctggagggcttgacatgggatgctagcagtcaatgagtaactttgtacttccattttcatagttttgaagttcttggtcctagatgtatttcagaattgagaattttttggattttgaaaagatgatctggtgaatttactctgtagtggaagatcagaagcagcatggcataagccaccatgtttatttctgtagcaaaatgtatgaatagccacagcaggagagagaaaagactataaatagccccatattagatcagatcagattttaccaaatgaggctggatgaggttttactgccaattgagtttagaaaacttctgtgttttagtgcttcttggatttggcagttacagttgaggaactgtggatgtttttagatcccaggcacatctgctgaatgttgagagccctagcacagcggcttggcagtgctggtggagccaatccctgtcttcatgtagcttgcagctgagggggcctgagagaagttgagcaagtggttgcgcttgttgctgttggtgaagggtaggtggaccttacatggtcccaggcgtcaaggaaggcatcttggcagagacacgaatcagagtgtgccaggtgaagaagatagggaagagcagagctggcacatgggcacatgcaaagaccccgacggtaggcttggctgttggggtaccagacgggagtgtggtagagtggagcaaagaaaatggggagaaaggagtgaaataacggccgatatttacgttgtcatgccggcactgttctaaacacctaacatggctcatctcatccgatcttcacagcaacccagtttgagtctcagaaatgtggcaaaacgtagggtgatgcctctgggctgtctggcttgcctttgttgctgctgcactctcctgatggtggcctgagcagtgcttcctggagaagcaggtcaccgctgctggccaaggtctgggcttgatcatccttttgggcacagccagttgtgagagggtgtatggctcctggttcatgtgtgtgcacacagcactaacttccaggcagagctgaggatcctatcccaggaactacgtggataaacagtaggaaaatagcactggggcccaggctgagcctaaggaggtgggctggaactaggggtgtcatgtcctcttatggcaacaggagcaagtttgaagcacagggctgtggggtggagaacaagggcccagggattgattaaggtggaggccagggcttggccggggcagcttttcctgtgggctctgcagccactccatgtgtgtgcagacttgccaagtaaaaactcagtcagaagactggtttgctctgcatggcttagaagggtggggcaggaggtcctaagcatcaggtagtgggtgtgggccaccaaattctgatgtctggagaagagtaaaaaggcatctaaagggtgcagaagttatctcaagggtcccaggaggctttgccataagggcctgcaggtcattgatgagtcagggacgggctatccctctgggccccccccccctttttttttttttttttttttttggtgggggatggagtcttgcttcatcatccgggctggaaggcagtggtgccatctcagctcactgcaacctccgcctcccaggttcaagggattctcctgtctcagccttctgagtagctgggattacaggcacgcaccaccacacccggctaatttttgaatttttattttagtagagatggggtttcgccatgttggccaggctcctgacctcaggtgatccgcctgccttggcatcccaaagcgctgggattacaggcttgagccaccaagcccagtggggccccacccttctaagccatgcagagcagcacttcactgaatagagttcagtccctcttctccatccccatcctgttatataaagtctttttcttgcacagtcatttaggaggtgggaagttgggagacagggaatcctggccattagattggagggaaagttccaacatggacaacatcctgaggggagagcgaagaagaaactgaaactcttctgggcccagtggctcacacctgtaatcccagcactttgggaggctgaggagggtggatcacttgaggtcaggagttcaacaccagcctggccaacatggtgaaagcccgtctctattaaaaatacaaaaattagctgggcgtggtggcaggcacctgtaatcccagatactcgggaggctgaggcaagagagtcgcttgagcctgggaggcagaggttgcagtgagctgagatcatgccactgtactccagcctgggcaacagacagagtgagactctgtctcaaaaaaaaagaaaaaaaactgaaactcttttgtgcatcactcttttcttccacataaactttcttaaaaatcaaatatggggatatggcccacagctctgagtagcttcatccatctgtatggccccagctgggcacagcagtaaggccaactgaaacgacgtttgccctgaatttctcggtcacttgacaacatgtatctaattgatacataatatttgagccctgatataatagaatttaattgcacagttacatggaaacagacttgacgtttctgagaagactgatgtcctggcgtggtgggggtggttggtttctaggaagaagacaagtggttggtggtgaatgctggcaggggctggtgaagtctccccaggagggagacagaatccatgtctctttagaggcccttcaggatcagcccttttataccagatctgctggtttgagagcccagagcctcagaggttagatctgaggcccaaggttttggccaggattagagagtagcctgtgaggcagagggcaactggcagagctgttggtgtaagagggtgcacgcctgaagctttggggtgtaaagggtagaccagaggcaggacagtcaaggagttatggtctggagtggcagctggctgggaattggggagtgtttcagatcctttcaagtaatgtggtctggtagagcttggaggattggtgggaccatgcctttttctcactggtttgtgtcctggttccttcccagagcctggcagagagcaggtgtgtgatacacgtcgtcaggtgactgaccgaggaattcagggcaaacagatcatctcaatttgccttgctgatgtgccagctgggattacgctgatggatgaagctcttcagagctatgggcaatatctacatatttgattgtcaagaaacttcgtgtggaaatagcttcaaacttacacaaattgcaagaataaaaaatagtataaggatattcgtacacactctctttactcagattcacctgttaatattttgctccatttgctctctatgtgtgcagagtatgtttttgttctgaaccatttgagaagttgcatctatcctggtcctctacttctcaatacttcagtgtgtattacctaagaattggaattaatcagttatcactgatactttaacctactgtccatattccacctttgtcattttacccaataacgtctttttaaaaaaagttttttgaggtttcattgacatacaattgatatcaatatgtgcaaagaactgcatataaagtgtacaatttgataagttttgacatatatgtgtgtgtgtgtatatatatatatatatatatacctgtaaaagtatcaccacaatcaagataataaacatatccacccttctagaagcttcctaatgcccctgtgtagtaactaccctactgcccttctctgcctccatccccaggcaacaactgatctgctttctgtaatatagattagtttctattttcggcagttttatgtcaatggaatcacagtgtatgtgctcttttttgtttttcccaaaaagacccatattgtgtaattatttggagattgtgttgtgtatgtcagtggtttattcagttttattgctgaatattattccattctatgagtaaaccacaatttgtttatctgtatttccctgttgatgggcctttgggttatttccagttttgagtgattatgaataaagttaccatcaacactcctgtgtaggtttttgtagggacatggctgaaagtagaaagaaatggggcatgcaggagagactgggcttggttataacagcctgttatccctggggaactagctcactcaccagaggacgttaggaaggatctgcccctgccccccttgtgatccaaacacctaccactagaccccacctccggcagcaccaccacacaggggatcaaatcccaacatgtgtttcagagaacaaaccatattcaagctatagcatagctacgtaattattataacactattaataagaccatctttgccttgggaattttaagtagcacctttattacatattagatttttttgtgtaatgagtctgtttctggagcttaaattctatttcactggatggtctgtttatttatgtaccagtaccacgcagttgtaattatggaggttttgtagtatgccatatatatatatatataataaaaaaaaatttttttgagacagagtctcactctcttgcccaggctggagtgcaatggcacaatccaatcacagctcactacagcctcagcctcccagactcaggtgatcccatctcagcctcctgagtagctgggaccacaggtgcgtgccaccatgcccagctttttttttttttttttttaattgttacttgtagagacagggtctccgtgtgctgcccaggctattcttgaactcctgggctcaagtgatcctcctgtattggcctcccaaagtgctgggattgcaggtaggagctactgcatctggccagtatgcagtattttcatatctggtagggctgagtccctcctcacagcttatttttattgttttcctagtttttcatgtgaactttactgtcagttcgtctagctccataaaaaggtatttttattgggatttttgatgatgctgaaatgtcctgaccaagaacaagggatattcagatgttcttttgtgtctttcaggaatgatagttttgttcacataagttttgaatgtttaagtttatttaagtttatttctaaatattttctcatttctctggcttttgtaagtagggttttctcatccatgttttcttctcatgagttatttgtggatatgaaggctatccattagtatatgttgatttttatattacacttccttgctcagttcattattgattctttttgagttttccaggcatattctcacaagtaaagataatagaaatagtttgcttcctttccacttctgctttgaatttttttttcttggttcatttgcattggctgcttcctccagcaaaatgttaaataaccctggagatgatgggcaacttcgttttgctcctgacattcgtggggtgcctctggtgcttccctgttggtaaggggttaactgtagccctgaggtgggacatttgattttaaaaatcagtcatcttggggcgcttaggttagaggaatggtaggcagatgctgtcactccttgcccctcccctcctccttcccacctggaggggaaatgaaatctgacaggtagaaagaggggagttggggttctttttctctctccctccaccagcatcactctctgcctctccctcaaaaatacgttcctgggtcaggatatatgttgactccctagagagctctggagtcaacctcctggccttcctccaccctcactcttggccttttcctgcccccatttcctctacctgtggggcatggagccacgagcctttgtgtgacggtttgctttctctctcctgtctttaggtgcatggctgcctcctaatcccatagtccagaggaggcatccctaggactgcgggcaagggagccgggcaagcccagggcagccttgaaccgtcccctggcctgccctccccggtgggggccaggatgctgaagaagcagtctgcagggcttgtgctgtggggcgctatcctctttgtggcctggaatgccctgctgctcctcttcttctggacgcgcccagcacctggcaggccaccctcagtcagcgctctcgatggcgaccccgccagcctcacccgggaagtgattcgcctggcccaagacgccgaggtggagctggagcggcagcgtgggctgctgcagcagatcggggatgccctgtcgagccagcgggggagggtgcccaccgcggcccctcccgcccagccgcgtgtgcctgtgacccccgcgccggcggtgattcccatcctggtcatcgcctgtgaccgcagcactgttcggcgctgcctggacaagctgctgcattatcggccctcggctgagctcttccccatcatcgttagccaggactgcgggcacgaggagacggcccaggccatcgcctcctacggcagcgcggtcacgcacatccggcagcccgacctgagcagcattgcggtgccgccggaccaccgcaagttccagggctactacaagatcgcgcgccactaccgctgggcgctgggccaggtcttccggcagtttcgcttccccgcggccgtggtggtggaggatgacctggaggtggccccggacttcttcgagtactttcgggccacctatccgctgctgaaggccgacccctccctgtggtgcgtctcggcctggaatgacaacggcaaggagcagatggtggacgccagcaggcctgagctgctctaccgcaccgactttttccctggcctgggctggctgctgttggccgagctctgggctgagctggagcccaagtggccaaaggccttctgggacgactggatgcggcggccggagcagcggcaggggcgggcctgcatacgccctgagatctcaagaacgatgacctttggccgcaagggtgtgagccacgggcagttctttgaccagcacctcaagtttatcaagctgaaccagcagtttgtgcacttcacccagctggacctgtcttacctgcagcgggaggcctatgaccgagatttcctcgcccgcgtctacggtgctccccagctgcaggtggagaaagtgaggaccaatgaccggaaggagctgggggaggtgcgggtgcagtatacgggcagggacagcttcaaggctttcgccaaggctctgggtgtcatggatgaccttaagtcgggggttccgagagctggctaccggggtattgtcaccttccagttccggggccgccgtgtccacctggcgcccccactgacgtgggagggctatgatcctagctggaattagcacctgcctgtccttcctgggcccctccttgccacatcatgagctgaggtgggaccacagtccccaggctgcatcggcctgcctgtgtttccctcttaggtgcatttatctttttgatttttccgagtggcatttaagtgcacaaatgataacaagaggattattctcccgttctcaagggagtcagatcaggggaactattctagggtatgttgcggggtattaagcaggaaaccactgtgtggtggggggcactgggcttgttggggccagaaatgtccacgtcctgagctttctcctggagcatgtgcagagagtttggcaacgttcgctctcttgaccagaccccttctccctgacctggctcttccagccagggcacgagccctccttctatacctgctccccttcccccagtggggactgagttatgggagaaggggacatatttgtggccaaaatgatactaaccaaaggggcttccttgtcagggcctggtggagttggtgggtcatcggggctcactgcctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaata

SEQ ID NO: 539 - DNA, 45936 bp, Homo sapiens
gggcacgtaggtgaagctcagtgcttggcacgaggtgctcatcagcagcatcgcccttgctttgggctggcctgttagtaattcgtttttagtggaatcgaatacaacacttgagcctcggaggctcaggtcgtcggagcaactacaccagggccggtgcacctcggggcggcggcgcaggactaggctaggccgggccgggccgggcagggcggcgcgagtcgggggtggggcggcggcgcagcgccgtcgtcgtagtccccgcctcttccccaggggccgcgtcggagcctcggcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcaggtaagcggcgcccgactccagccccgaactccggtccctggctctgccctgcccgctggccgcctcaggcctctctggccggcccgcggccaactcgacgccggggcttggcaggccgcgctgggcctggaggggcgggtcgggccccgggctcggattcgaggctgccacgggcccggcctgcccgtctgcgaccccaggtgggactccggcggtggaaagtcctcctcccggcctcgtttcccgcatttcccagggcgggcgggtccctgagtcagaacccgcgacccacaggcggcatcgatctgaggcattcgtttttcatttttccacctttggtttgatgtcattggaaaagaaagaaagaaaaaagcatgaaacggaaactgggtggagagaaaagattaaaatctctgctgctgccgatagctccccacagcaagatgctattgctcagggtttcagagcctagtttgtcgaaacccatccccctcgcctccgttttaagacaaaagtaaaaaatgaagcaagagacaagcccgcagtttgcagtagatttggaagaggcgatgtttggctgtggtgatgccccaaaagggagagctacgatgaagtctgcagggcgtgtgccgggtgtattttaaatgcttggaagtgacgttttaagagatttgatggcatagctggggaggaaatgtataggaaatgattggatcattttctcgggtttgatttaatacattgaggccccagggaaaagagctgcttgtttcactccgcgtctgtagctaagttcccccaggaaatttagagaccttctgcagggtttttggaagtgttaatctaacatacagtaatggtgggaattgagccaggtggtaaactgatgttgattggaaccgcaaataacggcttgtgtttgtcatgtttcagatgctttcggtgcatacagatgtcaatcctccttttatcaaataaaatgtcctatcttagacgatctacaattttatattttagaagtaaggaaagccagccagtacgatgaaaacgtagattaaccctggtgcggccggccggttactggtttgttttgctatcatcagccatgtgttgcaatccgtccccactcaggcttggactcccaaaatgactagttaagaatttcacttcttggttttataaacacggcccaaattgtggcaatgcagttaatccttagatctcttcagagcacatggatctagcacatgctttttttctatgaccttgggcagcctgcgggttccttactgctttaataaaatgggaataacagatgccacttaactgtcaccacagtgtttgcaaatcacccctactgtatactgtcatctgatttcatccttttcatcctgacttggataaggctaacgagcaaaagagctgtggtttttctttgtactgccatcttcttgagctattaggtaatgctgacatactgctagaatataaaaaatttgctggagtatcaaaatcatgtattccttagtgtggcatttaatattttttaattatgcagaattgaagtataaaaaaaagagaaaaaaatcttcctagaaaaattgtaaaagatgaaagcccaaaaaactgcaaaaccctccctaaacaaaaaccaaatagataaccaaaggtaatattttaatgtgcattcttgtgggtttatagctatgtaaatatacatagttatagatcagtatatgtgtgtacagataaggaatgcaggaaagctaatattgatttttttatgcaacaatcacagtattaagtaatttacatccattttttttttcttttaattcataccaaacccttatgaaccagggtttgttctcattgtcaaagactcaaagtggctcagtaacttgcctcaaggtcacaggctgctaagtagtgattataaggatatacacacactcacctacttaaaacacaggctcacagtccagatataggtgtatgcattagcagatatatacacatgcatatgtattctcttatgtacccatatatacgtatacagacatatctttgtacatttgtgtgcagttttatgagccccgatcatacttgcacatacttttgcacgtgtccatgtgtatcttgttctcagacatgtgcattcatacatttgcacatgtgtatcatgcacatgtatctacaaaggcatgctagataaataatgaaataggttcataattctattttgtaatgttcttcacacaatgttattaatgtcttctatataaaatatttttaatgtctgcatggcatgtaattgtatggctgaatcataatttaactaattgcttatctttggtcactaagaatgtttacagtttttttcattgaaatttatttcacatacgtcttcaaccgtttccttagcataaattactagccatggaaatgcctggtcagcgaatatgcatttttaaaaggcttttgaattatagaatgatggtgaattgtccaggcaacttgataggagcatgatactctttggttgtcacacagggctgttctgacttctatttgatctggttaatcaaattgagctagttttctcaccaagtaaatgtaatggaaaactgtatgattcattcataaatgcaaacacagttttgtctttatggtctttttattggtagtgtaatatgtggacaacttgaatttagcatagtgacagactatgcagaaagggtaggctcaaccaggtgtggtggctcacacctgtaatcacagcactttgggaggccgaggtgggcggatcacttgaggtcaggagttcgagaccagcctggccaacatggcaaaaccttgcctctactaaaaatacaaaaattagccaggtgtggtggcactcacctgtaatcccagctacttgggaggctgaggcaggagaattgcttgaacctgggaggcagaagttgcagtgagccaagattgtgccactgaaccccagcctgggtgacagagtgggactgtctcaaaaaaaaccaaaacaaaacaaaacaaaaaatggccaggcaaggtggctcatgcctgtaatcccagcactttgggaggccaaggcaggcagatcacaaagatcacgaggtcaagagattgagaccatcctggccaacatgtgaaaccccatctctattaaaaatacaaaaattagctgggcgtggtggcgtgcacctgtagtcccagctactcaggaggctgaggcaggagaatcgcttgaacctgggaggcagatgtttcagtgaactgagatcgtgccactgcactcctgcctggcgacagagcaagactctgtttaaaaaaaaaagcacggtgtggtggtgcacatctgtaactccagctacttgggaggctgaggcaggaaaatcacttgaacccaggaggcagagtttgcagtaggctgggatcgcgccactgtactccaggttgggtgagcaagactgtcttaaaaaaaaaaaaaaaaaaaggcaccgaggtgggcggatcacaaggtcaggagatcgagaccatcctggctaacatggtgaaaccccatctctactaaaaatacaaaaaattagttgggcgtggtggcacgtgcctgtagtagtcccagctactcgggaggctgaggcaggagaaacccgggaggtgaagattgcagtgagccgagatcgcgccactgcactccaggctgggcgacgaagtgagactctgtccaaaaaaaaaaaaaagaggctaggcttataggttcccctggcattattttattttttttttcatttttgccttttgaaactgagactgtctcagacagtatggaagcactattttagaaagacctaagtaggcccatactgagtgctgagaaacctgttgcgtgtttctctctctgaggacgttaactcccgttcatccatagatgaacgcagatcttctgcggtagatgtgtgcatgaattttgccaattcatttcaagtattttgggatacttggatttgaattcaatgtaagtgggtgatgatgacactgccatgtaggttcaaacagattacagaatgtttagttctggacttgcctcattacctgctaaagaagttgcccacttgtgagcatcaccaatactctgtatgatagtttgatgacattatagtgcagattttggaatggtatacttttggataaattctctcaggattatggaggaatattttgatgagcataagaatttcatctctgataggtcaaaccatattcatgttaaattattagatgaagtaatgatcctggaggaaggaatgaatagtgcttatgtggcttttttgcttatttttcagtttcaaaagaagttatatcacagaatgccaacataacctaaatgtcaaagtttcttaagttatatgctgtatttgtggcctacatggtcagtgatcaaagaaaatttataaaaatattaggaagatgggtaaattattcctttgaaaactttaattgtggtaaaatacacataaaatttaccatgttaaccacttttaagtatacagtttagtggcattaagtacattcacattgttgtggaaccagtccatctccagaactttgtcaccttgcagaactgaaactccatatccattaaacaataactctccattccccctcctccagcccctggaagccaccattctactttctatgtatttgactaccgtaggtacctctcataagtggaattagacaggatttgtccttttgtgactggcatatgtcacttagcataatgtcttcagagttcatccatgttgtagcatgtgtcagaatttcctgcctctttaaggctgaataatagtccattttatatatgtaccacattttgtttatgcattcatttgttgacggatgcttggtttgcttctaccttttggtcattgtgagtaatgctgctataaaaaacatgagtctacaaatatctttcaagtccctgctttcagttcttttggatatacccagaaatggaattgctgggtcatacggcaattctatttttaagttttcgagaaactcccatactgttttccatggcagcttcaccattttattttcccaccaacaatgcataaggattccaatttctccatatcctcaacatacttgttatgttctcttttttgtttttgtttttttgatagtagccatctaatgggtgtgaagtggtatctcattgcagtattgatccctatttccctaataattagcgatgttgagcatcttttcatgtgcttattggccattgatattttctttagagaaaatgtgtattcatgttctttgttcatttttgaattgagttttttgttgtcgagttgtaggagtaatttcttcatgatgtttacattttcaactttttactatggaaatttcaaacacatacaataataaagtagtgtaagaaattttatgtaccatcacccagcttcagcaattgtgaatgaatggccaatattatttcacttatactcaccacattattttgaaacgaatcctagaaatcatatattgataaatatttctatgtgtaacgctaaaagaaaacaaatggtatgatatttcaagaagatatcacatgaggaatatatcatgagagctctcttgtaatctgtgaggagtatggaaacaggatttgtcagtgtcgggctgtggatccataactaactgtcctttgtattgattgggctcactcttgccaagcctcatgctttgtttttgtagcagtgatagattcctgttaatctatccttgttttcttacctgatcccatgggtgaccacttgttaggcaagatttatttggcttaatcatactatctgtgtcctgaaaatagggcagtgcttcctggtttgggcagaaaccaaggcccagttgaactgctctagggaattttgctctaagctgatgccaccagtagtttaactgcacataacttcaaattgttttatcctagacattaattatatttcataattttatggtagattataaagtaaatcctaccatgagaataacttcatatttttattaagaaagaaaaaaagtctccaagagattcaagtgacatcctcagatttatttgtttttagggctttaaaataattattttggtttcttaaaatgttcttgttttacctttaagcaagtacaacagcttagaagaattatattcttttttgtttgtttgttttgagatggagtgtctttcttcttgctcaggctggaaggcaatggcgcgatctcggctcactgcaacctccgcctcccaggttcaagcgattctcctgcctcagcctcctgagtagctgggattacaggtgcccaccaccacgcccagctaattttttgtatttttcgtagagatggggtttcaccatgttggccaggctggtcttgaactcctgacctcaagtgatctgcccgcctcggtctcccaaagtgctgggattacaggtgtgagccactgcgcccggcctatattcttataataatggacaatttagataaagcaactttaatacttctgttccattcatactgaaaattggcatgatggtttatctttttttcaagtcattgttgccaataagctaggcaactggcaaacatcatgtatgaaattttttgggcttgacatactttccagtggtaattgcttctagtggttggctaggtgggggtatgagttagagtaggctctgggtatccacaggttctacattcgcagattcaaccaactgcagattgaaaataggggaaaataaccatacaataataaataatagtgcaagtaaaatatacactataacagctattttacatagcatttacattgtattaagtgttataagtaaagatgatttaaagtacatgaggtaggttatgtgtaaatactataccattttatgtcagaggcttgtgcatcctcccattttggtatctgtggggagtcctggaaccaattcccagtggatactgagggatgactgtatgatatgtcttgttaacttgaccaagagtggtagtaaagcaagtgtaacttgatatcacttagcacatcctgctgttacaataaggcttactcatgatttttctgaataacataatttatattaaatgtcctaaatactagcactgatcaagtttaagagcattcctagtgaaatattttcttattaatgcagttcccttcatatgtatatttatttatttatttccttccttccttccttccttccttctttctctctctctctctctctctttctttctttctttcaacagagtcttgctctgttccccaggctggagtgcagtggcgcaatcttggcacactgcaacccctgccttccagtttgaagccattctcctgcctcagcctctggagtagctgggactacaggtgcccgccagcaggcccggctaatttttgtatttttagtagaggtggggtttcaccatgttggccaggctagtctcgaactcctgacttcaaatgatctacccaccttggcttacagagattacaggtgtgagccaccatgcccaggctaccttcatatgtatttttcttttctcttctctcctcttcttttttatttatttatttatttatttttgagacagggtctggttctgtcacctaggctgtagtgcagtggtgagagctctgctcactgcaatctccgcctcctgggttcaagagattctcgtgcctcagcttcccaagtagctggtgttacaggtgcatgccaccacgcctggctaatttttgtatttttagtagagatggggtttcaccacgttgcccaggctggtctcgaactcctggccttaagtgatctgcccatctctgcctcccaaagtgctgggattacaggcatgagccaccgtgcccggcccatatgtataatatatttcttatccccctccccgagcaatttagcataatctttgaccatttttctgtttttgtcttttaaattagtttatctcagcaatattaattagtacttaccataatcaaaggcttgaatacaatttggaggtctatctggagactggacaatttatgaatagagatataagggtttagggagtggtgcctgtttaataatgatttcattttctttttttgctttttttttttttttgagacggagtctcactctgtcgccaggctggagtgcagtggcgaaatctcagctcactgcaacctccgcctcctgggctcaagtgattctcctgcctcagtctcctgagtagctgggactacaggcgcccgctatcacgcccagctaattttttctatttttagcagagggggtttcaccatgttggccaagatggtctcgatctcttgacctcgtgatccacccgcctccatctcccaaagtgctgggattacaggtgtgagccactgcgcctggccgatttcattttatcattcgatgcttaaatgtgatatttaaaattaagcattttgtattaaatagtaatacattcttcatgtgctagattcaaacagtaactttctaaagaaaaacttgatttccctttcctccctatctctttgcagagctgtaactgctcctcaagtttggtgtgtgttctacaggcttttttttttttttttttgagacagggcctcactctgcacccaggctggagtgcagccacatagtctcggctcactgcaaccctccatcttcaggctttcttcttaacctttccttggctttaaatgttttttaaataaatctgtactttcaaatagactttactttttggaacttttttccccctaagatgggttcctgctatgttgctacccaggctggcgtcaaactccttggctcaagcgatcattcccccactgacctcccaagtagctgggaccacaggcacacgccagcacacccagctgaaacatttttaatttttcagaaacactgagaagacagtagagagtttccatatgccctatgcccagctttccctattagcatcttatatcagtatggtacggttttcacaattattgaaccaatattagtacattgttatcaattaaagtctgtactttgttcagattttctaagtttttacctaatgtcctttttctgttccaggatcccatccaggatccaggatgatataatgtggtaatgttacatttagtcgtcctgtctccttaggctcttcttggctgtgagtttctcaaactttccttgtttttgatgagcttgacagttttgaggagtattggtcaggtctttgtagaatgtccctcaattggggtttgtttgatgtttttctcatgattagactggggctgtggatttgggggaagaccacaggtaaagtgctgttctcatcacatcatatcaagaatgcacactttcaacatgacttatcattgttgacattgaccttgatcacctggctgaggtagtgtttctcaggtttctcttctgtaaagatacgttttaccccactttccatacttactcttgggaaggaagtcactatgcatggtccacacataaggagtggggagttatgtaacacctcgctgagggccaagtattgacatgaattatttggaatttcctgcatggggcatttgtctctgctctgataatttgtttagtatttatatctgtatagactcataaatatttattttattcttccaattatccaataactgctttattttattgcttaaattgcatacctccatcattgtggatttttttttaaccacttccatactttttggcactaggctcatcttatatatttcctgcactatcctagaatcaggcatttttccaaggagcctaggttccttttattgaaaaataatactacaaaccaagatctgtgctccttgctactagggtgtcattgcttttaggccttctaagctgacagagcaaggaactatatatgtctgtatattaacctgtgggtatacacatctgtaactatttctgtatgtaccatctatctatattaagctaaacataagttcatactaatatctccacctctaatttgttaccatatgggtcactctagcctactccccttatctataaactcccactccaacatggagaaacctggctcacttccaccatccatttacatcattcttcagttctgatatacatgtgtaagttgtatcagaattattaacccacacccctgtgggaaatagtattataaccactacaggacaaagcatatgtacagttcctttgcctttagtcttaaaaactctacttatttccaaatgttacttaggtcagcaccttttcctccacccacttgagtgaggttgtttcaaacatttataatacagttatcttgttttgtcacattttgcatacatcctccagccacctaagtggatttttaaaatttgcataccttgagattctttctttgtgctatcaagttctataaattttcacaaatgcatagtgtctttttttttctttttaaacaacacgttttaagaaaaatggtaggactgatttttctttattttccaaactttctgctaatgatcatgtttgctttctttttaaagtacctttaaagaaaattttatttagaaataattttaaacttagagaaggttgcaagaatagtataacataacactcatatatctattaccaaattcatcttagacttattgttaaattttgattaacaatgaatacaatcctataaaaattgaaagcgctacagataaaacccaagtccctttaatcatcacagtcctttctctatagaattcagtgttgatttagctacttgttgtcaaattattattattattatttttgagacggagtctcgctctgttgtccaggctggagtgcagtggtgccatctcagctcactgcaatctctgcctcccgggttgaagcaattctcctgcctcagcctcccgagtagttgggattacaggcacgcaccacaatgtccagctaattcttgtatttttagtagagacggggtttcactatgttggtcaggctggtctcaaactcctgacctcaggcaatctgcccacctcagcctcccaaagtgctgggattacaggcatgagccactgcacccggcccaaactttctttctgtttataaatctcgtctacagccataccactctgaacatgcccaatctcgtctgtttataaatctcattttcacttgtacttctaccagtacctggtgccaccagttcttgagcttttgggggatacaaaacaggttgttttttggctttctggtttaggatttagctttcttgggtctgctgagtcagttaccacttgtcatcctgcttctagctttcagaaatttattgctgcttcctttcctgttgcttgtaagtttttttgcctttaaacaaacaacattttactcacatttatatttaagagggtttcaggaggaataagaggcaactgtctaatctttaattggacattatacagtaagtgtaattctttgtgtttcatttgctaaacttgcagacttagtgaggccaaaaacaccagccatgtcactgttctgtccccagaccccacatcagttgtggcctgacacatttaatgagagttgttaaattaacctagcagttgaatacttgtagaatgaaacattctgtgatgatagtgtaacaggaaaggtattaaatgcttgatgcacctactttttggctctctttgttcttgaaggaagaggggacctcatgaccaggcctgaatcaaggtggactctcctgaatagaataccttttcccacccataatgtctacctgagtatgctctactccaggctaatgagcaagcatagcttttggaacttctcactatcagagctgagcaggctgcagtcaacatgcaagcctgggttctaggcatggctctgtcactgtctttcagtgtctacatttgatttcactgtcttttcaatgtggaatattccattcttgggatatactaattggttgtttttagaagaaacaatattgtaggaattacattgtgatcaagataagttttccttcatatataatacaaactttaattgaacacctgagcacttaatgctaagtgctgtaggttgaatactaaatgttaaacatttctcatttctaaagagataaaggttggagatgcctgtttctcctttgtgtttcttttctgttatttctttctaaaattggtaactataaagccatactattcttttcatttttattgtgaaattatggatacatatgaaaggaatacatagtatagatataccttgtgcaaaataacaataataaatcagagacctgtgactgccatccaaatcatagcaatcttttttgaaagtttgtttgtttcacacgtattcttttagaccagtcagtaggagagagctgcttttgccttagttgctttgtaaggccatgtttctcctcaactcttccatgtttaaaatgcactccttgtgctgagtactgatggggataccatacctgctgttctcctctcctgaaaccatcatcactgtcctctctacagttatagcagtcatctgtgtatggctacatgcatagcctgtgaatttatttggagatttgtaaagtaatatgaatacttttcatagatgcgaactggtaagttaaaatggtattaagattagctgctatttcttcagctaagtttctgttagaaatccacctccatgcctgttttggccaacactcactaatgtatccatgctgtgccactcactggtaagtgctggggtgaacgcagtgataaaccatgcaaaggtctcagtccacagagggctcacagtctgcatcactattcctcgtacagtctttttcttctcccatttctgaattgttagtgaagtatgatttatgtataaaaacatgtacaatcacaaatgtgcagctcaatgaattttcacaaactgaacatgcacagctaactagtacttaaatccagaaacagcattgccagcactccaaaagatcccttcagtgcctttccagtcactctcctcccgggacatactcactggtatgtttagtttgcctgttctttaaaaaaatctttatatgaatctaatcatacagtaaatactgttttgagtctggcttcttttgctcaacatgatgttgcaaaatttacccatgtgggttacagtttattcatgcacactgctgtctcattatgtgaaaataccacaatttatttacctattctactgtagataggcatttgaataatttccagttttatgaatactgttgctttttccctccttatgtgtcttttggtatcatatgtaaatgtttctgttggacatataactaggagtggaattgctggatatgtgtaaattcattttttgttgatattagcaaacagttttctaaagtagttgtacaggtttatactcccatcagtagtgtagtgcgagaattctggttattatatattctcaacaacatttggtattttctgttttttattttggtcatcatctgtggttttaattttcatttctataatgactaatgaaatagagcacctttttgtaagtttattggccatttagatatctttttttgtgaaatgtctattcaagtcttgtccctttttttattgaatggcttccttattgattttaagaagttctttatatattttggatataagtccattgtctgaaaaatatatcctcccgctctttggattttcttttcactttcctaatggtgtcttctgaatgaatagtagagttctcgtgtgtgtgttttggttttgttttgtgttttaggcagagtctcgctctgttgcccaggctggagtgcagtggggtaatctcggctcactgcaacctctacctcccaggttgcagtgattctcgtgcctcagcctcccaagtagctgggactacaggggcatgccaccacacccagctaatttttctatttttagtagagatggggtttcaccatgttggccaggctggtctcaaactcctgatctcaagtgatcgtcccacctcggcctcccaaagtgctggtattacaggcatgagccactgtgcctggcccaaacaagtgatttttaaaattgttcttgaaatctaaaagaattattttttttaagaggcagggtcttgctatgttgcccaggctggtcttgaactcctgggctcaagcagtccttccacctcagcctcccaaagtgctgggattacaggtgagatccaccatgtccagccataaaataattcttgaatagatgccagttgtagtccatggtcttttgtgacttttttttctcctttggaaggagctgcttaatgtatcattttaaatgacaaataattaggagcttgtttgtgcttccatgtttctattttagagctttaacatatcttagatgaaatctatatacggggtcttgagaggttaaaacagaatgtatttaccacctttgcatttaaattatggactagattttatataaattattttaaaatgagtctgatacagccattatttttagtattgtttactctgtaaacaaaagatgaccagttcctgctattctgtcaaagtcagggagccaggtgtgtagtctccttttcaacttgtctttctctagggctttaaatccttctcaaatgggccctggagctctgagctaagcctgaattttcttatggaaccaagaagtggagaaaaagaactcacattactgaggatatggactggttataaatagtgtagatgctacttcttaatttaaaatgctatatgttcatgagcagctagacttgctattaactatttggaaatattgaacaattgtcgctccttatttccgtagtctttgtaagatcatgacccatcaaggacctaccgttaacctcaaaggctcttggctgtaggttttcctcaagctgggtgccagaaaacagaggattatttgcttgataatatcttggtggagccatcagtactagaaatatttggatgtcagacacagatcccaggggttggcaggttgatgataattttctggtgccaccccaaaaccttgcagtgctactaccataaccatggttggctaattagtgccttcggggatgagggttgatttctgctagttccttgcctttctctttggatggcatgccttcacttgttacttggacctatgtaaagaataggaagatcagaagaaaaccataaaattgatgatcataggtcacagtatttgtgctttcatttctaaggactcattctaacataaataattttctctttcaaaaccaaggtgtactcatcagttatattgatacatattaacagtgatgataaccacaaaaattttaaatagaaagctttacaaacggttagctttgtgaggggatttactgcaaaattagggtattcttttcatctgttattgtattgactttttaaaacattattctgattacttagtttttcctttggcaaattttgatttttaaatgtgttttcattttgctattgagaggattttcatttatcttttccatgggagatattgaggatagtctaactctggtaattggtttggtgggtttttcttttcttttttttggctccctatgagcaacttgaagatttttttttttttgagacggagtctcgcctctgtcgcccaggcgggagtgcagtggcgcaatctcggctcactgcaagctccacctcccgggttcacaccattctcctgcctcagcctcccaagtagctgggactacaggtgcccaccatcacgcccagctaatttttttgtatttttagtagagatggggtttcaccttgttagccaggatggtctcgatctcctaacctcgtgatctgcctgcctcggcctcccaaagtgctgggattacccacacccggcctcttgtactgtaatgtttttaaggttcatccatatttcagcatgtgtcagtatctcattttttctgggtgaataatatttcattgtacagataagccacattttgtcgatcccttcgtaagttgatgaacattgttggctattatggataatgctactgtgaagattcatgtaccagtttttgtgtgaacttgttttcagttctcttgggtatataccttggagtggaattgcttgatgttaatataaatctgtgttgctgtttttgtttgagacaggatctcactctgttgctcagactgagcaacagactagactggactcactgcagccttgaactccttggctaaagtgatcctcctgtctcagcgtcttgagtagctggatcacaggtgtgccgccatgcctggctaatttttaaatttttagtagagacaggatcttgctgtgttgcccaggctggtctcagactcctggcctcaagtgatcctcctgcctcagcctcccaaagtgctgggattgcaggctgagccactgtgttttcagcctatgtttaacttattttgaggaactgccaaacttttccacagcagctgtaccattttacattcccaccagcagtgtattagagttcccgtttctccacatactcagcacttgttattgtctgtcttttttattatagccatcctagtaagcatgaagtggtattgagtcttggttttgatttgcgttttcctgctgacttaatgatgttgagcattttgtgtctactggccttttgtatatcttctttggagaaatgtctgttcaaatcatttgcccattttataattgggttgcctttttattgtttagtctctcttatcttgtcagaattatttaaaatatcttcccctaattaataacaattagatagagaatttttcttgaatgtaaataatttggtgatgttagaataacagagtttatatttacaatatataaagtaaatgtacaggccacacaaacttaatgattatttctgaacagcagtaaaatagcatactcagctgtttaccaaaagaaatgtgcttgtttactttttgtaattatactgccttgttttggtaggatttagggactatgcagaagtagtgggttggtaatgagagctttaaaaattgcattttaaggtaaaagttttagcaattaactctaagatagaagtagtaaataacattcaaaactagagttcaagcattgacccagaattttctgatatttatttttaataacttaaagaagggacttgaaacttacaagaattttcttgctgtttaaatatgaccaaaccaagaaaaaattaagtagtgaaaatacttgcaactttatggacttactggatacttcagcattatttttcacgtgctttgtttgtttgtttgtatgaattctgaggtgtatgttgataccttttctcatatataaggatttatgggttttgtttagtgtagggttttttgttgttctctcattcttagtaaatatagataatccaagaatgacttttaagtgcctttaggtcctgccatttgctacagttataaatgttgccccttgcttagccctaatcctagccccagctctgctattgcttaaaaacaactcattttagaactgcttagtgaggagggcggtggtgaagctttcttgctgattgggaactcaaataatagtttaaatctgtagggtataatgtcttaaacgtgttaaattcaagtttgtttctattagaattagaactatatatgatttctgtgttggagattcataaaaatgtcatatttatttttaataacaataggacctagatacagaggaaggtgataaggagggaaaaaaaaacgctctattttattttatttatttatttatttttgagacagaatctcactttgtcgcccaggctgaagtgcagtggcttgatctcagcttactgtaacctccacctccccggatcaagtgattctcgtgcctaagcctcccgagtagttgggactacaggtgcatgccaccacacctggttgatttttgtatttttagtagagacgagattttaccatgttggccaggctggtctcaaactcctgacctcaagtgatccgcccacctcagcctcccaaagtgctgggattacaggtgtgacttgagaacaaaaccttagtagcacctatttgtaaataaatgttttcttaaaattgaaggtcatcaaggccaaaggcaccatggcagattgtgacatatctgaagtaggaagagttttagggttcttctggggagccattctagtctgctcagcacatagaagggagcaaaggtaatcaggaaaagagtaatggcacactctgggtgtgagaaagtgaaaggtcatctgaattctcaggtgattggattatttatttcttagcgatggaggcataggtagttataggtagttctgtattaaactctactttgtatggcctgtgtaggtaattgtatagctgtatttggaaaaaatgccatttaaatcatatttcagccgggtatggtggctcacgcctataatcccagcgctttgggaggctgaggcaggcggatcacttgaggtcaggagtttggtaccaacctggccaacatggcacaaccccatctctactaaaaatacaaaaattagccaggtatggtggtgcatgcctgtaatcccaactacttgggaggctgaggcggaagaatcacttgaacccaggaggcagaggttgcagtgagccaagatggtaccactgcactccagcctgggtgacagagtgagattctgtctcaaaaaaataaatcatatttgaagtttagtaaaattggtcagaaattatatgacaggaaaaaaaatccagtgtccaacagctatttattatctatcacagtcactcaaaggatatcccccctacccttgcccaacatctctgtgcactgagagcagaagttcccagatctgtcccagttttcagatctgtctctctgagtatcccctacaacccagattctgtgacagttaaattggactcgggcttccactgacccagttgatggaagagactgagcatctttccaactctaacccaaacgtgacaatgccgcgtattctttcagaaagtgtcaggaaagagcccgaagatccctgagctccagggacatggcagggaggctgcacagaagggttcccaggggtggaaaaggggaatcttaaaaataaattttggaaccaagtaatcaattttatagcacactctagttctagcgcacatggttcctccacttgttagtgaatgcctgacttgttgcccctgaagtgtaaaaagatgtatatttaaggattccattgttcagcaagttattatgcatgcagatggcaggcactaagtgcttactctttttgaaggtgattgcctctccccgcgatccccctacattgcagtgttttgttttaaacagctttcttgatggagcctaatcttatcaccagcattatagaaataagccagagtgagaagcctgtacagtgaggtcttgggattataccatagtcataatggtgttttaaattgtttttatttttcaattgaaaaaagtacactattctaaagtagtgaattttagtggagcaaactcttcacctggaagtgtttttttccttaccaaagtgaaaattggtggttctaagaaggctggaatttatttgcactgtcatcttttactatggtgggggatgatcaaatttaacatttccaagtttccaggagacaggcagcctatcttataaatattgtcatagaagacctcttaacctctttgttctttggatttctgtatttcttagaattgtcatgcttcctttctgagacctaaattatgcaggggtaacgtgattactttgacaccaagctcaggaaatataaaacgggttaagtataaaccaagctaggtttaaatgaagttcattactggctacagtatattaagggaacatattcgaaaagtctgtatttgcctttgttcttgctgctgactcttctgcttcttttggtgaccttcccacagcacaagagtggttaggtgtgaggaggctaagaataccttgccaagagcttcaaataatgttaaaaccagtattttaggtgaaccatggtcccaagaactctatttaagtaattcctagttcggtgtcccaggagcatttggctttactgcacctattttggccacatgtctttgtttaaaaggaaaaattatcttaggttataatacagctattttgggagtaccttaagtttaacattagattactaggattcgaaaaaatgtacccagatggtagatgctgatgagaatttgacacaagaattcatttgaaattgaagcttttgtagtattagtcagaaaaatttattgacatctggttttgaacagcatagtgagtggagattgagatgatcagttaaaatttaatggattgtggccgggcacaatggctcacgcctgtaattccagcactttgggaggctaaggcaggcatatcacctgaggtcgggagtttgagacgagcctggcccacgtctactaaaaatacaaaaattagccaggtctggtggcatacgcctgtagtcccagctacttggagtctgaggcaacagaattgcttgaacctgggaggtggaggtttcagtgagccgagatcccaccattgctctccagcctgggcaacaaaagcgaaactacatctcaaaaaaaaaaaaaaaaaaagaaagaaagaaaatttaatggattatggagctctacttcacattagtacacctcggtctctctgtttttctgtctcaattcaagatagagttctttgtagcggtatggtttagaggtggtatgtattttacaagtatgtcagttggctctgtatatcctgatgataccgaagccaggaccagacccctacgtcagttatatcactaaatattctgttattaattttcagattggctcctagtcccagccaactcatgttttaaattaatatagttcattgtcacactggactggaaaaaccaaatgaaatgtctttattctatgaagatgacttgtgtagactatacagactagcaacagcagacactttcagtgcgagttattttaaaaaattgaagatttgactggcagaaaagttgctgagatagggaaaagggatatctattgacagatatatgtagaattagggagaattttatgttttcataagtgtctcaattatttaagatttaatttggtgtgcatgtggaatataatggtaacatggtttgtctgtgatttgtcttttgtcttaacagattatttttctaactttaaaaaagtatacatcacttgaggccaggagttttaaaccagtctgggcaacacaggaagaccccatctctacaaaacataaattttaaaaaaagttagccagggtcacagtgtgccataattgtgccactgcactcctgcctggacaacaagagtgagatcctgtctctccaaaaaaaaaaaagtatgcaagtgataaatattcactacaaaatatttgaacatgcagatacacaacaaaaaggaaaaattcccctgtactcctattacctagaaataacagtgttgaactgtaaatgtctcattctaggcctcctttccattatatgtctgcctttttaaaaaggattatatgatgcctattgtttggcaagtttagcttttttcatgtaataatagtacactgtaaatatctatttgagtaatgaaatttaatttttttttttttaaagacatggtctctctcatgccccaggctggagggcagtggcacaatcttagctcgctgcagccacgacctcctgggttcaagccatcctgctgcctcagcctcctgagtagctagaaccacaggtgcatgccaccactcccgggtaatttttgtattttttgtagagacagggtttgttttgccatgttgcccaggctagtcttgaactcctaaactctcctaatctcaagcgatcccacccacctaggcctcccagagtgctaggattacaggtgtgagccaccatgcctggctgaaatttaatgtatattttttttgacacagagtttcactctgttgcccaggctggagtgcagtggcaccatctcagctcactgcaacctccgcctcccgggttaaaacgattcttgtgcctcagcctcctgagcagctgggactataggagtgtgccaccatgcctggctaatttttgtatttttagtagagattgggttttgccatgttggccaggatggcaaaatttaatttttaatggccgtttagtagtcctttgtgtgatgtactataatttatttgtctcctatgattggaatttaggttgtttctaatttttgctgacacaacacttatatgtacccattttgcctctttgaatatttccatagaataacttcctgggagtagaatacttttcttaaaggatttgtgcatttcaaggctttcaaaatacgttgccaaatagctttcgagaaaggctatttatttcagtttttgggttcttatctttctaattggctttatgcttacattaaaatatgaaatttttatttagttgcagaatgaagaagagtctggagaacctgaacaggctgcaggtgatgctcctccaccttacagcagcatttctgcagagagcgcaggtaggtaacagggcaaggtgatcacggaatccttaaaaacactctgtgctttgacattacagtttaaaaaaaaaaaagcttcagaagcagttggaagaaaggttacaaagcaagtctggattttaaataattgagaagtggatacatttaaaaatcacccccagtctcttacattcatctaagaatgtcttttggttcaattgttatgtatgtactcttaagggaatggctgggttttgtctgctagagttagtggaactccttttatttcaattcagctaatcatcaaaaaattgtgactgttaaaattctgcagcatattttgactacaaggatgagtctgggtttccaaagcccccatcttacaatgtagctacaacactgcccagttatgatgaagcggagaggaccaaggctgaagctactatccctttggttcctgggagagtgagtataatttgccatgttacttgatggctgctctgtgggaattaagttattttcattatccaattttgattcgttacttatgattgtattgattagtgaaagtagagctaattttaaaaatcaggtacatttgcttttgggataataaactcatctcttcttaaaaatgatgaggtaaattactagtcagacctgctcatttttccttcatctctcctattaccactactttttcaagtctcctgggatggctgaagtatcttgaagcagaagcacactaatgtttccttgattctgcacacttaatattttgctgttgggtggatagctgctagggaggtctaggaagagaataaatatatgcaaatttgtagaattaaactcataagagggatcttcacattgatttagatgaactccgttcttccagcagtccagatcatgtcatttgtggggacatagtgagttcagattccatctagcctgatgttgattcatggaggtggagattgggatgccatataaaccagtggagattattgggcactcttggttcttgatgtcagatatgtgagtgctgcatttgtcattttgtaaatattcatccagattgaggctgatgaaggtagggcattgtgggagaatggaagcaggataagtccccagaaatgcggggaccatcaggcctctaggctctattctagcaagtaactggagtgagtgatgagcaagtacagaagcctagtctgggcagtgtgatggcataggcccagatgttcccctcttggctttaagatagtagacagtttgcagaccacacctactgtgaggagcgaagctcctaaaatcattgcttggtagaaatagtttatgagcccaatctaggatgatcctaaatggcgatgatgtgcattcagttcttacaggtaccagggagaaactaaaaaccctagtgtctaagggcaagaccatcataatgtaactgccgtatattggaagcaaaccacatgcttggtactgtgcttgatgcttttatatattttgtatattgtttccaatcttcatagtaaccttgaaaggtagagattatattatctccattttacagatgtgaaaatttaggtccagagagaaaaagtaattttcccaaagtcatatgactgataagtagcagaagtgaaagtcaaacccagatattctagaatccaaagtccttgtttgtttcactgtactctgcagatctgttgcaatatatggtaaatagatcagtatggaaattagctctgattaatcacataactcttcagaatactttcatttgatacaagtacatatttaggaacttcttaaagggctctagtattcagcagacatgtataaagcactttttaaatataagatgcagtatattttacagtggataggtaaaaagctttgtataaggcagtgttcctcattgttattcaaaagcctaaaatccaactagggtaaagggcccacaaatactgataactaagacacataagagcagtgggcatcaagaactgaaactttttactgggtgatcataggggaaaatgagatttgatgtgggcccggagttttgatgggtaagaacattccagagggaaaaaggcacagaaagcaggtgtgaattcagccaggtgaaggcagttctgtggatgtagtaattggctttgtatgagcaagagtttgtgaagggagatagaaagtcctgactacaactgttgtttatagaatctttggaatgttagatgggcgtatttaaacttcatatgtagcttttagagaatccttcagagtttttgagcaggggtatgagaggacttgtgtggtgttttggaaacattaacttggcagcaatttctaggatgcatcatggtagaagagataccaagaggacaggaagaacagttagaaggtgttcgtaatattattagatgttacttccatatattttttggagtatatctttgaatagttatgcaaaaaacaattagcttttaattttggcaaaaccttattctgctgatacgaagtaagaatactaggtatttaatgttttaaaaaattaattataaaaattcgtttttatagaaatttcaaacaatagaggaagtatgttaagttagaaaaggaagctgccattgccaccgacttccctttctctagttcccactccccaggggaaccactgttaacaatttgggtcttccagacccttttctgtgtacaacaagttttgatattccctaaaatatttttcatttaaggagccctcattgaactgtgtacaaatctatcacttttaagtatatattcaattatttttaaatatctcaacacacacctatatcagttaaaaagatagcccacatgtgttggtattgttcatgatcatgttatttctagttttgcaatattacgttatcaagttaggatggaaaagatcttatctgctgataaggttagaagtgagatttagatctgtataccaatacaaatacatgcttatggagttgagcagtgggcagttctgtggactattcatgtatgatcgtactattcttttttcccctatatcagcctcgtaaagcacttgagctggttgattttatctttttttttttgagacggagtctcactctgttgcccaggctggagtgcagtggtgggatcttggctcactgcaagctctgcctcccgggttcatgccattctcctgccttagcctcccgagtagctgggactacaggtgcccgccaccactcccggctaatttttttgtatttttagtagagacgggtttcaccatgttagccaggatggtctcgatctcctgacctcgtgatctgcctgccttggcctcccaaagtgctgggattacaggcatgagccactgcacctggctgattttatctctaattactaatattttaggtcctaaacaggtcctcgattactgatattctagaatttaaaccaaatgtgtaagtaaattttgtcttttgtcttttcttgaggtatatttttttaaaggaagagtaaatagttctttgtgaactattcttgaagtgtattgtttttgaagtgtattaaatttttgaagtgtattgttaaagaacttgggttataagatgaaaatttcatttagaacactggggatagaagaaagatttgcttcttttctaattatatattaataatgcaaaatggaattttaaacacacattgagcctttaatgctcataattttgaactgaaccaaagcaataacttttttccttgctactcaaatttaacccttcatttttctttatgtcttccctttgcctagaaataattctttttcttttcatttaggatgaggattttgtgggtcgggatgattttgatgatgctgaccagctgaggataggaaatgatgggattttcatgttaacttttttcagtaagtatgtatgcatatcagaaccaccccctacaaactagagtgctttggattatgggtgaatctgactgaattaaaataactagttgagctaatatattaatacattatgtttatttggtgccttttactggaatattcaaagcttaatatacctttgttttaatatcccttctctttgccttctattttcatgaatatctgtggaaaatataattaaagcagttatgaggatgctgcatttttacatgagctaagcctcatcttccaggtctacggggcccttttgcgttgcttctactcatacttaatctgtagaataggaattaaatgcctttgatgaattttgctctgaaagcttcttttttctgacagatcaaagtcagcctgattttctcccttcatgttacttgccatttatctttttgtgtgcctcacatagaagtgagcaaccatttcctttatttgttgtattagaaagataagaaaatgcaatgcttttagaggtgatgttatataagttgtcaaaattcagagaacaggaggatgagtgacttgaatcagattatttgggggcacttatttaatgttgaaggcatttattttatttactggactatatatatataacacacacagtaaaaagcagaggtcaggctgggcatggtggctcatgcctataatcccagcactttgggaggccgaggcaggcagatgccctgaggtcaggagttcgagaccagcctggccaccatggtgaaaccccatctctactaaaaatacaaaaattagctgggtgtggtggcaggcacctgtaatcccagctactcaggaggctgaggcaggagaatcgattgaacccgggaggcagaggttgccgtgaggtgagatcgcaccattgcactctagcctgggggacaagagtgagacttcgtctcaaaaaaaaaaaaaaaaaaagaggtcaaaggctgggcacagtggctcatgcctgtaatcccagcactttggaaggctgaggtgggcgaatcacctggggctagaggttcaagaccaacctggccaacatggagaaaccccatctctactaaaaacaaaaattagccgttagccgggcctggcggtgcacgcctatagtcccagccactcgggaggctgaggcaggagaatcacttgaacctgggaggcagagattgcagtgagccaaggtcgtgctactgcactccagcctgggtgacagagtgagactcagtctcaaaaaaaaaaaaaaaaaaaaaagcagaggttgtaagtatacagtttggtgaatgttaaggtttgctttttgctgttttttgttttttttgctttttccttttgagacaaggtcttgctctgttgcccaggctgaatttggagtgcagtggtgtgatcacttctcagtgtacccttgacttcctgggctcaagtgatccccccacctcagcctcccaagtagctgggacttgcaggtgtgcaccactgtgcccggcttttgtttgtttgtttgtttgttttgtttttttcagtttttgtagagatgggtctcactgtggtgctcaggctggtctcaaactgctgggctcgggatcctccaacgttggcctcccaaagtgctaggattacagatgtgagctattgtgctcagcctattaaggcgtttttgaaagtgactagcagtagacataagtgtgtaaaacctgatagggaggagtttttcttgtttgctttttggggaaagacagaagaatggatgttttagaggaggtatggtgacggttgtggaggacaggctgtcttttatcctttggaaagtcatttaaacagaggcaggtgtaaggcactcttgttcttgggtaacaggacatgtctaacatctttcccctcctctgcttttgcagtggcattcctctttaactggattgggtttttcctgtctttttgcctgaccacttcagctgcaggaaggtatggggccatttcaggatttggtctctctctaattaaatggatcctgattgtcagggtaagttgtataacagaaaagatgggctctacagagaggcaataatcagaatatttttgaatattcgatttttcatttgcttttttaaaagttatttcagtgtgttaaatgatttttggtttgtctgtggtttcatgatgaagctgaaccaaaatcatttgcaaatggttcatgcacacaagttttgttgtcaaatctattgaaaactggtctatcattaatattgttcaccatctgctttgtttgtttttaatgtttataatatgataatgtatatgttctgaaattagttgtttttataataaaaggaaggatattacccctttgatatctcatcaaaagcagccattcctctcattaattctgttacagttttaatctagctctcttcttccttcttttcttttctccttctcttcccctctcccttccaggattgcttatgccaaaatgtttggggagccaaaactgtttaacaagtattgctccattaggagcctacctctcaagtaaattacagagatgtatgtctttagtgacttcagagttaccagttagttaaatttgcatgaagtaatttacagttgtaaaagatctaggcttttaaagtatcctctgatttcagataaatttattgctatcgtcaaccttataaacaaaaccaatttatccgtcataaattggcatacttaactaactaatgggtgttgcttgaccactgtagtttttctacgtagtgccaccttatttattataaaacatttgttaacgtttttagggttccagaatcctttgggaatctgatgaaagttgtaagcttttcccccacatagctaatatgtactcatctataataatggactttaggttaagaactcgagccctaaagaggttttcattccttccctaaattttaattgttactttattaacaaagaaaatactatattttacttttcgaactacattaaactcttggacaccaaagcctccaaggaaaagagaaataaaattaattccagtcttttttttttttcaaactaaattttcaactgcatttaaaaagtgaatcaaatgggccgggtgcggtggctcacgcctgtaatcccagcactttgggaggccgaggcggacagatcacgaagtcaggagatcgagaccatcctggctaacatggtgaaaccccgtctctactaaaaaaatacaaaaaaaatagccagacatggtagcgggggcctgtagtcccagctactcgggaggctgaggaaggagaatggcgtgaacccaggaggtggagcttacagtgagccgagatcgtgccactgcactccagcctgggcgacagagcgagactccttctcaaaaaaaaaaaaaaagttaaatgaattaacttgtatcaggtaggatgcttttgactgtgagtaacaaaaacctagctcaaaatggcttagaaaaaaatttttaattgtttttttaaacggggaaattttatttcccctgaaaacaagtccctgacaaggttagttaagtcagtggttctttgacatcatcaaggacagctgacatatcagcatattggcacaggtcccccctcccctcagggttaaaagatggcagtttcacgtatcagtattacattgaaacacgacagtgctcaagagaagaaaaagaactatttaaaaaaaaattttctaccacctttagaaagaactgtttttttctttgagaagcaaggaaagcttctcagaagccctcaatttccactggtcagaatggcatcctgtgcccattcctaaaccagcaagggaaggggattaccctggtatacatgataaagcttccaaagtcaagacaaggctggaggagtaggaagaaaatcaggcctcattagaaagaaggcaatggtatcatctactcaggaggctgaggtgagaggattgcttgagcccaggagttcaaatgcagcctggacaacatagtgagatcctgtctcttaaaattaataataataataattgcttttggcactgaataggcaaagtaaaacgatcattattgaaacacatttctagaagagcaaatattatgtggggaaaatgttttctaaaaaaaccaatttttgtatactttcaaaataaggagttaataaagctaaaagctgtcatatttaacaattgcttttccttgaaaggaaatagatttgcatttattgtaaccatttcaagctagtaatatgtaaaatactttcacttatattttaaaattattctaaaggctaagtgatggcattggtagaacaaataagtcttgctggtcacggtagctcacgcctgtaatcccagcactttgggaggctgatgtgggtggatcacctgaggtagggagtttgagaccggcttgaccaacatggagaaaccccatctctactaaaaatataaagttagccaggcatggtggtatatgcctgtaatcccagctactcgggaggctgaggcaggagaatcgcttgaacctgagaggcagaggttgcagtgagccgagatcacgccattgcacttcagcctgggcaacaagagcgaaactccgtctcaaaaaaaaaaaaaaaaagaataagtcttgcattttgtgattttgtgtacccttaagttaaaatgagaaattgtgtctgttaagctgctataaagtgttttgccttattttttagttttccacctatttccctggatattttgatggtcagtactggctctggtgggtgttccttgttttaggtaagtgtttttaatgtaagaaaaggcaagaaaacattacattaaattttataagtaaaattacttgtagtaaatgttcatcttgattactgtatagtaatatattaacaattaataataaacatttttaaaatgttgctttcttaaaaatagtctttcgttaccatcagagtaacatgcacgttaataaaaagtttctttgtggttgtaggttcttcctaacctatacatatattcttctcccccatgtgataaatggggtatgctgatgactctgtagtctgtcagtttttttccccttgtgagctattgccacacagcattcacagactcaaaccagaattgcttatacgcttactgcagccagttgaactaactcataagtgcaggtggcccatctttggtgggtctgtcagtagaaaacagaaaatatgtaacctcgctagacataacttctgaaagaaccaccattggatttccagaatgctttagtttaccgttggtgagaataagaactattttacaataggcaagaggacttttttttttttttttttttttttttttacagagtcttgctctgtcgcacaggctggagtgcagtggcgtgatctcggctcactgcaagctccacctcccgggttcacaccattctcctgcctcagcctcccgagtagctgggactacaggcacctgccaccacgcccggctaatttttttgtatttttagtagagacggggttttaccgtgttggccaggatggtctcgatctcctgactttgtgatccgcccgcctcggcctcccaaagtgctgggattacaggcctgagccaccatgcctggcctggattatattttttactctaaatatttatttttaaatacttttttcctagacattaaaacaaagagatgaacattggagtaaattatttcaatgttggcttcttgattatatgtaaagaaaatatatatgatacagttagagagaccaccatcacttctgtcatttctacaaaagaataacagggccatcttgtggctattaaagatggtgtgattgcctcactgtgcttctgtgacatcagtttctcctatgtcctgttttgcttcttgttgcccccttaattaagatccttggtggtggttctgctaatggttctggctaggacatcctggcacccatgcctggcaggtgtttaataaattgaggacctgggccaggcatggtggctcacgcctgtaatcccagcattttgggagactgagtcaggaggatttcaccttgaggccaggattttaagaccagcctgggcaacatagcaagacctcgtctctacaaaaaaatttttttaaattaaccaagcatggtggtttgtgcctgtagtcctagctacttgggagactgagccaggaggaccccttgagcccaggagttggagcctgcagtgaactatgatggcgtcactgcacttcagcttgggtgacagcaagacagtgtctctaaaaacaaaacaaaacagttcaggacctgttttgccaaaactgacagagccttgcattgctgaccctacattttacttagaaaacataaatcattcatcgcaccatctaccacctcctcaacagcatcatgtactctatgattggtcattagaattctaaggaaagagaaatagtaattttttttcctctattgattattgagaacttcagtaataaaaatgaccaacaggagaataatttagaagaaatagttccttggcttgcttattttctaaactgtacctttaagagaaaggctgaccacccgtgtttccccaagtcaaatcctgaatggaccaaagaggagcccttaagcgtatgttcagattgattgcttatggcataaataatttaaagaaatttaatggattgattcccttttaaagtttcatgggaggaggttttataatccttcatcattgatcattcttgctatgtaccatttgcttgtaagcaaaaaataagagtttggcccggcgtggtggctcatgcctgtaatcccagcactttgggaggccgaggcaggcagataacttgaggtcaggagttcgagaccagcatggccaccgtggtgaaaccccgtctctactaaaaatacaaaaattagctggctgtggttgctcatgcctatgatcccagctacttgggaggagaatggcttgaacccgagagacggaggttgcggtgagctgagatcgtgccactgcactccagcctgggtaacagagcaagattccatctcaaaaaaaaaaaaaaaaaaaaaaaatatatatatatatatatatatatatattaataagagtttggatacacttatgagcatttgtgcccaatattcgggtcattttgggaacttcccttttgaagagaaccagtttaatggtgttttgtcttgcagagctctgtgcagagctcccaagctggctgctcttgagctatagttagcctatagtttatttgttccacagttatttttcaagtttttttaaattagttgccaacattttaaaaatcaaaattatttcacataaaacgcctgaatgtttttacttttcttgaaagttggaatatcaagaaaagctagcctacatttcacatggcaccctttggctggagctgagttgttgctgtctcctccatacaggtcatgtgccttccagttcagtaagatcccaccaccataccccaacttagtatttgaaggggtaacccctgctcaatagtcacttgttgctttgggtcccaaacagaatgatgttccccaagctcagagctgacagctcttggttactgctaaaaatcagttcaactgtccaagtaccattttctaccactgagtatcccagtaaaagtatttaaaaaaaaaaatgtgctaaaggctcagagaccatctctgaaagaggaaggccaggaggagtatctgagtttccactggaggggcatatcacctctctgctgacagttttaggaggtacaaacttttgtgaatgtatagattctggtgtagtcacacaaaaagagtcttactaagaatagagaaataggctgggtacagtggttgacacctataatcccaactctttgggaggctgagacaggagaatcacttgagcctaggagttgaaggccagcctgagcaacatagcgagacccctatctctacagaaaattaaaaaattagctgggcatgaacctgttatcttagctacttgggaagcagaggcaggaggatcatctgggcccaggaattcaagcttgcagaggctgtgatcataccgctgcactccagcctgggcaacagagcaagaccctgtctgttaataataataataataataataataataataatagtagacaaagtttcaagttgagacgatgagaattgctgtaatagataaggggatcctgacatctagtggacaacattatatactgtcgacagaaaaaacagcccatgacaaggaaggttacattttttctttttacttgagaaaaacacagttataacctctttttgttgttgttgttgttgttgttgtttggagttcattatcttggaatgcttttttggaactcaataggtagattttgatgtttctcaatgaggctttcatatgtaaatgtttggctccatcttattttttatttcctttttagaccaattcaattctgaatgtgcaaaagacactattgactcttacattataccttctcattgaaggatggataatttggtatgaaaatcctctgcagattctggaggaaattgctaatgttttgattacctttagcagaaaaataacaatgtatcgctatcaggagagggatttctggggaggggacttaacatggaaattataaattcattcatgacttttcttttttaaattaggctttctcctgtttctcagaggatttatcaattatgcaaaagttcggaagatgccagaaactttctcaaatctccccaggaccagagttctctttatttattaaaggtattaaagaaaaaatttattctagtcccagtgtaaccatgtgctacattgtagatttctgttcagttttagagtaagtatctgtgataggggcatatagagaaagtaaagaaggcacagtccctgccttttagcagtttcttgtctagtaacagggatttttacaaaaagctattgataaagtcaaattagaaaaactgccataggagaaatcattacttcatgctttgacagtgtgaaagaggcaggggtcttagcagtcatcagaaagctgggatatttggctgcttgactgaattccagcatcctgaagccactgcttactgttgcaccagttccagaggatgacattcagaaggaacccttcaggcctaatcactcatctctgcccctaaatcccagaacctggagagactgtgtagtactttaagaactccttttgtctgggctgctgacaagcccaccaagtcttccatcttttaaaattgtcattgaggctttccccatggctttcttcaggttgacattctgataccactctaatgtgaggaaggtcaaactcaagaaaagaggagaaaggaccttttcccttgcctagaacaggaggactaagccctgccaaggctctttgattcacacatgattttccccagaggctgacactccatcttacatcaatggctgcctgaaggaagaggtagagaatcttgagaaagagtacaccagagagagctctctgtggtagcaagttctaataggctttcttggacttggctgtttgttccttggggctttggggactgtgttaatcatagagtggaaccttgagcaccacctagaggccagtccagttgaaggtcttaggcaaagcattataaaggataggtggtgtagttcagataaactttacatgatagtggagagtgtggggaagaatttcagaatcatctgaggcagagtgaagagcaaaaatagggaagtatggggcttgttcagaggatagcagcttgattggggcataaaggagtattgagggtcaaggctaaaaagtcaggttgaaacaagtttctcagataccttgagcaccaagcccatttgcagtagaaccatgaaattgatagagccagcgacatgttgggtcaatgcaagactaagcccacgtggagcacgaatttgttctgtactcgcagagtgtcagtttatataggcaatcatatactaatcgtgaggttctcaattttgaagacttgtggtggtctcaggaggtatgcttcaagaaaataaagcatctaccatagttgattttccaggtgatagaacagcattgaaagcttttaggcaacagaatcatataatgagaccctcttgaatataacaaacattttttcaagcatagtatagtaaactaaaattaacactcatggagttttccatgtgtcagataatatattaagcattttacatggataattaaatgtatgtaggtaaagaaggcttaaactgcttttaaagttagtttcattattaaaaaaactagtattcattattaaaaaacaggaatctttgattgcatgtctgaaaatgtgtagcatgtcatgaatttgaattcagtcacacagtctggacacagatggatattcataccactggcctgggccttaatgcctacaatgtgtctttgtttatgtctagaacataagagacttattagatattctttgcagttttatttagttaccattgtcatctttcatctatatatcagattggaatttatagttagccttaggtttaacttttacctatcaaggattccaaagctagtactgttgggttgctacaagtcctccttatgaagggtgctgaaatcacctaatattttccctctaatacattgacacccaagatatactgaggggacagatttctttctctttttaaaaaaagtcatcaattctgtaggtgtagtctaatgttagctctgaatttctaaatggactgagatcacacctctgtctattctctttgttcttcagttagaaagaaatctgaatctttattaggggattgcataccttcttcatcttggttctaagcataagaaatagcagcccagttgacagaaagcctgaacgtctcagttttcctgtgttgtttggtgctttactgaaaattttgttgttattgtttggattttctaaaatttctgaaatgttttttgatattctaaatttaaaactatgtatgtggggttgtgatttgaagtaggcagtccttagtaataataatgttgtaggaagtactaagggagattcaagtgttgagcctgctggtgcttcaggagtgtacgttaagagttgtcagaaactttctcagaggtaaatgaatgcacaccattggagggcataatagagtttatttgcttttctatttaactgtgataccctggtttatttgaaatcattcctgacacacccagagaattcagagctctaaattaagggtttgaggaacttacagcagaatttagaattctaatgacttcactaattttccagggatccccagagggaacctgaaaagccataatatcctatgggactgagttccctttgtccactgaaagggtaagaactctgtccagatccagatgtagaatcccttctttctctagttcagaggacatttagtttaattttgttagaagacatactagaaaaccgtcatgtgaagtaagaaagctttatttttttcctccctatcgattctttattatgcttatcacagtttttaaaaagtaattatctgctaattccaacatcaggttagataagtctatttgtattgatggatttttctcttgactctgggttacattttcctgtttttacacacctggccagttatttctttgttgcagcattgttaattatcatgttgtagagattatgagctctgaattttgtcagaaggttgttgagtttttgcctagcaggcagtcaaattactaaaggataaatttgatcttatttctaactgtcatgtacagtgattcttctagggagatagggataggggagagggaaaatgtagtttaaaaatcctaggctaactcctgctgaggaaaatcactggtaaactagtgactactctgctaaattgcctctcttgacattgtcaacctgaagccatcaaaaggatcagaatacagagtttatgcaagtagaaagctgggaatggccaatcagagaacacaaactttagaaaatggggtcagtgttcccaaaagctttattttcttttatggacttctacttctttgatggagatgtcaccaattaaaaggtagctgaagaaagacacaggtagggaatttttaaaataactttgccagaaagatacagatacagaatttttaaaataactttaccaaaacagaaaaataatatactttccatattgtactaagatttggcattttactagaaaagggcataagaatagtgacttttctagtcaggctacctgaaatatagtacaaataaaccaatcttgaagtgatcccaaaacacctccttctaatcagtcaaagtagatattacaaaagctaaacattaaagctcatgtactactatcataggggcagctctcaggttccttttcagagtccatttaagcttaagggagggaaaaatgtattaataagctgttatctgttttcctacttcataacaaaatgccagaaggaactgctaaaggtgtgcacagtggccatcaagaagtatgtgactgggccgggcgcagtggctcacgcctgtaatcccagcactttgggaggccgaggtgggcaggtcacctgaggttagaagtttgagaccagcctgggcaacatgacaaaaccccgtctctactaaagatacaaaaattatctgggtgtggtggtgtgcacctgtaatcccagctacttgggaggctgaggcagaagaatcgcttgaacccaggaggtggaggttgcagtgagccaagatcacaccactgcactccagcctgggcgacagagcgagactctgtctcaaaaaaaaaaaaaaaaaaaaaaaaaaagtatgtgactgaggaagcagaagaaacagatacctgttataaacatctgtacctgaaatggtaaaaaatgtaaagtgtttatacttttcttatttaccagttcactggaaaatacatttttatggattaccacctcctctgatgctgccaggtgaatgaggagttagctacagtaataaggtggtaacacagttgattggttatatctaacactatttgtgtggtaccaaaagcacttgtacatatgaagcataatatattttaaaattatttattttaactgcatctgaaatagaaggaaaaaaggaggtttttgagccctagcattaatgagctagggccttcataattaaaaaagtgacctagtgagctgtacctattaggcatcaaatattttaatttttttccatgtgataacagacactttcatttctccttttctgtaatttttctcctgttccttaatacttcttttattttattaaaggaaattcatctcaaggtaaaggtttacttattggactatgttataagatagcaagataatagggaaatggtgtttccagtagaatttttgctaaacaaaatttacatgtctccaagaagaactggttgtcttcctcttggaattaaatgatctgtaggctattggattcctttttttttttttttttttttacaaagtgatctgatctataatttagtaatacggtccagagtccctaagatctgtttgttcttcagtttgtgtactgccagcatttctgtaacactgccactcaagcctccaagtctcagacagcagtgccctctagcagtctttcatttggagattgtgtggtgattgagattacccactggtgacctctctaggtcctcttgagatattttattttaatttaatttttacttctcttactgaacaagcaaagggatttttaatgtttgttgggtgtcaggctttgactttgagggatctattaaagctgtttacctatgctaaagcatcataaactaaggaagtggccaggtaattgtccgtaccatattgtatattcttgcaaactctgttttgacctactagtcactgtttcatcagttttcatctattaaaagaaactgggccaggcatggtggctcacgcctgtaatcccagcactttgggaagccaaggcgggcagatcacgaggtcaggagatcaagaccatcctggctaacacagtgaaaccccgtctctactaaaaatacaaaaaatcagctgggtgtggtggcgggcgcctgtagtcccagctactcgggaggctgaggcaggagaacagcatgaacccggggggcggagcttgcagtgagccgaaattgtgccactgcactccagcctgggtgatagagcgggactccgtctcaaaaaaaaaaaaaaaaaaaatatatagaaactgataaaacaaattatttatgtttataatgagtctggcctcattgcaaaaacattcatttaatattcatctgccaattttcttttttgcttctgcttggcttttagagttcctcatatttttgtgtctctgtctctgtgctttccgaggtctttcaatctcttatgtctctcaatctaaagaaaagatgtccttgtatcagtttcagtggtttacttcaaatcacaacacaaatgaatttatagtttggaaaaatgttgataatattaaaatatgttcatttcctccagtgtgtttgtagtctctctccattttggcagccttttaaatacttacgcagtaatctaatcagaaaagatacagaagacaccgggcatagtggtgcacgcctgttagtgccagtcacttgcggggctgaggcagaaggttggcttgagccctggaggtgtaggttgcagtgagccgagctcgcgccactgcactccagcctgagtgacagactcttgtctccaaaaaaaaaaaaaagaaaagaaaagaaagaaaagacatagaagagtttcttgtggcttttatagtaatttggaggatagaaaagtaagttataggccgatatttgagcccatccaactctcacttcttgctgagtaccacaaaatagtttctcaataaatgtttattaagcagtaaatgtatctctttagtgtttcttcttttattcttaatagttcttcttttattgttaatatagggaattacttgtagtttttcccaagttattttcatgagaaccaaaacaatatactagtacagaaatgcctcaaagtattagatgaaaactgcatttagtaaaatgcgtaggcattatttcgagagcatttatttcagtcagatatattcctttcttaaaatttagtttgaaagtacatgtattattttaagagaaacatgccccaaatacaatgactttttaggaaaacttgttttttaaaagtatttgtggtacctgtgagtttatccttgttttctaattttgccatgctcggttgaggtatagcatgacatggttggcatccttactggaaagcttccttgtgcaatatctagtggaattgttagggtaaacagtatcttcaggtatattaggaaaattacttgtgcacttggattatgctctctgtcccaagtttcagtcattgctgacagcgttcagtgtgggatgcgcagtagcactgcttccattgtattcttttgttaagaggtttggaaagagagactcctgacttcaggagtttttagaaaaagcattccagttttttctagttctagaggccttgataactttaagaactgaaattttaatgtttattgaataccgtgatgtcagtatacagtaatcttaaaactatgttaaaatgcacttgtgtctccaaacatcctgccttcttttgtgactacatccttctcttagccaaaataacaagctaactagagtttcaatattcaatatccttctctggcagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgctatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcaatgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatga

SEQ ID NO: 540 - DNA, 3729 bp, Homo sapiens
aggcgggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcaggtgagacggacgtggtgcgcgttgccttctggggtttgtagttcacgcatggctgggacggggcgggcagggaatcgtgccctgagccctgttttgcctgggctatttgtgggactcagactctgaccaggggggcgggatagtaacccagaagtgcttcaggggcttaacgcaagtcagagagtaggaattataaatcagtacgtttttctatgttggggtagtagaggtactttttttttttttttaattttctagttcttgcaaagcactttttttttttttttgagacagagtctcactctgtcacctaggctagagtgcagtggcgcgatctcagctcactgcaacctccgcctcccaggttcaagcgattctcctgcctcagccctccaagtagctgggactataggcgtgtgccaccatgcccagctaattttcgtgtttttagtagagacagggtttcaccatgttgaccaggctggtctcgaactcctgacctcaggtaatctgcctgccttggcttctcaaagtgctaggattacaggtgtgagccaccacgcccggccaaattttttttttttttttttttttgagatggaatttcactcttgttgcccaagctggagtgcagtggctccatctgggttcaccgcaacctccgcctcccagattcaagcaattctcctgcctcagcctcctgagtagctgagattacaggcatgcgccaccactcccagctaattttgcatttttagcagagacagggtttctccatgttggtcaggctggtcttgaactcctgacctcaggtggtccacctgccttggcctgccaaagtgctgggattacaggcgtgagccactgcgcccggccccacatttttaaattttttttgagacagagtctcactatgttgcccaggctgctctcaaactcctggcctcccagagcgctggattacaggcatgaaccaccacacccggcttaagcactgagtgacagccccatgtaaagctcttgtctatacactagctcatctaattgtgatggaatcttctgtgagctccatttgtcagttgaggaagctggcaggagaggcctgggtgcttgctcagaggtccctgaggcatcacctcaactctccccttcttcagtgtcttcttggagccacccatgggactgcatgggcaggtgctggcttggggcggggccgcctcaaaagaaggctgagaagtcaggacagtgggaggcctggcaggttttgggggaagcagggaggaatctgtggatgggaggtttcatacgtcccaggcaggcctcatccagtctttccctgcagacagaggtgttccaggccttgcagcggctccatatgaccatcttctcccagagcgtctcaccatgtgggaagtttctggcggctggcaacaattacgggcagattgccatcttcaggtaccctctgccgctgtccacccattagccctggcacttggccctcatgggacggatgcccccgtttctgactcctgggtcccctccgctgtccctgcagcttgtcctctgctttgagctcagaagccaaagaggaaagtaagaagccggtggtgactttccaaggtgggtatacctgtggagtctggcttcaggactttgggtgggattggctcactcagttctgcatttctctttagcccatgatgggcccgtctatagcatggtttccaccgatcgacatctgcttagtgctggggatggggaggtgaaggcctggctttgggcggagatgctcaagaaggtaaggagtcgagcttgggaaagggctggggtgcctggacccagagagagcctttgaggtcacctggtattttctcttttgaagggctgtaaggagctgtggcgtcgtcagcctccatacaggtgagcagggccacgtggatagagggtgcatcagggtgaagccacttcctcactgaccttgcctttccttccccaggaccagcctggaagtgcctgagatcaacgctttgctgctggtccccaaggtctgagccccatgtgactgttcttggtccaaactttgatccttcaccctctgcctatcctgatttgacattgactttctgcctcatcctgctcctccacaggagaattccctcatcctggctgggggagactgtcagttgcacactatggaccttgaaactgggactttcacggtgagcagggtcctggagccctagagcaggtctaggtcagggagaggcactcttcctaggtctcctcctgacatcgcccctctacatgcagagggtcctccggggccacacagactacatccactgcctggcactgcgggaaaggagcccagaggtgctgtcaggtggcgaggatggagctgttcgactttggggtaagcaggtggctggttggagggcaagatggcagtgaaggaggctgaggcaagtggggcaccactcacagttctttccccgcagacctgcgcacagccaaggaggtccagacgatcgaggtctataagcacgaggtgagggtgtgaccgtggccattgtcctcttctcccccaactccttgaattctccaggtcttcacctctttccctcctcccctccccatcccaggagtgctcgaggccccacaatgggcgctggattggatgtttggcaactgattccgactggatggtgagctgggcagactgtgggatgggatggcagctccgggccctgtcagctgtgggcctgtggttcacagctggggactcccacctttctgtccaggtctgtggagggggcccagccctcaccctctggcacctccgatcctccacacccaccaccatcttccccatccgggcgccacagaagcacgtcaccttctaccaggacctggtgaggccctgtgtctcacttctgccacccccactgactcttcccttcagtcctgacccctgagcaccttccctgtcctctgcagattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtgggtccggcaggggccgcggagcggctgggaggcaggggtgtgggcaggccagtcatgcccctctttcctccaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccatg

SEQ ID NO: 541 - DNA, 6684 bp, Homo sapiens
gcgccacgtgtgcgtaggagcgcaccggaagcgcccggctggaggcgcggcggcagggctgggcggcggcggcggcggcggtcatggaacgccaagaggagtctctgtccgcgcggccggccctggagaccgaggggctgcgcttcctgcacaccacgggtgagtcgttgcggggcagccgggcgcgcgccgccacttttgcgacgcgcagccatgatgggtgggtcgtccgccgctgcaccgggcgccggagcctgggaggcctgggaacggtcgggcgttggcgcttacgcggaccttgggcagcaggcccggaccttgcgcggaggcttctcgggagccgcacttccctgggcggctcggctgtcccttgtttgcgcaagtcttttttgcgaaccaagcccttcctgtggtagttactggggtcactcggccgttggcgtttgcctctgggacccgtcccacacagccccatacacactcctgactccccgcgctgtcacccctttctatgtggctctgaaaggcctttgccttcctgattcagattagttgctcttcattcttcaaaacccagttgctgtgccctccacactctaactgcccccgactccccagatggttgggaagtctcacttctcagtgatccctgaattgtcgcacttcttgagttcgtgttttaacgatctacttaggaggctttttcctcagcctagaccatgaaggctttgagggcaggagttacactttgtgtttgttgagtcttatggaaaggtcaactagtagtgtcatttttagttttttgaaaactgtttttcttttcagtgggctccctgctggccacctatggctggtacatcgtcttcagctgcatccttctctacgtggtctttcagaagctttccgcccggctaagagccttgaggcagaggcagctggaccgagctgcggctgctgtgggttagtgcctgataaccgaaatgaaagcggtggttttgcacctcctttatattaagagttagtctcttagtaaaagtaagaggggccacacaggaagaccctgtctctatttaaaaaaaaaaaaaatagccgggagtggcggcacgcacctgtagtcccagctgctcaggaggctgaggcgggataatcacttgagtccagggagtcaaagctgcagtgggctatgctcgggccacactacactccagcctgggcaattgattgagaccttgtctttaaaaaaaaaaaaaaaaaaaaagtaggaagtatatggttctcggtggggcgcggtggctcacacctgtaatcccagcactttgggaagccgaggcaggaggatgacttgaggtcaggggttcgagaacagcctggccaacatggtgaaaccctgtctctactaaaaatacaaatattagtggggcgtggtgacgggcacctgtaatcccagctattagggtggctgaggcaggagaaatcgcttgaacctgggagctggagattgcagtgagctgagattgtgccactgcactccagcctgggcaacagagtgagactgtcttttctttcttttttttttttttttctatgagatggagtctagccttgttgcaaagagcgagactctatgagtagacgttatgaatagaaatgagttcatttctattcataatgctatttggaaggatttttcttttctgtagaaacaaatacttaagaatcttctgcgctaattaagggatggataatgatttagaaaactttatatttccttggtagtcttccaggattctagtcagcctagagactgtgggtgtcactgaggtatccaagatgtgctctgtgtggccactatcccaggctttatgaatcggaattgctcaggggaactcagaaattggcatttctaacagatttctggtgatgtagatatttcgggctaaaatccgtggctcagcaacagacccctgccccctgaagcagtaaaatgtatgcagaggggttaggagtacttatgtaaaaatatgttgtttcattgtctgatatccatacctctttatacttttaataatatggacactcaaaagtttctattttatattgtacacagtgctttatctccatttttttctgacattttagaacctgatgttgttgttaaacgacaagaagctttagcagctgctcgactgaaaatgcaagaagaactaaatgcgcaagttgaaaagcataaggaaaaactgaaacaagtatgaactggtttcagtttgaatgtgtgcatagaaattgtctgaggtttagtggctaacgatgcctgtgtctgtgttgtctataagcttctaggaccaggtcctatcccattagattcaataagcatttcagttcctaccatgtaagtattggtgatatcaagaagaatacacgattgttagggaacactagatgtgtgaatatattaccatgaaaggtccagagcacaaaaggagggacaggctggagcagggagcatgtgagtgtgtgtgtgcatgtgcctgtgtcttccccattaccaaaaatgtcctgacaggagtgagtttcagaagaatggagtcagtaatctttttcatgaaacattttgctttctttaatagtgtacaaaaaccaaagctgctctatgtgagttaaactcacactaccagatcacaacagttttattaactaaagaaaacgagggtgaagtttgttctgaaagacatttaaattaagaattatcagagttagctttgtctttgagagaaatggcagcttctgaattctttctgtaaaatgtgattgtttctcagcttgaagaagaaaaaaggagacagaagattgaaatgtgggacagcatgcaagaaggaaaaagttacaaaggaaatgcaaagaagccccaggtgactggagacctcggccggctggcatgcggtagatgaagattgccaagtagaatgttttaattgcttcttacactactgtgtgtgttcaaacaggaggaagacagtcctgggccttccacttcatctgtcctgaaacggaaatcggacagaaagcctttgcggggaggaggtaagcaccactgatgtcaaatgttaacagattttcaacacttacaggatatagttaccttttaggaacaagattgtttgtttctttgtccataaattaagactaattccttaggattgtgaagattcaataaaggaaacagatgcaaatcacctcctaggtcctcactaagtacttagaaggattgtacttatagtattctaacttgatccttctgcagccccgtagagggagagctaagtagggtgaggaattgtctgccaatcttcagatgagtgtcaaggagctggaacacagtggttttggtctttctggctgggaccaccttgtttcttgcaaataacaaggagtagcagacagatgctcatccaaagctgcttcctgtgtgcagcactgccccggggactctggatgatgccacagcagtctgtcttcatcccatccctgagaatttcaaatctgggaagatgggactcacaaacgaaaataagcaatccttggtgattctggctaagagttgcaagttactgctgaggaaggaaagaacaaacacactagaacactgtaggaaccaaggcggaagattttgtatcctccataggaggagaggggcaccgcagaggccctgatggtgtctttgaggactgaggaaagactggggcatgggctccaaggcagcagggccacagacttggctgaccttaaacgctgagctgtaatcccctttgtgtcagaagactaaacctggcttgctgtagagaaggtgatgcatctggaaagaaaatgctatttttaaatggtcctgccggaagcttatttttagacacatagaggtgatatttaggagaggaatggaaatcgtagaagatggaatgcagggtgtgcttgcctgcacggcctctttcagcatccccagcatttctgagctgggacttttgactagcctggctttacaaataaggaaactgaggcacagtgtttaattgcccaaagattccactataagtaaggagtaaaagtaacatttaagttctgggtggccctagaaccttagcactcaaccaggttaccagttgtgcactgactttgggaagctcatgagggagtggggtggttgggggtagggaaggatacagaagaccccgttctgactggtagaagtgacaagtttgactcttgattttttttaatctgttttctgtagcgtgaacagcccttatttgaatgtatgagttttagtaagcactgtgataggaggattcatatacttaaatcaggccctcttgagagagttttttggtgacccttttgcatgtgtttcggaggttgggacaaagaagctgaatgacttttttccccaccagacaatcagttcaaatggcaatcacaatataaaggtttttttttttttcacatagctaaaaggtttttttaaatgtcccttaggatctgtatctttgcagtgctttgcgtgtcactctcataattttattgtggatatacaatgttcccagattttcagatttttatcaatactgttgtgctgcttttctgtcctcccaggttataacccgttgtctggtgaaggaggcggagcttgctcctggagacctggacgcagaggcccgtcatctggcggatgaggctaagaatcttgttagtgtcacttttgacattagcaagatgaacccttaaccctcgattcaattgccttacgcacgcttttcacagtgactagccaaggggaggtggggttgatttctgttcctaactacacctgcatatgtcagggctccagtcagcaaaaggtatagatgttgcctctaggcatgaggtcattggtcacattctacttggagacagtgattgcattcattgatttcatggttaattgctagttggtaggtaaaggcctctagatgattagcaatcttgataaaagaggcctagtaatgttcttttgaggttagaaatccttgctgctaggacagtctctgtgacaggttgcgttgaatgatgtcttccttatcaatggtgagcccaccagtgaggattactgatgtggacagttgatggggtttgtttctgtatatttatttttatgtacagaactttgtaaaaacgaaactatttaaaaaacaagaataacatttttagcatctttattcaaggagatttatggacttcaatttgtctatcaaacattaaatagctttttattacaacctctaactattacttatttctctatttattattactcacccaaaataagtctggcaagtggcagacagctgccgtgattttgaaagttgacagactccttggggttcatccacaaaattgggtgcttggagtcgagttgccgaattactgggataaagaaacatcgtgcctcaaggttcctcataggctgaccaggtttctacgtgacctctcagttattcccttacgccatgactcatcttttacgctcttgtccagaggcactatcagcagttttggataaagagccaaacagtaaatattttagactttacaggccacatatgatctctgtcacatagtcttaggtttttatatttttaaaggattgtttttaaaaaagattctctgctcatgggctggatttgggctgaatgctgtagtgtgtggaccccgtctagatcatcagaaggaaaaacattaaccttcagaatagggggtaattcgctgcaaaagtactatagaatggtctcatacataaattagtcaacatttgttatctcctgcaggtagaatattccgtggttgcttcttgaccaagggaaatacagtctggctgtgagagacttaaaatctcttgaggagcgctctggagaatggctgaaggagaggaaacaggagccttgagcagtgtaattacaaacaaataggttggcatagtcttaagtctttgagtctagagagatttgagttttgttttgcctgtggaggcaattgggggtttcaggtcaaagagagggtcagtggaaacaagggtgggccttgtgaggtgtggggaagccctgggaccctcactccccttccagtgtgtaactggattggctcccaccagcccagaagatttacgacgtgggaaatggtatacttggattaaaatatttcatccagatttgtttacatctagagagaaccccttgtaggttataaggaaactttttaacattcttccttgaatatattttctgtagctgaaaatgtttgtgaagtggctgtcaactacacatcgcatgagtagaggggctctgggtcggggtttcatatgcagcagagcagctcccttgctgccgtccatcaagagccctcaacacaagagtttgttataaatagaaataaacgacaaaaagtagaggggtatgtttaagtacactattagatgtgactgactaccttgaaacctgatttttttccatggggagaaacagtgcttgaattctgcatgccccccttgcatctagcaccttttggtaggggtggaaggagggtgtcagggagaatgattaggagataatggaggggaggggaaacttgcgttgtgtaatagcatttgaagagcactta

SEQ ID NO: 542 - DNA, 14644 bp, Homo sapiens
gtctccttacgccacccgcaacccaagccagggccccggtgacagcggcggggtgggccaggaccggggagggggtgcccagcagcgacccccggctccccctaaggccgggcgcagctcggagccaggagctggcccggcgcgtggcttcccggaaggcccggcgcagccggaaggtgggacggagggcggggccagcgccggggccgccaccaaggcctgcgcgaccctccgcggggctggggagctgggcggggagcccggggcctgccaggcccgggctgcagccgcgtctgatcgccgagcgcgccgcgtagacctccgctcccccaggtaaaggagcgcccggagccggggcggggcgcctcccaggccgcgccccgcgagaggagggggcaccccaagagcaggcctggagacccgggagtgccttggggagagggtccccgccctgccgggagcccggccctcccggtgccggggtggacactgttagtgtagtcattgtccctatggagaaactgaggcatggagaggctgaagtcacacaagtaagcagcagagctgggactagagtcccgggccctggctcgctgtcacccaggagtggcgtaggcatgggtgtggtgggtgggggtggggtgcgggtggtggatgtggtgggagtgggtgaggttgggtggggtggggatgtgggtttggcgggggtggggtgcggaatgtgatgggtaggggtggggtagagtgggggtggctggtggggcaggggcggggctgggggtggggtgctaggtattataaatgtgaagcggatcctgacaggacacctgtggggcagcggagctgggctgagccatatgggaagaaaatctgggcgctagtttagatttggtcaggaagggtcgttaatgctttaggaggtgagattagttttggggatggcaggtagtttgttgagcttttgtttagacagtcttgctctgttgtccaggctggagtgcaatggcgcgatctcggctcactgcaacctccacctccctcgttcaagcaattcccctgcctcagcctccctagtagctgggattacaggcgacaccaccaagcctggctaatttttttgtatttttagtagagacggagtttcaccatatcggccaggctaatctcaaactcctgaccttgcgatccacctgcctcagccttctgcaatgctgggattacagacgtgagccaccccgaccaatttttgtattttttagtagagacggggtttcaccatcttggaatagcacctgtagttccagctactcgggaggccgaggcggaagaattgcttgaggccagttcccgaccagcctaggcaacacagggagactgcgtttctggaaaaaacaacaacaacaccagcaacaacaaaaagcaggaaggaaggggagagggaaagagaaagagagagagagagaacgaaagagaaagagaaaaggaaggaaggaaggaaggaaagaaagaaaaaaagaaagagggatactttgagaagctttgaagtgatctgtttattgatcaagtagataggtaaggtgcatgctgccaggaggagctggggtagggagggcagggccctgctgtatgggggtgggcaggggacggcccctgctcagccctggcctccattgctacacagaatggcaggtccaatgtgatctggtcttctgatttttcaggagaaatcaggaatctgaggtgcatgcaaaatctcctgatttttaaatattggcaactaatttgttttaaaaaaacaacaactatgagctaatccaaaactgtttgctggtgggatccacctactgcctttgcgctggggtatggagaggtgggaggtcaatgttgacaagagccagatctaattttttgttaaagaaaagggtacttggaggtcagatagctctcttcatagctatctgaagccttcctctcccttatctcttacaatctggtccaaactcagaaagctaggccgctctcggtgagatgggcttgtctccgtctctctgtacctgtcagagcagcctgggcgcctgcaagaaaccggggcttccagttggcatttgccttccctgtggctggcagatgggcttcctgtgatcaaggcctggtatgtggataaatctgagtgtgaaataggtgtgatacagtgggggagggggagccacactcccaccccctaaggtctgtccccatcctccctcctcacccacttccctgtcatttacagacaaaggcagccttgcggtgggagaaggagcagggtgggcttccctctcaatctggtgagcctggagaattcaggaagctgagctttttagcaagggctcaggagatggagttactaacctttcttccccaacaagagcctgttaatgctctaacttctgaaatgattactacaaagaaattgaaccttggatggagtcagccacaacatctctacccgtggtgctggactattaaaacacagtgacttcctctgcctgccctcacacacgcagtgatagctgctggccctcccattctgcagaaccctgggcttgtgtctcagtgaaacctgcctcattgtctgagatatcactgaagttctgggtctcatggccaaggaaatcaaggacgcagacactccagagggtaggttagagcagaagtttaataagcaaaagaaagaaagctctctggatcagagaggggtcccagaaagatgggttgccattttacagtgaaatgcaagggtttttatagaaaagctggtgggaggggtgcttcatttacataaggtgcgaatttctgagtcccccgccccactgtttctagtgcacatgtgggcttcttagcctgagttactactccatgttgcttatttcttcctactgtgcatgtgtgaaaaaggttgggtggtgggggggaagaacactccaaggtagacatgcctggtccagggtagctcttcttatcagtgccatgcaagcctctgtgtctgagtatttcttttttcttttttttttgagacggagtcccactctgctgccaggctggagtgcagtggtgtgatctcagctcactgcaacctccacctcccgggttcaagtggttctcctgcctcagcctcccaagtagctgggattacaggcgagcaccatgacacctggctaatttttgtatttttttagtagagatgggttttcaccatgttggccaggatagtctcgatctcttgacctcgtgatctgcccacctcggcttcccaaagtgctgggattacaagcgtgagccaccgtggccggccgtgtcttgagtatttctaagaagggagaggactgtgcttactggggcccaccatatgtctgtatgtcacacaggggacccgctttctgtgttagagcttgccttccttatctgtgtttcctgaaagggcaacgacttcttaggctgctttttgttagaagggaattctgccaaggacccttgccctaactatttgcctaattgatttctctctctcctctcacattgatgctggcctggctggagcaggtagagctggaagtagcatttttgcaaggacatctctttagcctctgtagattttcacctcaagtcattcggagcaggtcggaagctaggttttttttggggggggaagccagtagagctaaagtggttatgtatctgtttcctgccttccttctttccacttctacatgcattttcttgctgtgcagaaactgttttgagagtgcagacccaaaactgcagaaaacctgttttgggagtggtgtctgggtgctggcctggaagccagccttgcagaccaagcatggcagggctcagggtcttcacgcccggggaaagggaggttccttgcagcctccaaaggggccctcctgagacctgggcagtgcctctctttttccaatataattgacagatgaaaagctggatataaaccagaactaagctcaaaggtgattagatattttacaccaggattttgagctttttgtaagattttactgtaaaattatttcctttggttactttaatatgtacttcaaatatatctcattttgtgctggacgtagtggctcacgcccataatcccagcactttgagaggccaaggcaggcagatcacctgaggccaggagttcaagaccagcctggccaacatggtgaaaccccatctctactaaaaatacaaaaattagccaggtgtggtggtgcatgtctgtagtcccagctattcgggaggttgaggcaggagaatcgcttgaacgtgggaggcggaggctgcagtgagccgagatcgcgccgctacactccagcctaggtgacggagcagactctgtctcaaaaaaaaaaaaaaaaaaaaaacctctctgtatatctctatctagctatctatgtcattttgtttgtgtgatagcttttcaggaccatggtgactggataaatcaggttctgcgctccgtctccccatttccaggtggcttctgcctgttcagtcctgacactgttataatgccattttatcgtttagacatttgtatgtaaacaaatcttgaccactggaatagtggaagggggttctcttctggggagaaggaggaggcattcaacctgtcagcaagcaaaggagctgggcagggcctggaaagcaggagaccaggttttgggagacccagggcacagggtagccagagcagggacccccaggcctgagtgctcctccagtcccttatgtgagcagggctcacaaggcctgccctcccactgcctctcatactccatggggacaaaaagacatatctaggggtgcttgtttgcaatttctgaatttgaagactgagtaacgaatgtcagagtcctgcgttatgccctcttggggtcttgctgcccaaagtgagatcagaggagcactttgggggcttgttggaaatgcagaatcttaccctcccatactggctgtatctgacaaggttttcagtgattcccgtgcacttgtggagaatcacaggtctaatgtgtaccaacggggaaaaagaagggaaatttacaggggcaggagcgcaggatgctctcctgggactgcagagaagttctgaggacctggctttgcggtcctctcatggattcatgggtttgttctctgggctcaaaattatatcccaggattgggagagcaattttacagtagggacttctgcttctggatcatccttgggtcagaaaagcacacatgtctgggtacggtggcccacacctgtaatcccagtactctgggaggctgaggcaggaagattgcttgagctcaggaagtcaagaccaggctgggcaacattgcgagaccctgtctctatgaaaacaaaaaattagctgagcgtagtgttgcatgcctttagccccagctactcaggagactgaggtggggggatcactgtagcccaggagttcaaggctgcagtcagccatgatcgcaccactgcacaccagcttgggcaacaagagacactgtctcttaaaaacaaacgaacaaacaaaacaaaaaaacctcataaaacatataacccaaagatattaaggtcaaatgtagtggctcacgcctgtaatcctaacactttgagaggctaaggcaggaggatctcttgagcccaggagttcaagaccagcctgggcaacatagtagtcatctctactaaaaataaaaataaaattagctgggcgtggtgattgcatacctgtagtcccatctactcaagaggctgaggtgggaggatcgcttgagcccaggaggtcaaggctgcagtgagttgtgatcatgccactgcactccagcctgggcaacaaagcaagaccccatctcaaaaaaaaaaaaaaaaaagataataagcaatagaatctatccataacttcctcagttgaattgctgtagcacctgtttcaatatttccacctagaatgaaatgggaagtgctggtgagaaagggaagtactgctggagccttgggctcagccagagctctgaggagaccccccacctcatggcccctttgattttctcagcctttgggctctccagagcccgtctctccctgccctggctccagcatgccacacattttccctaccctggaggattgtgctaaaggtcattgtgctaaaggtctactcgcccgtccgtctgtctattcatatatattgcaaagcctgggaatgatttcatgtattttttctccagttgctttgtctccctgctttatcttttccctgcttttagtgtcccatgggtacaactgtgttgacttttaagaacagttgcttaaggcagcccagtgtgtgtgttagtaacagtgttcgttcagagccatcctgggtcgggagcctgcaggcttccagacttacgccaggcacttcctgcccatcctgctggcactgtctgagagtccagcctgtagggactgtctccgtcttagaagggaggtatctgaccctctgctcagggcccactgcaggtcagtgcccgtgtggtcacagggtcccatcccttccctggctctggcttggcctcagctcagatgcctcacgccgggacttcccgttctctgctgggctttgtgtgcagggcattccccgggccagtgcaaaggccactaatgccagaagggtcagaccacctccctcgtgatgaaccagcagaacatgtggccgggttgctccttaatctgtcgtaagtcagaagttaatcagagggcaaagaagacctttcatccactcagctgctgctatttgcttattcactaactgctgcctgtcctgtctgtgggaactttccaccgtctggatgctgtctgtcatacaggcgcttggagctgctgagctttcctgaaaagggggacccttccttaaaactctaggaactagagtggcattgtgatggaaatactcttatgctcattgaaactgtccctctgaacttctccctcgaaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttggtaagtgcaggtgtctcacagagatagccagcctcggggatgtcataaaagggccgttgaaacacagggagaaggccaggcacagtgtggctcatgcctgtaatcccagcactttgggaggccgaggcgggcggatcacctgaggtcaggagtttgagactagcctggccaacatggtgaaaccccgtctctactaaaaatacaaaaaatagctgggcgtggtggcgggtgtctggtgtatgtaatcccagctactcgggaggctgaggcaggagaatcgcttaaacccgggaggcaaagattgcagtgagccaagatcatgccattgtactccagcctgggtgacagaacgagactctatctcaaagaaaaaaaaaaaaaaggaaaaagaaaaaagaaaagaaacacagggagaaatgaacttgtacaagtggtgccatgcgtcttgtgggaggagttggtggagttaaagatgcctctgggaaatgatctttgtagatataatttgccccattggaaatgcaggcttctgtgtgaatgtctcagaagtgtggggtactcttgtaaatggcatctgtgtcatttgggcctagaggcatctttcccccagtgctgggatcccagaataagtatcagagcagcaggcctctgaagataccagggtgtcctgggtcccatggtggccttcatgactgtgaggtccctgcagaaaggaaaccagggaggaggctgggaggagccatgcaccttctcagcacatatggtgtggccatttcatgtgagccagctcactctgagagagctcccttgttctgaaagagaccaccaaaagaactgcctttcacccttagagggcctgcccacctcctttaccacctgcttttttctttcctttttgagaccgagtctcattctgtcgcccacactggagtgcagtggcatgatctcggctcaccgcaaccactgccttgtgggttcaagtgattctcctgcctcagcctcctgagtagctgggactacgggtgtgtgccaccacacccggctaatttttgtatttttagtagagacagggttttgtccttttggccaggctggtctcaaactcctggccacaagcgatccacccgcctgggcctcccgaagtgctaggattacaggcgtgagccactgtgcctggccatttaccacctgcttctatttgagaatcaatttcaggcaatgaatgaaagtttggctaatttttccactgttccttggagctgggatgaagttactttctttggcttggggaaggaagaattcctgtgtcctgagcctcagaaggtctacctggcctggggctgtggcccaaaccatagatggagtcagagagctgaacttttctgctgaggttggcttccgttccccagctcgctggccgggttcctgccctgttcttcccttctgtagtgggattgacattcaaggacatttcgttaagctgaggctcacactgaggagaaaaataaatgtgtgggtggccccagaccttccctttccatattttcctttccaaactccatgaattagtgaggcctgacttcagcatcttgccatccgggaaggaaccggagatgggggagacaaggctgtttccttcttcctcgatgacactgtgcatctgtgcccccacctccatctcagtgctcaggggaaggctttggggatcattttgtcatatagctgtgcccagatgctattttgggagcacatattttattcagattgagtaaaagctggtagagaacaggatgtccactaagagagcccgggggattcactacttccagtccctggtcatgggcgggagcatcattttaccctgaaaacaaaggaattttctcctctccaaagagccagtaatttgctggtcgatattcctggcgactttttgcattaagtgctgctctaaatcaaatattgatgttctcataaaggtttagtgcacatgagtgcaactcttgtcgacttggagcatttcactggtgtcatggggaaaagttcagtaaaacttgtaaattagctggttttcccttcccagaatgtgcctttcttttgcagaggaggtgaaccctgtctgcgtgtggcattcagcctctgggatatggggctggccccagctcagtacccggggtggtgtctgctccaggggcctcggtgcttggcttccagaagaagcaagcgctggttttgctgcctgttgtctgagtccagcctgccagtgggttctctctggcctgggttgcatttttgaaagaaacttttcatttcccaataatattaggtttacagagaagtcgtgaagatagtacaaaggattcctgtatatcttccatccagtttcggttctcctagcgatcacatgtattactgtatgcttgtcaaaactaaaatgggctgggtgcagtggcgcatgcctctgtagtctcagcactttgggaggcttgaggctgaaagattgcttgagcccagcagttcgagaccggactgggcaacataatgagaccccgtctctacgaaaaataataaaaaaaaaattagccaggcatggtggttcatgcctgtaatcccagctacttaggaggccaaggtgggaggattgcttgagcctaagagtttgaggctgcagtgaggtatgatcacaccactgcactccaacctgggcaacagagtgagattctgtctaaggaaaaaaaaaaaaaaacctaagaaaccaacaccaacgaatacattactattaaccattctccagacttgatttgggtttcaccagtttctgcattaatggccttttttttttttttttttttttggtttcaggatccagtctaagacaccgcattgcattgaatcgcctgctttcttagtctcctctggcctttaacactttctcagacttgccttgttcacagccttgatagttttgaggagtactgggcaggtatttcgtagaacatctctcagtttgaatttgccagttgtgtttaggatgggactggagttaggagtctttgggaggcatgcctgggaggtgacatgcccctctcccttgtcttgcattaattctgggggtgtgtgatattcacatgacgtcagtgatattcaccttgaacacttggttaagggcatgtttgctgggtttttccactgcaaagtttctgtttccctttccatactctgtctgttgaaagtgagtcactaagtctagtgggcttcatctttaaatatctgattggtgatatttaaaaatcgtgagatgttttaaagctacaaatctggtattttgtgtggtagcaatgaactggcgtgaagtagccactgccactccataggaaccaagctgtccagctcttctgtgtcctgggcctcggaaggtccatgcgattcaaggcttggttggcccagactatagactgggatgaagtcagagcctgccacccatccaatctcagcaggggagaggccgggtaaggcccaaccgccccttcactcttcttagttcctccctggctcttggaggcacttgactttggaccccttccctagggcaccttccgcttctctgcaccatattctgcacgtggcctcttcaggtagaactttccgtggatacaaggtctttaagtcccagaatagcatgacatagccttggcaatgagtttacatttaacaataatgtttctgcccttttagggtggcagaagtagaaatagtaagctaccttacatttgatatttatttttatttttttgagatggagtctcactctgtcgcccaggctggagtgcagtggcacagtcttggctcactgcaacctctgcctcccgggttcaagtgattctcctgcctcagccagtagctgggattacaggcacccaccactatgcctggctaattttttgtatttttagtagagacagggtttcaccatgttggccaggctagtctccaactcctgacctcgtgattcgcccacctcggcctctcaaagtgctgggattacaggcgtgagccactgcgcccggccagtttgttatttatcgatcatacaacttggaggggatctatgaaaagcactgcttcaagaggaaagagcctccttatctgtccccaggtcctttaaccacatgggctcactgaagattttctaagttcaggggcaaggagcatatcagctgcctggtggaggaaattcagtctcaccactgagatggtttcttttttggagacagagtcttgctctgtcacccaggctggagtgcaagggtatgatctcggctcactgcaacctctacttcccgggttcaagtgattctcctgcctcagcttccaagtatctgggattacaggcatgtgcccccaagcccagctaatttttgtatttttagtagagatggtgtttcaccatgtcggccaggctggtgtcgaactcctgacctcaggtgatccacctgccctggcctcccaaattgctgatattacaggcatgagccaccgcacccagcctgagatggtttctcttgaaaatgcatttgtggctggttgtggtggctcatgcctataatcccagcactttgcggggccgaggtaggcggatcacctgaggtcaggagttcaagaccagcctgccaacatggtgaaaccctgtttctacaaaaatacaaaaattagccaggtgtggtggtgtgcgcctgtaatcccagctacttgggaggctgaggtgggagaatcgcttgaacctgggaggcagaggttgcagcgagccaagatcatgccattgcactccagcctgggcaacagagcaagactccgtctcaaaaaaaaaaaaaaaaaaaagaaaagaaaaagaaaatgcatttgtttctcagccttctcctttgtgattagagagggatttttacagtaagcccagaaacctccgtcagctcatgaagaagaaagtgggcccagcactgaggtgggagatggggcaggcaggcttcattttgcatccttaaatgtggagcccagggaatgcatgttgggtgtcaattatctgagccaaatggacagaagactgcataaacctttgccctccacactggctggcggagcaggcgtggcaccggctgagcccgctgcagcccgctcatgaatgtgcctgctcatggtgatggtggtgtgcactcagtgggaacttaagtaaggccatcgcttatgaataagacccactaattgaacgattccatgttttctagggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatgtacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagccattttcccacatattatgtgtaaaatatctctaatattcaaagtcttacaaatggaacaagagggaaggtaccagatttgtggctttaaagaatgcaagagtaggtcaggtgaggtggctcatgcttgtaatgtcggcacttttggaggccaaagtgggaggatcgcttgaggccaagagtttgaaactagcctgggcaatatagtgagacctccatctctacaaaaaatgttattccttggtccccaggtcctggggcagggcagggacttggggctctcctctcaggccctggaggctcggagggaggcacttctgctgaggccctgcttataggaaagctcag

SEQ ID NO: 543 - DNA, 6014 bp, Homo sapiens
ggctggatgaaggactgggcgagcaccgagggcgtgaacccggaaggtggcgcggccaccagtaacatgatctctagactgggacggtggggttcctgccggctgtattcgggccttggactggactgagaagctacggtgcggatccagctggggtatcaggggctaggcacgtgatgaaaatgaaggacgcggacaccaggacaggaatctcctggttcttagagaatttatttcgccacaaataattggcaaacgggatctcgctgtattgctcaggctggtctcgaactcctgggcacaagcgatcctcacgcctcagccttgcccaatgttgggattacagacgtgagctaccatgcccagcccaggattcttttaaaacttaaatctgatcgtgcctctggccttattggaatccaatgccattaccacctccaccaccacacatcccgtctccagccaccctggccttcattcaggcctttgtgttttctttttcttttcttttttttttttttttttgagacgagtcttgctctgtcgcccaggctggagtgcagtggcgcgatctcggctcactgcaacctccgccttccggattcaagcaattctctgcctcagcctcccaagtggctgggattacaggtgcccaccaccaagcccggctaatttttttgtatttttagtagagacgcggtttcactatcttggccaggctggtcttgaactcctgaccttgtgatccacccgcctcgctcggcctcccaaagtgctgggattacaggtgtgagccaccgcgcccagcctgtgttttcttattagtaattataaagggaatcttatttgacagttctttgacaaataattcagtttgcagaggggatcctgccccagaggccctggcttggagtggaatgcagggccgtgtgcaggagagcctgctcaagtgccgcctggcttttccctccttaggtggagaccatccatggaaaagaacccccctgatgatacgggccccgtgcacgtgcctttggggcatattgtggccaatgagaaatggcgcgggtcacagctggcgcaggagatgcaaggtcggtggcctgccctctgccagccctttcctcccctgacatattaaaaaaaaaaaatctgcctattattgccatcttttcatccaaagcttatggaactcattttcttctctgtattttaagggaaaattaagctcattttcgaggatggcttgacaccagacttttatctgtcgaacagatgctgcattctttatgtcaccgaagctgatttggtggcaggaaatggctacagaaagaggcttgttcgggttagaaatgtaagtattaggctgggtgctgtggctcacgccagtaatcccagcactttgggaggccaaggcgggtggatcacctgaggtcagtagttggagaccagcctggccaacatggtgaaaccctgtctctgctaaaaatacaaaaattagctgagtatggtggcgcacgcctgtaatcccagctactagggaggctgagacgggagaattgcttgagcctgggaggcagaggctgtagtgagccgagatcacgccactgcactccagcctgggcgacagagtgagattccaactcaaaaaacaaaaaacaaaaacaaaaaagaaatgtaagcattggattaaagaaactcgaacattgatttgtctcaccccacccttccctccatcccttggtatcatttatttaaaatcattggccaggtcaggcacgaagtgatagcattcttaacctgaaaagcaatttggttgcaaaatgacttactgtcttttttcctttcaagtccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggtgagtaccgattcctacaccttcgtggtagtcctgtcctcatggacactcagctgctctccagaagcaaccatcaatccaatctatgtcattctctgacttggtttataaaatctcttcgaggaatttaaatgcggaagctgcctctgcagccagctcagcttgtcacacactccaggcaagtgtatcacaaagtatacaagttggagacctgattttagattctcagggtgtgatggctccatcagtcattatcctgccctttcgctggtgaaaacgtcaacctagaggccaggcgtgatggctcatgcttgtaatcccagcactttgggaggcggaggcgggaggatcacttgaggccagcagttcgagaccagcctggccaacatggcaaaaccctgtctctactaaaaatacaaaaattagctgggcgtggtggtgggtgcatgtaatcccagctactccggaggctgaggcaggagaatcacctgaactgaggaggtggaggttgcagtgagtggagatgctccattgcactccagcctgagcaacaggagcgaaactttgtctcaaaaaaagaaagaaagaaagaaaatgttaactagaagctgctttgtctcatcccgtatttttgttaagcatcagcaccttgtgcaagttttttttttttcccttttttttgaggcggagtctcgctctgtcctacaggccagagtgcagtggtacaatcttggctcactgccatctccacctcccgggttcaagccattcttctgcctcagcctcccgagtagctgggactacaggcacgcaccaccacacccggctaatttttgtatttttagtagacagggtttcaccatattggccaggctggtctcaaactcctgacctcatgatccgcccaccttggcctcccaaagtgctgggattacaggtgtgagccaccatgcctgggcagtttttttttttttttagatagggtcttgctctgtcattccagctggagtgcagtggtgcaatcttggcttactgcaacctttgcctcctgggttcaagcgattctcctgcctcagcctccctagtacctgggattacaggcacccaccaccatgcccggctaatttttgtatttttagtagagataagagtttcaccatgttggccaggctagtctcaaactcctgacctcaggtgatctgcctgcctcagcctcccaaagttctgggccaccgcaccaaccaacacttttttttttttttttgagatggagtttcgctcttgttgctcaggttggagtgcaatgatgcagtctcggctcactgcaacctcctcctcctgagttcaagtgattctcctgcctcagcctcccgagtagctggaattacaggtgcccgccaccacgcccagctaatttgtattcttagtaaagacggggtttctccatgttggtcaggctggtctcgaactcccgacctcaggtgttgtgcccgcctcagcctcccaaagtgctgggattacagtcgtgagccatcgcgcccggccgccaacacttatttttaaaatcagtttagtagcttacgcctctgatcccagcatggggaacatcaattgtgtgtgtgtgttgtttgtttttttcacttttgttttctttgttatgtgtgtgttgtttttaaatcaccccctctgatgtggagctagagttgagagccacattgaagatgcaagcagccatgaatggttcacagatccctctctactatatcccttgcgtcaccgttcctaactttccttgatataacactgttgtctgccttagtataaccaccactaactagaccaggtttctcctttgaggcaggcttcctgcagctcctgcgtgaagtaggcctagtttaggtgtagccatcatttaatcctgcacaactgaaatgtttcttaatggaccaacagaaagtgtttgaattcatctgtgtgtttttctaaacattctgaaaacgcacatttttgtaaattaatgtcttaactcctttgtgtggttcacctttcaataattttactgatgtctgagaaattatattcatgatacatgaaaacatttgttcccttaagtcaagctgagccaaatggaaaaacgcaatttctacaaaacatattttaagaaaacggccagtcctccagagggcgctcacgtgctgttgctttcattgtggttcaggttcaagagcaaaccaaagagcccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcctgagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggccaacatggagaaacccctaaaaataggaacaattagccaggcatggtgacaggtgcctgtaatcccagctacttgggaggccgaggcatgagaatcacttgaacccgggaggcggaggttgcagtgagctgagatcgtgccactgcactccagcctgggcaccagagcgagactccgtctcaaagaaaacaacaaaaaaaaaaaaaaaagaaaaaggattttctccagcagcaaccagtgaaagatgaggcgaggcttgaatggagcccgtgggtcgtcctgccttagcgtctgagttcagcttgtgaagttagtgggccgcagagggcactgccttcattctgctaagacgaaaagggctggtgggatcttcgcaagagagtcagggactcacactcagcaaaaagcattagggccgattttaatgtgcgaccttgacctgcatctgtcatggaaagtgccttctaaaaagcttcagtggtggatgtgaccatctgaaggaaacaaatgtacaaggaagcactgtgtatcctaagccctgggttcccagagtttcacctgctgttcatcaggtctggccttcatatacccgtactgcgagggctgtttccaatgtaaataaataactgcgcaacagttccttcctcctttcctttgttcctccctccccccggcctttttttttggcagatgtacagtttgtttataatcactgcatatgtcttctgcacacagaaagtatgaagtctgaagttcccacttaaagttgaaaactcaacggccgggcatagtggctcacacctgtaatcccagcactttgggaggccaaggggggtgaatcacaaggtcaggagatccagaccatcctggccgacatggtgaagccctgtctctactaaaaatacaaaaattagctgggtgtggtggcacacacctgtaatcccaactactcaggagactgaggcacgagaatcgcttgaacccaggaggtggaggttgcaatgggccgagattgcaccactgcactccagcctggatgacagagtgagactccatctcaaaaaaaaaaaaaaaaaatttaaagttgaaaactcaacatgcatgaggcagaacaggctgtgtttgtatatgaaaggcccaacaatggaaggatacaagaaaatgatggcagcagctgcatctagtgagggaagcaggggctggggatcaaaaggtacaaattgcccattcaaaaaatagacacaggccaggcacagtggctcacacctgtagtcccagcactttgggaggctgaggtgggaggattgcttgagtccaggatttcgagatcagcctgggcaacatggcaagaccccatctctac

SEQ ID NO: 544 - DNA, 7381 bp, Homo sapiens
ggccagctggctatcagacaatgacatgctttgacaggcccctgagctctgtgagtaaattcttgaacagctgagagtgctaccattttgtcatagccctaagggtgcagatgatgctgaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactgggtaagtaaaatatttgaatattggtgtgggaatggagctttgcttaccttgggagaaaggaccagaaggaaagaaacatggactaattctggccctccaaagaagcagtattcaggtggaataagaagggtaggtataagaaagtttggtgtacaggattgaattactttctgaatataaaaatcttccatcctgaaagtcccctctgatcatgatatcctctctagctctaatctcaactcttttctttcacttgtgagacaagttttcttaaaagaatagtttgcacttgctatctccacttcctcacttctcacacgctcctcaatgcttgcagcctggcttccactggaattggttttgtctagggcacaacgatctctatattgactgggttatggcatgcttttcagttcatatcctgctggacttctctgctgcactgggctctgttgatcacttactccttcttgcattctctactaccctggcttccatggcaccattttctccttgtactacatggacttctcttgatcccttaatagcttctcttctcttccccttaaacactagtgttctctatagttatagccttgcctctgtactcctctttctttacacaatctccttcatgagcttatttgtctgtttaatttttgccactataactctgtatttaagagtcccaaatcatatccccaaccctaaccatgcttttgagcttcacattcaaatatcaagcttcataccagacatatctacctacatatctcacaagtgtctctgcaccatgtgactagagttgaacttatctgtccttttggcccctgcctcatctaattcattttccactttctgatctcagctaatgacaccagcatctacccttacaaggccataaacctcagaaacaacccagactcttccttctttttcattctctaaatctgatcaatcattaggtttggccaattttaccttctaaattgttcatagaagcagtcccttgcctggatcatcactaatgtcttaggacaagccctcatcctctatgacttgggctattccagtaaattcctaactaatctcctcgtccaaaccttgtgttcttgaaatgaattctgtaccctgcagacagagtaatttctaaaactcaagtttaccagcccaaattctttatcatggcacaaaaggccaagcagcctctacttttaccctctcagccttgtaacttatgctctaataaatctcaatcagttcatatttacatactcacacaccagactcttgcctgtctctaaggctttgcttataccactatctctacctgaaatgagttctttccatggcaccctactctccttctccttgcaaatgtgtaggtacccctaaagactcagcttaaatggtatcttttccaggtagcttttcttgaatgcttctttctgctccaatggctgcttgcgatacatttttcttattataatattttcctacttatgctgaaataatattttcatctacctgtgtcttccactaaattgagagctatttgtgggtagtgacaatgtttttttgtttttgtcttgtgataagaactgcagacttggaatcagatactcctgtttcaagcccctcttctatttaccagctctatgtcactttagaaaatcactttttctatttctggttcagttttctcatttgtagaatgaaaataataatacctaccacctaaggtttattgagtgagttcccagtaacccaacaagattttattttattttattttatgttttgagacagggtctcgctctgccacccaggctggagtgcagtggtgcaatcactgctcactgcaaccttgacctcttgggcttaagcaatcgtcctatctcagcctcccaagtagctgggaccacaggcaagtgccaccaggcctggccaattttttaaaaaattatttgttgagacagggtctctctatgttccccaggctggtctcaaactcctgggctcaagggatcctcccacctcaacctcccaaagtgctgtgattataagcatgagccaccacgcctggataagattttatttttaaaaagaaaaaatggagaggaggcagagcacagatgagtgacagtggaggaactgaaaagaggtagcattacagtgaagggagcggagaaaggatggaaagaaaacacctggtactgatgtgatgagaattaggaagtagggaggggtcttggtaagggacatgacaaaatcaaagaagaacgctgggctattgggagtggaagagaataaaggcaagtggggcacgaaatgacagtcagatggagtgaagaagtatgcacatgtgaatggccatgaggctggaggagggggagaatagttagggagataaagagcagtcccagagaagggagaaatgtcacttcccttgcctaggtctaccatgaaggtaagagataggttgaggagatgtggtgagaaatggataattctaaatttcaatctggagcaaagaattgttccacagttactaatatggactgggaggaggggaaaaaagacagagaaagctctgtgccactgccagggaaaattcaagtggcagaggacattaaagtaaagatggctgaaaagtgaagacctgcaagggggaggaagaaaggaggagagacactgctgggtactgaaagctctttgttagataacatattcaaggctgaggagccaagtgaagtttgggaaaatcagaatatgaaagaaagtccccgaggaaggtctgaggactgaagtagaccatatttgcacagtgaagtaaaaagaacattgattttggactcagacacacctgcctttcccgatccattgcttagtctctttttaagctttgggtatgttaatttggttttctaagtgtgtttctttaagattataaaatgaggataaagtcacctacctggaaagtttgtgaggatgaagttagatactgcacacaagtgctagcagggtctggcacccagtgaacattagaatctgatgtctccctttcattcctgtcctatgcctccctgcttcgagttaccattgtctttgctcctggtttcccgtaccagcagctggatgtcatgccggtgagtttcaccattctttcattctctcccctccctcttctccaaaccacagtgcatttgctgagagcacctggacgccagtgaatcaaggtcaaaactatccccctgagacactctcaggggtctttccgaaaaaaaaaaaggttttgatgtcttactagtctcattctaaaaaggatgattatcctgggagatggaggaaccctgtcctctttctccaagttgcatcatcattttctggttctccctgggccatgccctcttcagctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatggtgaggtcctgggaaggcctgagcagtgccccaaaccccttctttcagcctcagagcccacccaggaaagtgtccctaggaaattggctatgggatgaggtacttccttcccagtcttcagcccacagcaaccagggtgctctaagtcctaggccctagggaagttgtcccatactcccaaccaggggtgagagtttacctggaccctcagagaaagtttaggggagtaggcatgcttgggggtggcccccaagggaggccctgggtgacactcagctctttctctggaccatagactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaaggtgagagctagaagcagcattgtcatggcaggggagggtaaggagagacagggagcccaaattgtctttctttagcctggaggtagcaagatcatcaacagactatggagcaggttgctggcaaatgcccaagttgggcttcgaaagggacgagacctcagccttttgaagtcatccagccccactcagagtccagcatagttcctaccacccagatctatgcttcctagtgctcactgattgggtgtctggacaactatcagatttgcccatctgtggatctttcctagtcctgtctacttacagaaagaacttgacagattcaaatggaatctaagagagcccattcctgctggaaacaggggaaaggaagtatgactccccaagtctcttcacctgcatgtgtctacctgtatataagatggctgagctcttctttcctgcctatctttttcccagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgagttcgcatcagagtgcaggttgtctgtttggcatgcgtgtgagtgaaaaggagggataggataaattgacctgtgagctggggttcagtgtgagcaggttaagaagggacacagagggggcaggaacaatgggccagaatccctgatgatgagagacagcacaaatagagaacttctccctcagactgtggtgcacacctcaccagaccaagagctgagccagctccacacctgctgccccacaagccttagcatcccccccaacatgctctctgggcatttataggaatttaatatctggaatgaagatgggatagtctgaagtctatgttcaattctgggagccactgttaagaggctgcacttgacctgaaacactcccagaagaggtgtccagggtgataagggggcttaaagtcatgtcatatgaaaaataatggaaggggctggagatgctatcctgaagaggaggtgactcagaggccagcagaggtgtcctcaaaaagctgaaggctggcattagcacaaggaattggactaatgtcttatataataaagaggctgacctagaaccagttaccacattcatgcttcagggaattagattcagccttgatagagaaagaactggctaatagttatagctgtccagtggtgaagcctcactgctgaagaatttcaaacagaagtggccaagcttcagattaaaatttggaccaggagggacactagagtcctcaagtccctgctgccattgggccccacagccactttcagagaacaagaaagattggccagggatgggagggaagggccagagtcagacttcactcttgtatgtgcctcctgccccataattcaggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagcta
